US007560542B2

(12) United States Patent
Andersen et al.

(10) Patent No.: US 7,560,542 B2
(45) Date of Patent: Jul. 14, 2009

(54) NUCLEIC ACID MOLECULE SEQ ID NO. 68811 AND OTHER MOLECULES ASSOCIATED WITH PLANTS

(75) Inventors: Scott E. Andersen, St. Louis, MO (US); Timothy W. Conner, Wildwood, MO (US); Raghunath V. Lalgudi, Arlington, MA (US)

(73) Assignee: Monsanto Technology LLC, St. Louis, MO (US)

( * ) Notice: Subject to any disclaimer, the term of this patent is extended or adjusted under 35 U.S.C. 154(b) by 283 days.

(21) Appl. No.: 11/353,150

(22) Filed: Feb. 14, 2006

(65) Prior Publication Data

US 2008/0263730 A1    Oct. 23, 2008

Related U.S. Application Data

(63) Continuation of application No. 09/565,306, filed on May 4, 2000, now abandoned.

(60) Provisional application No. 60/132,860, filed on May 7, 1999.

(51) Int. Cl.
*A01H 5/00* (2006.01)
*C07H 21/04* (2006.01)
*C12N 15/05* (2006.01)
*C12N 15/82* (2006.01)

(52) U.S. Cl. .................. 536/23.6; 800/278; 800/295; 800/298; 800/300.1

(58) Field of Classification Search ............. 800/320.1, 800/300.1
See application file for complete search history.

(56) References Cited

U.S. PATENT DOCUMENTS

| | | | |
|---|---|---|---|
| 4,784,949 A | 11/1988 | Gelfand et al. | |
| 4,956,282 A | 9/1990 | Goodman et al. | |
| 5,011,912 A | 4/1991 | Hopp et al. | |
| 5,942,662 A * | 8/1999 | Ryals et al. | 800/300 |
| 6,093,545 A | 7/2000 | Goodearl et al. | |
| 2004/0152197 A1* | 8/2004 | Gelvin et al. | 435/468 |
| 2004/0172684 A1* | 9/2004 | Kovalic et al. | 800/284 |

FOREIGN PATENT DOCUMENTS

| | | | |
|---|---|---|---|
| EP | 1033405 A2 * | 9/2000 | |
| WO | WO 00/18922 | 4/2000 | |

OTHER PUBLICATIONS

Gencore Published Applications Result 1.*
Gencore Issued Patents Result 8.*
Geneseq Result 4.*
U.S. Appl. No. 09/815,254, filed Mar. 23, 2001, Boukharov et al.
U.S. Appl. No. 10/425,114, filed Mar. 28, 2003, Liu et al.
U.S. Appl. No. 11/329,175, filed Jan. 11, 2006, CaJacob et al.
U.S. Appl. No. 11/329,160, filed Jan. 11, 2006, Bhat et al.
U.S. Appl. No. 11/329,388, filed Jan. 11, 2006, Andersen et al.
U.S. Appl. No. 11/330,082, filed Jan. 12, 2006, Buehler et al.
U.S. Appl. No. 11/330,083, filed Jan. 12, 2006, Burym et al.
U.S. Appl. No. 11/330,364, filed Jan. 12, 2006, Abad et al.
U.S. Appl. No. 11/331,019, filed Jan. 13, 2006, Fincher et al.
U.S. Appl. No. 11/331,032, filed Jan. 13, 2006, Fincher et al.
U.S. Appl. No. 11/352,295, filed Feb. 15, 2006, Andersen et al.
U.S. Appl. No. 11/486,299, filed Jul. 14, 2006, Byrum.
U.S. Appl. No. 11/490,207, filed Jul. 21, 2006, Brown et al.
U.S. Appl. No. 11/491,125, filed Jul. 24, 2006, Boukharov et al.
U.S. Appl. No. 11/491,178, filed Jul. 24, 2006, Hinkle et al.
U.S. Appl. No. 11/491,371, filed Jul. 24, 2006, Byrum.
U.S. Appl. No. 11/497,489, filed Aug. 2, 2006, Byrum et al.
U.S. Appl. No. 11/503,243, filed Aug. 14, 2006, Kovalic et al.
U.S. Appl. No. 11/520,715, filed Sep. 14, 2006, Liu et al.
U.S. Appl. No. 11/521,349, filed Sep. 15, 2006, Byrum et al.
U.S. Appl. No. 11/595,983, filed Nov. 13, 2006, Boukharov et al.
AA501409, EST Database (Aug. 19, 1997).
Aach et al., "*ent*-Kaurene Biosynthesis in a Cell-Free System From Wheat (*Triticum aestivum* L.) Seedlings and the Localisation of *ent*-Kaurene Synthetase in Plastids of Three Species", *Planta* 197(2), 333-342 (1995).
Adams et al., "Complementary DNA Sequencing: Expressed Sequence Tags and Human Genome Project", *Science* 252(5013), 1651-1656 (1991).
Ait-Ali et al., "The *LS* Locus of Pea Encodes the Gibberellin Biosynthesis Enzyme *ent*-Kaurene Synthase A", *Plant J.* 11(3), 443-454 (1997).
Anaviev et al., "Oat-Maize Chromosome Addition Lines: A New System for Mapping the Maize Genome", *Proc. Natl. Acad. Sci. USA* 94, 3524-3529 (1997).
Anton et al., "Sequencing and Overexpression of the *Escherichia coli aroE* Gene Encoding Shikimate Dehydrogenase", *Biochem. J.* 249, 319-326 (1988).
Attwood, "The Babel of Bioinoformatics", *Science* 290(5491), 471-473 (2000).
Bensen et al., "Cloning and Characterization of the Maize An1 Gene", *Plant Cell* 7, 75-84.

(Continued)

*Primary Examiner*—Wendy C. Haas
(74) *Attorney, Agent, or Firm*—Lawrence M. Lavin, Jr.; Matthew L. Madsen; Arnold & Porter LLP

(57) ABSTRACT

Expressed Sequence Tags (ESTs) isolated from maize are disclosed. The ESTs provide a unique molecular tool for the targeting and isolation of novel genes for plant protection and improvement. The disclosed ESTs have utility in the development of new strategies for understanding critical plant developmental and metabolic pathways. The disclosed ESTs have particular utility in isolating genes and promoters, identifying and mapping the genes involved in developmental and metabolic pathways, and determining gene function. Sequence homology analyses using the ESTs provided in the present invention, will result in more efficient gene screening for desirable agronomic traits. An expanding database of these select pieces of the plant genomics puzzle will quickly expand the knowledge necessary for subsequent functional validation, a key limitation in current plant biotechnology efforts.

19 Claims, No Drawings

OTHER PUBLICATIONS

Bentley, "The Shikimate Pathway—A Metabolic Tree with Many Branches," *Critical Rev. Biochem. Mol. Biol.* 25(5), 307-384 (1990).
Birkenbihl et al., "Cosmid-Derived Map of *E.coli* Strain BHE2600 in Comparison to the Map of Strain W3110", *Nucleic Acids Res.* 17(13), 5057-5069 (1989).
Bishop et al., "The Tomato *Dwarf* Gene Isolated by Heterologous Transposon Tagging Encodes the First Member of a New Cytochrome P450 Family", *Plant Cell* 8, 959-969 (1996).
Bonner et al., "Cloning of cDNA Encoding the Bifunctional Dehydroquinase-Shikimate Dehydrogenease of Aromatic-Amino-Acid Biosynthesis in *Nicotiana tabacum*", *Biochem J.* 362, 11-14 (1994).
Bork, "Powers and Pitfalls in Sequence Analysis: The 70% Hurdle", *Genome Res.*, 10, 398-400 (2000).
Bougri et al., "Members of a Low-Copy Number Gene Family Encoding Glutamyl-tRNA Reductase are Differentially Expressed in Barley," *Plant J.* 9(6), 867-878 (1996).
Broun et al., "Catalytic Plasticity of Fatty Acid Modification Enzymes Underlying Chemical Diversity of Plant Lipids", *Science* 282, 1315-1317 (1998).
Bukanov et al., "Ordered Cosmid Library and High-Resolution Physical-Genetic Aap of *Helicobacter pylori* Strain NCTC11638", *Mol. Microbiol.* 11(3), 509-523 (1994).
Charles et al., "Isolation, Characterization and Nucleotide Sequences of the *aroC* Genes encoding Chorismate Synthase from *Salmonella typhi* and *Escherichia coli*", *J. Gen. Microbiol.* 136, 353-358 (1990).
Chen et al., "Microcolinearity in *sh2*-Homologous Regions of the Maize, Rice, and Sorghum Genomes", *Proc. Natl. Acad. Sci. USA* 94, 3431-3435 (1997).
Coulson et al., "Toward a Physical Map of the Genome of the Nematode *Caenorhabditis elegans*", *Proc. Natl. Acad. Sci. USA* 83, 7821-7825 (1986).
Day et al., "Cloning of the cDNA for Glutamyl-tRNA Synthetase from *Arabidopsis thaliana*", *Biochim. Biophys. Acta* 1399(2-3):219-224 (1998).
Duncan et al., "The Overexpression and Complete Amino Acid Sequence of *Escherichia coli* 3-Dehydroquinase", *Biochem. J.* 238, 475-483 (1986).
Eberhard et al., "Cloning and Expression in Yeast of a Higher Plant Chorismate Mutase", *FEBS Lett.* 334(2), 233-236 (1993).
Ebert et al., "Identification of an Essential Upstream Element in the Nopaline Synthase Promoter by Stable and Transient Assays", *Proc. Natl. Acad. Sci. USA* 84(16), 5745-5749 (1987).
Efstratiadis et al., "Enzymatic in Vitro Synthesis of Globin Genes", *Cell* 7, 279-288 (1976).
Eiglmeier et al., "Use of an Ordered Cosmid Library to Deduce the Genomic Organization of *Mycobacterium leprae*", *Mol. Microbiol.* 7(2), 197-206 (1993).
Evans et al., "Immunodetection of Recombinant Proteins Based on Antibodies Directed Against a Metal Binding Peptide Engineered for Purification by Immobilized Metal Affinity Chromatography," *J. Immunol. Meth.* 156(2), 231-238 (1992) (Abstract Only).
Entrez Accession No. M21071 J03227 (Sep. 15, 1989).
Entrez Accession No. 170374 (Sep. 15, 1989).
Entrez Accession No. M27715 (Jun. 15, 1990).
Entrez Accession No. 153878 (Jun. 15, 1990).
Entrez Accession No. X59509 S55160 (Jun. 30, 1993).
Entrez Accession No. 48906 (Jun. 30, 1993).
Entrez Accession No. Y00710 (Sep. 12, 1993).
Entrez Accession No. 40978 (Sep. 12, 1993).
Entrez Accession No. Z26519 (Dec. 2, 1993).
Entrez Accession No. 429153 (Dec. 2, 1993).
Entrez Accession No. 551666 (Jan. 25, 1995).
Entrez Accession No. X81413 (Jan. 25, 1995).
Entrez Accession No. M87280 M99707 (Apr. 12, 1995).
Entrez Accession No. 551855 (Apr. 12, 1995).
Entrez Accession No. 313150 (Jun. 13, 1995).
Entrez Accession No. X73535 (Jun. 13, 1995).
Entrez Accession No. X04306 (Jul. 12, 1995).
Entrez Accession No. 40973 (Jul. 12, 1995).
Entrez Accession No. D63474 D16312 (Jul. 27, 1995).
Entrez Accession No. 474964 (Jul. 27, 1995).
Entrez Accession No. 987267 (Jul. 31, 1995).
Entrez Accession No. U32579 (Sep. 16, 1995).
Entrez Accession No. X82831 (Mar. 1, 1996).
Entrez Accession No. 1213067 (Mar. 1, 1996).
Entrez Accession No. 1220402 (Mar. 5, 1996).
Entrez Accession No. M63245 (Mar. 11, 1996).
Entrez Accession No. W49458 (May 28, 1996).
Entrez Accession No. 1421741 (Oct. 17, 1996).
Entrez Accession No. U54770 (Oct. 18, 1996).
Entrez Accession No. X86101 (Nov. 8, 1996).
Entrez Accession No. 520943 (Feb. 26, 1997).
Entrez Accession No. 2160544 (Jun. 5, 1997).
Entrez Accession No. U63652 (Jun. 6, 1997).
Entrez Accession No. 2257714 (Jul. 15, 1997).
Entrez Accession No. U93215 (Jul. 15, 1997).
Entrez Accession No. 2224890 (Jul. 31, 1997).
Entrez Accession No. 2224892 (Jul. 31, 1997).
Entrez Accession No. U61385 (Aug. 1, 1997).
Entrez Accession No. U61386 (Aug. 1, 1997).
Entrez Accession No. 2316104 (Aug. 8, 1997).
Entrez Accession No. AF010169 (Aug. 9, 1997).
Entrez Accession No. 1524045 (Aug. 20, 1997).
Entrez Accession No. X96943 (Aug. 20, 1997).
Entrez Accession No. Y12809 (Dec. 2, 1997).
Entrez Accession No. D88382 (Mar. 17, 1998).
Entrez Accession No. 3068709 (Apr. 2, 1998).
Entrez Accession No. AF058763 (Aug. 16, 1998).
Entrez Accession No. 3420233 (Apr. 20, 1998).
Entrez Accession No. AF049236 (Apr. 22, 1998).
Entrez Accession No. AF038152 (May 7, 1998).
Entrez Accession No. 2708690 (May 7, 1998).
Entrez Accession No. AC003058 (May 16, 1998).
Entrez Accession No. 3135277 (May 16, 1998).
Entrez Accession No. 3288821 (Jul. 20, 1998).
Entrez Accession No. AF063901 (Jul. 21, 1998).
Entrez Accession No. 3435196 (Sep. 21, 1998).
Entrez Accession No. AF067773 (Sep. 22, 1998).
Entrez Accession No. 3694811 (Sep. 24, 1998).
Entrez Accession No. AJ225107 (Oct. 1, 1998).
Entrez Accession No. 3093410 (Oct. 1, 1998).
Entrez Accession No. AF060481 (Oct. 4, 1998).
Entrez Accession No. 3925407 (Nov. 24, 1998).
Entrez Accession No. AF083948 (Nov. 25, 1998).
Entrez Accession No. AB015492 (Dec. 11, 1998).
Entrez Accession No. 4001680 (Dec. 11, 1998).
Entrez Accession No. AF017431 (Jan. 2, 1999).
Entrez Accession No. 3080490 (Jan. 12, 1999).
Entrez Accession No. AL022602 (Jan. 12, 1999).
Entrez Accession No. AB011416 (Feb. 5, 1999).
Entrez Accession No. AAC17095 GI:315616 (Apr. 5, 1999).
Entrez Accession No. AP000836; GI:6539551 (Aug. 12, 2000).
Entrez Accession No. AY013245 (May 7, 2002).
Fiedler et al., "The Formation of Homogentisate in the Biosynthesis of Tocopherol and Plastoquinone in Spinach Chloroplasts", *Planta* 155, 511-515 (1982).
Garbe et al., "The *Mycobacterium tuberculosis* Shikimate Pathway Genes: Evolutionary Relationship Between Biosynthetic and Catabolic 3-Dehydroquinases", *Mol. Gen. Genet.* 228, 385-392 (1991).
Gasser et al., "Structure, Expression, and Evolution of the 5-Enolpyruvylshikimate-3-Phosphate Synthase Genes of Petunia and Tomato", *J. Biol. Chem.* 263, 4280-4289 (1988).
Gaubier et al., "A Chlorophyll Synthetase Gene from *Arabidopsis thaliana*", *Mol. Gen. Genet.* 249, 58-64 (1995).
GenBank Accession No. U03774 (Jun. 22, 1994).
GenBank Accession No. L37750 (Aug. 3, 1995).
GenBank Accession No. H30177 (Aug. 16, 1995).
GenBank Accession No. W21756 (May 6, 1996).
GenBank Accession No. X80265 (Feb. 26, 1997).
GenBank Accession No. E03435 (Sep. 29, 1997).
GenBank Accession No. AF015462 (Jul. 16, 1998).
Genbank Accession No. AC005922 (Nov. 14, 1998).
GenBank Accession No. X74737 (Jan. 21, 1999).

GenBank Accession No. AU033328 (Apr. 28, 1999).
GenBank Accession No. AQ402486 (Mar. 13, 1999).
GenBank Accession No. AI861202 (Jul. 19, 1999).
GenBank Accession No. AC018632 (Dec. 15, 1999).
GenBank Accession No. AI834598 (Feb. 2, 2000).
GenBank Accession No. AZ134591 (Jun. 2, 2000).
GenBank Accession No. BE428765 (Jul. 26, 2000).
GenBank Accession No. BF542512 (Dec. 11, 2000).
GenBank Accession No. AW871780 (Dec. 11, 2001).
GenBank Accession No. BQ603510 (Jun. 24, 2002).
GenBank Accession No. DR37H4T (Nov. 22, 2002).
GenBank Accession No. BX513761 (May 27, 2003).
GenEMBL Accession No. AF096555 (Jul. 22, 1999).
GenEMBL Accession No. AL096768 (Dec. 12, 1999).
GenSeq Accession No. AAZ35275 (Mar. 27, 2000).
Gerhold et al., "It's the genes! EST access to human genome content", *BioEssays* 18(2), 973-981 (1996).
Gibson et al., "The Bacteriochlorophyll Biosynthesis Gene, *bchM*, of *Rhodobacter sphaeroides* Encodes S-Adenosyl-l-Methionine: Mg Protoporphyrin IX Methyltransferase", *FEBS Lett.* 352, 127-130 (1994).
Goers et al., "The Differential Allosteric Regulation of Two Chorismate-Mutase Isoenzymes of *Nicotiana silvestris*", *Planta* 162, 117-124 (1984).
Goff, "Rice as a Model for Cereal Genomics", *Curr. Opin. Plant Biol.* 2, 86-89 (1999).
Hedden et al., "Gibberellin Biosynthesis: Enzymes, Genes and Their Regulation", *Annu. Rev. Plant Physiol. Plant Mol. Biol.* 48, 431-460 (1997).
Herrmann, "The Shikimate Pathway as an Entry to Aromatic Secondary Metabolism," *Plant Physiol.* 107, 7-12 (1995).
Hong, "A Rapid and Accurate Strategy for Rice Contig Map Construction by Combination of Fingerprinting and Hybridization", *Plant Mol. Biol.* 35,129-133 (1997).
Hundle et al., "Functional Assignment of *Erwinia herbicola* Eho10 Carotenoid Genes Expressed in *Escherichia coli*", *Mol. Gen. Genet.* 245, 406-416 (1994).
Ibba, "Biochemistry and Bioinformatics: When Worlds Collide," *Trends in Biochem. Sci.* 27(2), 64 (2000).
Iyer et al., "*Quod erat demonstrandum*? The Mystery of Experimental Validation of Apparently Erroneous Computational Analysis of Protein Aequences", *Genome Biol.* 2(12), 1-11 (2001).
Johnston et al., "Cloning and Characterization of Potato cDNAs Involved in Tetrapyrrole Biosynthesis: Ferrochelatase (Accession No. AJ005802), Chloroplatic Protoporphyrinogen IX Oxidase (Accession No. AJ225107), and Mitochondrial Protoporphyrinogen IX Oxidase (Accession No. AJ225108)", *Plant Physiol.* 118, 329-331 (1998).
Keon et al., "Isolation and Heterologous Expression of a Gene Encoding 4-Hydroxyphenylpyruvate Dioxygenase from the Wheat Leaf-Spot Pathogen, *Mycosphaerella graminicola*", *FEMS Microbiol. Lett.* 161, 337-343 (1998).
Kidwell et al., "Transposable Elements as Sources of Variation in Animals and Plants", *Proc. Natl. Acad. Sci. USA* 94, 7704-7711 (1997).
Kim et al., "Construction and Characterization of a Human Bacterial Artificial Chromosome Library", *Genomics* 34, 213-218 (1996).
Knott et al., "Randomly Picked Cosmid Clones Overlap the *pyr*B and *ori*C gap in the Physical Map of the *E.coli* Chromosome", *Nucleic Acids Res.* 16, 2601-2612 (1988).
Ko et al, "An 'Equalized cDNA' Library by the Reassociation of Short Double-Stranded cDNA", *Nucleic Acids Res.* 18(19), 5705-5711 (1990).
Kyrpides et al., "Whole-Genome Sequence Annotation: Going Wrong With Confidence", *Mol. Microbiol.* 32, 886-887 (1999).
Kurata et al., "A 300 Kilobase Interval Genetic Map of Rice Including 883 Expressed Sequences," *Nature Gen.* 8(4), 362-372 (1994).
Lange et al., "Cloning and Expression of a Gibberellin 2β,3β-Hydroxylase cDNA from Pumpkin Endosperm," *Plant Cell* 9(8), 1459-1467 (1997).

Lange "Cloning Gibberellin Dioxygenase Genes from Pumpkin Endosperm by Heterologous Expression of Enzyme Activities in *Escherichia coli*", *Proc. Natl. Acad. Sci. USA* 94(12), 6553-6558 (1997).
Lange et al., "Expression Cloning of a Gibberellin 20-Oxidase, a Multifunctional Enzyme Involved in Gibberellin Biosynthesis", *Proc. Natl. Acad. Sci. USA* 91(18), 8552-8556 (1994).
Liepman et al., "Sequence Analysis of a cDNA Encoding Alanine:Glyoxylate Amino Transferase from *Arabidopsis* (Accession No. AF063901)", *Plant Physiol.* 117, 1125-1127 (1998).
Lim et al., "Porphobilinogen Deaminase is Encoded by a Single Gene in *Arabidopsis thaliana* and Is Targeted to the Chloroplasts," *Plant Mol. Biol.* 26, 863-872 (1994).
Mahairas et al., "Sequence-Tagged Connectors: A Sequence Approach to Mapping and Scanning the Human Genome", *Proc. Natl. Acad. Sci. USA* 96, 9739-9744 (1999).
Martin et al., "MYB Transcription Factors in Plants", *Trends Genet.* 13(2), 67-73 (1997).
Martin et al., "Mendel's Dwarfing Gene: cDNAs from the *Le* Alleles and Function of the Expressed Proteins", *Proc. Natl. Acad. Sci. USA*, 94(16):8907-8911 (1997).
McCombie et al., "*Caenorhabditis elegans* Expressed Sequence Tags Identify Gene Families and Disease Gene Homologues," *Nature Gen.* 1, 124-131 (1992).
Meinkoth et al., "Hybridization of Nucleic Acids Immobilized on Solid Supports", *Anal. Biochem.* 138, 267-284 (1984).
Mende et al., "The Geranylgeranyl Diphosphate Synthase Gene of *Gibberella fujikuroi*: Isolation and Expression", *Mol. Gen. Genet.* 255(1), 96-105 (1997).
Mohan et al., "Genome Mapping, Molecular Markers and Marker-Assisted Selection Crop Plants", *Mol. Breed.* 3, 87-103 (1997).
Nakane et al., "Nucleotide Sequence of the Shikimate Kinase Gene (*aroL*) of *Bacillus subtilis*", *J. Ferment. Bioeng.* 77, 312-314 (1994).
Nakayashiki et al., "Nucleotide Sequence of a cDNA Clone Encoding Glutamyl-tRNA Reductase from Rice (Accession No. AB011416)", *Plant Physiol.* 117, 332 (1998).
NCBI Accession No. S42508 (May 8, 1993).
NCBI Accession No. D23883 (Nov. 29, 1993).
NCBI Accession No. AAA34069, corresponding to gi:535771 (Sep. 11, 1994).
Norris et al., "Complementation of the Arabidopsis *pds 1* Mutation with the Gene Encoding *p*-Hydroxyphenylpuruvate Dioxygenase", *Plant Physiol.* 117, 1317-1323 (1998).
Oka et al., "Replication Origin of the *Escherichia coli* K-12 Chromosome: The Size and Structure of the Minimum DNA Segment Carrying the Information for Autonomous Replication", *Mol. Gen. Genet.* 178(1), 9-20 (1980).
Okubo et al., "Large Scale cDNA Sequencing for Analysis of Quantitative and Qualitative Aspects of Gene Expression", *Nature Gen.* 2, 173-179 (1992).
Phillips et al., "Isolation and Expression of Three Gibberellin 20-Oxidase cDNA Clones from *Arabidopsis*", *Plant Physiol.* 108(3), 1049-1057 (1995).
Porra, "Recent Progress in Porphyrin and Chlorophyll Biosynthesis", *Photochem. Photobiol.* 65(3), 492-516 (1997).
Russell et al., "Structural Features can be Unconserved in Proteins with Similar Folds. An Analysis of Side-Chain to Side-Chain Contacts Secondary Structure and Accessibility", *J. Mol. Biol.* 244, 322-350 (1994).
Sakamoto et al., "An Overview of Gibberellin Metabolism Enzyme Genes and Their Related Mutants in Rice", *Plant Physiol.* 134, 1642-1653 (2004).
Schmitz et al., "The Tomato *Blind* Gene Encodes a MYB Transcription Factor that Controls the Formation of Lateral Meristems", *Proc. Nat. Acad. Sci.* 99(2), 1064-1069 (2002).
Schünmann et al., "Identification of Three cDNA Clones Expressed in the Leaf Extension Zone and with Altered Patterns of Expression in the *Slender* Mutant of Barley: A Tonoplast Intrinsic Protein, a Putative Structural Protein and Protochlorophylide Oxidoreductase," *Plant Mol. Biol.* 31, 529-537 (1996).
Seffernick et al., "Melamine Deaminase and Atrazine Chlorohydrolase: 98 Percent Identical but Functionally Different", *J. Bacteriol.* 183(8), 2405-2410 (2001).

SIGMA Chemical Catalogue (Sigma Chemical Co.; P.O. Box 14508, St. Louis MO 63178) 1993, product Nos. 01256, 03628, 04375, pp. 736-737.

Smith et al., "Partial Purification and Characterization of the Gibberellin $A_{20}$ 3β-Hydroxylase from Seeds of *Phaseolus vulgaris*", *Plant Physiol.* 94:1390-1401 (1990).

Smith et al., "The First Step of Gibberellin Biosynthesis in Pumpkin is Catalyzed by at Least Two Copalyl Diphosphate Synthases Encoded by Differentially Regulated Genes", *Plant Physiol.* 118, 1411-1419 (1998).

Stammers et al., "Rapid Purification and Characterization of HIV-1 Reverse Transcriptase and RNaseH Engineered to Incorporate a C-terminal Tripeptide α-Tubulin Epitope", *FEBS Lett.* 283(2), 298-302 (1991).

Tanaka et al., "The Third Member of the *hemA* gene Family Encoding Glutamyl-tRNA Reductase is Primarily Expressed in Roots in *Hordeum vulgare*", *Photosynthesis Res.* 53, 161-171 (1997).

Tanksley et al., "Chromosome landing: a paradigm for map-based gene cloning in plants with large genomes", *Trends in Genet.* 11(2), 63-68 (1995).

Tikhonov et al., "Colinearity and its Exceptions in Orthologous *adh* Regions of Maize and Sorghum", *Proc. Natl. Acad. Sci. USA* 96, 7409-7414 (1999).

van de Loo et al., "An Oleate 12-Hydroxylase from *Ricirus communis L.* is a Fatty Acyl Desaturase Homolog", *Proc. Nat. Acad. Sci.* 92, 6743-6747 (1995).

Venter et al., "A New Strategy for Genome Sequencing", *Nature* 381, 364-366 (1996).

Venter et al., "The Sequence of the Human Genome" *Science* 291, 1304-1351 (2001).

Wang et al., "Construction of a Rice Bacterial Artificial Chromosome Library and Identification of Clones Linked to the Xa-21 Disease Resistance Locus", *Plant J.* 7(3), 525-533 (1995).

Wells et al., "The Chemokine Information Source: Identification and Characterization of Novel Chemokines Using the WorldWideWeb and Expressed Sequence Tag Databases", *J Leukocyte Biol.* 61(5), 545-550 (1997).

Wendel et al., "New Isozyme Systems for Maize (*Zea mays* L.): Aconitate Hydratase, Adenylate Kinase, NADH Dehydrogenase, and Shikimate Dehydrogenase", *Biochem. Genet.* 26(5-6), 421-446 (1988) (Abstract Only).

Wenzel et al., "Physical mapping of the *Mycoplasma pneumoniae* genome", *Nucleic Acids Res.* 16(17), 8323-8336 (1988).

Winkler et al., "The Maize *Dwarf3* Gene Encodes a Cytochrome P450-Mediated Early Step in Gibberellin Biosynthesis", *Plant Cell* 7(8), 1307-1317 (1995).

Woese et al., "Conservation of Primary Structure in 16S Ribosomal RNA", *Nature* 254, 83-85 (1975).

Written Description Training Material, Example 7, pp. 30-32.

Yomo et al., "Histochemical Studies on Protease Formation in the Cotyledons of Germinating Bean Seeds," *Planta* 112(1), 35-43 (1973).

Zhang et al., "Physical Mapping of the Rice Genome with BACs", *Plant Mol. Biol.* 35, 115-127 (1997).

Zhang et al., "Construction and Characterization of Two Rice Bacterial Artificial Chromosome Libraries from the Parents of a Permanent Recombinant Inbred Mapping Population", *Mol. Breeding* 2, 11-24 (1996).

Zwick et al., "Physical Mapping of the *liguleless* Linkage Group in *Sorghum bicolor* Using Rice RFLP-Selected Sorghum BACs", *Genetics* 248, 1983-1992 (1998).

BlastP Search of Non-redundant Protein Sequences database performed Nov. 7, 2008, showing 50 hits (12 pages), herewith.

BlastX Search of SwissProt database performed Nov. 7, 2008, showing 50 hits (13 pages), herewith.

Huh et al., "Differential expression of the two types of histone H2A genes in wheat", *Biochimica et Biophysica Acta*, 1261:155-160 (1995), herewith.

Huh et al., "Structural characteristics of two wheat histone H2A genes encoding distinct types of variants and functional differences in their promoter activity", *Plant Molecular Biology*, 33:791-802 (1997), herewith.

\* cited by examiner

NUCLEIC ACID MOLECULE SEQ ID NO. 68811 AND OTHER MOLECULES ASSOCIATED WITH PLANTS

CROSS-REFERENCE TO RELATED APPLICATIONS

This application is a continuation of U.S. application Ser. No. 09/565,306 filed May 4, 2000 now abandoned, which claims the benefit of U.S. Provisional Application Ser. No. 60/132,860 filed May 7, 1999, each of which is herein incorporated by reference in its entirety, U.S. application Ser. No. 09/565,306 filed May 4, 2000, also claims the benefit of U.S. Provisional Application Ser. No. 60/101,508 filed Sep. 22, 1998.

INCORPORATION OF SEQUENCE LISTING

This application contains a sequence listing, which is contained on three identical CD-ROMs: two copies of a sequence listing (Copy 1 and Copy 2) and a sequence listing Computer Readable Form (CRF), all of which are herein incorporated by reference. All three CD-ROMs each contain one file called "15459C seq list.txt" which is 53,538,816 bytes in size (measured in Windows XP) and which was created on Feb. 14, 2006.

FIELD OF THE INVENTION

The present invention is in the field of plant biochemistry. More specifically the invention relates to nucleic acid molecules that encode proteins and fragments of proteins produced in plant cells, in particular, maize plants. The invention also relates to proteins and fragments of proteins so encoded and antibodies capable of binding the proteins. The invention also relates to methods of using the nucleic acid molecules, proteins and fragments of proteins.

BACKGROUND OF THE INVENTION

I. Expressed Sequence TAG Nucleic Acid Molecules

Expressed sequence tags, or ESTs, are short sequences of randomly selected clones from a cDNA (or complementary DNA) library which are representative of the cDNA inserts of these randomly selected clones. McCombie, et al., *Nature Genetics,* 1:124-130 (1992); Kurata, et al., *Nature Genetics,* 8: 365-372 (1994); Okubo, et al., *Nature Genetics,* 2: 173-179 (1992), all of which references are incorporated herein in their entirety.

Using conventional methodologies, cDNA libraries can be constructed from the mRNA (messenger RNA) of a given tissue or organism using poly dT primers and reverse transcriptase (Efstratiadis, et al., *Cell* 7:279-288 (1976), the entirety of which is herein incorporated by reference; Higuchi, et al., *Proc. Natl. Acad. Sci.* (U.S.A.) 73:3146-3150 (1976), the entirety of which is herein incorporated by reference; Maniatis, et al., *Cell* 8:163 (1976) the entirety of which is herein incorporated by reference; Land, et al., *Nucleic Acids Res.* 9:2251-2266 (1981), the entirety of which is herein incorporated by reference; Okayama, et al., *Mol. Cell. Biol.* 2:161-170 (1982), the entirety of which is herein incorporated by reference; Gubler, et al., Gene 25:263 (1983), the entirety of which is herein incorporated by reference).

Several methods may be employed to obtain full-length cDNA constructs. For example, terminal transferase can be used to add homopolymeric tails of dC residues to the free 3' hydroxyl groups (Land, et al., *Nucleic Acids Res.* 9:2251-2266 (1981), the entirety of which is herein incorporated by reference). This tail can then be hybridized by a poly dG oligo which can act as a primer for the synthesis of full length second strand cDNA. Okayama and Berg, report a method for obtaining full length cDNA constructs. This method has been simplified by using synthetic primer-adapters that have both homopolymeric tails for priming the synthesis of the first and second strands and restriction sites for cloning into plasmids (Coleclough, et al., *Gene* 34:305-314 (1985), the entirety of which is herein incorporated by reference) and bacteriophage vectors (Krawinkel, et al., *Nucleic Acids Res.* 14:1913 (1986), the entirety of which is herein incorporated by reference; and Han, et al., *Nucleic Acids Res.* 15:6304 (1987), the entirety of which is herein incorporated by reference).

These strategies have been coupled with additional strategies for isolating rare mRNA populations. For example, a typical mammalian cell contains between 10,000 and 30,000 different mRNA sequences. Davidson, *Gene Activity in Early Development,* 2nd ed., Academic Press, New York (1976). The number of clones required to achieve a given probability that a low-abundance mRNA will be present in a cDNA library is $N=(\ln(1-P))/(\ln(1-1/n))$ where N is the number of clones required, P is the probability desired, and 1/n is the fractional proportion of the total mRNA that is represented by a single rare mRNA. (Sambrook, et al., *Molecular Cloning: A Laboratory Manual,* 2nd ed., Cold Spring Harbor Laboratory Press (1989), the entirety of which is herein incorporated by reference.).

A method to enrich preparations of mRNA for sequences of interest is to fractionate by size. One such method is to fractionate by electrophoresis through an agarose gel (Pennica, et al., *Nature* 301:214-221 (1983), the entirety of which is herein incorporated by reference). Another such method employs sucrose gradient centrifugation in the presence of an agent, such as methylmercuric hydroxide, that denatures secondary structure in RNA (Schweinfest, et al., *Proc. Natl. Acad. Sci.* (U.S.A.) 79:4997-5000 (1982), the entirety of which is herein incorporated by reference).

A frequently adopted method is to construct equalized or normalized cDNA libraries (Ko, *Nucleic Acids Res.* 18:5705-5711 (1990), the entirety of which is herein incorporated by reference; Patanjali, S. R. et al., *Proc. Natl. Acad. Sci.* (U.S.A.) 88:1943-1947 (1991), the entirety of which is herein incorporated by reference). Typically, the cDNA population is normalized by subtractive hybridization. Schmid, et al., *J. Neurochem.* 48:307-312 (1987) the entirety of which is herein incorporated by reference; Fargnoli, et al., *Anal. Biochem.* 187:364-373 (1990) the entirety of which is herein incorporated by reference; Travis, et al., *Proc. Natl. Acad. Sci.* (U.S.A.) 85:1696-1700 (1988) the entirety of which is herein incorporated by reference; Kato, *Eur. J. Neurosci.* 2:704 (1990); and Schweinfest, et al., *Genet. Anal. Tech. Appl.* 7:64 (1990), the entirety of which is herein incorporated by reference). Subtraction represents another method for reducing the population of certain sequences in the cDNA library. Swaroop, et al., *Nucleic Acids Res.* 19:1954 (1991), the entirety of which is herein incorporated by reference).

ESTs can be sequenced by a number of methods. Two basic methods may be used for DNA sequencing, the chain termination method of Sanger et al., *Proc. Natl. Acad. Sci.* (U.S.A.) 74: 5463-5467 (1977), the entirety of which is herein incorporated by reference and the chemical degradation method of Maxam and Gilbert, *Proc. Nat. Acad. Sci.* (U.S.A.) 74: 560-564 (1977), the entirety of which is herein incorporated by reference. Automation and advances in technology such as the replacement of radioisotopes with fluorescence-based sequencing have reduced the effort required to sequence DNA (Craxton, *Methods*, 2: 20-26 (1991), the entirety of which is herein incorporated by reference; Ju et al., *Proc. Natl. Acad. Sci.* (U.S.A.) 92: 4347-4351 (1995), the entirety of which is herein incorporated by reference; Tabor and Richardson, *Proc. Natl. Acad. Sci.* (U.S.A.) 92: 6339-6343 (1995), the entirety of which is herein incorporated by reference). Automated sequencers are available from, for example, Pharmacia Biotech, Inc., Piscataway, N.J. (Pharmacia ALF), LI-COR, Inc., Lincoln, Nebr. (LI-COR 4,000) and Millipore, Bedford, Mass. (Millipore BaseStation).

In addition, advances in capillary gel electrophoresis have also reduced the effort required to sequence DNA and such advances provide a rapid high resolution approach for sequencing DNA samples (Swerdlow and Gesteland, *Nucleic Acids Res.* 18:1415-1419 (1990); Smith, *Nature* 349:812-813 (1991); Luckey et al., *Methods Enzymol.* 218:154-172 (1993); Lu et al., *J. Chromatog. A.* 680:497-501 (1994); Carson et al., *Anal. Chem.* 65:3219-3226 (1993); Huang et al., *Anal. Chem.* 64:2149-2154 (1992); Kheterpal et al., *Electrophoresis* 17:1852-1859 (1996); Quesada and Zhang, *Electrophoresis* 17:1841-1851 (1996); Baba, *Yakugaku Zasshi* 117: 265-281 (1997), all of which are herein incorporated by reference in their entirety).

ESTs longer than 150 bases have been found to be useful for similarity searches and mapping. (Adams, et al., *Science* 252:1651-1656 (1991), herein incorporated by reference.) EST sequences normally range from 150-450 bases. This is the length of sequence information that is routinely and reliably generated using single run sequence data. Typically, only single run sequence data is obtained from the cDNA library, Adams, et al., *Science* 252:1651-1656 (1991). Automated single run sequencing typically results in an approximately 2-3% error or base ambiguity rate. (Boguski, et al., *Nature Genetics*, 4:332-333 (1993), the entirety of which is herein incorporated by reference).

EST databases have been constructed or partially constructed from, for example, *C. elegans* (McCombrie, et al., *Nature Genetics* 1:124-131 (1992), human liver cell line HepG2 (Okubo, et al. *Nature Genetics* 2:173-179 (1992)), human brain RNA (Adams, et al., *Science* 252:1651-1656 (1991); Adams, et al., *Nature* 355:632-635 (1992)), *Arabidopsis*, (Newman, et al., *Plant Physiol.* 106:1241-1255 (1994)); and rice (Kurata, et al., *Nature Genetics* 8:365-372 (1994).

II. Sequence Comparisons

A characteristic feature of a protein or DNA sequence is that it can be compared with other known protein or DNA sequences. Sequence comparisons can be undertaken by determining the similarity of the test or query sequence with sequences in publicly available or propriety databases ("similarity analysis") or by searching for certain motifs ("intrinsic sequence analysis")(e.g. cis elements)(Coulson, *Trends in Biotechnology*, 12: 76-80 (1994), the entirety of which is herein incorporated by reference; Birren, et al., *Genome Analysis*, 1: 543-559 (1997), the entirety of which is herein incorporated by reference).

Similarity analysis includes database search and alignment. Examples of public databases include the DNA Database of Japan (DDBJ) (available on the world wide web at ddbj.nig.ac.jp/); Genebank (available on the world wide web at ncbi.nlm.nih.gov/web/Genbank/Index.htlm); and the European Molecular Biology Laboratory Nucleic Acid Sequence Database (EMBL) (available on the world wide web at ebi.ac.uk/ebi_docs/embl_db.html). A number of different search algorithms have been developed, one example of which are the suite of programs referred to as BLAST programs. There are five implementations of BLAST, three designed for nucleotide sequences queries (BLASTN, BLASTX, and TBLASTX) and two designed for protein sequence queries (BLASTP and TBLASTN) (Coulson, *Trends in Biotechnology*, 12: 76-80 (1994); Birren, et al., *Genome Analysis*, 1: 543-559 (1997)).

BLASTN takes a nucleotide sequence (the query sequence) and its reverse complement and searches them against a nucleotide sequence database. BLASTN was designed for speed, not maximum sensitivity, and may not find distantly related coding sequences. BLASTX takes a nucleotide sequence, translates it in three forward reading frames and three reverse complement reading frames, and then compares the six translations against a protein sequence database. BLASTX is useful for sensitive analysis of preliminary (single-pass) sequence data and is tolerant of sequencing errors (Gish and States, *Nature Genetics*, 3: 266-272 (1993), the entirety of which is herein incorporated by reference). BLASTN and BLASTX may be used in concert for analyzing EST data (Coulson, *Trends in Biotechnology*, 12: 76-80 (1994); Birren, et al., *Genome Analysis*, 1: 543-559 (1997).

Given a coding nucleotide sequence and the protein it encodes, it is often preferable to use the protein as the query sequence to search a database because of the greatly increased sensitivity to detect more subtle relationships. This is due to the larger alphabet of proteins (20 amino acids) compared with the alphabet of nucleic acid sequences (4 bases), where it is far easier to obtain a match by chance. In addition, with nucleotide alignments, only a match (positive score) or a mismatch (negative score) is obtained, but with proteins, the presence of conservative amino acid substitutions can be taken into account. Here, a mismatch may yield a positive score if the non-identical residue has physical/chemical properties similar to the one it replaced. Various scoring matrices are used to supply the substitution scores of all possible amino acid pairs. A general purpose scoring system is the BLOSUM62 matrix (Henikoff and Henikoff, *Proteins*, 17: 49-61 (1993), the entirety of which is herein incorporated by reference), which is currently the default choice for BLAST programs. BLOSUM62 is tailored for alignments of moderately diverged sequences and thus may not yield the best results under all conditions. Altschul, *J. Mol. Biol.* 36: 290-300 (1993), the entirety of which is herein incorporated by reference, uses a combination of three matrices to cover all contingencies. This may improve sensitivity, but at the expense of slower searches. In practice, a single BLOSUM62 matrix is often used but others (PAM40 and PAM250) may be attempted when additional analysis is necessary. Low PAM matrices are directed at detecting very strong but localized sequence similarities, whereas high PAM matrices are directed at detecting long but weak alignments between very distantly related sequences.

Homologues in other organisms are available that can be used for comparative sequence analysis. Multiple alignments are performed to study similarities and differences in a group of related sequences. CLUSTAL W is a multiple sequence alignment package available that performs progressive multiple sequence alignments based on the method of Feng and Doolittle, *J. Mol. Evol.* 25: 351-360 (1987), the entirety of which is herein incorporated by reference. Each pair of sequences is aligned and the distance between each pair is calculated; from this distance matrix, a guide tree is calculated, and all of the sequences are progressively aligned based on this tree. A feature of the program is its sensitivity to the effect of gaps on the alignment; gap penalties are varied to encourage the insertion of gaps in probable loop regions instead of in the middle of structured regions. Users can specify gap penalties, choose between a number of scoring matrices, or supply their own scoring matrix for both the pairwise alignments and the multiple alignments. CLUSTAL W for UNIX and VMS systems is available by ftp at: ebi-.ac.uk. Another program is MACAW (Schuler et al., *Proteins, Struct. Func. Genet,* 9:180-190 (1991), the entirety of which is herein incorporated by reference, for which both Macintosh and Microsoft Windows versions are available. MACAW uses a graphical interface, provides a choice of several alignment algorithms, and is available by anonymous ftp at: ncbi.nlm.nih.gov (directory/pub/macaw).

Sequence motifs are derived from multiple alignments and can be used to examine individual sequences or an entire database for subtle patterns. With motifs, it is sometimes possible to detect distant relationships that may not be demonstrable based on comparisons of primary sequences alone. Currently, the largest collection of sequence motifs in the world is PROSITE (Bairoch and Bucher, *Nucleic Acid Research,* 22: 3583-3589 (1994), the entirety of which is herein incorporated by reference.) PROSITE may be accessed via either the ExPASy server on the World Wide Web or anonymous ftp site. Many commercial sequence analysis packages also provide search programs that use PROSITE data.

A resource for searching protein motifs is the BLOCKS E-mail server developed by S. Henikoff, *Trends Biochem Sci.,* 18:267-268 (1993), the entirety of which is herein incorporated by reference; Henikoff and Henikoff, *Nucleic Acid Research,* 19:6565-6572 (1991), the entirety of which is herein incorporated by reference; Henikoff and Henikoff, *Proteins,* 17: 49-61 (1993). BLOCKS searches a protein or nucleotide sequence against a database of protein motifs or "blocks." Blocks are defined as short, ungapped multiple alignments that represent highly conserved protein patterns. The blocks themselves are derived from entries in PROSITE as well as other sources. Either a protein or nucleotide query can be submitted to the BLOCKS server; if a nucleotide sequence is submitted, the sequence is translated in all six reading frames and motifs are sought in these conceptual translations. Once the search is completed, the server will return a ranked list of significant matches, along with an alignment of the query sequence to the matched BLOCKS entries.

Conserved protein domains can be represented by two-dimensional matrices, which measure either the frequency or probability of the occurrences of each amino acid residue and deletions or insertions in each position of the domain. This type of model, when used to search against protein databases, is sensitive and usually yields more accurate results than simple motif searches. Two popular implementations of this approach are profile searches (such as GCG program ProfileSearch) and Hidden Markov Models (HMMs)(Krough et al., *J. Mol. Biol.* 235:1501-1531 (1994); Eddy, *Current Opinion in Structural Biology* 6:361-365 (1996), both of which are herein incorporated by reference in their entirety). In both cases, a large number of common protein domains have been converted into profiles, as present in the PROSITE library, or HHM models, as in the Pfam protein domain library (Sonnhammer et al., *Proteins* 28:405-420 (1997), the entirety of which is herein incorporated by reference). Pfam contains more than 500 HMM models for enzymes, transcription factors, signal transduction molecules, and structural proteins. Protein databases can be queried with these profiles or HMM models, which will identify proteins containing the domain of interest. For example, HMMSW or HMMFS, two programs in a public domain package called HMMER (Sonnhammer et al., *Proteins* 28:405-420 (1997)) can be used.

PROSITE and BLOCKS represent collected families of protein motifs. Thus, searching these databases entails submitting a single sequence to determine whether or not that sequence is similar to the members of an established family. Programs working in the opposite direction compare a collection of sequences with individual entries in the protein databases. An example of such a program is the Motif Search Tool, or MoST (Tatusov et al. *Proc. Natl. Acad. Sci.* 91: 12091-12095 (1994), the entirety of which is herein incorporated by reference.) On the basis of an aligned set of input sequences, a weight matrix is calculated by using one of four methods (selected by the user); a weight matrix is simply a representation, position by position in an alignment, of how likely a particular amino acid will appear. The calculated weight matrix is then used to search the databases. To increase sensitivity, newly found sequences are added to the original data set, the weight matrix is recalculated, and the search is performed again. This procedure continues until no new sequences are found.

SUMMARY OF THE INVENTION

The present invention provides a substantially purified nucleic acid molecule that encodes a maize protein or fragment thereof comprising a nucleic acid sequence selected from the group consisting of SEQ ID NO: 1 through SEQ ID NO: 83523.

The present invention also provides one or more substantially purified nucleic acid molecules comprising a nucleic acid sequence selected from the group consisting of SEQ ID NO: 1 through SEQ ID NO:83523 or complements thereof.

The present invention also provides a substantially purified maize protein or fragment thereof, wherein said maize protein is encoded by a nucleic acid molecule that comprises a nucleic acid sequence selected from the group consisting of SEQ ID NO: 1 through SEQ ID NO: 83523.

The present invention further provides a substantially purified protein, peptide, or fragment thereof encoded by a nucleic acid sequence which specifically hybridizes to a nucleic acid molecule comprising a nucleic acid sequence selected from the group consisting of a complement of SEQ ID NO: 1 through SEQ ID NO:83523.

The present invention further provides a substantially purified antibody capable of specifically binding to a protein or fragment thereof encoded by a nucleic acid sequence which specifically hybridizes to a nucleic acid molecule having a nucleic acid sequence selected from the group consisting of a complement of SEQ ID NO:1 through SEQ ID NO:83523.

The present invention also provides a transformed plant transformed to contain a nucleic acid molecule which comprises: (A) an exogenous promoter region which functions in plant cells to cause the production of an mRNA molecule; which is linked to (B) a structural nucleic acid molecule, wherein said structural nucleic acid molecule comprises a nucleic acid molecule that encodes a protein, peptide, or fragment thereof which hybridizes to a nucleic acid sequence selected from the group consisting of a complement of SEQ ID NO:1 through SEQ ID NO:83523 expressed in an effective amount to produce a desirable agronomic effect; which is linked to (C) a 3' non-translated sequence that functions in plant cells to cause the termination of transcription and the addition of polyadenylated ribonucleotides to the 3' end of the mRNA sequence.

The present invention also provides a transformed plant cell containing a nucleic acid molecule whose non-transcribed strand encodes a protein or fragment thereof, wherein the transcribed strand of said nucleic acid is complementary to a nucleic acid molecule that encodes a protein or fragment thereof. The present invention also provides bacterial, viral, microbial, and plant cells comprising a nucleic acid molecule of the present invention The present invention also provides a method of producing a plant containing one or more proteins encoded by sequences comprising SEQ ID NO:1 or complement thereof through SEQ ID NO:83523 or complements thereof, expressed in a sufficient amount and/or fashion to produce a desirable agronomic effect.

In accomplishing the foregoing, there is provided, in accordance with one aspect of the present invention, methods of producing genetically transformed plants, comprising the steps of:

(a) inserting into the genome of a plant cell a recombinant, double-stranded DNA molecule comprising
  (i) a promoter which functions in plant cells to cause the production of an RNA sequence,
  (ii) a structural DNA sequence that causes the production of an RNA sequence which encodes a desired protein.
  (iii) a 3' non-translated DNA sequence which functions in plant cells to cause the addition of polyadenylated nucleotides to the 3' end of RNA sequence; where the promoter is homologous or heterologous with respect to the coding sequence and adapted to cause sufficient expression of a protein in desired plant tissues to enhance the agronomic utility of a plant transformed with said gene.
(b) obtaining a transformed plant cell with said nucleic acid molecule that encodes one or more proteins, wherein said nucleic acid molecule is transcribed and results in expression of said protein(s); and
(c) regenerating from the transformed plant cell a genetically transformed plant The present invention also encompasses differentiated plants, seeds, and progeny comprising said transformed plant cells and which exhibit novel properties of agronomic significance.

The present invention also provides a method of producing a plant containing reduced levels of a protein comprising: (A) transforming a plant cell with a nucleic acid molecule that encodes a protein, wherein said nucleic acid molecule is transcribed and results in co-suppression of endogenous protein synthesis activity, and (B) regenerating plants and producing subsequent progeny from the transformed plant.

The present invention also provides a method of determining an association between a polymorphism and a plant trait comprising: (A) hybridizing a nucleic acid molecule specific for a polymorphism to genetic material of a plant, wherein said nucleic acid molecule comprising a nucleic acid sequence selected from the group consisting of SEQ ID NO: 1 through SEQ ID NO:83523 or complements thereof; and (B) calculating the degree of association between the polymorphism and the plant trait.

The present invention also provides a method of isolating a genetic region, or nucleic acid that encodes a protein or fragment thereof comprising: (A) incubating under conditions permitting nucleic acid hybridization: a marker nucleic acid molecule, preferably an EST, with a complementary nucleic acid molecule obtained from a plant cell or plant tissue; (B) permitting hybridization between said marker nucleic acid molecule, preferably an EST, and said complementary nucleic acid molecule obtained from said plant cell or plant tissue; and (C) isolating said complementary nucleic acid molecule.

The present invention also provides a method for determining a level or pattern in a plant cell of a protein in a plant comprising: (A) incubating, under conditions permitting nucleic acid hybridization, a marker nucleic acid molecule, the marker nucleic acid molecule selected from the group of marker nucleic acid molecules which specifically hybridize to a nucleic acid molecule having the nucleic acid sequence selected from the group consisting of SEQ ID NO: 1 through SEQ ID NO: 83523 or complements thereof or fragments of either, with a complementary nucleic acid molecule obtained from the plant cell or plant tissue, wherein nucleic acid hybridization between the marker nucleic acid molecule and the complementary nucleic acid molecule obtained from the plant cell or plant tissue permits the detection of an mRNA for the enzyme; (B) permitting hybridization between the marker nucleic acid molecule and the complementary nucleic acid molecule obtained from the plant cell or plant tissue; and (C) detecting the level or pattern of the complementary nucleic acid, wherein the detection of the complementary nucleic acid is predictive of the level or pattern of the protein.

The present invention also provides a method for determining the level or pattern of a protein in a plant cell or plant tissue comprising: (A) incubating under conditions permitting nucleic acid hybridization: a marker nucleic acid molecule, the marker nucleic acid molecule comprising a nucleotide sequence selected from the group consisting of SEQ ID NO: 1 through SEQ ID NO:83523 or complements thereof, with a complementary nucleic acid molecule obtained from a plant cell or plant tissue, wherein nucleic acid hybridization between the marker nucleic acid molecule, and the complementary nucleic acid molecule obtained from the plant cell or plant tissue permits the detection of said protein; (B) permitting hybridization between the marker nucleic acid molecule and the complementary nucleic acid molecule obtained from the plant cell or plant tissue; and (C) detecting the level or pattern of the complementary nucleic acid, wherein the detection of said complementary nucleic acid is predictive of the level or pattern of the protein synthesis.

The present invention also provides a method for determining a level or pattern of a protein in a plant cell or plant tissue which comprises assaying the concentration of a molecule, whose concentration is dependent upon the expression of a gene, the gene having a nucleic acid sequence which specifically hybridizes to a protein marker nucleic acid molecule, the molecule being present in a plant cell or plant tissue, in comparison to the concentration of that molecule present in a plant cell or plant tissue with a known level or pattern of said protein, wherein an assayed concentration of the molecule is compared to the assayed concentration of the molecule in a plant cell or plant tissue with a known level or pattern of said protein.

The present invention also provides a method of determining a mutation in a plant whose presence is predictive of a mutation affecting a level or pattern of a protein comprising the steps: (A) incubating, under conditions permitting nucleic acid hybridization, a marker nucleic acid, the marker nucleic acid selected from the group of marker nucleic acid molecules which specifically hybridize to a nucleic acid molecule consisting of the nucleic acid sequence selected from the group consisting of SEQ ID NO: 1 through SEQ ID NO: 83523 or complements thereof or fragments of either and a complementary nucleic acid molecule obtained from the plant, wherein nucleic acid hybridization between the marker nucleic acid molecule and the complementary nucleic acid molecule obtained from the plant permits the detection of a polymorphism whose presence is predictive of a mutation affecting the level or pattern of the protein in the plant; (B) permitting hybridization between the marker nucleic acid molecule and the complementary nucleic acid molecule obtained from the plant; and (C) detecting the presence of the polymorphism, wherein the detection of the polymorphism is predictive of the mutation.

The present invention also provides a method for determining a mutation in a plant whose presence is predictive of a mutation affecting the level or pattern of protein synthesis comprising the steps: (A) incubating under conditions permitting nucleic acid hybridization: a marker nucleic acid molecule, the marker nucleic acid molecule comprising a nucleic acid molecule that is linked to gene, the gene having a nucleic acid sequence which specifically hybridizes to a sequence selected from the group consisting of SEQ ID NO: 1 through SEQ ID NO:83523 and complements thereof, and a complementary nucleic acid molecule obtained from a plant tissue or plant cell of the plant, wherein nucleic acid hybridization between the marker nucleic acid molecule and the complementary nucleic acid molecule obtained from the plant permits the detection of a polymorphism whose presence is predictive of a mutation affecting said level or pattern of a protein synthesis in the plant; (B) permitting hybridization between said marker nucleic acid molecule and said complementary nucleic acid molecule obtained from said plant; and; (C) detecting the presence of the polymorphism, wherein the detection of the polymorphism is predictive of the mutation.

The present invention also provides a method for reducing expression of a protein in a plant cell, the method comprising: growing a transformed plant cell containing a nucleic acid molecule whose non-transcribed strand encodes a protein or fragment thereof, wherein the transcribed strand of said nucleic acid is complementary to a nucleic acid molecule that encodes the protein in said plant cell, and whereby the strand that is complementary to the nucleic acid molecule that encodes the protein reduces or depresses expression of the protein.

The present invention provides maize nucleic acid molecules for use as molecular tags to isolate genetic regions (i.e. promoters and flanking sequences), isolate genes, map genes, and determine gene function. The present invention further provides maize nucleic acid molecules for use in determining if genes are members of a particular gene family.

The present invention also provides a method of obtaining full length genes using maize ESTs or complements thereof or fragments of either.

The present invention also provides a method of isolating promoters and flanking sequences using maize ESTs or complements thereof or fragments of either.

The present invention also provides maize ESTs or complements thereof or fragments of either for use in marker-assisted breeding programs.

The present invention also provides a method of identifying tissues comprising hybridizing nucleic acids from the tissue with maize ESTs or complements thereof or fragments of either.

The present invention also provides a method for production of antibodies targeted against the proteins, peptides, or fragments produced by the disclosed or complements thereof or fragments of either.

The present invention also provides a method for the transformation and regeneration of plants comprising sequences hybridizable to the disclosed ESTs or complements thereof or fragments of either.

The present invention also provides a method of modifying plant protein expression by inserting in a chimeric gene sense or antisense constructs of the maize ESTs.

DETAILED DESCRIPTION OF THE INVENTION

Agents
(a) Nucleic Acid Molecules

Agents of the present invention include nucleic acid molecules and more specifically EST nucleic acid molecules or nucleic acid fragment molecules thereof. Fragment EST nucleic acid molecules may encode significant portion(s) of, or indeed most of, the EST nucleic acid molecule. Alternatively, the fragments may comprise smaller oligonucleotides (having from about 15 to about 250 nucleotide residues, and more preferably, about 15 to about 30 nucleotide residues).

A subset of the nucleic acid molecules of the present invention includes nucleic acid molecules that are marker molecules. Another subset of the nucleic acid molecules of the present invention include nucleic acid molecules that encode a protein or fragment thereof. Another subset of the nucleic acid molecules of the present invention are EST molecules.

The term "substantially purified", as used herein, refers to a molecule separated from substantially all other molecules normally associated with it in its native state. More preferably a substantially purified molecule is the predominant species present in a preparation. A substantially purified molecule may be greater than 60% free, preferably 75% free, more preferably 90% free, and most preferably 95% free from the other molecules (exclusive of solvent) present in the natural mixture. The term "substantially purified" is not intended to encompass molecules present in their native state.

The agents of the present invention will preferably be "biologically active" with respect to either a structural attribute, such as the capacity of a nucleic acid to hybridize to another nucleic acid molecule, or the ability of a protein to be bound by antibody (or to compete with another molecule for such binding). Alternatively, such an attribute may be catalytic, and thus involve the capacity of the agent to mediate a chemical reaction or response.

The agents of the present invention may also be recombinant. As used herein, the term recombinant means any agent (e.g. DNA, peptide etc.), that is, or results, however indirect, from human manipulation of a nucleic acid molecule.

It is understood that the agents of the present invention may be labeled with reagents that facilitate detection of the agent (e.g. fluorescent labels (Prober, et al., *Science* 238:336-340 (1987); Albarella et al., EP 144914, chemical labels (Sheldon et al., U.S. Pat. No. 4,582,789; Albarella et al., U.S. Pat. No. 4,563,417, modified bases (Miyoshi et al., EP 119448, all of which are hereby incorporated by reference in their entirety).

It is further understood, that the present invention provides bacterial, viral, microbial, and plant cells comprising the agents of the present invention.

Nucleic acid molecules or fragment thereof of the present invention are capable of specifically hybridizing to other nucleic acid molecules under certain circumstances. As used herein, two nucleic acid molecules are said to be capable of specifically hybridizing to one another if the two molecules are capable of forming an anti-parallel, double-stranded nucleic acid structure. A nucleic acid molecule is said to be the "complement" of another nucleic acid molecule if they exhibit complete complementarity. As used herein, molecules are said to exhibit "complete complementarity" when every nucleotide of one of the molecules is complementary to a nucleotide of the other. Two molecules are said to be "minimally complementary" if they can hybridize to one another with sufficient stability to permit them to remain annealed to one another under at least conventional "low-stringency" conditions. Similarly, the molecules are said to be "complementary" if they can hybridize to one another with sufficient stability to permit them to remain annealed to one another under conventional "high-stringency" conditions. Conventional stringency conditions are described by Sambrook, et al., In: *Molecular Cloning, A Laboratory Manual, 2nd Edition, Cold Spring Harbor Press*, Cold Spring Harbor, N.Y. (1989), and by Haymes, et al. In: *Nucleic Acid Hybridization, A Practical Approach*, IRL Press, Washington, D.C. (1985), the entirety of which is herein incorporated by reference. Departures from complete complementarity are therefore permissible, as long as such departures do not completely preclude the capacity of the molecules to form a double-stranded structure. Thus, in order for an nucleic acid molecule or fragment of the present invention to serve as a primer or probe it need only be sufficiently complementary in sequence to be able to form a stable double-stranded structure under the particular solvent and salt concentrations employed.

Appropriate stringency conditions which promote DNA hybridization are, for example, 6.0×sodium chloride/sodium citrate (SSC) at about 45° C., followed by a wash of 2.0×SSC at 50° C., are known to those skilled in the art or can be found in *Current Protocols in Molecular Biology*, John Wiley & Sons, N.Y. (1989), 6.3.1-6.3.6. For example, the salt concentration in the wash step can be selected from a low stringency of about 2.0×SSC at 50° C. to a high stringency of about 0.2×SSC at 50° C. In addition, the temperature in the wash step can be increased from low stringency conditions at room temperature, about 22° C., to high stringency conditions at about 65° C. Both temperature and salt may be varied, or either the temperature or the salt concentration may be held constant while the other variable is changed.

In a preferred embodiment, a nucleic acid of the present invention will specifically hybridize to one or more of the nucleic acid molecules set forth in SEQ ID NO: 1 through SEQ ID NO: 83523 or complements thereof under moderately stringent conditions, for example, at about 2.0×SSC and about 65° C.

In a particularly preferred embodiment, a nucleic acid of the present invention will include those nucleic acid molecules that specifically hybridize to one or more of the nucleic acid molecules set forth in SEQ ID NO:1 through SEQ ID NO: 83523 or complements thereof under high stringency conditions.

In one aspect of the present invention, the nucleic acid molecules of the present invention have one or more of the nucleic acid sequences set forth in SEQ ID NO: 1 through SEQ ID NO:83523 or complements thereof. In another aspect of the present invention, one or more of the nucleic acid molecules of the present invention share between 100% and 90% sequence identity with one or more of the nucleic acid sequences set forth in SEQ ID NO: 1 through SEQ ID NO:83523 or complements thereof. In a further aspect of the present invention, one or more of the nucleic acid molecules of the present invention share between 100% and 95% sequence identity with one or more of the nucleic acid sequences set forth in SEQ ID NO: 1 through SEQ ID NO:83523 or complements thereof. In a more preferred aspect of the present invention, one or more of the nucleic acid molecules of the present invention share between 100% and 98% sequence identity with one or more of the nucleic acid sequences set forth in SEQ ID NO: 1 through SEQ ID NO:83523 or complements thereof. In an even more preferred aspect of the present invention, one or more of the nucleic acid molecules of the present invention share between 100% and 99% sequence identity with one or more of the sequences set forth in SEQ ID NO: 1 through SEQ ID NO:83523 or complements thereof. In a further, even more preferred aspect of the present invention, one or more of the nucleic acid molecules of the present invention exhibit 100% sequence identity with one or more nucleic acid molecules present within the cDNA libraries LIB143, LIB148, LIB189, LIB3059, LIB3060, LIB3062, LIB3066, LIB3067, LIB3068, LIB3069, LIB3075, LIB3076, LIB3078, LIB3079, LIB3088 and LIB3114 (Monsanto Company, St. Louis, Mo. United States of America).

In a preferred embodiment of the present invention, a maize protein or fragment thereof of the present invention is a homologue of another plant protein. In another preferred embodiment of the present invention, a maize protein or fragment thereof of the present invention is a homologue of a fungal protein. In another preferred embodiment of the present invention, a maize protein or fragment thereof of the present invention is a homologue of a mammalian protein. In another preferred embodiment of the present invention, a maize protein or fragment thereof of the present invention is a homologue of an algal protein. In another preferred embodiment of the present invention, a maize protein or fragment thereof of the present invention is a homologue of a bacterial protein. In another preferred embodiment of the present invention, a maize protein or fragment thereof of the present invention is a homologue of a soybean protein.

In a preferred embodiment of the present invention, the nucleic molecule of the present invention encodes a maize protein or fragment thereof where a maize protein or fragment thereof exhibits a BLAST probability score of greater than 1E-12, preferably a BLAST probability score of between about 1E-30 and about 1E-12, even more preferably a BLAST probability score of greater than 1E-30 with its homologue.

In another preferred embodiment of the present invention, the nucleic acid molecule encoding a maize protein or fragment thereof exhibits a % identity with its homologue of between about 25% and about 40%, more preferably of between about 40% and about 70%, even more preferably of between about 70% and about 90% and even more preferably between about 90% and 99%. In another preferred embodiment, of the present invention, a maize protein or fragment thereof exhibits a % identity with its homologue of 100%.

In a preferred embodiment of the present invention, the nucleic acid molecule of the present invention encodes a maize protein or fragment thereof where the maize protein exhibits a BLAST score of greater than 120, preferably a BLAST score of between about 1450 and about 120, even more preferably a BLAST score of greater than 1450 with its homologue.

Nucleic acid molecules of the present invention also include non-maize homologues. Preferred non-maize homologues are selected from the group consisting of alfalfa, *Arabidopsis*, barley, *Brassica*, broccoli, cabbage, citrus, cotton, garlic, oat, oilseed rape, onion, canola, flax, an ornamental plant, pea, peanut, pepper, potato, rice, rye, sorghum, soybean strawberry, sugarcane, sugarbeet, tomato, wheat, poplar, pine, fir, eucalyptus, apple, lettuce, lentils, grape, banana, tea, turf grasses, sunflower, oil palm and *Phaseolus*.

The degeneracy of the genetic code, which allows different nucleic acid sequences to code for the same protein or peptide, is known in the literature. (U.S. Pat. No. 4,757,006, the entirety of which is herein incorporated by reference).

In an aspect of the present invention, one or more of the nucleic acid molecules of the present invention differ in nucleic acid sequence from those encoding a maize protein or fragment thereof in SEQ ID NO: 1 through SEQ ID NO: 83523 due to the degeneracy in the genetic code in that they encode the same protein but differ in nucleic acid sequence.

In another further aspect of the present invention, one or more of the nucleic acid molecules of the present invention differ in nucleic acid sequence from those encoding a maize protein or fragment thereof in SEQ ID NO: 1 through SEQ ID NO: 83523 due to fact that the different nucleic acid sequences encode a protein having one or more conservative amino acid residues. It is understood that codons capable of coding for such conservative substitutions are known in the art.

It is well known in the art that one or more amino acids in a native sequence can be substituted with another amino acid(s), the charge and polarity of which are similar to that of the native amino acid, i.e., a conservative amino acid substitution, resulting in a silent change. Conserved substitutes for an amino acid within the native polypeptide sequence can be selected from other members of the class to which the naturally occurring amino acid belongs. Amino acids can be divided into the following four groups: (1) acidic amino acids, (2) basic amino acids, (3) neutral polar amino acids, and (4) neutral nonpolar amino acids. Representative amino acids within these various groups include, but are not limited to, (1) acidic (negatively charged) amino acids such as aspartic acid and glutamic acid; (2) basic (positively charged) amino acids such as arginine, histidine, and lysine; (3) neutral polar amino acids such as glycine, serine, threonine, cysteine, cystine, tyrosine, asparagine, and glutamine; and (4) neutral nonpolar (hydrophobic) amino acids such as alanine, leucine, isoleucine, valine, proline, phenylalanine, tryptophan, and methionine.

Conservative amino acid changes within the native polypeptides sequence can be made by substituting one amino acid within one of these groups with another amino acid within the same group. Biologically functional equivalents of the proteins or fragments thereof of the present invention can have 10 or fewer conservative amino acid changes, more preferably seven or fewer conservative amino acid changes, and most preferably five or fewer conservative amino acid changes. The encoding nucleotide sequence will thus have corresponding base substitutions, permitting it to encode biologically functional equivalent forms of the proteins or fragments of the present invention.

It is understood that certain amino acids may be substituted for other amino acids in a protein structure without appreciable loss of interactive binding capacity with structures such as, for example, antigent-binding regions of antibodies or binding sites on substrate molecules. Because it is the interactive capacity and nature of a protein that defines that protein's biological functional activity, certain amino acid sequence substitutions can be made in a protein sequence and, of course, its underlying DNA coding sequence and, nevertheless, obtain a protein with like properties. It is thus contemplated by the inventors that various changes may be made in the peptide sequences of the proteins or fragments of the present invention, or corresponding DNA sequences that encode said peptides, without appreciable loss of their biological utility or activity. It is understood that codons capable of coding for such amino acid changes are known in the art.

In making such changes, the hydropathic index of amino acids may be considered. The importance of the hydropathic amino acid index in conferring interactive biological function on a protein is generally understood in the art (Kyte and Doolittle, *J. Mol. Biol.* 157, 105-132 (1982), herein incorporated by reference in its entirety). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like.

Each amino acid has been assigned a hydropathic index on the basis of its hydrophobicity and charge characteristics (Kyte and Doolittle, 1982); these are isoleucine (+4.5), valine (+4.2), leucine (+3.8), phenylalanine (+2.8), cysteine/cystine (+2.5), methionine (+1.9), alanine (+1.8), glycine (−0.4), threonine (−0.7), serine (−0.8), tryptophan (−0.9), tyrosine (−1.3), proline (−1.6), histidine (−3.2), glutamate (−3.5), glutamine (−3.5), aspartate (−3.5), asparagine (−3.5), lysine (−3.9), and arginine (−4.5).

In making such changes, the substitution of amino acids whose hydropathic indices are within ±2 is preferred, those which are within ±1 are particularly preferred, and those within ±0.5 are even more particularly preferred.

It is also understood in the art that the substitution of like amino acids can be made effectively on the basis of hydrophilicity. U.S. Pat. No. 4,554,101, incorporated herein by reference in its entirety, states that the greatest local average hydrophilicity of a protein, as govern by the hydrophilicity of its adjacent amino acids, correlates with a biological property of the protein.

As detailed in U.S. Pat. No. 4,554,101, the following hydrophilicity values have been assigned to amino acid residues: arginine (+3.0), lysine (+3.0), aspartate (+3.0±1), glutamate (+3.0±1), serine (+0.3), asparagine (+0.2), glutamine (+0.2), glycine (0), threonine (−0.4), proline (−0.5±1), alanine (−0.5), histidine (−0.5), cysteine (−1.0), methionine (−1.3), valine (−1.5), leucine (−1.8), isoleucine (−1.8), tyrosine (−2.3), phenylalanine (−2.5), and tryptophan (−3.4).

In making such changes, the substitution of amino acids whose hydrophilicity values are within ±2 is preferred, those which are within ±1 are particularly preferred, and those within ±0.5 are even more particularly preferred. In a further aspect of the present invention, one or more of the nucleic acid molecules of the present invention differ in nucleic acid sequence from those encoding a maize protein or fragment thereof set forth in SEQ ID NO: 1 through SEQ ID NO: 83523 or fragment thereof due to the fact that one or more codons encoding an amino acid has been substituted for a codon that encodes a nonessential substitution of the amino acid originally encoded.

One aspect of the present invention concerns markers that include nucleic acid molecules SEQ ID NO: 1 through SEQ ID NO: 83523 or complements thereof or fragments of either that can act as markers or other nucleic acid molecules of the present invention that can act as markers. Genetic markers of the present invention include "dominant" or "codominant" markers "Codominant markers" reveal the presence of two or more alleles (two per diploid individual) at a locus. "Dominant markers" reveal the presence of only a single allele per locus. The presence of the dominant marker phenotype (e.g., a band of DNA) is an indication that one allele is present in either the homozygous or heterozygous condition. The absence of the dominant marker phenotype (e.g. absence of a DNA band) is merely evidence that "some other" undefined allele is present. In the case of populations where individuals are predominantly homozygous and loci are predominately dimorphic, dominant and codominant markers can be equally valuable. As populations become more heterozygous and multi-allelic, codominant markers often become more informative of the genotype than dominant markers. Marker molecules can be, for example, capable of detecting polymorphisms such as single nucleotide polymorphisms (SNPs).

SNPs are single base changes in genomic DNA sequence. They occur at greater frequency and are spaced with a greater uniformity throughout a genome than other reported forms of polymorphism. The greater frequency and uniformity of SNPs means that there is greater probability that such a polymorphism will be found near or in a genetic locus of interest than would be the case for other polymorphisms. SNPs are located in protein-coding regions and noncoding regions of a genome. Some of these SNPs may result in defective or variant protein expression (e.g., as a results of mutations or defective splicing). Analysis (genotyping) of characterized SNPs can require only a plus/minus assay rather than a lengthy measurement, permitting easier automation.

SNPs can be characterized using any of a variety of methods. Such methods include the direct or indirect sequencing of the site, the use of restriction enzymes (Botstein et al., *Am. J. Hum. Genet.* 32:314-331 (1980), the entirety of which is herein incorporated reference; Konieczny and Ausubel, *Plant J.* 4:403-410 (1993), the entirety of which is herein incorporated by reference), enzymatic and chemical mismatch assays (Myers et al., *Nature* 313:495-498 (1985), the entirety of which is herein incorporated by reference), allele-specific PCR (Newton et al., *Nucl. Acids Res.* 17:2503-2516 (1989), the entirety of which is herein incorporated by reference; Wu et al., *Proc. Natl. Acad Sci.* (U.S.A.) 86:2757-2760 (1989), the entirety of which is herein incorporated by reference), ligase chain reaction (Barany, *Proc. Natl. Acad. Sci.* (U.S.A.) 88:189-193 (1991), the entirety of which is herein incorporated by reference), single-strand conformation polymorphism analysis (Labrune et al., *Am. J. Hum. Genet.* 48: 1115-1120 (1991), the entirety of which is herein incorporated by reference), primer-directed nucleotide incorporation assays (Kuppuswami et al., *Proc. Natl. Acad. Sci. USA* 88:1143-1147 (1991), the entirety of which is herein incorporated by reference), dideoxy fingerprinting (Sarkar et al., *Genomics* 13:441-443 (1992), the entirety of which is herein incorporated by reference), solid-phase ELISA-based oligonucleotide ligation assays (Nikiforov et al., *Nucl. Acids Res.* 22:4167-4175 (1994), the entirety of which is herein incorporated by reference), oligonucleotide fluorescence-quenching assays (Livak et al., *PCR Methods Appl.* 4:357-362 (1995), the entirety of which is herein incorporated by reference), 5'-nuclease allele-specific hybridization TaqMan assay (Livak et al., *Nature Genet.* 9:341-342 (1995), the entirety of which is herein incorporated by reference), template-directed dye-terminator incorporation (TDI) assay (Chen and Kwok, *Nucl. Acids Res.* 25:347-353 (1997), the entirety of which is herein incorporated by reference), allele-specific molecular beacon assay (Tyagi et al., *Nature Biotech.* 16: 49-53 (1998), the entirety of which is herein incorporated by reference), PinPoint assay (Haff and Smirnov, *Genome Res.* 7: 378-388 (1997), the entirety of which is herein incorporated by reference) and dCAPS analysis (Neff et al., *Plant J.* 14:387-392 (1998), the entirety of which is herein incorporated by reference).

Additional markers, such as AFLP markers, RFLP markers and RAPD markers, can be utilized (Walton, *Seed World* 22-29 (July, 1993), the entirety of which is herein incorporated by reference; Burow and Blake, *Molecular Dissection of Complex Traits*, 13-29, Paterson (ed.), CRC Press, New York (1988), the entirety of which is herein incorporated by reference). DNA markers can be developed from nucleic acid molecules using restriction endonucleases, the PCR and/or DNA sequence information. RFLP markers result from single base changes or insertions/deletions. These codominant markers are highly abundant in plant genomes, have a medium level of polymorphism and are developed by a combination of restriction endonuclease digestion and Southern blotting hybridization. CAPS are similarly developed from restriction nuclease digestion but only of specific PCR products. These markers are also codominant, have a medium level of polymorphism and are highly abundant in the genome. The CAPS result from single base changes and insertions/deletions.

Another marker type, RAPDs, are developed from DNA amplification with random primers and result from single base changes and insertions/deletions in plant genomes. They are dominant markers with a medium level of polymorphisms and are highly abundant. AFLP markers require using the PCR on a subset of restriction fragments from extended adapter primers. These markers are both dominant and codominant are highly abundant in genomes and exhibit a medium level of polymorphism.

SSRs require DNA sequence information. These codominant markers result from repeat length changes, are highly polymorphic and do not exhibit as high a degree of abundance in the genome as CAPS, AFLPs and RAPDs, SNPs also require DNA sequence information. These codominant markers result from single base substitutions. They are highly abundant and exhibit a medium of polymorphism (Rafalski et al., In: *Nonmammalian Genomic Analysis*, Birren and Lai (ed.), Academic Press, San Diego, Calif., pp. 75-134 (1996), the entirety of which is herein incorporated by reference). It is understood that a nucleic acid molecule of the present invention may be used as a marker.

A PCR probe is a nucleic acid molecule capable of initiating a polymerase activity while in a double-stranded structure with another nucleic acid. Various methods for determining the structure of PCR probes and PCR techniques exist in the art. Computer generated searches using programs such as Primer3 (available on the world wide web at genome.wi.mit.edu/cgi-bin/primer/primer3.cgi), STSPipeline (available on the world wide web at genome.wi.mit.edu/cgi-bin/www-STS_Pipeline), or GeneUp (Pesole et al., *BioTechniques* 25:112-123 (1998) the entirety of which is herein incorporated by reference), for example, can be used to identify potential PCR primers.

It is understood that a fragment of one or more of the nucleic acid molecules of the present invention may be a probe and specifically a PCR probe.

(b) Protein and Peptide Molecules

A class of agents comprises one or more of the protein or peptide molecules encoded by SEQ ID NO: 1 through SEQ ID NO:83523 or one or more of the protein or fragment thereof or peptide molecules encoded by other nucleic acid agents of the present invention. As used herein, the term "protein molecule" or "peptide molecule" includes any molecule that comprises five or more amino acids. It is well know in the art that proteins may undergo modification, including post-translational modifications, such as, but not limited to, disulfide bond formation, glycosylation, phosphorylation, or oligomerization. Thus, as used herein, the term "protein molecule" or "peptide molecule" includes any protein molecule that is modified by any biological or non-biological process. The terms "amino acid" and "amino acids" refer to all naturally occurring L-amino acids. This definition is meant to include norleucine, ornithine, homocysteine, and homoserine.

One or more of the protein or fragment of peptide molecules may be produced via chemical synthesis, or more preferably, by expression in a suitable bacterial or eukaryotic host. Suitable methods for expression are described by Sambrook, et al., (In: *Molecular Cloning, A Laboratory Manual, 2nd Edition, Cold Spring Harbor Press*, Cold Spring Harbor, N.Y. (1989)), or similar texts.

A "protein fragment" is a peptide or polypeptide molecule whose amino acid sequence comprises a subset of the amino acid sequence of that protein. A protein or fragment thereof that comprises one or more additional peptide regions not derived from that protein is a "fusion" protein. Such molecules may be derivatized to contain carbohydrate or other moieties (such as keyhole limpet hemocyanin, etc.). Fusion protein or peptide molecule of the present invention are preferably produced via recombinant means.

Another class of agents comprise protein or peptide molecules encoded by SEQ ID NO: 1 through SEQ ID NO:83523 or complements thereof or, fragments or fusions thereof in which non-essential, or not relevant, amino acid residues have been added, replaced, or deleted. An example of such a homologue is the homologue protein of all non-maize plant species, including but not limited to alfalfa, *Arabidopsis*, barley, *Brassica*, broccoli, cabbage, citrus, cotton, garlic, oat, oilseed rape, onion, canola, flax, an ornamental plant, pea, peanut, pepper, potato, rice, rye, sorghum, soybean, strawberry, sugarcane, sugarbeet, tomato, wheat, poplar, pine, fir, eukalyptus, apple, lettuce, peas, lentils, grape, banana, tea, turf grasses, etc. Particularly preferred non-maize plants to utilize for the isolation of homologues would include alfalfa, *Arabidopsis*, barley, cotton, oat, oilseed rape, rice, canola, ornamentals, soybean, sugarcane, sugarbeet, tomato, potato, wheat, and turf grasses. Such a homologue can be obtained by any of a variety of methods. Most preferably, as indicated above, one or more of the disclosed sequences (SEQ ID NO: 1 through SEQ ID NO:83523 or complements thereof) will be used to define a pair of primers that may be used to isolate the homologue-encoding nucleic acid molecules from any desired species. Such molecules can be expressed to yield homologues by recombinant means.

(c) Antibodies

One aspect of the present invention concerns antibodies, single-chain antigen binding molecules, or other proteins that specifically bind to one or more of the protein or peptide molecules of the present invention and their homologues, fusions or fragments. Such antibodies may be used to quantitatively or qualitatively detect the protein or peptide molecules of the present invention. As used herein, an antibody or peptide is said to "specifically bind" to a protein or peptide molecule of the present invention if such binding is not competitively inhibited by the presence of non-related molecules.

Nucleic acid molecules that encode all or part of the protein of the present invention can be expressed, via recombinant means, to yield protein or peptides that can in turn be used to elicit antibodies that are capable of binding the expressed protein or peptide. Such antibodies may be used in immunoassays for that protein. Such protein-encoding molecules, or their fragments may be a "fusion" molecule (i.e., a part of a larger nucleic acid molecule) such that, upon expression, a fusion protein is produced. It is understood that any of the nucleic acid molecules of the present invention may be expressed, via recombinant means, to yield proteins or peptides encoded by these nucleic acid molecules.

The antibodies that specifically bind proteins and protein fragments of the present invention may be polyclonal or monoclonal, and may comprise intact immunoglobulins, or antigen binding portions of immunoglobulins (such as (F(ab'), F(ab')$_2$) fragments, or single-chain immunoglobulins producible, for example, via recombinant means). It is understood that practitioners are familiar with the standard resource materials which describe specific conditions and procedures for the construction, manipulation and isolation of antibodies (see, for example, Harlow and Lane, In *Antibodies: A Laboratory Manual*, Cold Spring Harbor Press, Cold Spring Harbor, N.Y. (1988), the entirety of which is herein incorporated by reference).

Murine monoclonal antibodies are particularly preferred. BALB/c mice are preferred for this purpose, however, equivalent strains may also be used. The animals are preferably immunized with approximately 25 µg of purified protein (or fragment thereof) that has been emulsified a suitable adjuvant (such as TiterMax adjuvant (Vaxcel, Norcross, Ga.)). Immunization is preferably conducted at two intramuscular sites, one intraperitoneal site, and one subcutaneous site at the base of the tail. An additional i.v. injection of approximately 25 µg of antigen is preferably given in normal saline three weeks later. After approximately 11 days following the second injection, the mice may be bled and the blood screened for the presence of anti-protein or peptide antibodies. Preferably, a direct binding Enzyme-Linked Immunoassay (ELISA) is employed for this purpose.

More preferably, the mouse having the highest antibody titer is given a third i.v. injection of approximately 25 µg of the same protein or fragment. The splenic leukocytes from this animal may be recovered 3 days later, and are then permitted to fuse, most preferably, using polyethylene glycol, with cells of a suitable myeloma cell line (such as, for example, the P3X63Ag8.653 myeloma cell line). Hybridoma cells are selected by culturing the cells under "HAT" (hypoxanthine-aminopterin-thymine) selection for about one week. The resulting clones may then be screened for their capacity to produce monoclonal antibodies ("mAbs), preferably by direct ELISA.

In one embodiment, anti-protein or peptide monoclonal antibodies are isolated using a fusion of a protein, protein fragment, or peptide of the present invention, or conjugate of a protein, protein fragment, or peptide of the present invention, as immunogens. Thus, for example, a group of mice can be immunized using a fusion protein emulsified in Freund's complete adjuvant (e.g. approximately 50 µg of antigen per immunization). At three week intervals, an identical amount of antigen is emulsified in Freund's incomplete adjuvant and used to immunize the animals. Ten days following the third immunization, serum samples are taken and evaluated for the presence of antibody. If antibody titers are too low, a fourth booster can be employed. Polysera capable of binding the protein or peptide can also be obtained using this method.

In a preferred procedure for obtaining monoclonal antibodies, the spleens of the above-described immunized mice are removed, disrupted, and immune splenocytes are isolated over a ficoll gradient. The isolated splenocytes are fused, using polyethylene glycol with BALB/c-derived HGPRT (hypoxanthine guanine phosphoribosyl transferase) deficient P3x63xAg8.653 plasmacytoma cells. The fused cells are plated into 96-well microtiter plates and screened for hybridoma fusion cells by their capacity to grow in culture medium supplemented with hypothanthine, aminopterin and thymidine for approximately 2-3 weeks.

Hybridoma cells that arise from such incubation are preferably screened for their capacity to produce an immunoglobulin that binds to a protein of interest. An indirect ELISA may be used for this purpose. In brief, the supernatants of hybridomas are incubated in microtiter wells that contain immobilized protein. After washing, the titer of bound immunoglobulin can be determined using, for example, a goat anti-mouse antibody conjugated to horseradish peroxidase. After additional washing, the amount of immobilized enzyme is determined (for example through the use of a chromogenic substrate). Such screening is performed as quickly as possible after the identification of the hybridoma in order to ensure that a desired clone is not overgrown by non-secreting neighbors. Desirably, the fusion plates are screened several times since the rates of hybridoma growth vary. In a preferred sub-embodiment, a different antigenic form of immunogen may be used to screen the hybridoma. Thus, for example, the splenocytes may be immunized with one immunogen, but the resulting hybridomas can be screened using a different immunogen. It is understood that any of the protein or peptide molecules of the present invention may be used to raise antibodies.

As discussed below, such antibody molecules or their fragments may be used for diagnostic purposes. Where the antibodies are intended for diagnostic purposes, it may be desirable to derivatize them, for example with a ligand group (such as biotin) or a detectable marker group (such as a fluorescent group, a radioisotope or an enzyme).

The ability to produce antibodies that bind the protein or peptide molecules of the present invention permits the identification of mimetic compounds of those molecules. A "mimetic compound" is a compound that is not that compound, or a fragment of that compound, but which nonetheless exhibits an ability to specifically bind to antibodies directed against that compound.

It is understood that any of the agents of the present invention can be substantially purified and/or be biologically active and/or recombinant.

Uses of the Agents of the Invention

The nucleic acid molecules and fragments thereof of the present invention are generated from the cDNA library, LIB143, prepared from *Zea mays* heat shocked seedlings two days post germination. Seedlings are a developmental phase in the growth process therefore, the ESTs of the present invention will find great use in the isolation of a variety of agronomically significant genes, including but not limited to genes that regulate germination, developmental stress, protein, amino acids, sterols, oils, minerals, isoflavones, saponins, trypsin inhibitors, vitamins, tocopherols, antinutrient components, carbohydrates, starch metabolism, and seedling and vegetative regulatory elements. Such crucial genes are associated with plant growth, quality, yield, and could also serve as links in important metabolic, developmental and catabolic pathways.

The nucleic acid molecules and fragments thereof of the present invention are generated from the cDNA library, LIB148, prepared from *Zea mays* pollen tissue at the V10+ plant development stage. ESTs from this tissue sample can enable the acquisition of a variety of agronomically significant genes involved in the synthesis and catabolism of commercially important traits. The ESTs of the present invention can enable the acquisition of, including but not limited to genes involved in reproduction and seed production, therefore, the ESTs of the present invention will find great use in the isolation of a variety of agronomically significant genes, including but not limited to, genes that regulate meiosis, cell division, carotenoids, floral biogenesis, embryogenesis, protein, amino acids, sterols, oils, minerals, isoflavones, saponins, vitamins, tocopherols, antinutrient components, carbohydrates, starch metabolism and seed regulatory elements. Such genes are associated with plant growth, quality and yield, and could also serve as links in important developmental, metabolic, and catabolic pathways.

The nucleic acid molecules and fragments thereof of the present invention are generated from the cDNA library, LIB189, prepared from *Zea mays* pooled leaf tissue harvested from field grown plants. Leaves are the carbohydrate factories of crop plants, therefore, the ESTs of the present invention will find great use in the isolation of a variety of agronomically significant genes, including but not limited to genes that are necessary to for the interception and transformation of light energy via photosynthesis linked with plant growth, quality and yield. Genes isolated using the disclosed ESTs would also be in pathways including but not limited to a pathway such as nitrogen metabolism linked to fruiting and mobilization and distribution of nitrogen.

The nucleic acid molecules and fragments thereof of the present invention are generated from the cDNA library, LIB3059, prepared from *Zeas mays* pooled kernel tissue harvested 12-15 days after pollination from field grown plants. Libraries from this tissue can enable the acquisition of a variety of agronomically significant genes involved in the synthesis and catabolism of commercially important traits. The ESTs of the present invention can enable the acquisition of, including but not limited to genes that regulate protein, oils, amino acids, sterols, minerals, isoflavones, saponins, vitamins, tocopherols, antinutrient components, carbohydrates, starch metabolism and seed regulatory elements. Such genes are associated with plant growth, quality and yield, and could also serve as links in important developmental, metabolic, and catabolic pathways.

The nucleic acid molecules and fragments thereof of the present invention are generated from the cDNA library, LIB3060, prepared from the tissue of *Zea mays* senescing leaves, which are collected at the position of two leaves below the ear leaf of mature corn plants at 40 days after pollination. The ESTs of the present invention can enable the acquisition of genes expressed during onset and early stages of leaf senescence. The ESTs of the present invention can also be used in isolating genes which would be involved in pathways, including but not limited to, of light and dark respiration, of $CO_2$ assimilation, and of nitrogen metabolism linked to fruiting and mobilization and distribution of nitrogen. Leaves are the main photosynthetic organs of crop plants, therefore, the ESTs of the present invention will find great use in the isolation of a variety of agronomically significant genes, including but not limited to, genes that regulate photosynthesis and respiration. Such genes are associated with plant growth, quality and yield, and could also serve as links in important developmental, metabolic, and catabolic pathways. Libraries from this tissue can enable the acquisition of a variety of agronomically significant genes involved in the synthesis and catabolism of commercially important traits.

The nucleic acid molecules and fragments thereof of the present invention are generated from the cDNA library, LIB3062, prepared from *Zeas mays* husk tissue harvested at the eight week old stage from plants grown in a green house. Husks have similar characters of leaves which are the carbohydrate factories of crop plants, therefore, the ESTs of the present invention will find great use in the isolation of a variety of agronomically significant genes, including but not limited to genes that are necessary to for the interception and transformation of light energy via photosynthesis linked with plant growth, quality and yield. Genes isolated using the disclosed ESTs would also be in pathways including but not limited to a pathway such as nitrogen metabolism linked to fruiting and mobilization and distribution of nitrogen.

The nucleic acid molecules and fragments thereof of the present invention are generated from the cDNA library, LIB3066, prepared from *Zeas mays* (Monsanto Corp. St. Louis, Mo.), immature anthers. The ESTs of the present invention can enable the acquisition of, but are not limited to genes involved in reproduction, pollen production and development, and seed production, therefore, the ESTs of the present invention will find great use in the isolation of a variety of agronomically significant genes, including but not limited to, genes that regulate microsporogenesis, meiosis, cell division, carotenoids, floral biogenesis, embryogenesis, protein, amino acids, sterols, oils, minerals, isoflavones, saponins, vitamins, tocopherols, antinutrient components, carbohydrates, starch metabolism and seed regulatory elements. Such genes are associated with plant growth, quality and yield, and could also serve as links in important developmental, metabolic, and catabolic pathways. Libraries from this tissue can enable the acquisition of a variety of agronomically significant genes involved in the synthesis and catabolism of commercially important traits.

The nucleic acid molecules and fragments thereof of the present invention are generated from the cDNA library, LIB3067, prepared from *Zeas mays* kernel tissue harvested 5-8 days after pollination from plants grown in a green house. Libraries from this tissue can enable the acquisition of a variety of agronomically significant genes involved in the synthesis and catabolism of commercially important traits. The ESTs of the present invention can enable the acquisition of, including but not limited to genes that regulate protein, early kernel development, cell division, amyloplast biogenesis, early carbon flow across material to filial tissue, oils, amino acids, sterols, minerals, isoflavones, saponins, vitamins, tocopherols, antinutrient components, carbohydrates, starch metabolism and seed regulatory elements. Such genes are associated with plant growth, quality and yield, and could also serve as links in important developmental, metabolic, and catabolic pathways.

The nucleic acid molecules and fragments thereof of the present invention are generated from the cDNA library, LIB3068, prepared from *Zea mays*, genotype MO17 pollen germinating on H99 silk tissue. This sample represents genes expressed in both pollen and silk tissues earlier in pollination and can enable the acquisition of a variety of agronomically significant genes involved in the synthesis and catabolism of commercially important traits. The ESTs of the present invention can enable the acquisition of, including but not limited to genes involved in reproduction and seed production, therefore, the ESTs of the present invention will find great use in the isolation of a variety of agronomically significant genes, including but not limited to, genes that regulate meiosis, cell division, carotenoids, floral biogenesis, embryogenesis, protein, amino acids, sterols, oils, minerals, isoflavones, saponins, vitamins, tocopherols, antinutrient components, carbohydrates, starch metabolism and seed regulatory elements. Such genes are associated with plant growth, quality and yield, and could also serve as links in important developmental, metabolic, and catabolic pathways.

The nucleic acid molecules and fragments thereof of the present invention are generated from the cDNA library, LIB3069, prepared from *Zea mays*, genotype H99 (Monsanto Corp., St. Louis, Mo.), ears pollinated with an excess of genotype MO17 (Illinois Foundation Seeds, Champaign, Ill.) pollen and harvested from 18 hours after pollination plants. The ESTs of the present invention can enable the acquisition of, including but not limited to genes expressed early in fertilization and those involved in reproduction and seed development, therefore, the ESTs of the present invention will find great use in the isolation of a variety of agronomically significant genes, including but not limited to, genes that regulate cell division, floral biogenesis, embryogenesis, protein, oils, amino acids, sterols, minerals, isoflavones, saponins, vitamins, tocopherols, antinutrient components, carbohydrates, starch metabolism and seed regulatory elements. Such genes are associated with plant growth, quality and yield, and could also serve as links in important developmental, metabolic, and catabolic pathways. Libraries from this tissue can enable the acquisition of a variety of agronomically significant genes involved in the synthesis and catabolism of commercially important traits.

The nucleic acid molecules and fragments thereof of the present invention are generated from the cDNA library, LIB3075, prepared from maize microspore tissue. Libraries from this tissue can enable the acquisition of a variety of agronomically significant genes involved in the synthesis and catabolism of commercially important traits. The ESTs of the present invention can enable the acquisition of, but are not limited to genes involved in reproduction, meiosis, and cell division. Such genes are associated with plant growth, quality and yield, and could also serve as links in important developmental, metabolic, and catabolic pathways.

The nucleic acid molecules and fragments thereof of the present invention are generated from the cDNA library, LIB3076, prepared from *Zeas mays* kernels from immature ear tissue harvested from seven week old plants grown in a green house. Libraries from this tissue can enable the acquisition of a variety of agronomically significant genes involved in the synthesis and catabolism of commercially important traits. The ESTs of the present invention can enable the acquisition of, including but not limited to genes that regulate protein, oils, amino acids, sterols, minerals, isoflavones, saponins, vitamins, tocopherols, antinutrient components, carbohydrates, starch metabolism and seed regulatory elements. Such genes are associated with plant growth, quality and yield, and could also serve as links in important developmental, metabolic, and catabolic pathways.

The nucleic acid molecules and fragments thereof of the present invention are generated from the cDNA library, LIB3078, prepared from *Zea mays*, genotype RX601 (Asgrow, Des Moines, Iowa), shoots harvested at 10 days after planting from plants which are grown in a greenhouse in a high $CO_2$ environment (~1000 ppm $CO_2$). The ESTs of the present invention can enable the acquisition of, but are not limited to genes involved in photosynthesis and respiration, therefore, the ESTs of the present invention will find great use in the isolation of a variety of agronomically significant genes, including but not limited to, genes that regulate light and dark respiration, $CO_2$ assimilation, photosynthesis, developmental stress, proteins, oils, amino acids, sterols, minerals, isoflavones, saponins, vitamins, tocopherols, antinutrient components, carbohydrates, and starch metabolism. Such genes are associated with plant growth, quality and yield, and could also serve as links in important developmental, metabolic, and catabolic pathways. Libraries from this tissue can enable the acquisition of a variety of agronomically significant genes involved in the synthesis and catabolism of commercially important traits.

The nucleic acid molecules and fragments thereof of the present invention are generated from the cDNA library, LIB3079, prepared from *Zeas mays* dissected kernel tissue including the lower endosperm and the basal endosperm transfer region. This tissue was harvested from plants beyond the V10 stage grown under greenhouse conditions. Libraries from this tissue can enable the acquisition of a variety of agronomically significant genes involved in the synthesis and catabolism of commercially important traits. The ESTs of the present invention can enable the acquisition of, including but not limited to genes that regulate protein, oils, amino acids, sterols, minerals, isoflavones, saponins, vitamins, tocopherols, antinutrient components, carbohydrates, starch metabolism and seed regulatory elements. Such genes are associated with plant growth, quality and yield, and could also serve as links in important developmental, metabolic, and catabolic pathways.

The nucleic acid molecules and fragments thereof of the present invention are generated from the cDNA library, LIB3088, prepared from *Zeas mays* kernels from immature ear tissue harvested from eight week old plants grown in a green house. Libraries from this tissue can enable the acquisition of a variety of agronomically significant genes involved in the synthesis and catabolism of commercially important traits. The ESTs of the present invention can enable the acquisition of, including but not limited to genes that regulate protein, oils, amino acids, sterols, minerals, isoflavones, saponins, vitamins, tocopherols, antinutrient components, carbohydrates, starch metabolism and seed regulatory elements. Such genes are associated with plant growth, quality and yield, and could also serve as links in important developmental, metabolic, and catabolic pathways.

The nucleic acid molecules and fragments thereof of the present invention are generated from the cDNA library, LIB3114, prepared from maize silks harvested from plants which are beyond the V10 stage. Libraries from this tissue can enable the acquisition of a variety of agronomically significant genes involved in the synthesis and catabolism of commercially important traits. The ESTs of the present invention can enable the acquisition of, including but not limited to, non-regulatory genes and genes that regulate protein, oils, amino acids, sterols, minerals, isoflavones, saponins, vitamins, tocopherols, antinutrient components, carbohydrates, starch metabolism and seed regulatory elements. Such genes are associated with plant growth, quality and yield, and could also serve as links in important developmental, metabolic, and catabolic pathways.

Nucleic acid molecules and fragments thereof of the present invention may be employed to obtain other nucleic acid molecules. Such molecules include the nucleic acid molecules of other plants or other organisms (e.g., alfalfa, rice, potato, cotton, oat, rye, barley, maize, wheat, *Arabidopsis*, *Brassica*, etc.) including the nucleic acid molecules that encode, in whole or in part, protein homologues of other plant species or other organisms, and sequences of genetic elements such as promoters and transcriptional regulatory elements. Such molecules can be readily obtained by using the above-described nucleic acid molecules or fragments thereof to screen cDNA or genomic libraries obtained from such plant species. Methods for forming such libraries are well known in the art. Such homologue molecules may differ in their nucleotide sequences from those found in one or more of SEQ ID NO:1 through SEQ ID NO:83523 or complements thereof because complete complementarity is not needed for stable hybridization. The nucleic acid molecules of the present invention therefore also include molecules that, although capable of specifically hybridizing with the nucleic acid molecules may lack "complete complementarity."

Any of a variety of methods may be used to obtain one or more of the above-described nucleic acid molecules (Zamechik et al., *Proc. Natl. Acad. Sci.* (U.S.A.) 83:4143-4146 (1986), the entirety of which is herein incorporated by reference; Goodchild et al., *Proc. Natl. Acad. Sci.* (U.S.A.) 85:5507-5511 (1988), the entirety of which is herein incorporated by reference; Wickstrom et al., *Proc. Natl. Acad. Sci.* (U.S.A.) 85:1028-1032 (1988), the entirety of which is herein incorporated by reference; Holt, et al., *Molec. Cell. Biol.* 8:963-973 (1988), the entirety of which is herein incorporated by reference; Gerwirtz, et al., *Science* 242:1303-1306 (1988), the entirety of which is herein incorporated by reference; Anfossi, et al., *Proc. Natl. Acad. Sci.* (U.S.A.) 86:3379-3383 (1989), the entirety of which is herein incorporated by reference; Becker, et al., *EMBO J.* 8:3685-3691 (1989); the entirety of which is herein incorporated by reference). Automated nucleic acid synthesizers may be employed for this purpose. In lieu of such synthesis, the disclosed nucleic acid molecules may be used to define a pair of primers that can be used with the polymerase chain reaction (Mullis, et al., *Cold Spring Harbor Symp. Quant. Biol.* 51:263-273 (1986); Erlich et al., EP 50,424; EP 84,796, EP 258,017, EP 237,362; Mullis, EP 201,184; Mullis et al., U.S. Pat. No. 4,683,202; Erlich, U.S. Pat. No. 4,582,788; and Saiki, R. et al., U.S. Pat. No. 4,683,194, all of which are hereby incorporated by reference in their entirety) to amplify and obtain any desired nucleic acid molecule or fragment.

Promoter sequence(s) and other genetic elements including but not limited to transcriptional regulatory elements associated with one or more of the disclosed nucleic acid sequences can also be obtained using the disclosed nucleic acid sequences provided herein.

In one embodiment, such sequences are obtained by incubating EST nucleic acid molecules or preferably fragments thereof with members of genomic libraries (e.g. maize and soybean) and recovering clones that hybridize to the EST nucleic acid molecule or fragment thereof. In a second embodiment, methods of "chromosome walking," or inverse PCR may be used to obtain such sequences (Frohman, et al., *Proc. Natl. Acad. Sci.* (U.S.A.) 85:8998-9002 (1988); Ohara, et al., *Proc. Natl. Acad. Sci.* (U.S.A.) 86: 5673-5677 (1989); Pang et al., *Biotechniques,* 22(6); 1046-1048 (1977); Huang et al., *Methods Mol. Biol.* 69: 89-96 (1977); Hartl et al., *Methods Mol. Biol.* 58: 293-301 (1996), all of which are hereby incorporated by reference in their entirety). In one embodiment, the disclosed nucleic acid molecules are used to identify cDNAs whose analogous genes contain promoters with desirable expression patterns. The nucleic acid molecules isolated from the library of the present invention are used to isolate promoters of tissue-enhanced, tissue-specific, developmentally- or environmentally-regulated expression profiles. Isolation and functional analysis of the 5' flanking promoter sequences of these genes from genomic libraries, for example, using genomic screening methods and PCR techniques would result in the isolation of useful promoters and transcriptional regulatory elements. These methods are known to those of skill in the art and have been described (See for example Birren et al., *Genome Analysis:Analyzing DNA,* 1, (1997), Cold Spring Harbor Laboratory Press, Cold Spring Harbor, N.Y., the entirety of which is herein incorporated by reference).

Promoters obtained utilizing the nucleic acid molecules of the present invention could also be modified to affect their control characteristics. Examples of such modifications would include but are not limited to enhancer sequences as reported by Kay et al., *Science* 236:1299 (1987), herein incorporated by reference in its entirety. Such genetic elements could be used to enhance gene expression of new and existing traits for crop improvements.

The nucleic acid molecules of the present invention may be used to isolate promoters of tissue enhanced tissue specific, cell-specific, cell-type, developmentally or environmentally regulated expression profiles. Isolation and functional analysis of the 5' flanking promoter sequences of these genes from genomic libraries, for example, using genomic screening methods and PCR techniques would result in the isolation of useful promoters and transcriptional regulatory elements. These methods are known to those of skill in the art and have been described (See, for example, Birren et. al., *Genome Analysis: Analyzing DNA,* 1, Cold Spring Harbor Laboratory Press, Cold Spring Harbor, N.Y. (1997), the entirety of which is herein incorporated by reference). Promoters obtained utilizing the nucleic acid molecules of the present invention could also be modified to affect their control characteristics. Examples of such modifications would include but are not limited to enhancer sequences as reported by Kay, et al *Science* 236:1299 (1987), herein incorporated reference in its entirety. Such genetic elements could be used to enhance gene expression of new and existing traits for crop improvements.

In an aspect of the present invention, one or more of the nucleic molecules of the present invention are used to determine whether a plant (preferably maize) has a mutation affecting the level (i.e., the concentration of mRNA in a sample, etc.) or pattern (i.e., the kinetics of expression, rate of decomposition, stability profile, etc.) of the expression encoded in part or whole by one or more of the nucleic acid molecules of the present invention (collectively, the "Expression Response" of a cell or tissue). As used herein, the Expression Response manifested by a cell or tissue is said to be "altered" if it differs from the Expression Response of cells or tissues of plants not exhibiting the phenotype. To determine whether a Expression Response is altered, the Expression Response manifested by the cell or tissue of the plant exhibiting the phenotype is compared with that of a similar cell or tissue sample of a plant not exhibiting the phenotype. As will be appreciated, it is not necessary to re-determine the Expression Response of the cell or tissue sample of plants not exhibiting the phenotype each time such a comparison is made; rather, the Expression Response of a particular plant may be compared with previously obtained values of normal plants. As used herein, the phenotype of the organism is any of one or more characteristics of an organism (e.g. disease resistance, pest tolerance, environmental tolerance, male sterility, yield, quality improvements, etc.). A change in genotype or phenotype may be transient or permanent. Also as used herein, a tissue sample is any sample that comprises more than one cell. In a preferred aspect, a tissue sample comprises cells that share a common characteristic (e.g. derived from leaf, root, or pollen etc).

In one sub-aspect, such an analysis is conducted by determining the presence and/or identity of polymorphism(s) by one or more of the nucleic acid molecules of the present invention and more specifically, one or more of the EST nucleic acid molecules or fragments thereof which are associated with phenotype, or a predisposition to phenotype.

Any of a variety of molecules can be used to identify such polymorphism(s). In one embodiment, one or more of the EST nucleic acid molecules (or a sub-fragment thereof) may be employed as a marker nucleic acid molecule to identify such polymorphism(s). Alternatively, such polymorphisms can be detected through the use of a marker nucleic acid molecule or a marker protein that is genetically linked to (i.e., a polynucleotide that co-segregates with) such polymorphism(s).

In an alternative embodiment, such polymorphisms can be detected through the use of a marker nucleic acid molecule that is physically linked to such polymorphism(s). For this purpose, marker nucleic acid molecules comprising a nucleotide sequence of a polynucleotide located within 1 mb of the polymorphism(s), and more preferably within 100 kb of the polymorphism(s), and most preferably within 10 kb of the polymorphism(s) can be employed.

The genomes of animals and plants naturally undergo spontaneous mutation in the course of their continuing evolution (Gusella, *Ann. Rev. Biochem.* 55:831-854 (1986)). A "polymorphism" is a variation or difference in the sequence of the gene or its flanking regions that arises in some of the members of a species. The variant sequence and the "original" sequence co-exist in the species' population. In some instances, such co-existence is in stable or quasi-stable equilibrium.

A polymorphism is thus said to be "allelic," in that, due to the existence of the polymorphism, some members of a species may have the original sequence (i.e., the original "allele") whereas other members may have the variant sequence (i.e., the variant "allele"). In the simplest case, only one variant sequence may exist, and the polymorphism is thus said to be di-allelic. In other cases, the species' population may contain multiple alleles, and the polymorphism is termed tri-allelic, etc. A single gene may have multiple different unrelated polymorphisms. For example, it may have a di-allelic polymorphism at one site, and a multi-allelic polymorphism at another site.

The variation that defines the polymorphism may range from a single nucleotide variation to the insertion or deletion of extended regions within a gene. In some cases, the DNA sequence variations are in regions of the genome that are characterized by short tandem repeats (STRs) that include tandem di- or tri-nucleotide repeated motifs of nucleotides. Polymorphisms characterized by such tandem repeats are referred to as "variable number tandem repeat" ("VNTR") polymorphisms. VNTRs have been used in identity analysis (Weber, U.S. Pat. No. 5,075,217; Armour, et al., *FEBS Lett.* 307:113-115 (1992); Jones, et al., *Eur. J. Haematol.* 39:144-147 (1987); Horn, et al., PCT Application WO91/14003; Jeffreys, European Patent Application 370,719; Jeffreys, U.S. Pat. No. 5,699,082; Jeffreys. et al., *Amer. J. Hum. Genet.* 39:11-24 (1986); Jeffreys. et al., *Nature* 316:76-79 (1985); Gray, et al., *Proc. R. Acad. Soc. Lond.* 243:241-253 (1991); Moore, et al., *Genomics* 10:654-660 (1991); Jeffreys, et al., *Anim. Genet.* 18:1-15 (1987); Hillel, et al., *Anim. Genet.* 20:145-155 (1989); Hillel, et al., *Genet.* 124:783-789 (1990), all of which are herein incorporated by reference in their entirety).

The detection of polymorphic sites in a sample of DNA may be facilitated through the use of nucleic acid amplification methods. Such methods specifically increase the concentration of polynucleotides that span the polymorphic site, or include that site and sequences located either distal or proximal to it. Such amplified molecules can be readily detected by gel electrophoresis or other means.

The most preferred method of achieving such amplification employs the polymerase chain reaction ("PCR") (Mullis, et al., *Cold Spring Harbor Symp. Quant. Biol.* 51:263-273 (1986); Erlich, et al., European Patent Appln. 50,424; European Patent Appln. 84,796, European Patent Application 258, 017, European Patent Appln. 237,362; Mullis, European Patent Appln. 201,184; Mullis, et al., U.S. Pat. No. 4,683,202; Erlich., U.S. Pat. No. 4,582,788; and Saiki, et al., U.S. Pat. No. 4,683,194, all of which are herein incorporated by reference), using primer pairs that are capable of hybridizing to the proximal sequences that define a polymorphism in its double-stranded form.

In lieu of PCR, alternative methods, such as the "Ligase Chain Reaction" ("LCR") may be used (Barany, *Proc. Natl. Acad. Sci.* (U.S.A.) 88:189-193 (1991), the entirety of which is herein incorporated by reference). LCR uses two pairs of oligonucleotide probes to exponentially amplify a specific target. The sequences of each pair of oligonucleotides is selected to permit the pair to hybridize to abutting sequences of the same strand of the target. Such hybridization forms a substrate for a template-dependent ligase. As with PCR, the resulting products thus serve as a template in subsequent cycles and an exponential amplification of the desired sequence is obtained.

LCR can be performed with oligonucleotides having the proximal and distal sequences of the same strand of a polymorphic site. In one embodiment, either oligonucleotide will be designed to include the actual polymorphic site of the polymorphism. In such an embodiment, the reaction conditions are selected such that the oligonucleotides can be ligated together only if the target molecule either contains or lacks the specific nucleotide that is complementary to the polymorphic site present on the oligonucleotide. Alternatively, the oligonucleotides may be selected such that they do not include the polymorphic site (see, Segev, PCT Application WO 90/01069, the entirety of which is herein incorporated by reference).

The "Oligonucleotide Ligation Assay" ("OLA") may alternatively be employed (Landegren, et al., *Science* 241:1077-1080 (1988), the entirety of which is herein incorporated by reference). The OLA protocol uses two oligonucleotides which are designed to be capable of hybridizing to abutting sequences of a single strand of a target. OLA, like LCR, is particularly suited for the detection of point mutations. Unlike LCR, however, OLA results in "linear" rather than exponential amplification of the target sequence.

Nickerson, et al. have described a nucleic acid detection assay that combines attributes of PCR and OLA (Nickerson, et al., *Proc. Natl. Acad. Sci.* (U.S.A.) 87:8923-8927 (1990), the entirety of which is herein incorporated by reference). In this method, PCR is used to achieve the exponential amplification of target DNA, which is then detected using OLA. In addition to requiring multiple, and separate, processing steps, one problem associated with such combinations is that they inherit all of the problems associated with PCR and OLA.

Schemes based on ligation of two (or more) oligonucleotides in the presence of nucleic acid having the sequence of the resulting "di-oligonucleotide", thereby amplifying the di-oligonucleotide, are also known (Wu, et al., *Genomics* 4:560 (1989), the entirety of which is herein incorporated by reference), and may be readily adapted to the purposes of the present invention.

Other known nucleic acid amplification procedures, such as allele-specific oligomers, branched DNA technology, transcription-based amplification systems, or isothermal amplification methods may also be used to amplify and analyze such polymorphisms (Malek, et al., U.S. Pat. No. 5,130,238; Davey, et al., European Patent Application 329,822; Schuster et al., U.S. Pat. No. 5,169,766; Miller, et al., PCT Application WO 89/06700; Kwoh, et al., *Proc. Natl. Acad. Sci.* (U.S.A.) 86:1173-1177 (1989); Gingeras, et al., PCT Application WO 88/10315; Walker, et al., *Proc. Natl. Acad. Sci.* (U.S.A.) 89:392-396 (1992), all of which are herein incorporated by reference in their entirety).

The identification of a polymorphism can be determined in a variety of ways. By correlating the presence or absence of it in a plant with the presence or absence of a phenotype, it is possible to predict the phenotype of that plant. If a polymorphism creates or destroys a restriction endonuclease cleavage site, or if it results in the loss or insertion of DNA (e.g., a VNTR polymorphism), it will alter the size or profile of the DNA fragments that are generated by digestion with that restriction endonuclease. As such, individuals that possess a variant sequence can be distinguished from those having the original sequence by restriction fragment analysis. Polymorphisms that can be identified in this manner are termed "restriction fragment length polymorphisms" ("RFLPs"). RFLPs have been widely used in human and plant genetic analyses (Glassberg, UK Patent Application 2135774; Skolnick, et al., *Cytogen. Cell Genet.* 32:58-67 (1982); Botstein, et al., *Ann. J. Hum. Genet.* 32:314-331 (1980); Fischer, et al. (PCT Application WO90/13668); Uhlen, PCT Application WO90/11369).

Polymorphisms can also be identified by Single Strand Conformation Polymorphism (SSCP) analysis. The SSCP technique is a method capable of identifying most sequence variations in a single strand of DNA, typically between 150 and 250 nucleotides in length (Elles, *Methods in Molecular Medicine: Molecular Diagnosis of Genetic Diseases*, Humana Press (1996), the entirety of which is herein incorporated by reference); Orita et al., *Genomics* 5: 874-879 (1989), the entirety of which is herein incorporated by reference). Under denaturing conditions a single strand of DNA will adopt a conformation that is uniquely dependent on its sequence conformation. This conformation usually will be different, even if only a single base is changed. Most conformations have been reported to alter the physical configuration or size sufficiently to be detectable by electrophoresis. A number of protocols have been described for SSCP including, but not limited to Lee et al., *Anal. Biochem.* 205: 289-293 (1992), the entirety of which is herein incorporated by reference; Suzuki et al., *Anal. Biochem.* 192: 82-84 (1991), the entirety of which is herein incorporated by reference; Lo et al., *Nucleic Acids Research* 20: 1005-1009 (1992), the entirety of which is herein incorporated by reference; Sarkar et al., *Genomics* 13: 441-443 (1992), the entirety of which is herein incorporated by reference). It is understood that one or more of the nucleic acids of the present invention, may be utilized as markers or probes to detect polymorphisms by SSCP analysis.

Polymorphisms may also be found using a DNA fingerprinting technique called amplified fragment length polymorphism (AFLP), which is based on the selective PCR amplification of restriction fragments from a total digest of genomic DNA to profile that DNA. Vos, et al., *Nucleic Acids Res.* 23:4407-4414 (1995), the entirety of which is herein incorporated by reference. This method allows for the specific co-amplification of high numbers of restriction fragments, which can be visualized by PCR without knowledge of the nucleic acid sequence.

AFLP employs basically three steps. Initially, a sample of genomic DNA is cut with restriction enzymes and oligonucleotide adapters are ligated to the restriction fragments of the DNA. The restriction fragments are then amplified using PCR by using the adapter and restriction sequence as target sites for primer annealing. The selective amplification is achieved by the use of primers that extend into the restriction fragments, amplifying only those fragments in which the primer extensions match the nucleotide flanking the restriction sites. These amplified fragments are then visualized on a denaturing polyacrylamide gel.

AFLP analysis has been performed on *Salix* (Beismann, et al., *Mol. Ecol.* 6:989-993 (1997), the entirety of which is herein incorporated by reference); *Acinetobacter* (Janssen, et al., *Int. J. Syst. Bacteriol* 47:1179-1187 (1997), the entirety of which is herein incorporated by reference), *Aeromonas popoffi* (Huys, et al., *Int. J. Syst. Bacteriol.* 47:1165-1171 (1997), the entirety of which is herein incorporated by reference), rice (McCouch, et al., *Plant Mol. Biol.* 35:89-99 (1997), the entirety of which is herein incorporated by reference); Nandi, et al., *Mol. Gen. Genet.* 255:1-8 (1997); Cho, et al., *Genome* 39:373-378 (1996), herein incorporated by reference), barley (*Hordeum vulgare*) (Simons, et al., *Genomics* 44:61-70 (1997), the entirety of which is herein incorporated by reference; Waugh, et al., *Mol. Gen. Genet.* 255:311-321

(1997), the entirety of which is herein incorporated by reference; Qi, et al., *Mol. Gen Genet.* 254:330-336 (1997), the entirety of which is herein incorporated by reference; Becker, et al., *Mol. Gen. Genet.* 249:65-73 (1995), the entirety of which is herein incorporated by reference), potato (Van der Voort, et al., *Mol. Gen. Genet.* 255:438-447 (1997), the entirety of which is herein incorporated by reference; Meksem, et al., *Mol. Gen. Genet.* 249:74-81 (1995), the entirety of which is herein incorporated by reference), *Phytophthora infestans* (Van der Lee, et al., *Fungal Genet. Biol.* 21:278-291 (1997), the entirety of which is herein incorporated by reference), *Bacillus anthracis* (Keim, et al., *J. Bacteriol.* 179:818-824 (1997)), *Astragalus cremnophylax* (Travis, et al., *Mol. Ecol.* 5:735-745 (1996), the entirety of which is herein incorporated by reference), *Arabidopsis* (Cnops, et al., *Mol. Gen. Genet.* 253:32-41 (1996), the entirety of which is herein incorporated by reference), *Escherichia coli* (Lin, et al., *Nucleic Acids Res.* 24:3649-3650 (1996), the entirety of which is herein incorporated by reference), *Aeromonas* (Huys, et al., *Int. J. Syst. Bacteriol.* 46:572-580 (1996), the entirety of which is herein incorporated by reference), nematode (Folkertsma, et al., *Mol. Plant Microbe Interact.* 9:47-54 (1996), the entirety of which is herein incorporated by reference), tomato (Thomas, et al., *Plant J.* 8:785-794 (1995), the entirety of which is herein incorporated by reference), and human (Latorra, et al., *PCR Methods Appl.* 3:351-358 (1994)). AFLP analysis has also been used for fingerprinting mRNA (Money, et al., *Nucleic Acids Res.* 24:2616-2617 (1996), the entirety of which is herein incorporated by reference; Bachem, et al., *Plant J.* 9:745-753 (1996), the entirety of which is herein incorporated by reference). It is understood that one or more of the nucleic acids of the present invention, may be utilized as markers or probes to detect polymorphisms by AFLP analysis for fingerprinting mRNA.

Polymorphisms may also be found using random amplified polymorphic DNA (RAPD) (Williams et al., *Nucl. Acids Res.* 18: 6531-6535 (1990), the entirety of which is herein incorporated by reference) and cleavable amplified polymorphic sequences (CAPS) (Lyamichev et al., *Science* 260: 778-783 (1993), the entirety of which is herein incorporated by reference). It is understood that one or more of the nucleic acids of the present invention, may be utilized as markers or probes to detect polymorphisms by RAPD or CAPS analysis.

Polymorphisms are useful, through linkage analysis, to define the genetic distances or physical distances between polymorphic traits. A physical map or ordered array of genomic DNA fragments in the desired region containing the gene may be used to characterize and isolate genes corresponding to desirable traits. For this purpose, yeast artificial chromosomes (YACs), bacterial artificial chromosomes (BACs), and cosmids are appropriate vectors for cloning large segments of DNA molecules. Although fewer clones are needed to make a contig for a specific genomic region by using YACs (Agyare et al., *Genome Res.* 7: 1-9 (1997), the entirety of which is herein incorporated by reference; James et al., *Genomics* 32: 425-430 (1996), the entirety of which is herein incorporated by reference), chimerism in the inserted DNA fragment can arise. Cosmids are convenient for handling smaller-size DNA molecules and may be used for transformation in developing transgenic plants. BACs also carry DNA fragments and are less prone to chimerism.

Through genetic mapping, a fine scale linkage map can be developed using DNA markers and, then, a genomic DNA library of large-sized fragments can be screened with molecular markers linked to the desired trait. Molecular markers are advantageous for agronomic traits that are otherwise difficult to tag, such as resistance to pathogens, insects and nematodes, tolerance to abiotic stress, quality parameters and quantitative traits such as high yield potential.

The essential requirements for marker-assisted selection in a plant breeding program are: (1) the marker(s) should co-segregate or be closely linked with the desired trait; (2) an efficient means of screening large populations for the molecular marker(s) should be available; and (3) the screening technique should have high reproducibility across laboratories and preferably be economical to use and be user-friendly.

The genetic linkage of marker molecules can be established by a gene mapping model such as, without limitation, the flanking marker model reported by Lander and Botstein, *Genetics* 121:185-199 (1989) and the interval mapping, based on maximum likelihood methods described by Lander and Botstein, *Genetics* 121:185-199 (1989) and implemented in the software package MAPMAKER/QTL (Lincoln and Lander, *Mapping Genes Controlling Quantitative Traits Using MAPMAKER/QTL*, Whitehead Institute for Biomedical Research, Massachusetts, (1990). Additional software includes Qgene, Version 2.23 (1996), Department of Plant Breeding and Biometry, 266 Emerson Hall, Cornell University, Ithaca, N.Y., the manual of which is herein incorporated by reference in its entirety). Use of Qgene software is a particularly preferred approach.

A maximum likelihood estimate (MLE) for the presence of a marker is calculated, together with an MLE assuming no QTL effect, to avoid false positives. A $\log_{10}$ of an odds ratio (LOD) is then calculated as: LOD=$\log_{10}$ (MLE for the presence of a QTL/MLE given no linked QTL).

The LOD score essentially indicates how much more likely the data are to have arisen assuming the presence of a QTL than in its absence. The LOD threshold value for avoiding a false positive with a given confidence, say 95%, depends on the number of markers and the length of the genome. Graphs indicating LOD thresholds are set forth in Lander and Botstein, *Genetics* 121:185-199 (1989) the entirety of which is herein incorporated by reference and further described by Arús and Moreno-González, *Plant Breeding*, Hayward et al., (eds.) Chapman & Hall, London, pp. 314-331 (1993), the entirety of which is herein incorporated by reference.

Additional models can be used. Many modifications and alternative approaches to interval mapping have been reported, including the use of non-parametric methods (Kruglyak and Lander, *Genetics* 139:1421-1428 (1995), the entirety of which is herein incorporated by reference). Multiple regression methods or models can be also be used, in which the trait is regressed on a large number of markers (Jansen, *Biometrics in Plant Breeding*, van Oijen and Jansen (eds.), Proceedings of the Ninth Meeting of the Eucarpia Section Biometrics in Plant Breeding, The Netherlands, pp. 116-124 (1994); Weber and Wricke, *Advances in Plant Breeding*, Blackwell, Berlin, 16 (1994), both of which is herein incorporated by reference in their entirety). Procedures combining interval mapping with regression analysis, whereby the phenotype is regressed onto a single putative QTL at a given marker interval and at the same time onto a number of markers that serve as 'cofactors,' have been reported by Jansen and Stam, *Genetics* 136:1447-1455 (1994), the entirety of which is herein incorporated by reference and Zeng, *Genetics* 136:1457-1468 (1994) the entirety of which is herein incorporated by reference. Generally, the use of cofactors reduces the bias and sampling error of the estimated QTL positions (Utz and Melchinger, *Biometrics in Plant Breeding*, van Oijen and Jansen (eds.) Proceedings of the Ninth Meeting of the Eucarpia Section Biometrics in Plant Breeding, The Netherlands, pp. 195-204 (1994), the entirety of which is herein incorporated by reference, thereby improving the precision and efficiency of QTL mapping (Zeng, *Genetics* 136:1457-1468 (1994)). These models can be extended to multi-environment experiments to analyze genotype-environment interactions (Jansen et al., *Theo. Appl. Genet.* 91:33-37 (1995), the entirety of which is herein incorporated by reference).

Selection of an appropriate mapping population is important to map construction. The choice of an appropriate mapping population depends on the type of marker systems employed (Tanksley et al., *Molecular mapping plant chromosomes. Chromosome structure and function: Impact of new concepts*, Gustafson and Appels (eds.), Plenum Press, New York, pp 157-173 (1988), the entirety of which is herein incorporated by reference). Consideration must be given to the source of parents (adapted vs. exotic) used in the mapping population. Chromosome pairing and recombination rates can be severely disturbed (suppressed) in wide crosses (adapted×exotic) and generally yield greatly reduced linkage distances. Wide crosses will usually provide segregating populations with a relatively large array of polymorphisms when compared to progeny in a narrow cross (adapted×adapted).

An $F_2$ population is the first generation of selfing after the hybrid seed is produced. Usually a single $F_1$ plant is selfed to generate a population segregating for all the genes in Mendelian (1:2:1) fashion. Maximum genetic information is obtained from a completely classified $F_2$ population using a codominant marker system (Mather, *Measurement of Linkage in Heredity*, Methuen and Co., (1938), the entirety of which is herein incorporated by reference). In the case of dominant markers, progeny tests (e.g. $F_3$, $BCF_2$) are required to identify the heterozygotes, thus making it equivalent to a completely classified $F_2$ population. However, this procedure is often prohibitive because of the cost and time involved in progeny testing. Progeny testing of $F_2$ individuals is often used in map construction where phenotypes do not consistently reflect genotype (e.g. disease resistance) or where trait expression is controlled by a QTL. Segregation data from progeny test populations (e.g. $F_3$ or $BCF_2$) can be used in map construction. Marker-assisted selection can then be applied to cross progeny based on marker-trait map associations ($F_2$, $F_3$), where linkage groups have not been completely disassociated by recombination events (i.e., maximum disequilibrium).

Recombinant inbred lines (RIL) (genetically related lines; usually >$F_5$, developed from continuously selfing $F_2$ lines towards homozygosity) can be used as a mapping population. Information obtained from dominant markers can be maximized by using RIL because all loci are homozygous or nearly so. Under conditions of tight linkage (i.e., about <10% recombination), dominant and co-dominant markers evaluated in RIL populations provide more information per individual than either marker type in backcross populations (Reiter et al., *Proc. Natl. Acad Sci.* (U.S.A.) 89:1477-1481 (1992), the entirety of which is herein incorporated by reference). However, as the distance between markers becomes larger (i.e., loci become more independent), the information in RIL populations decreases dramatically when compared to codominant markers.

Backcross populations (e.g., generated from a cross between a successful variety (recurrent parent) and another variety (donor parent) carrying a trait not present in the former) can be utilized as a mapping population. A series of backcrosses to the recurrent parent can be made to recover most of its desirable traits. Thus a population is created consisting of individuals nearly like the recurrent parent but each individual carries varying amounts or mosaic of genomic regions from the donor parent. Backcross populations can be useful for mapping dominant markers if all loci in the recurrent parent are homozygous and the donor and recurrent parent have contrasting polymorphic marker alleles (Reiter et al., *Proc. Natl. Acad. Sci.* (U.S.A.) 89:1477-1481 (1992)). Information obtained from backcross populations using either codominant or dominant markers is less than that obtained from $F_2$ populations because one, rather than two, recombinant gametes are sampled per plant. Backcross populations, however, are more informative (at low marker saturation) when compared to RILs as the distance between linked loci increases in RIL populations (i.e. about 15% recombination). Increased recombination can be beneficial for resolution of tight linkages, but may be undesirable in the construction of maps with low marker saturation.

Near-isogenic lines (NIL) created by many backcrosses to produce an array of individuals that are nearly identical in genetic composition except for the trait or genomic region under interrogation can be used as a mapping population. In mapping with NILs, only a portion of the polymorphic loci are expected to map to a selected region.

Bulk segregant analysis (BSA) is a method developed for the rapid identification of linkage between markers and traits of interest (Michelmore et al., *Proc. Natl. Acad. Sci.* (U.S.A.) 88:9828-9832 (1991), the entirety of which is herein incorporated by reference). In BSA, two bulked DNA samples are drawn from a segregating population originating from a single cross. These bulks contain individuals that are identical for a particular trait (resistant or susceptible to particular disease) or genomic region but arbitrary at unlinked regions (i.e. heterozygous). Regions unlinked to the target region will not differ between the bulked samples of many individuals in BSA.

It is understood that one or more of the nucleic acid molecules of the present invention may be used as molecular markers. It is also understood that one or more of the protein molecules of the present invention may be used as molecular markers.

In accordance with this aspect of the present invention, a sample nucleic acid is obtained from plants cells or tissues. Any source of nucleic acid may be used. Preferably, the nucleic acid is genomic DNA. The nucleic acid is subjected to restriction endonuclease digestion. For example, one or more EST nucleic acid molecule or fragment thereof can be used as a probe in accordance with the above-described polymorphic methods. The polymorphism obtained in this approach can then be cloned to identify the mutation at the coding region which alters the protein's structure or regulatory region of the gene which affects its expression level.

In one aspect of the present invention, an evaluation can be conducted to determine whether a particular mRNA molecule is present. One or more of the nucleic acid molecules of the present invention, preferably one or more of the EST nucleic acid molecules of the present invention are utilized to detect the presence or quantity of the mRNA species. Such molecules are then incubated with cell or tissue extracts of a plant under conditions sufficient to permit nucleic acid hybridization. The detection of double-stranded probe-mRNA hybrid molecules is indicative of the presence of the mRNA; the amount of such hybrid formed is proportional to the amount of mRNA. Thus, such probes may be used to ascertain the level and extent of the mRNA production in a plant's cells or tissues. Such nucleic acid hybridization may be conducted under quantitative conditions (thereby providing a numerical value of the amount of the mRNA present). Alternatively, the assay may be conducted as a qualitative assay that indicates either that the mRNA is present, or that its level exceeds a user set, predefined value.

A principle of in situ hybridization is that a labeled, single-stranded nucleic acid probe will hybridize to a complementary strand of cellular DNA or RNA and, under the appropriate conditions, these molecules will form a stable hybrid. When nucleic acid hybridization is combined with histological techniques, specific DNA or RNA sequences can be identified within a single cell. An advantage of in situ hybridization over more conventional techniques for the detection of nucleic acids is that it allows an investigator to determine the precise spatial population (Angerer et al., *Dev. Biol.* 101: 477-484 (1984), the entirety of which is herein incorporated by reference; Angerer et al., *Dev. Biol.* 112: 157-166 (1985), the entirety of which is herein incorporated by reference; Dixon et al., *EMBO J.* 10: 1317-1324 (1991), the entirety of which is herein incorporated by reference). In situ hybridization may be used to measure the steady-state level of RNA accumulation. It is a sensitive technique and RNA sequences present in as few as 5-10 copies per cell can be detected (Hardin et al., *J. Mol. Biol.* 202: 417-431. (1989), the entirety of which is herein incorporated by reference). A number of protocols have been devised for in situ hybridization, each with tissue preparation, hybridization, and washing conditions (Meyerowitz, *Plant Mol. Biol. Rep.* 5: 242-250 (1987), the entirety of which is herein incorporated by reference; Cox and Goldberg, In: *Plant Molecular Biology: A Practical Approach* (ed. C. H. Shaw), pp. 1-35. IRL Press, Oxford (1988), the entirety of which is herein incorporated by reference; Raikhel et al., *In situ RNA hybridization in plant tissues*. In *Plant Molecular Biology Manual*, vol. B9: 1-32. Kluwer Academic Publisher, Dordrecht, Belgium (1989), the entirety of which is herein incorporated by reference).

In situ hybridization also allows for the localization of proteins within a tissue or cell (Wilkinson, *In Situ Hybridization*, Oxford University Press, Oxford (1992), the entirety of which is herein incorporated by reference; Langdale, *In Situ Hybridization* 165-179 In: *The Maize Handbook*, eds. Freeling and Walbot, Springer-Verlag, New York (1994), the entirety of which is herein incorporated by reference). It is understood that one or more of the molecules of the present invention, preferably one or more of the EST nucleic acid molecules of the present invention or one or more of the antibodies of the present invention may be utilized to detect the level or pattern of a protein or fragment thereof by in situ hybridization.

Fluorescent in situ hybridization also enables the localization of a particular DNA sequence along a chromosome which is useful, among other uses, for gene mapping, following chromosomes in hybrid lines or detecting chromosomes with translocations, transversions or deletions. In situ hybridization has been used to identify chromosomes in several plant species (Griffor et al., *Plant Mol. Biol.* 17: 101-109 (1991), the entirety of which is herein incorporated by reference; Gustafson et al., *Proc. Nat'l. Acad. Sci.* (U.S.A.). 87: 1899-1902 (1990), herein incorporated by reference; Mukai and Gill, *Genome* 34: 448-452. (1991); Schwarzacher and Heslop-Harrison, *Genome* 34: 317-323 (1991); Wang et al., *Jpn. J. Genet.* 66: 313-316 (1991), the entirety of which is herein incorporated by reference; Parra and Windle, *Nature Genetics*, 5: 17-21 (1993), the entirety of which is herein incorporated by reference). It is understood that the nucleic acid molecules of the present invention may be used as probes or markers to localize sequences along a chromosome.

It is also understood that one or more of the molecules of the present invention, preferably one or more of the EST nucleic acid molecules of the present invention or one or more of the antibodies of the present invention may be utilized to detect the expression level or pattern of a protein or mRNA thereof by in situ hybridization.

Another method to localize the expression of a molecule is tissue printing. Tissue printing provides a way to screen, at the same time on the same membrane many tissue sections from different plants or different developmental stages. Tissue-printing procedures utilize films designed to immobilize proteins and nucleic acids. In essence, a freshly cut section of an organ is pressed gently onto nitrocellulose paper, nylon membrane or polyvinylidene difluoride membrane. Such membranes are commercially available (e.g. Millipore, Bedford, Mass.) The contents of the cut cell transfer onto the membrane, and the molecules are immobilized to the membrane. The immobilized molecules form a latent print that can be visualized with appropriate probes. When a plant tissue print is made on nitrocellulose paper, the cell walls leave a physical print that makes the anatomy visible without further treatment (Varner and Taylor, *Plant Physiol.* 91: 31-33 (1989), the entirety of which is herein incorporated by reference).

Tissue printing on substrate films is described by Daoust, *Exp. Cell Res.* 12: 203-211 (1957), the entirety of which is herein incorporated by reference, who detected amylase, protease, ribonuclease, and deoxyribonuclease in animal tissues using starch, gelatin, and agar films. These techniques can be applied to plant tissues (Yomo and Taylor, *Planta* 112:35-43 (1973); Harris and Chrispeels, *Plant Physiol.* 56: 292-299 (1975). Advances in membrane technology have increased the range of applications of Daoust's tissue-printing techniques allowing (Cassab and Varner, *J. Cell. Biol.* 105: 2581-2588 (1987), the entirety of which is herein incorporated by reference; the histochemical localization of various plant enzymes and deoxyribonuclease on nitrocellulose paper and nylon (Spruce et al., *Phytochemistry*, 26: 2901-2903 (1987), the entirety of which is herein incorporated by reference; Barres et al. *Neuron* 5: 527-544 (1990), the entirety of which is herein incorporated by reference; the entirety of which is herein incorporated by reference; Reid and Pont-Lezica, *Tissue Printing: Tools for the Study of Anatomy, Histochemistry, and Gene Expression*, Academic Press, New York, N.Y. (1992), the entirety of which is herein incorporated by reference; Reid et al. *Plant Physiol.* 93: 160-165 (1990), herein incorporate by reference; Ye et al. *Plant J.* 1: 175-183 (1991), the entirety of which is herein incorporated by reference).

It is understood that one or more of the molecules of the present invention, preferably one or more of the EST nucleic acid molecules of the present invention or one or more of the antibodies of the present invention may be utilized to detect the presence or quantity of a protein by tissue printing.

Further, it is also understood that any of the nucleic acid molecules of the present invention may be used as marker nucleic acids and or probes in connection with methods that require probes or marker nucleic acids. As used herein, a probe is an agent that is utilized to determine an attribute or feature (e.g. presence or absence, location, correlation, etc.) or a molecule, cell, tissue or plant. As used herein, a marker nucleic acid is a nucleic acid molecule that is utilized to determine an attribute or feature (e.g., presence or absence, location, correlation, etc.) or a molecule, cell, tissue or plant.

A microarray-based method for high-throughput monitoring of plant gene expression may be utilized to measure gene-specific hybridization targets. This 'chip'-based approach involves using microarrays of nucleic acid molecules as gene-specific hybridization targets to quantitatively measure expression of the corresponding plant genes (Schena et al., *Science* 270: 467-470 (1995), the entirety of which is herein incorporated by reference; Shalon, Ph.D. Thesis. Stanford University (1996), the entirety of which is herein incorporated by reference). Every nucleotide in a large sequence can be queried at the same time. Hybridization can be used to efficiently analyze large amounts of nucleotide sequence.

Several microarray methods have been described. One method compares the sequences to be analyzed by hybridization to a set of oligonucleotides representing all possible subsequences (Bains and Smith, *J. Theor. Biol.* 135: 303 (1989), the entirety of which is herein incorporated by reference). A second method hybridizes the sample to an array of oligonucleotide probes. An array consisting of oligonucleotides complementary to subsequences of a target sequence can be used to determine the identity of a target sequence, measure its amount, and detect differences between the target and a reference sequence. Nucleic acid molecules microarrays may also be screened with protein molecules or fragments thereof to determine nucleic acid molecules that specifically bind protein molecules or fragments thereof.

The microarray approach may be used with polypeptide targets (U.S. Pat. No. 5,445,934; U.S. Pat. No. 5,143,854; U.S. Pat. No. 5,079,600; U.S. Pat. No. 4,923,901, all of which are herein incorporated by reference in their entirety). Essentially, polypeptides are synthesized on a substrate (microarray) and these polypeptides can be screened with either protein molecules or fragments thereof or nucleic acid molecules in order to screen for either protein molecules or fragments thereof or nucleic acid molecules that specifically bind the target polypeptides. Implementation of these techniques rely on recently developed combinatorial technologies to generate any ordered array of a large number of oligonucleotide probes (Fodor et al., *Science* 251:767-773 (1991), the entirety of which is herein incorporated by reference).

It is understood that one or more of the molecules of the present invention, preferably one or more of the nucleic acid molecules or protein molecules or fragments thereof of the present invention may be utilized in a microarray based method.

In a preferred embodiment of the present invention microarrays may be prepared that comprise nucleic acid molecules where preferably at least 10%, preferably at least 25%, more preferably at least 50% and even more preferably at least 75%, 80%, 85%, 90% or 95% of the nucleic acid molecules located on that array are selected from the group of nucleic acid molecules that specifically hybridize to one or more nucleic acid molecule having a nucleic acid sequence selected from the group of SEQ ID NO: 1 through SEQ ID NO: 83523 or complement thereof or fragments of either.

A particular preferred microarray embodiment of the present invention is a microarray comprising nucleic acid molecules encoding genes or fragments thereof that are homologues of known genes or nucleic acid molecules that comprise genes or fragment thereof that elicit only limited or no matches to known genes. A further preferred microarray embodiment of the present invention is a microarray comprising nucleic acid molecules having genes or fragments thereof that are homologues of known genes and nucleic acid molecules that comprise genes or fragment thereof that elicit only limited or no matches to known genes. Site-directed mutagenesis may be utilized to modify nucleic acid sequences, particularly as it is a technique that allows one or more of the amino acids encoded by a nucleic acid molecule to be altered (e.g. a threonine to be replaced by a methionine). Three basic methods for site-directed mutagenesis are often employed. These are cassette mutagenesis (Wells et al., *Gene* 34:315-23 (1985), the entirety of which is herein incorporated by reference), primer extension (Gilliam et al., *Gene* 12:129-137 (1980), the entirety of which is herein incorporated by reference); Zoller and Smith, *Methods Enzymol.* 100:468-500 (1983), the entirety of which is herein incorporated by reference; and Dalbadie-McFarland et al., *Proc. Natl. Acad. Sci.* (U.S.A.) 79:6409-6413 (1982), the entirety of which is herein incorporated by reference) and methods based upon PCR (Scharf et al., *Science* 233:1076-1078 (1986), the entirety of which is herein incorporated by reference; Higuchi et al., *Nucleic Acids Res.* 16:7351-7367 (1988), the entirety of which is herein incorporated by reference). Site-directed mutagenesis approaches are also described in European Patent 0 385 962, the entirety of which is herein incorporated by reference, European Patent 0 359 472, the entirety of which is herein incorporated by reference, and PCT patent application WO 93/07278, the entirety of which is herein incorporated by reference.

Site-directed mutagenesis strategies have been applied to plants for both in vitro as well as in vivo site-directed mutagenesis (Lanz et al., *J. Biol. Chem.* 266:9971-6 (1991), the entirety of which is herein incorporated by reference; Kovgan and Zhdanov, *Biotekhnologiya* 5:148-154; No. 207160n, Chemical Abstracts 110:225 (1989), the entirety of which is herein incorporated by reference; Ge et al., *Proc. Natl. Acad. Sci.* (U.S.A.) 86:4037-4041 (1989), the entirety of which is herein incorporated by reference, Zhu et al., *J. Biol. Chem.* 271:18494-18498 (1996), Chu et al., *Biochemistry* 33:6150-6157 (1994), the entirety of which is herein incorporated by reference, Small et al., *EMBO J.* 11:1291-1296 (1992), the entirety of which is herein incorporated by reference, Cho et al., *Mol. Biotechnol.* 8:13-16 (1997), Kita et al., *J. Biol. Chem.* 271:26529-26535 (1996), the entirety of which is herein incorporated by reference, Jin et al., *Mol. Microbiol.* 7:555-562 (1993), the entirety of which is herein incorporated by reference, Hatfield and Vierstra, *J. Biol. Chem.* 267:14799-14803 (1992), the entirety of which is herein incorporated by reference, Zhao et al., *Biochemistry* 31:5093-5099 (1992), the entirety of which is herein incorporated by reference).

Any of the nucleic acid molecules of the present invention may either be modified by site-directed mutagenesis or used as, for example, nucleic acid molecules that are used to target other nucleic acid molecules for modification. It is understood that mutants with more than one altered nucleotide can be constructed using techniques that practitioners skilled in the art are familiar with such as isolating restriction fragments and ligating such fragments into an expression vector (see, for example, Sambrook et al., *Molecular Cloning: A Laboratory Manual*, Cold Spring Harbor Press (1989)).

Sequence-specific DNA-binding proteins play a role in the regulation of transcription. The isolation of recombinant cDNAs encoding these proteins facilitates the biochemical analysis of their structural and functional properties. Genes encoding such DNA-binding proteins have been isolated using classical genetics (Vollbrecht et al., *Nature* 350: 241-243 (1991), the entirety of which is herein incorporated by reference) and molecular biochemical approaches, including the screening of recombinant cDNA libraries with antibodies (Landschulz et al., *Genes Dev.* 2: 786-800 (1988), the entirety of which is herein incorporated by reference) or DNA probes (Bodner et al., *Cell* 55: 505-518 (1988), the entirety of which is herein incorporated by reference). In addition, an in situ screening procedure has been used and has facilitated the isolation of sequence-specific DNA-binding proteins from various plant species (Gilmartin et al., *Plant Cell* 4: 839-849 (1992), the entirety of which is herein incorporated by reference; Schindler et al., *EMBO J.* 11: 1261-1273 (1992) the entirety of which is herein incorporated by reference). An in situ screening protocol does not require the purification of the protein of interest (Vinson et al., *Genes Dev.* 2: 801-806 (1988), the entirety of which is herein incorporated by reference; Singh et al., *Cell* 52: 415-423 (1988), the entirety of which is herein incorporated by reference).

Steps may be employed to characterize DNA-protein interactions. The first is to identify promoter fragments that interact with DNA-binding proteins, to titrate binding activity, to determine the specificity of binding, and to determine whether a given DNA-binding activity can interact with related DNA sequences (Sambrook et al., *Molecular Cloning: A Laboratory Manual*, $2^{nd}$ edition. Cold Spring Harbor Laboratory Press, Cold Spring Harbor, N.Y. (1989). Electrophoretic mobility-shift assay is a widely used assay. The assay provides a simple, rapid, and sensitive method for detecting DNA-binding proteins based on the observation that the mobility of a DNA fragment through a nondenaturing, low-ionic strength polyacrylamide gel is retarded upon association with a DNA-binding protein (Fried and Crother, *Nucleic Acids Res.* 9: 6505-6525 (1981), the entirety of which is herein incorporated by reference). When one or more specific binding activities have been identified, the exact sequence of the DNA bound by the protein may be determined. Several procedures for characterizing protein/DNA-binding sites are used, including methylation and ethylation interference assays (Maxam and Gilbert, *Methods Enzymol.* 65: 499-560 (1980), the entirety of which is herein incorporated by reference; Wissman and Hillen, *Methods Enzymol.* 208: 365-379 (1991), the entirety of which is herein incorporated by reference) and footprinting techniques employing DNase I (Galas and Schmitz, *Nucleic Acids Res.* 5: 3157-3170 (1978), the entirety of which is herein incorporated by reference), 1,10-phenanthroline-copper ion methods (Sigman et al., *Methods Enzymol.* 208: 365-379 (1991), the entirety of which is herein incorporated by reference) or hydroxyl radical methods (Dixon et al., *Methods Enzymol.* 208: 380-413 (1991), the entirety of which is herein incorporated by reference). It is understood that one or more of the nucleic acid molecules of the present invention, preferably one or more of the EST nucleic acid molecules of the present invention may be utilized to identify a protein or fragment thereof that specifically binds to a nucleic acid molecule of the present invention. It is also understood that one or more of the protein molecules or fragments thereof of the present invention may be utilized to identify a nucleic acid molecule that specifically binds to it.

The two-hybrid system is based on the fact that many cellular functions are carried out by proteins that interact (physically) with one another. Two-hybrid systems have been used to probe the function of new proteins (Chien et al., *Proc. Natl. Acad. Sci.* (U.S.A.) 88: 9578-9582 (1991) the entirety of which is herein incorporated by reference; Durfee et al., *Genes Dev.* 7: 555-569 (1993) the entirety of which is herein incorporated by reference; Choi et al., *Cell* 78: 499-512 (1994), the entirety of which is herein incorporated by reference; Kranz et al., *Genes Dev.* 8: 313-327 (1994), the entirety of which is herein incorporated by reference).

Interaction mating techniques have facilitated a number of two-hybrid studies of protein-protein interaction. Interaction mating has been used to examine interactions between small sets of tens of proteins (Finley and Brent, *Proc. Natl. Acad. Sci.* (U.S.A.) 91: 12098-12984 (1994), the entirety of which is herein incorporated by reference), larger sets of hundreds of proteins, (Bendixen et al., *Nucl. Acids Res.* 22: 1778-1779 (1994), the entirety of which is herein incorporated by reference) and to comprehensively map proteins encoded by a small genome (Bartel et al., *Nature Genetics* 12: 72-77 (1996), the entirety of which is herein incorporated by reference). This technique utilizes proteins fused to the DNA-binding domain and proteins fused to the activation domain. They are expressed in two different haploid yeast strains of opposite mating type, and the strains are mated to determine if the two proteins interact. Mating occurs when haploid yeast strains come into contact and result in the fusion of the two haploids into a diploid yeast strain. An interaction can be determined by the activation of a two-hybrid reporter gene in the diploid strain. The primary advantage of this technique is that it reduces the number of yeast transformations needed to test individual interactions. It is understood that the protein-protein interactions of protein or fragments thereof of the present invention may be investigated using the two-hybrid system and that any of the nucleic acid molecules of the present invention that encode such proteins or fragments thereof may be used to transform yeast in the two-hybrid system.

*Synechocystis* 6803 is a photosynthetic Cyanobacterium capable of oxygenic photosynthesis as well as heterotrophic growth in the absence of light. The entire genome has been sequenced, and it is reported to have a circular genome size of 3.57 Mbp containing 3168 potential open reading frames. Open reading frames (ORFs) were identified based upon their homology to other reported ORFs and by using ORF identification computer programs. Sixteen hundred potential ORFs were assigned based on their homology to previously identified ORFs. Of these 1600 ORFs, 145 were identical to reported ORFs (Kaneko et al., *DNA Research* 3:109-36 (1996), herein incorporated by reference in its entirety).

Several prokaryote promoters have been used in *Synechocystis* to express heterologous genes including the tac, lac, and lambda phage promoters (Bryant (ed.), *The Molecular Biology of Cyanobacteria*, Kluwer Academic Publishers, (1994); Ferino and Chauvat, *Gene* 84:257-266 (1989), both of which are herein incorporated by reference in their entirety). Several bacterial origins of replication such as RSF1010 and ACYC are reported to replicate in Synechocystis (Mermet-Bouvier and Chauvat, *Current Microbiology* 28:145-148 (1994); Kuhlemeier et al., *Mol. Gen. Genet.* 184:249-254 (1981), both of which are herein incorporated by reference in their entirety).

Synechocystis has been used to study gene regulation by gene replacement through homologous recombination or by gene disruption using antibiotic resistance markers (Pakrasi et al., *EMBO* 7:325-332 (1988), herein incorporated by reference in its entirety). In such gene regulation studies, double reciprocal homologous regions of the host genome flanking the gene of interest recombine to stably integrate the gene of interest into the genome. The gene of interest can be expressed once that gene has been stably integrated into the genome. Biochemical analysis can be performed to study the effect of the replaced or deleted gene.

It is understood that the agents of the present invention may be employed in a *Synechocystis* system.

Exogenous genetic material may be transferred into a plant cell and the plant cell regenerated into a whole, fertile or sterile plant. Exogenous genetic material is any genetic material, whether naturally occurring or otherwise, from any source that is capable of being inserted into any organism. Such genetic material may be transferred into either monocotyledons and dicotyledons including but not limited to the crops, maize and soybean (*See specifically*, Chistou, *Particle Bombardment for Genetic Engineering of Plants*, pp 63-69 (maize), pp 50-60 (soybean), Biotechnology Intelligence Unit. Academic Press, San Diego, Calif. (1996), the entirety of which is herein incorporated by reference and generally Chistou, *Particle Bombardment for Genetic Engineering of*

*Plants*, Biotechnology Intelligence Unit. Academic Press, San Diego, Calif. (1996), the entirety of which is herein incorporated by reference).

Transfer of a nucleic acid that encodes for a protein can result in overexpression of that protein in a transformed cell or transgenic plant. One or more of the proteins or fragments thereof encoded by nucleic acid molecules of the present invention may be overexpressed in a transformed cell or transformed plant. Such overexpression may be the result of transient or stable transfer of the exogenous material.

Exogenous genetic material may be transferred into a plant cell by the use of a DNA vector or construct designed for such a purpose. Design of such a vector is generally within the skill of the art (See, Plant Molecular Biology: A Laboratory Manual eds. Clark, Springer, New York (1997), the entirety of which is herein incorporated by reference).

A construct or vector may include a plant promoter to express the protein or protein fragment of choice. A number of promoters which are active in plant cells have been described in the literature. These include the nopaline synthase (NOS) promoter (Ebert et al., *Proc. Natl. Acad. Sci.* (U.S.A.) 84:5745-5749 (1987), the entirety of which is herein incorporated by reference), the octopine synthase (OCS) promoter (which are carried on tumor-inducing plasmids of *Agrobacterium tumefaciens*), the caulimovirus promoters such as the cauliflower mosaic virus (CaMV) 19S promoter (Lawton et al., *Plant Mol. Biol.* 9:315-324 (1987), the entirety of which is herein incorporated by reference) and the CAMV 35S promoter (Odell et al., *Nature* 313:810-812 (1985), the entirety of which is herein incorporated by reference), the figwort mosaic virus 35S-promoter, the light-inducible promoter from the small subunit of ribulose-1,5-bis-phosphate carboxylase (ssRUBISCO), the Adh promoter (Walker et al., *Proc. Natl. Acad. Sci.* (U.S.A.) 84:6624-6628 (1987), the entirety of which is herein incorporated by reference), the sucrose synthase promoter (Yang et al., *Proc. Natl. Acad. Sci.* (U.S.A.) 87:4144-4148 (1990), the entirety of which is herein incorporated by reference), the R gene complex promoter (Chandler et al., *The Plant Cell* 1:1175-1183 (1989), the entirety of which is herein incorporated by reference), and the chlorophyll a/b binding protein gene promoter, etc. These promoters have been used to create DNA constructs which have been expressed in plants; see, e.g., PCT publication WO 84/02913, herein incorporated by reference in its entirety.

Promoters which are known or are found to cause transcription of DNA in plant cells can be used in the present invention. Such promoters may be obtained from a variety of sources such as plants and plant viruses. It is preferred that the particular promoter selected should be capable of causing sufficient expression to result in the production of an effective amount of a protein to cause the desired phenotype. In addition to promoters which are known to cause transcription of DNA in plant cells, other promoters may be identified for use in the current invention by screening a plant cDNA library for genes which are selectively or preferably expressed in the target tissues or cells.

For the purpose of expression in source tissues of the plant, such as the leaf, seed, root or stem, it is preferred that the promoters utilized in the present invention have relatively high expression in these specific tissues. For this purpose, one may choose from a number of promoters for genes with tissue- or cell-specific or -enhanced expression. Examples of such promoters reported in the literature include the chloroplast glutamine synthetase GS2 promoter from pea (Edwards et al., *Proc. Natl. Acad. Sci.* (U.S.A.) 87:3459-3463 (1990), herein incorporated by reference in its entirety), the chloroplast fructose-1,6-biphosphatase (FBPase) promoter from wheat (Lloyd et al., *Mol. Gen. Genet.* 225:209-216 (1991), herein incorporated by reference in its entirety), the nuclear photosynthetic ST-LS1 promoter from potato (Stockhaus et al., *EMBO J.* 8:2445-2451 (1989), herein incorporated by reference in its entirety), the phenylalanine ammonia-lyase (PAL) promoter and the chalcone synthase (CHS) promoter from *Arabidopsis thaliana*. Also reported to be active in photosynthetically active tissues are the ribulose-1,5-bisphosphate carboxylase (RbcS) promoter from eastern larch (*Larix laricina*), the promoter for the cab gene, cab6, from pine (Yamamoto et al., *Plant Cell Physiol.* 35:773-778 (1994), herein incorporated by reference in its entirety), the promoter for the Cab-1 gene from wheat (Fejes et al., *Plant Mol. Biol.* 15:921-932 (1990), herein incorporated by reference in its entirety), the promoter for the CAB-1 gene from spinach (Lubberstedt et al., *Plant Physiol.* 104:997-1006 (1994), herein incorporated by reference in its entirety), the promoter for the cab1R gene from rice (Luan et al., *Plant Cell.* 4:971-981 (1992), the entirety of which is herein incorporated by reference), the pyruvate, orthophosphate dikinase (PPDK) promoter from maize (Matsuoka et al., *Proc. Natl. Acad. Sci.* (U.S.A.) 90: 9586-9590 (1993), herein incorporated by reference in its entirety), the promoter for the tobacco Lhcb1*2 gene (Cerdan et al., *Plant Mol. Biol.* 33: 245-255. (1997), herein incorporated by reference in its entirety), the *Arabidopsis thaliana* SUC2 sucrose-H+ symporter promoter (Truernit et al., *Planta.* 196: 564-570 (1995), herein incorporated by reference in its entirety), and the promoter for the thylacoid membrane proteins from spinach (psaD, psaF, psaE, PC, FNR, atpC, atpD, cab, rbcS). Other promoters for the chlorophyl a/b-binding proteins may also be utilized in the present invention, such as the promoters for LhcB gene and PsbP gene from white mustard (*Sinapis alba*; Kretsch et al., *Plant Mol. Biol.* 28: 219-229 (1995), the entirety of which is herein incorporated by reference).

For the purpose of expression in sink tissues of the plant, such as the tuber of the potato plant, the fruit of tomato, or the seed of maize, wheat, rice, and barley, it is preferred that the promoters utilized in the present invention have relatively high expression in these specific tissues. A number of promoters for genes with tuber-specific or -enhanced expression are known, including the class I patatin promoter (Bevan et al., *EMBO J.* 8: 1899-1906 (1986); Jefferson et al., *Plant Mol. Biol.* 14: 995-1006 (1990), both of which are herein incorporated by reference in its entirety), the promoter for the potato tuber ADPGPP genes, both the large and small subunits, the sucrose synthase promoter (Salanoubat and Belliard, *Gene.* 60: 47-56 (1987), Salanoubat and Belliard, *Gene.* 84: 181-185 (1989), both of which are incorporated by reference in their entirety), the promoter for the major tuber proteins including the 22 kd protein complexes and proteinase inhibitors (Hannapel, *Plant Physiol.* 101: 703-704 (1993), herein incorporated by reference in its entirety), the promoter for the granule bound starch synthase gene (GBSS) (Visser et al., *Plant Mol. Biol.* 17: 691-699 (1991), herein incorporated by reference in its entirety), and other class I and II patatins promoters (Koster-Topfer et al., *Mol Gen Genet.* 219: 390-396 (1989); Mignery et al., *Gene.* 62: 27-44 (1988), both of which are herein incorporated by reference in their entirety).

Other promoters can also be used to express a fructose 1,6bisphosphate aldolase gene in specific tissues, such as seeds or fruits. The promoter for β-conglycinin (Chen et al., *Dev. Genet.* 10: 112-122 (1989), herein incorporated by reference in its entirety) or other seed-specific promoters such as the napin and phaseolin promoters, can be used. The zeins are a group of storage proteins found in maize endosperm. Genomic clones for zein genes have been isolated (Pedersen et al., *Cell* 29: 1015-1026 (1982), herein incorporated by reference in its entirety), and the promoters from these clones, including the 15 kD, 16 kD, 19 kD, 22 kD, 27 kD, and gamma genes, could also be used. Other promoters known to function, for example, in maize, include the promoters for the following genes: *waxy, Brittle, Shrunken* 2, Branching enzymes I and II, starch synthases, debranching enzymes, oleosins, glutelins, and sucrose synthases. A particularly preferred promoter for maize endosperm expression is the promoter for the glutelin gene from rice, more particularly the Osgt-1 promoter (Zheng et al., *Mol. Cell Biol.* 13: 5829-5842 (1993), herein incorporated by reference in its entirety). Examples of promoters suitable for expression in wheat include those promoters for the ADPglucose pyrophosphorylase (ADPGPP) subunits, the granule bound and other starch synthases, the branching and debranching enzymes, the embryogenesis-abundant proteins, the gliadins, and the glutenins. Examples of such promoters in rice include those promoters for the ADPGPP subunits, the granule bound and other starch synthases, the branching enzymes, the debranching enzymes, sucrose synthases, and the glutelins. A particularly preferred promoter is the promoter for rice glutelin, Osgt-1. Examples of such promoters for barley include those for the ADPGPP subunits, the granule bound and other starch synthases, the branching enzymes, the debranching enzymes, sucrose synthases, the hordeins, the embryo globulins, and the aleurone specific proteins.

Root specific promoters may also be used. An example of such a promoter is the promoter for the acid chitinase gene (Samac et al., *Plant Mol. Biol.* 25: 587-596 (1994), the entirety of which is herein incorporated by reference). Expression in root tissue could also be accomplished by utilizing the root specific subdomains of the CaMV35S promoter that have been identified (Lam et al., *Proc. Natl. Acad. Sci.* (U.S.A.) 86:7890-7894 (1989), herein incorporated by reference in its entirety). Other root cell specific promoters include those reported by Conkling et al. (Conkling et al., *Plant Physiol.* 93:1203-1211 (1990), the entirety of which is herein incorporated by reference).

Additional promoters that may be utilized are described, for example, in U.S. Pat. Nos. 5,378,619, 5,391,725, 5,428,147, 5,447,858, 5,608,144, 5,608,144, 5,614,399, 5,633,441, 5,633,435, and 4,633,436, all of which are herein incorporated in their entirety. In addition, a tissue specific enhancer may be used (Fromm et al., *The Plant Cell* 1:977-984 (1989), the entirety of which is herein incorporated by reference).

Constructs or vectors may also include, with the coding region of interest, a nucleic acid sequence that acts, in whole or in part, to terminate transcription of that region. For example, such sequences have been isolated including the Tr7 3' sequence and the nos 3' sequence (Ingelbrecht et al., *The Plant Cell* 1:671-680 (1989), the entirety of which is herein incorporated by reference; Bevan et al., *Nucleic Acids Res.* 11:369-385 (1983), the entirety of which is herein incorporated by reference), or the like.

A vector or construct may also include regulatory elements. Examples of such include the Adh intron 1 (Callis et al., *Genes and Develop.* 1:1183-1200 (1987), the entirety of which is herein incorporated by reference), the sucrose synthase intron (Vasil et al., Plant Physiol. 91:1575-1579 (1989), the entirety of which is herein incorporated by reference) and the TMV omega element (Gallie et al., *The Plant Cell* 1:301-311 (1989), the entirety of which is herein incorporated by reference). These and other regulatory elements may be included when appropriate.

A vector or construct may also include a selectable marker. Selectable markers may also be used to select for plants or plant cells that contain the exogenous genetic material. Examples of such include, but are not limited to, a neo gene (Potrykus et al., *Mol. Gen. Genet.* 199:183-188 (1985), the entirety of which is herein incorporated by reference) which codes for kanamycin resistance and can be selected for using kanamycin, G418, etc.; a bar gene which codes for bialaphos resistance; a mutant EPSP synthase gene (Hinchee et al., *Bio/Technology* 6:915-922 (1988), the entirety of which is herein incorporated by reference) which encodes glyphosate resistance; a nitrilase gene which confers resistance to bromoxynil (Stalker et al., *J. Biol. Chem.* 263:6310-6314 (1988), the entirety of which is herein incorporated by reference); a mutant acetolactate synthase gene (ALS) which confers imidazolinone or sulphonylurea resistance (European Patent Application 154,204 (Sep. 11, 1985), the entirety of which is herein incorporated by reference); and a methotrexate resistant DHFR gene (Thillet et al., *J. Biol. Chem.* 263:12500-12508 (1988), the entirety of which is herein incorporated by reference).

A vector or construct may also include a transit peptide. Incorporation of a suitable chloroplast transit peptide may also be employed (European Patent Application Publication Number 0218571, the entirety of which is herein incorporated by reference). Translational enhancers may also be incorporated as part of the vector DNA. DNA constructs could contain one or more 5' non-translated leader sequences which may serve to enhance expression of the gene products from the resulting mRNA transcripts. Such sequences may be derived from the promoter selected to express the gene or can be specifically modified to increase translation of the mRNA. Such regions may also be obtained from viral RNAs, from suitable eukaryotic genes, or from a synthetic gene sequence. For a review of optimizing expression of transgenes, see Koziel et al., *Plant Mol. Biol.* 32:393-405 (1996), the entirety of which is herein incorporated by reference.

A vector or construct may also include a screenable marker. Screenable markers may be used to monitor expression. Exemplary screenable markers include a β-glucuronidase or uidA gene (GUS) which encodes an enzyme for which various chromogenic substrates are known (Jefferson, *Plant Mol. Biol, Rep.* 5: 387-405 (1987), the entirety of which is herein incorporated by reference; Jefferson et al., *EMBO J.* 6: 3901-3907 (1987), the entirety of which is herein incorporated by reference); an R-locus gene, which encodes a product that regulates the production of anthocyanin pigments (red color) in plant tissues ((Dellaporta et al., Stadler Symposium 11:263-282 (1988), the entirety of which is herein incorporated by reference); a β-lactamase gene (Sutcliffe et al., *Proc. Natl. Acad. Sci.* (U.S.A.) 75: 3737-3741 (1978), the entirety of which is herein incorporated by reference), a gene which encodes an enzyme for which various chromogenic substrates are known (e.g., PADAC, a chromogenic cephalosporin); a luciferase gene (Ow et al., *Science* 234: 856-859 (1986), the entirety of which is herein incorporated by reference) a xylE gene (Zukowsky et al., *Proc. Natl. Acad. Sci.* (U.S.A.) 80:1101-1105 (1983), the entirety of which is herein incorporated by reference) which encodes a catechol dioxygenase that can convert chromogenic catechols; an α-amylase gene (Ikatu et al., *Bio/Technol.* 8:241-242 (1990), the entirety of which is herein incorporated by reference); a tyrosinase gene (Katz et al., *J. Gen. Microbiol.* 129:2703-2714 (1983), the entirety of which is herein incorporated by reference) which encodes an enzyme capable of oxidizing tyrosine to DOPA and dopaquinone which in turn condenses to melanin; an α-galactosidase, which will turn a chromogenic α-galactose substrate.

Included within the terms "selectable or screenable marker genes" are also genes which encode a scriptable marker whose secretion can be detected as a means of identifying or selecting for transformed cells. Examples include markers which encode a secretable antigen that can be identified by antibody interaction, or even secretable enzymes which can be detected catalytically. Secretable proteins fall into a number of classes, including small, diffusible proteins detectable, e.g., by ELISA, small active enzymes detectable in extracellular solution (e.g., α-amylase, β-lactamase, phosphinothricin transferase), or proteins which are inserted or trapped in the cell wall (such as proteins which include a leader sequence such as that found in the expression unit of extension or tobacco PR-S). Other possible selectable and/or screenable marker genes will be apparent to those of skill in the art.

Methods and compositions for transforming a bacteria and other microorganisms are known in the art (see for example Sambrook et al., *Molecular Cloning: A Laboratory Manual*, Second Edition, Cold Spring Harbor Laboratory Press, Cold Spring Harbor, N.Y., (1989), the entirety of which is herein incorporated by reference).

There are many methods for introducing transforming nucleic acid molecules into plant cells. Suitable methods are believed to include virtually any method by which nucleic acid molecules may be introduced into a cell, such as by *Agrobacterium* infection or direct delivery of nucleic acid molecules such as, for example, by PEG-mediated transformation, by electroporation or by acceleration of DNA coated particles, etc. (Pottykus, *Ann. Rev. Plant Physiol. Plant Mol. Biol.* 42:205-225 (1991), the entirety of which is herein incorporated by reference; Vasil, *Plant Mol. Biol.* 25: 925-937 (1994), the entirety of which is herein incorporated by reference. For example, electroporation has been used to transform maize protoplasts (Fromm et al., *Nature* 312:791-793 (1986), the entirety of which is herein incorporated by reference).

Other vector systems suitable for introducing transforming DNA into a host plant cell includes but is not limited to binary artificial chromosome (BIBAC) vectors (Hamilton et al., *Gene* 200:107-116, (1997), the entirety of which is herein incorporated by reference, and transfection with RNA viral vectors (Della-Cioppa et al., *Ann. N.Y. Acad. Sci.* (1996), 792 (Engineering Plants for Commercial Products and Applications), 57-61, the entirety of which is herein incorporated by reference.

Technology for introduction of DNA into cells is well known to those of skill in the art. Four general methods for delivering a gene into cells have been described: (1) chemical methods (Graham and van der Eb, *Virology*, 54:536-539 (1973), the entirety of which is herein incorporated by reference); (2) physical methods such as microinjection (Capecchi, *Cell* 22:479-488 (1980), electroporation (Wong and Neumann, *Biochem. Biophys. Res. Commun.*, 107:584-587 (1982); Fromm et al., *Proc. Natl. Acad. Sci. USA*, 82:5824-5828 (1985); U.S. Pat. No. 5,384,253; and the gene gun (Johnston and Tang, *Methods Cell Biol.* 43:353-365 (1994), all of which the entirety is herein incorporated by reference; (3) viral vectors (Clapp, *Clin. Perinatol.*, 20:155-168 (1993); Lu et al., *J. Exp. Med.*, 178:2089-2096 (1993); Eglitis and Anderson, *Biotechniques*, 6:608-614 (1988), all of which the entirety is herein incorporated by reference); and (4) receptor-mediated mechanisms (Curiel et al., *Hum. Gen. Ther.*, 3:147-154 (1992); Wagner et al., *Proc. Natl. Acad. Sci. USA*, 89:6099-6103 (1992), all of which the entirety is herein incorporated by reference).

Acceleration methods that may be used include, for example, microprojectile bombardment and the like. One example of a method for delivering transforming nucleic acid molecules to plant cells is microprojectile bombardment. This method has been reviewed by Yang and Christou, eds., *Particle Bombardment Technology for Gene Transfer*, Oxford Press, Oxford, England (1994), the entirety of which is herein incorporated by reference). Non-biological particles (microprojectiles) that may be coated with nucleic acids and delivered into cells by a propelling force. Exemplary particles include those comprised of tungsten, gold, platinum, and the like.

A particular advantage of microprojectile bombardment, in addition to it being an effective means of reproducibly, and stably transforming monocotyledons, is that neither the isolation of protoplasts (Cristou et al., *Plant Physiol.* 87:671-674 (1988), the entirety of which is herein incorporated by reference) nor the susceptibility of *Agrobacterium* infection is required. An illustrative embodiment of a method for delivering DNA into maize cells by acceleration is a biolistics g-particle delivery system, which can be used to propel particles coated with DNA through a screen, such as a stainless steel or Nytex screen, onto a filter surface covered with corn cells cultured in suspension. Gordon-Kamm et al., describes the basic procedure for coating tungsten particles with DNA (Gordon-Kamm et al., *Plant Cell* 2: 603-618 (1990), the entirety of which is herein incorporated by reference). The screen disperses the tungsten nucleic acid particles so that they are not delivered to the recipient cells in large aggregates. A particle delivery system suitable for use with the present invention is the helium acceleration PDS-1000/He gun which is available from Bio-Rad Laboratories (Bio-Rad, Hercules, Calif.) (Sanford et al., *Technique* 3:3-16 (1991), the entirety of which is herein incorporated by reference).

For the bombardment, cells in suspension may be concentrated on filters. Filters containing the cells to be bombarded are positioned at an appropriate distance below the microprojectile stopping plate. If desired, one or more screens are also positioned between the gun and the cells to be bombarded.

Alternatively, immature embryos or other target cells may be arranged on solid culture medium. The cells to be bombarded are positioned at an appropriate distance below the macroprojectile stopping plate. If desired, one or more screens are also positioned between the acceleration device and the cells to be bombarded. Through the use of techniques set forth herein one may obtain up to 1000 or more foci of cells transiently expressing a marker gene. The number of cells in a focus which express the exogenous gene product 48 hours post-bombardment often range from one to ten and average one to three.

In bombardment transformation, one may optimize the prebombardment culturing conditions and the bombardment parameters to yield the maximum numbers of stable transformants. Both the physical and biological parameters for bombardment are important in this technology. Physical factors are those that involve manipulating the DNA/microprojectile precipitate or those that affect the flight and velocity of either the macro- or microprojectiles. Biological factors include all steps involved in manipulation of cells before and immediately after bombardment, the osmotic adjustment of target cells to help alleviate the trauma associated with bombardment, and also the nature of the transforming DNA, such as linearized DNA or intact supercoiled plasmids. It is believed that pre-bombardment manipulations are especially important for successful transformation of immature embryos. In another alternative embodiment, plastids can be stably transformed. Methods disclosed for plastid transformation in higher plants include the particle gun delivery of DNA containing a selectable marker and targeting of the DNA to the plastid genome through homologous recombination (Svab et al., *Proc. Natl. Acad. Sci.* (U.S.A.) 87:8526-8530 (1990); Svab and Maliga, *Proc. Natl. Acad. Sci.* (U.S.A.) 90:913-917 (1993); Staub and Maliga, *EMBO J.* 12:601-606 (1993); U.S. Pat. Nos. 5,451,513 and 5,545,818, all of which are herein incorporated by reference in their entirety).

Accordingly, it is contemplated that one may wish to adjust various aspects of the bombardment parameters in small scale studies to fully optimize the conditions. One may particularly wish to adjust physical parameters such as gap distance, flight distance, tissue distance, and helium pressure. One may also minimize the trauma reduction factors by modifying conditions which influence the physiological state of the recipient cells and which may therefore influence transformation and integration efficiencies. For example, the osmotic state, tissue hydration and the subculture stage or cell cycle of the recipient cells may be adjusted for optimum transformation. The execution of other routine adjustments will be known to those of skill in the art in light of the present disclosure.

*Agrobacterium*-mediated transfer is a widely applicable system for introducing genes into plant cells because the DNA can be introduced into whole plant tissues, thereby bypassing the need for regeneration of an intact plant from a protoplast. The use of *Agrobacterium*-mediated plant integrating vectors to introduce DNA into plant cells is well known in the art. See, for example the methods described (Fraley et al., *Biotechnology* 3:629-635 (1985); Rogers et al., *Meth. In Enzymol,* 153:253-277 (1987), both of which are herein incorporated by reference in their entirety. Further, the integration of the Ti-DNA is a relatively precise process resulting in few rearrangements. The region of DNA to be transferred is defined by the border sequences, and intervening DNA is usually inserted into the plant genome as described (Spielmann et al., *Mol. Gen. Genet.,* 205:34 (1986), the entirety of which is herein incorporated by reference).

Modern *Agrobacterium* transformation vectors are capable of replication in *E. coli* as well as *Agrobacterium*, allowing for convenient manipulations as described (Klee et al., In: *Plant DNA Infectious Agents*, T. Hohn and J. Schell, eds., Springer-Verlag, New York, pp. 179-203 (1985), the entirety of which is herein incorporated by reference. Moreover, recent technological advances in vectors for *Agrobacterium*-mediated gene transfer have improved the arrangement of genes and restriction sites in the vectors to facilitate construction of vectors capable of expressing various polypeptide coding genes. The vectors described have convenient multi-linker regions flanked by a promoter and a polyadenylation site for direct expression of inserted polypeptide coding genes and are suitable for present purposes (Rogers et al., *Meth. In Enzymol.,* 153:253-277 (1987), the entirety of which is herein incorporated by reference). In addition, *Agrobacterium* containing both armed and disarmed Ti genes can be used for the transformations. In those plant strains where *Agrobacterium*-mediated transformation is efficient, it is the method of choice because of the facile and defined nature of the gene transfer.

A transgenic plant formed using *Agrobacterium* transformation methods typically contains a single gene on one chromosome. Such transgenic plants can be referred to as being heterozygous for the added gene. More preferred is a transgenic plant that is homozygous for the added structural gene; i.e., a transgenic plant that contains two added genes, one gene at the same locus on each chromosome of a chromosome pair. A homozygous transgenic plant can be obtained by sexually mating (selfing) an independent segregant transgenic plant that contains a single added gene, germinating some of the seed produced and analyzing the resulting plants produced for the gene of interest.

It is also to be understood that two different transgenic plants can also be mated to produce offspring that contain two independently segregating added, exogenous genes. Selfing of appropriate progeny can produce plants that are homozygous for both added, exogenous genes that encode a polypeptide of interest. Back-crossing to a parental plant and outcrossing with a non-transgenic plant are also contemplated, as is vegetative propagation.

Transformation of plant protoplasts can be achieved using methods based on calcium phosphate precipitation, polyethylene glycol treatment, electroporation, and combinations of these treatments. See for example (Potrykus et al., *Mol. Gen. Genet.,* 205:193-200 (1986); Lorz et al., *Mol. Gen. Genet.,* 199:178, (1985); Fromm et al., *Nature,* 319:791, (1986); Uchimiya et al., *Mol. Gen. Genet.:* 204:204, (1986); Callis et al., *Genes and Development,* 1183, (1987); Marcotte et al., *Nature,* 335:454, (1988), all of which the entirety is herein incorporated by reference).

Application of these systems to different plant strains depends upon the ability to regenerate that particular plant strain from protoplasts. Illustrative methods for the regeneration of cereals from protoplasts are described (Fujimura et al., *Plant Tissue Culture Letters,* 2:74, (1985); Toriyama et al., *Theor Appl. Genet.* 205:34. (1986); Yamada et al., *Plant Cell Rep.,* 4:85, (1986); Abdullah et al., *Biotechnology,* 4:1087, (1986), all of which the entirety is herein incorporated by reference).

To transform plant strains that cannot be successfully regenerated from protoplasts, other ways to introduce DNA into intact cells or tissues can be utilized. For example, regeneration of cereals from immature embryos or explants can be effected as described (Vasil, *Biotechnology,* 6:397, (1988), the entirety of which is herein incorporated by reference). In addition, "particle gun" or high-velocity microprojectile technology can be utilized (Vasil et al., *Bio/Technology* 10:667, (1992), the entirety of which is herein incorporated by reference).

Using the latter technology, DNA is carried through the cell wall and into the cytoplasm on the surface of small metal particles as described (Klein et al., *Nature,* 328:70, (1987); Klein et al., *Proc. Natl. Acad. Sci. USA,* 85:8502-8505, (1988); McCabe et al., *Biotechnology,* 6:923, (1988), all of which the entirety is herein incorporated by reference). The metal particles penetrate through several layers of cells and thus allow the transformation of cells within tissue explants.

Other methods of cell transformation can also be used and include but are not limited to introduction of DNA into plants by direct DNA transfer into pollen (Zhou et al., *Methods in Enzymology,* 101:433, (1983); Hess et al., *Intern Rev. Cytol.,* 107:367, (1987); Luo et al., *Plant Mol Biol. Reporter,* 6:165, (1988), all of which the entirety is herein incorporated by reference), by direct injection of DNA into reproductive organs of a plant (Pena et al., Nature, 325:274, (1987), the entirety of which is herein incorporated by reference), or by direct injection of DNA into the cells of immature embryos followed by the rehydration of desiccated embryos (Neuhaus et al., *Theor. Appl. Genet.,* 75:30, (1987), the entirety of which is herein incorporated by reference).

The regeneration, development, and cultivation of plants from single plant protoplast transformants or from various transformed explants is well known in the art (Weissbach and Weissbach, In: *Methods for Plant Molecular Biology*, (Eds.), Academic Press, Inc. San Diego, Calif., (1988), the entirety of which is herein incorporated by reference). This regeneration and growth process typically includes the steps of selection of transformed cells, culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil.

The development or regeneration of plants containing the foreign, exogenous gene that encodes a protein of interest is well known in the art. Preferably, the regenerated plants are self-pollinated to provide homozygous transgenic plants, as discussed before. Otherwise, pollen obtained from the regenerated plants is crossed to seed-grown plants of agronomically important lines. Conversely, pollen from plants of these important lines is used to pollinate regenerated plants. A transgenic plant of the present invention containing a desired polypeptide is cultivated using methods well known to one skilled in the art.

There are a variety of methods for the regeneration of plants from plant tissue. The particular method of regeneration will depend on the starting plant tissue and the particular plant species to be regenerated.

Methods for transforming dicots, primarily by use of *Agrobacterium tumefaciens*, and obtaining transgenic plants have been published for cotton (U.S. Pat. No. 5,004,863, U.S. Pat. No. 5,159,135, U.S. Pat. No. 5,518,908, all of which the entirety is herein incorporated by reference); soybean (U.S. Pat. No. 5,569,834, U.S. Pat. No. 5,416,011, McCabe et al., *Biotechnology* 6:923, (1988), Christou et al., *Plant Physiol.*, 87:671-674 (1988), all of which the entirety is herein incorporated by reference); *Brassica* (U.S. Pat. No. 5,463,174, the entirety of which is herein incorporated by reference); peanut (Cheng et al., *Plant Cell Rep.* 15: 653-657 (1996), McKently et al., *Plant Cell Rep.* 14:699-703 (1995), all of which the entirety is herein incorporated by reference); papaya (Yang et al., (1996), the entirety of which is herein incorporated by reference); pea (Grant et al., *Plant Cell Rep.* 15:254-258, (1995), the entirety of which is herein incorporated by reference).

Transformation of monocotyledons using electroporation, particle bombardment, and *Agrobacterium* have also been reported. Transformation and plant regeneration have been achieved in asparagus (Bytebier et al., *Proc. Natl. Acad. Sci. USA* 84:5345, (1987), the entirety of which is herein incorporated by reference); barley (Wan and Lemaux, *Plant Physiol* 104:37, (1994), the entirety of which is herein incorporated by reference); maize (Rhodes et al., *Science* 240: 204, (1988), Gordon-Kamm et al., *Plant Cell*, 2:603, (1990), Fromm et al., *Bio/Technology* 8:833, (1990), Koziel et al., *Bio/Technology* 11:194, (1993), Armstrong et al., *Crop Science* 35:550-557, (1995), all of which the entirety is herein incorporated by reference); oat (Somers et al., *Bio/Technology*, 10:1589, (1992), the entirety of which is herein incorporated by reference); orchardgrass (Horn et al., *Plant Cell Rep.* 7:469, (1988), the entirety of which is herein incorporated by reference); rice (Toriyama et al., *Theor Appl. Genet.* 205:34, (1986); Park et al., *Plant Mol. Biol.*, 32: 1135-1148, (1996); Abedinia et al., *Aust. J. Plant Physiol.* 24:133-141, (1997); Zhang and Wu, *Theor. Appl. Genet.* 76:835, (1988); Zhang et al. *Plant Cell Rep.* 7:379, (1988); Battraw and Hall, *Plant Sci.* 86:191-202, (1992); Christou et al., *Bio/Technology* 9:957, (1991), all of which the entirety is herein incorporated by reference); sugarcane (Bower and Birch, Plant J. 2:409, (1992), the entirety of which is herein incorporated by reference); tall fescue (Wang et al., Bio/Technology 10:691, (1992), the entirety of which is herein incorporated by reference), and wheat (Vasil et al., Bio/Technology 10:667, (1992), the entirety of which is herein incorporated by reference; U.S. Pat. No. 5,631,152, the entirety of which is herein incorporated by reference.

Assays for gene expression based on the transient expression of cloned nucleic acid constructs have been developed by introducing the nucleic acid molecules into plant cells by polyethylene glycol treatment, electroporation, or particle bombardment (Marcotte, et al., *Nature,* 335: 454-457 (1988), the entirety of which is herein incorporated by reference; Marcotte, et al., *Plant Cell,* 1: 523-532 (1989), the entirety of which is herein incorporated by reference; McCarty, et al., *Cell* 66: 895-905 (1991), the entirety of which is herein incorporated by reference; Hattori, et al., *Genes Dev.* 6: 609-618 (1992), the entirety of which is herein incorporated by reference; Goff, et al., *EMBO J.* 9: 2517-2522 (1990), the entirety of which is herein incorporated by reference). Transient expression systems may be used to functionally dissect gene constructs (See generally, Mailga et al., *Methods in Plant Molecular Biology*, Cold Spring Harbor Press (1995)).

Any of the nucleic acid molecules of the present invention may be introduced into a plant cell in a permanent or transient manner in combination with other genetic elements such as vectors, promoters enhancers etc. Further any of the nucleic acid molecules of the present invention may be introduced into a plant cell in a manner that allows for over expression of the protein or fragment thereof encoded by the nucleic acid molecule.

Cosuppression is the reduction in expression levels, usually at the level of RNA, of a particular endogenous gene or gene family by the expression of a homologous sense construct that is capable of transcribing mRNA of the same strandedness as the transcript of the endogenous gene (Napoli et al., *Plant Cell* 2: 279-289 (1990), the entirety of which is herein incorporated by reference; van der Krol et al., *Plant Cell* 2: 291-299 (1990), the entirety of which is herein incorporated by reference). Cosuppression may result from stable transformation with a single copy nucleic acid molecule that is homologous to a nucleic acid sequence found with the cell (Prolls and Meyer, *Plant J.* 2:465-475 (1992), the entirety of which is herein incorporated by reference) or with multiple copies of a nucleic acid molecule that is homologous to a nucleic acid sequence found with the cell (Mittlesten et al., *Mol. Gen. Genet.* 244: 325-330 (1994), the entirety of which is herein incorporated by reference). Genes, even though different, linked to homologous promoters may result in the cosuppression of the linked genes (Vaucheret, *C.R. Acad. Sci. III* 316: 1471-1483 (1993), the entirety of which is herein incorporated by reference).

This technique has, for example been applied to generate white flowers from red petunia and tomatoes that do not ripen on the vine. Up to 50% of petunia transformants that contained a sense copy of the chalcone synthase (CHS) gene produced white flowers or floral sectors; this was as a result of the post-transcriptional loss of mRNA encoding CHS (Flavell, *Proc. Natl. Acad. Sci.* (U.S.A.) 91:3490-3496 (1994)), the entirety of which is herein incorporated by reference). Cosuppression may require the coordinate transcription of the transgene and the endogenous gene, and can be reset by a developmental control mechanism (Jorgensen, *Trends Biotechnol,* 8:340344 (1990), the entirety of which is herein incorporated by reference; Meins and Kunz, In: *Gene Inactivation and Homologous Recombination in Plants* (Paszkowski, J., ed.), pp. 335-348. Kluwer Academic, Netherlands (1994), the entirety of which is herein incorporated by reference).

It is understood that one or more of the nucleic acids of the present invention including those comprising SEQ ID NO:1 through SEQ ID NO:83523 or complement thereof or fragments of either or other nucleic acid molecules of the present invention may be introduced into a plant cell and transcribed using an appropriate promoter with such transcription resulting in the co-suppression of an endogenous protein.

Antisense approaches are a way of preventing or reducing gene function by targeting the genetic material (Mol et al., *FEBS Lett.* 268: 427-430 (1990), the entirety of which is herein incorporated by reference). The objective of the antisense approach is to use a sequence complementary to the target gene to block its expression and create a mutant cell line or organism in which the level of a single chosen protein is selectively reduced or abolished. Antisense techniques have several advantages over other 'reverse genetic' approaches. The site of inactivation and its developmental effect can be manipulated by the choice of promoter for antisense genes or by the timing of external application or microinjection. Antisense can manipulate its specificity by selecting either unique regions of the target gene or regions where it shares homology to other related genes (Hiatt et al., *In Genetic Engineering*, Setlow (ed.), Vol. 11, New York: Plenum 49-63 (1989), the entirety of which is herein incorporated by reference).

The principle of regulation by antisense RNA is that RNA that is complementary to the target mRNA is introduced into cells, resulting in specific RNA:RNA duplexes being formed by base pairing between the antisense substrate and the target mRNA (Green et al., *Annu. Rev. Biochem.* 55: 569-597 (1986), the entirety of which is herein incorporated by reference). Under one embodiment, the process involves the introduction and expression of an antisense gene sequence. Such a sequence is one in which part or all of the normal gene sequences are placed under a promoter in inverted orientation so that the 'wrong' or complementary strand is transcribed into a noncoding antisense RNA that hybridizes with the target mRNA and interferes with its expression (Takayama and Inouye, *Crit. Rev. Biochem. Mol. Biol.* 25: 155-184 (1990), the entirety of which is herein incorporated by reference). An antisense vector is constructed by standard procedures and introduced into cells by transformation, transfection, electroporation, microinjection, or by infection, etc. The type of transformation and choice of vector will determine whether expression is transient or stable. The promoter used for the antisense gene may influence the level, timing, tissue, specificity, or inducibility of the antisense inhibition.

It is understood that protein synthesis activity in a plant cell may be reduced or depressed by growing a transformed plant cell containing a nucleic acid molecule whose non-transcribed strand encodes a protein or fragment thereof.

Antibodies have been expressed in plants (Hiatt et al., *Nature* 342:76-78 (1989), the entirety of which is herein incorporated by reference; Conrad and Fielder, *Plant Mol. Biol.* 26: 1023-1030 (1994), the entirety of which is herein incorporated by reference). Cytoplasmic expression of a scFv (single-chain Fv antibodies) has been reported to delay infection by artichoke mottled crinkle virus. Transgenic plants that express antibodies directed against endogenous proteins may exhibit a physiological effect (Philips et al., *EMBO J.* 16: 4489-4496 (1997), the entirety of which is herein incorporated by reference; Marion-Poll, *Trends in Plant Science* 2: 447-448 (1997), the entirety of which is herein incorporated by reference). For example, expressed anti-abscisic antibodies reportedly result in a general perturbation of seed development (Philips et al., *EMBO J.* 16: 4489-4496 (1997)).

Antibodies that are catalytic may also be expressed in plants (abzymes). The principle behind abzymes is that since antibodies may be raised against many molecules, this recognition ability can be directed toward generating antibodies that bind transition states to force a chemical reaction forward (Persidas, *Nature Biotechnology* 15:1313-1315 (1997), the entirety of which is herein incorporated by reference; Baca et al., *Ann. Rev. Biophys. Biomol. Struct.* 26:461-493 (1997), the entirety of which is herein incorporated by reference). The catalytic abilities of abzymes may be enhanced by site directed mutagenesis. Examples of abzymes are, for example, set forth in U.S. Pat. No: 5,658,753; U.S. Pat. No. 5,632,990; U.S. Pat. No. 5,631,137; U.S. Pat. 5,602,015; U.S. Pat. No. 5,559,538; U.S. Pat. No. 5,576,174; U.S. Pat. No. 5,500,358; U.S. Pat. No. 5,318,897; U.S. Pat. No. 5,298,409; U.S. Pat. No. 5,258,289 and U.S. Pat. No. 5,194,585, all of which are herein incorporated in their entirety.

It is understood that any of the antibodies of the present invention may be expressed in plants and that such expression can result in a physiological effect. It is also understood that any of the expressed antibodies may be catalytic.

In addition to the above discussed procedures, practitioners are familiar with the standard resource materials which describe specific conditions and procedures for the construction, manipulation and isolation of macromolecules (e.g., DNA molecules, plasmids, etc.), generation of recombinant organisms and the screening and isolating of clones, (see for example, Sambrook et al., *Molecular Cloning: A Laboratory Manual*, Cold Spring Harbor Press (1989); Mailga et al., *Methods in Plant Molecular Biology*, Cold Spring Harbor Press (1995), the entirety of which is herein incorporated by reference; Birren et al., *Genome Analysis: Analyzing DNA*, 1, Cold Spring Harbor, N.Y., the entirety of which is herein incorporated by reference).

The nucleotide sequence provided in SEQ ID NO:1, through SEQ ID NO:83523 or fragment thereof, or complement thereof, or a nucleotide sequence at least 90% identical, preferably 95%, identical even more preferably 99% or 100% identical to the sequence provided in SEQ ID NO:1 through SEQ ID NO:83523 or fragment thereof, or complement thereof, can be "provided" in a variety of mediums to facilitate use fragment thereof. Such a medium can also provide a subset thereof in a form that allows a skilled artisan to examine the sequences.

In one application of this embodiment, a nucleotide sequence of the present invention can be recorded on computer readable media. As used herein, "computer readable media" refers to any medium that can be read and accessed directly by a computer. Such media include, but are not limited to: magnetic storage media, such as floppy discs, hard disc, storage medium, and magnetic tape: optical storage media such as CD-ROM; electrical storage media such as RAM and ROM; and hybrids of these categories such as magnetic/optical storage media. A skilled artisan can readily appreciate how any of the presently known computer readable mediums can be used to create a manufacture comprising computer readable medium having recorded thereon a nucleotide sequence of the present invention.

As used herein, "recorded" refers to a process for storing information on computer readable medium. A skilled artisan can readily adopt any of the presently known methods for recording information on computer readable medium to generate media comprising the nucleotide sequence information of the present invention. A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII file, stored in a database application, such as DB2, Sybase, Oracle, or the like. A skilled artisan can readily adapt any number of data processor structuring formats (e.g. text file or database) in order to obtain computer readable medium having recorded thereon the nucleotide sequence information of the present invention.

By providing one or more of nucleotide sequences of the present invention, a skilled artisan can routinely access the sequence information for a variety of purposes. Computer software is publicly available which allows a skilled artisan to access sequence information provided in a computer readable medium. The examples which follow demonstrate how software which implements the BLAST (Altschul et al., *J. Mol. Biol.* 215:403-410 (1990)) and BLAZE (Brutlag et al., *Comp. Chem.* 17:203-207 (1993), the entirety of which is herein incorporated by reference) search algorithms on a Sybase system can be used to identify open reading frames (ORFs) within the genome that contain homology to ORFs or proteins from other organisms. Such ORFs are protein-encoding fragments within the sequences of the present invention and are useful in producing commercially important proteins such as enzymes used in amino acid biosynthesis, metabolism, transcription, translation, RNA processing, nucleic acid and a protein degradation, protein modification, and DNA replication, restriction, modification, recombination, and repair.

The present invention further provides systems, particularly computer-based systems, which contain the sequence information described herein. Such systems are designed to identify commercially important fragments of the nucleic acid molecule of the present invention. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A skilled artisan can readily appreciate that any one of the currently available computer-based system are suitable for use in the present invention.

As indicated above, the computer-based systems of the present invention comprise a data storage means having stored therein a nucleotide sequence of the present invention and the necessary hardware means and software means for supporting and implementing a search means. As used herein, "data storage means" refers to memory that can store nucleotide sequence information of the present invention, or a memory access means which can access manufactures having recorded thereon the nucleotide sequence information of the present invention. As used herein, "search means" refers to one or more programs which are implemented on the computer-based system to compare a target sequence or target structural motif with the sequence information stored within the data storage means. Search means are used to identify fragments or regions of the sequence of the present invention that match a particular target sequence or target motif. A variety of known algorithms are disclosed publicly and a variety of commercially available software for conducting search means are available and can be used in the computer-based systems of the present invention. Examples of such software include, but are not limited to, MacPattern (EMBL), BLASTN and BLASTX (NCBIA). One of the available algorithms or implementing software packages for conducting homology searches can be adapted for use in the present computer-based systems.

The most preferred sequence length of a target sequence is from about 10 to 100 amino acids or from about 30 to 300 nucleotide residues. However, it is well recognized that during searches for commercially important fragments of the nucleic acid molecules of the present invention, such as sequence fragments involved in gene expression and protein processing, may be of shorter length.

As used herein, "a target structural motif," or "target motif," refers to any rationally selected sequence or combination of sequences in which the sequences or sequence(s) are chosen based on a three-dimensional configuration which is formed upon the folding of the target motif. There are a variety of target motifs known in the art. Protein target motifs include, but are not limited to, enzymatic active sites and signal sequences. Nucleic acid target motifs include, but are not limited to, promoter sequences, cis elements, hairpin structures and inducible expression elements (protein binding sequences).

Thus, the present invention further provides an input means for receiving a target sequence, a data storage means for storing the target sequences of the present invention sequence identified using a search means as described above, and an output means for outputting the identified homologous sequences. A variety of structural formats for the input and output means can be used to input and output information in the computer-based systems of the present invention. A preferred format for an output means ranks fragments of the sequence of the present invention by varying degrees of homology to the target sequence or target motif. Such presentation provides a skilled artisan with a ranking of sequences which contain various amounts of the target sequence or target motif and identifies the degree of homology contained in the identified fragment.

A variety of comparing means can be used to compare a target sequence or target motif with the data storage means to identify sequence fragments sequence of the present invention. For example, implementing software which implement the BLAST and BLAZE algorithms (Altschul et al., *J. Mol. Biol.* 215:403-410 (1990)) can be used to identify open frames within the nucleic acid molecules of the present invention. A skilled artisan can readily recognize that any one of the publicly available homology search programs can be used as the search means for the computer-based systems of the present invention. Having now generally described the invention, the same will be more readily understood through reference to the following examples which are provided by way of illustration, and are not intended to be limiting of the present invention, unless specified.

EXAMPLE 1

The CMz030 (Lib143) cDNA library is generated from maize (DK604, Dekalb Genetics, Dekalb, Ill. U.S.A.) heat shocked seedling tissue two days post germination. Seeds are planted on a moist filter paper on a covered try that is keep in the dark until germination. The trays are then moved to the bench top at 15 hr daytime/9 hr nighttime cycles for 2 days post-germination. The day time temperature is 80° F. and the nighttime temperature is 70° F. Tissue is collected when the seedlings are 2 days old. At this stage, the colehrhiza has pushed through the seed coat and the primary root (the radical) is just piercing the colehrhiza and is barely visible. The seedlings are placed at 42° C. for 1 hour. Following the heat shock treatment, the seedlings are immersed in liquid nitrogen and crushed. The harvested tissue is stored at −80° until RNA preparation. The RNA is purified from the stored tissue and the cDNA library is constructed as described in Example 2. SEQ ID NO: 1 through SEQ ID NO: 5544 are from LIB143.

The CMz031 (Lib148) cDNA library is generated from maize (DK604, Dekalb Genetics, Dekalb, Ill. U.S.A.) pollen tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ stage plants. The ear shoots, which are ready for fertilization, are enclosed in a paper bag to withhold pollen. Twenty-one days after pollination, prior to removing the ears, the paper bag is shaken to collect the mature pollen. The mature pollen is immediately frozen in liquid nitrogen containers and the pollen is crushed. The harvested tissue is then stored at −80° C. until RNA preparation. The RNA is purified from the stored tissue and the cDNA library is constructed as described in Example 2. SEQ ID NO: 5545 through SEQ ID NO: 16803 are from LIB148.

The CMz033 (Lib189) cDNA library is generated from maize (RX601, Asgrow Seed Company, Des Moines, Iowa U.S.A.) pooled leaf tissue harvested from field grown plants at Asgrow research stations. Leaves are harvested at anthesis from open pollinated plants in a field (multiple row) setting. The ear leaves from 10-12 plants are harvested, pooled, frozen in liquid nitrogen and then frozen at −80° C. where they are stored until RNA preparation. The RNA is purified from the stored tissue and the cDNA library is constructed as described in Example 2. SEQ ID NO: 16804 through SEQ ID NO: 29109 are from LIB189.

The CMz037 (Lib3059) cDNA library is generated from maize (RX601, Asgrow Seed Company, Des Moines, Iowa U.S.A.) pooled kernels from plants at 12-15 days after pollination. Sample are collected from field grown material. Whole kernels from hand pollinated (control pollination) are harvested as whole ears and immediately frozen on dry ice. Kernels from 10-12 ears are pooled and ground together in liquid nitrogen. The harvested tissue is then stored at −80° C. until RNA preparation. The RNA is purified from the stored tissue and the cDNA library is constructed as described in Example 2. SEQ ID NO: 29110 through SEQ ID NO: 34509 are from LIB3059.

The CMz034 (Lib3060) cDNA library is generated from maize (DK604, Dekalb Genetics, Dekalb, Ill. U.S.A.) senescing leaves from plants at 40 days after pollination. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from leaves located two leaves below the ear leaf. This sample represents those genes expressed during onset and early stages of leaf senescence. The leaves are pooled and immediately transferred to liquid nitrogen. The harvested tissue is then stored at −80° C. until RNA preparation. The RNA is purified from the stored tissue and the cDNA library is constructed as described in Example2. SEQ ID NO: 34510 through SEQ D NO: 38668 are from LIB3060.

The CMz036 (Lib3062) cDNA library is generated from maize (H99, USDA Regional Plant Introduction Station, Ames, Iowa U.S.A.) husk tissue from 8 week old plants. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from 8 week old plants. The husk is separated from the ear and immediately transferred to liquid nitrogen containers. The harvested tissue is then stored at −80° C. until RNA preparation. The RNA is purified from the stored tissue and the cDNA library is constructed as described in Example2. SEQ ID NO: 38699 through SEQ ID NO: 43476 are from LIB3062

The CMz039 (Lib3066) cDNA library is generated from maize (H99, USDA Regional Plant Introduction Station, Ames, Iowa U.S.A.) immature anther tissue at the 7 week old immature tassel stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 7 week old immature tassel stage. At this stage, prior to anthesis, the immature anthers are green and enclosed in the staminate spikelet. The developing anthers are dissected away from the 7 week old immature tassel and immediately frozen in liquid nitrogen. The harvested tissue is then stored at −80° C. until RNA preparation. The RNA is purified from the stored tissue and the cDNA library is constructed as described in Example2. SEQ ID NO: 43477 through SEQ ID NO: 48460 are from LIB3066.

The CMz040 (Lib3067) cDNA library is generated from maize (MO17, USDA Regional Plant Introduction Station, Ames, Iowa U.S.A.) kernel tissue from plants at the V10+ plant development stage, 5-8 days after pollination. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ stage plants. The ear shoots, which are ready for fertilization, are enclosed in a paper bag before silk emergence to withhold pollen. Five to eight days after controlled pollination, the ears are pulled and the kernels removed. The kernels are immediately frozen in liquid nitrogen. This sample represents genes expressed in early kernel development, during periods of cell division, amyloplast biogenesis and early carbon flow across the material to filial tissue. The harvested kernels tissue is then stored at −80° C. until RNA preparation. The RNA is purified from the stored tissue and the cDNA library is constructed as described in Example2. SEQ ID NO: 48461 through SEQ ID NO: 53133 are from LIB3067.

The CMz041 (Lib3068) cDNA library is generated from maize pollen germinating silk tissue from plants at the V10+ plant development stage. Maize MO17 and H99 (USDA Regional Plant Introduction Station, Ames, Iowa U.S.A.) seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ stage plants when the ear shoots are ready for fertilization at the silk emergence stage. The H99 emerging silks are pollinated with an excess of MO17 pollen under controlled pollination conditions in the greenhouse. Eighteen hours after pollination the silks are removed from the ears and immediately frozen in liquid nitrogen. This sample represents genes expressed in both pollen and silk tissue early in pollination. The harvested tissue is then stored at −80° C. until RNA preparation. The RNA is purified from the stored tissue and the cDNA library is constructed as described in Example 2. SEQ ID NO: 53134 through SEQ ID NO: 56811 are from LIB3068.

The CMz042 (Lib3069) cDNA library is generated from maize ear tissue excessively pollinated at the V10+ plant development stage. Maize MO17 and H99 (USDA Regional Plant Introduction Station, Ames, Iowa U.S.A.) seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ stage plants and the ear shoots which are ready for fertilization are at the silk emergence stage. The H99 immature ears are pollinated with an excess of MO17 pollen under controlled pollination conditions. Eighteen hours post-pollination, the ears are removed and immediately transferred to liquid nitrogen containers. The harvested tissue is then stored at −80° C. until RNA preparation. The RNA is purified from the stored tissue and the cDNA library is constructed as described in Example2. SEQ ID NO: 56812 through SEQ ID NO: 61748 are from LIB3069.

The CMz044 (Lib3075) cDNA library is generated from maize (H99, USDA Regional Plant Introduction Station, Ames, Iowa U.S.A.) microspore tissue. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from immature anthers from 7 week old tassels. The immature anthers are first dissected from the 7 week old tassel with a scalpel on a glass slide covered with water. The microspores (immature pollen) are released into the water and are recovered by centrifugation. The microspore suspension is immediately frozen in liquid nitrogen. The harvested tissue is then stored at −80° C. until RNA preparation. The RNA is purified from the stored tissue and the cDNA library is constructed as described in Example 2. SEQ ID NO: 61749 through SEQ ID NO: 65946 are from LIB3075.

The CMz045 (Lib3076) cDNA library is generated from maize (H99, USDA Regional Plant Introduction Station, Ames, Iowa U.S.A.) immature ear megaspore tissue. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. The immature ears are harvested from the 7 week old plants and are approximately 2.5 to 3 cm in length. The kernels are removed from the cob and immediately frozen in liquid nitrogen. The harvested tissue is then stored at −80° C. until RNA preparation. The RNA is purified from the stored tissue and the cDNA library is constructed as described in Example2. SEQ ID NO: 65947 through SEQ ID NO: 68941 are from LIB3076.

The CMz047 (Lib3078) cDNA library is generated from maize (RX601, Asgrow Seed Company, Des Moines, Iowa, U.S.A.) $CO_2$ treated high-exposure shoot tissue. RX601 maize seeds are sterilized for 1 minute with a 10% Clorox solution. The seeds are rolled in germination paper, and germinated in 0.5 mM calcium sulfate solution for two days at 30° C. The seedlings are transplanted into a peat mix media in 3" peat pots at the rate of three seedlings per pot. They are then placed in a greenhouse. Twenty pots are placed into a high $CO_2$ environment (approximately 1000 ppm $CO_2$). Twenty plants are grown under ambient greenhouse $CO_2$ (approximately 450 ppm $CO_2$). Plants are hand watered. Peters 20-20-20 fertilizer is also lightly applied. Maize plants are grown in a greenhouse in 15 hr day/9 hr night cycles. At ten days post planting, the shoots from both atmospheres are frozen in liquid nitrogen and lightly ground by hand. The roots are washed in deionized water to remove the support media and the tissue is immediately transferred to liquid nitrogen containers. The harvested tissue is then stored at −80° C. until RNA preparation. The RNA is purified from the stored tissue and the cDNA library is constructed as described in Example 2. SEQ ID NO: 68942 through SEQ ID NO: 73607 are from LIB3078.

The CMz048 (Lib3079) cDNA library is generated from maize (MO17, USDA Maize Regional Plant Introduction Station, Ames, Iowa U.S.A.) basal endosperm transfer layer tissue. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ maize plants. The ear shoots, which are ready for fertilization, are enclosed in a paper bag prior to silk emergence, to withhold the pollen. Kernels are harvested at 12 days post-pollination and placed on wet ice for dissection. The kernels are cross sectioned laterally, dissecting just above the pedicel region, including 1-2 mm of the lower endosperm and the basal endosperm transfer region. The pedicel and lower endosperm region containing the basal endosperm transfer layer is pooled and immediately frozen in liquid nitrogen. The harvested tissue is then stored at −80° C. until RNA preparation. The RNA is purified from the stored tissue and the cDNA library is constructed as described in Example 2. SEQ ID NO: 73608 through SEQ ID NO: 78496 are from LIB3079.

The CMz049 (Lib3088) cDNA library is generated from maize (H99, USDA Maize Regional Plant Introduction Station, Ames, Iowa U.S.A.) immature ear tissue from 8 weeks old plants. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Ears are harvested from 8 week old plants and are approximately 3.5-4.5 cm long. Kernels are dissected away from the cob, frozen in liquid nitrogen and stored at −80° C. until preparation of RNA. The RNA is purified from the stored tissue and the cDNA library is constructed as described in Example 2. SEQ ID NO: 78497 through SEQ ID NO: 81737 are from LIB3088.

The CMz050 (Lib3114) cDNA library is generated from silks from maize (B73, Illinois Foundation Seeds, Champaign, Ill. U.S.A.) plants at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is beyond the V10 development stage and the ear shoots are approximately 15-20 cm in length. The ears are pulled and the silks are separated from the ears and immediately transferred to liquid nitrogen containers. The harvested tissue is then stored at −80° C. until RNA preparation. The RNA is purified from the stored tissue and the cDNA library is constructed as described in Example 2. SEQ ID NO: 81738 through SEQ ID NO: 83523 are from LIB3114.

EXAMPLE 2

The stored RNA is purified using TRIZOL® (phenol-guanidine isothiocyanate) reagent from Life Technologies (Gibco BRL, Life Technologies, Gaithersburg, Md. U.S.A.), essentially as recommended by the manufacturer. Poly A+ RNA (mRNA) is purified using magnetic oligo dT beads essentially as recommended by the manufacturer DYNABEADS®, Dynal Corporation, Lake Success, N.Y. U.S.A.).

Construction of plant cDNA libraries is well-known in the art and a number of cloning strategies exist. A number of cDNA library construction kits are commercially available. The SUPERSCRIPT™ Plasmid System for cDNA synthesis and Plasmid Cloning (Gibco BRL, Life Technologies, Gaithersburg, Md. U.S.A.) is used, following the conditions suggested by the manufacturer.

EXAMPLE 3

The cDNA libraries are plated on LB agar containing the appropriate antibiotics for selection and incubated at 37° for a sufficient time to allow the growth of individual colonies. Single selective media colonies are individually placed in each well of a 96-well microtiter plates containing LB liquid including the selective antibiotics. The plates are incubated overnight at approximately 37° C. with gentle shaking to promote growth of the cultures. The plasmid DNA is isolated from each clone using Qiaprep plasmid isolation kits, using the conditions recommended by the manufacturer (Qiagen Inc., Santa Clara, Calif. U.S.A.).

Template plasmid DNA clones are used for subsequent sequencing. For sequencing, the ABI PRISM® dRhodamine Terminator Cycle Sequencing Ready Reaction Kit with AMPLITAQ® DNA Polymerase, FS, is used (PE Applied Biosystems, Foster City, Calif. U.S.A.).

SEQUENCE LISTING (83523 sequences)

SEQ ID NO: 1 - DNA, 324 bp, Zea mays
  unsure at all n locations
  Clone ID: LIB143-011-Q1-E1-B7-F2A
acccnaaaaaccggccccagctacgcatnggccgaagcacacaaataaccataaaacatgggcccctggccccctccgttggcacgaaggtaactaaaccttcaaacaccagcccgatgttacaaacgctaaacgcatacatgttgaaccacggggcggaaagagatagaggctgcaccttatacgcaagaacatcctaatgcgaatgttacagctagagcgcatcacacagagcctgccgagacgagtggatagtcggactgcagacaccgataccactgcccattgggcacggccgggcgcttccctcccgcgcctgcggtg

SEQ ID NO: 2 - DNA, 453 bp, Zea mays
  Clone ID: LIB143-011-Q1-E1-B7-R2A
cgtctgcaccgaatcgatcgatcggtgcttttaatctctgagcaagcgatcgagctcaccaacaaccaccgcgctcaagagtagcagccggccggagccgaaaacgacgaggcggtggcatggggaggccgccgtgctgcgacaaggtgggagtgaagaaagggccgtggacccccgaggaggacctcatgctcgtctcctatgtccaggagcacggccccgggaactggcgcgccgtgccgaccaacaccgggctgatgcgctgcagcaagagctgcaggttgcggtggacaaactacctccggccgggaatcaagcgcggcaactttaccgaccaggaggagaagctcatcatccacctccaggctctccttggcaaccggtgggcggcgatagcgtcctacttgccggagaggacggacaacgatatcaagaactactggaacacgcacc

SEQ ID NO: 3 - DNA, 51 bp, Zea mays
  Clone ID: LIB143-001-Q1-E1-A5
tactggtcaagcattcccgggcccaaccacgcgtcaggccgctctagagga

SEQ ID NO: 4 - DNA, 231 bp, Zea mays
  Clone ID: LIB143-001-Q1-E1-H2
agtgagtcgtattatcaccggatcatcgttcttctcgtccctctatctttctccctaacgacgccttcctcgtagtgatcatttcctagatccttgattcctggggggtgacggtcagcctcggggtctgtcccgggccgatcgtggaacgcaagcccgtattcctgaacctggtcaagttcaccacacctagtgttgatcactaccccctctcgtttcagggagtcctta

SEQ ID NO: 5 - DNA, 402 bp, Zea mays
  Clone ID: LIB143-005-Q1-E1-B12
cccacgcgtccggaatggggcctcttacgaggaaatcaagaaagctattaggctgcttctgagggcccactcaagggtattatgggctacgtggaggaggatctggtttccaccgacttcaccggtgacagcaggtcgagcatcttcgacgccaaggccgggattgccctgaacgaccacttcatcaagctcgtctcttggtacgacaacgagtggggctacagcaaccgcgtcgtcgacctgatccgccacatgttcaagacccagtagagagagatatttctgcctccctatcgagggtcgtccccgatggcctttggtcgcagaccatctttgctgcttgtctatgctgagaataaatgtgaacggtgcccctggacgctggattcatgctggttttgg

SEQ ID NO: 6 - DNA, 310 bp, Zea mays
  Clone ID: LIB143-005-Q1-E1-B5
ccacgcgtccgcacatcgcctgctcaccggtctacgacgcatctccagctacgccagcagagttagatctagggactgggtgtcatcgccagccattctcgccctgttcgacacggccgtatcgatcttcctctatctgacgctggtgctagactcactcgcagtcgcagtcggctatgcgactgtcggacgggcacacaacttatgcacggtgtgcagccatcaatcgcgtcgacgaggctacagcagcgttagcgaggacaccagtggacatcgtgcaagagccacttgcgattacacctgtcatgct

SEQ ID NO: 7 - DNA, 397 bp, Zea mays
  Clone ID: LIB143-041-Q1-E1-F6
acggacgcgtgggtatcgaatggtgagattgtgcacttcaaagttgcttttaagccgacaccatctatcggggtgaaacagaacactgtgtcaagggagcgtcagaacgttgagcttctggcaagagggcgccatgacccatgcgtcgcccctcgagctgttcctgtggtggaatccatggccgcgttggtcctcgtggaccagctgatggcgcacgtggcccagtgcgagatgttcgcgctcaatgctgcacttcaagaaccagttggctctttctagcagaggcagagcacacctgatgagctcgcgccaaattttatcatttatcatagtaataagtagctcaagcgtggcttggtttgcttgtctcttgcaccgtagttttgttttttttccc

SEQ ID NO: 8 - DNA, 368 bp, Zea mays
  Clone ID: LIB143-034-Q1-E1-C6
aagtcaccccagccgcaaactgcagctctgcaagctacagaggccaccacgagtccacgacgccacgccctccgagagaaagagaaagagaaaaccaaagcacgataatgcccccgacccccacagccgccgcagccggcgccgccgtggcggcggcatcagcagcggagcaggcggcgttccgcctcgtgggccaccgcaacttcgtccgcttcaacccgcgctccgaccgcttccacacgctcgcgttccaccacgtggagctctggtgcgccgacgcggcctccgccgcgggccgcttctccttcggcctgggcgcgccgctcgccgcgcgctccgacctctccacgggcaactccgcgcacgcg

SEQ ID NO: 9 - DNA, 394 bp, Zea mays
  Clone ID: LIB143-025-Q1-E1-C10
tgggacaatgccaagaagtacatcgaggctggtgccagcgagcacgcgaggaccctcggtcccaagggatccgactgccacaaggccgctgtgatcggtgacaccattggtgaccccctgaaggacacctccggcccgtccctcaacatcctcatcaagctcatggccgtggagtccctcgtgtttgcccccttctttgccacccagggtggcctgctcttcaagtacctgtaacagggacaacaccaagcacacagcagaagtatacgatctcccgaccgaccgtggacaatatcgaataactcctgccaaatcgccagttccttttgtgtactgtgcgctagccgccgcctagctgcactgctgtatttttgtttcaggattgctgctgctg

SEQ ID NO: 10 - DNA, 259 bp, Zea mays
  Clone ID: LIB143-029-Q1-E1-H1
caatggacggtgtcgtacttgaacatgtaggtcatgtactccgtggccactggaagcacagcgacatcacactcatggactccacgacccttctcttcggtgacaagccggtcaccgtctttggcatcaggaaccctgacgaaatcccgtgaggtgaggctggcgctgagtatgtcgtggagtccaccggcgtcttcactgacaaggacaaggctgctgcacatctcaagggtggtgccaagaaggttgttatctctgc

SEQ ID NO: 11 - DNA, 396 bp, Zea mays
  Clone ID: LIB143-018-Q1-E1-D7
accaaggctgctgatgttggtgctgaccttgtggggaaggtagaaagaaacattcctgaggacgatccaagaaacccagctgttattgctgacaatgttggtgataatgttggagatattgctggaatgggatcagatctctttggctcatatgctgaatcatcatgtgctgctcttgttgtggcctctatctcgtcttttggaatcaaccatgaatttactccgatggtgtaccctcttctcgtcagttctgttggtattatagcatgtctcataacaacgctgtttgcaactgatttcttcgagataaaggctgtggatgaaatagagcctgctctcaagaaacagctcataatttccacaattgtgatgaccattggcattgcactaatcagt

SEQ ID NO: 12 - DNA, 424 bp, Zea mays
  Clone ID: LIB143-021-Q1-E1-A12
gtgatgattaatctcagcatactgtttaagtttccccatgcttcaatgtctgcatccaacactggtggtgcctgggacaacgccaagaagtacattgaggctggagtttcagagcatgccaggacccttggcccaaaaggttctgaccctcacaaggcggctgtcattggtgacaccattggagatcctctcaaggacacgtctggcccttccctcaacatcctcatcaagcttatggcggttgaatcccttgtcttcgcccccttcttcgccgcccatggtggcattctcttcaaatggctctaagccagcgagagacgcaggataaaggccgtagttttgcaaggcgagtagagcagtatgtcagtaatacagcatctatggcatgtgcttttgctcgtccagttcatgagccccgttgtgt

SEQ ID NO: 13 - DNA, 398 bp, Zea mays
  unsure at all n locations
  Clone ID: LIB143-061-Q1-E1-G2
tgattggtgaagtcttgtagttgcatatggttgttcattttctttcttaacacttgctttagacttgaatgaattaagaagggggaaacacttttgtgggtgtaaataatttagttcaagcaataggtaatccaacgatcatgatgcttgttatggtttagtagtagcttatctatgcttttgtgctcgcttttacctgtggttgcatatcaagtattattaaaatgccttgttgtctaaatatgatatattgtgttgggggccttcggcttccgaaggtcctcaaaaacatgatttaacaatgtttctggagtataatgtgtgaacaggtatcttcggacttgaatcagaaagggagaagctcanaagatacgaaagttgacacagtgccgaagctg

SEQ ID NO: 14 - DNA, 410 bp, Zea mays
  unsure at all n locations
  Clone ID: LIB143-037-Q1-E1-C3
aggaatagctgaaatggctgggatgagccataggattcgtgagagaactgatgctctagaatctgcaggaaattacaaggctgcaattgggaanggttttggcattggctctgcaaccttggtttcccttgcactaatttgtgcgtttgttagccgggctgctatctccactgttgatgttctgactcctaaagtattcatcgggcttattgtcggtgctatgctcncgtactggttctcggcaatgaccatgaagagtgtgggcagtgctgcgctcaagatggtggaggaagttcgtcggcagttcaacaacatccctgggctcatggaaggcaccacaaagcctgactacgcaacttgtgtcaagatctcaacggatgcatccattcaagagatgatccccccaggtg

SEQ ID NO: 15 - DNA, 202 bp, Zea mays
  Clone ID: LIB143-028-Q1-E1-F3
acccacgcgtccgcccacgcgtccgcccacgcgtccgcccacgcgtccgatttggtgcgtttgtaagccgggctgctatctccactgttgatgttctgactcctaaagtattcatcgggcttattgtcggtgctatgctcccgtactggttctcggcaatgaccatgaagagtgtgggcagtgctgcgctcaagatggtgga

SEQ ID NO: 16 - DNA, 335 bp, Zea mays
  Clone ID: LIB143-001-Q1-E1-G11
gcttcgaggaaggaaaaccctaccgctgtgggagtagcctccggcgatggctgcggcggcgatcctgccggagctggcgacgcaggtgctcatcccggtcgcggcggccgtgggcatcgcgttcgcggtggtgcagtgggtgctggtctccaaggtgcgggtcacccccgagcgccgcgcggacggcggggccgtgaagagcgggcccagcgactacctcatcgaggaggaggagggactcaacgaccacaacgtcgtcgtcaagtgcgccgagatccagaccgccatctctgaaggagctacatctttccttttcactgagtacaagtatgttg

SEQ ID NO: 17 - DNA, 387 bp, Zea mays
  Clone ID: LIB143-061-Q1-E1-E10
cactcatcattagctctgtgggtatcatagcttgcttgataaccactctttttgcaactgatttctttgagatcaaggctgtagatgaaattgagccggctctcaagaagcagcttataatttccactgctgtgatgactgttggcattgcacttgtcagttggttagggcttccatatacattcacaatcttcaactttggtgtgcagaagacggtgtataactggcaattattcctatgcgtggcagttggtctgtgggcaggactagttattggatttgttacggagtattacacaagcaatgcatacagtcctgtacaggatgttgctgactcctgcagaactggagctgctacgaatgtcatctttgggcttgctctgggat

SEQ ID NO: 18 - DNA, 212 bp, Zea mays
  Clone ID: LIB143-066-Q1-E1-H11
acgcatatccgctcacctacctctccagcatcctcccgtctccgtcgtctcgtctccgctcctcacctcgccagccatgggcaagatcaagatcggaatcaacggtttcggaaggatcggcaggctcgtggccagggtcgccgtgcagagcgaggatgtcgagctcgtcgccgtcaacgacgccttcatcaccacggactacatgacgtaca

SEQ ID NO: 19 - DNA, 101 bp, Zea mays
  Clone ID: LIB143-037-Q1-E1-C8
aactgagtctggacatgttttgcacttttgtttcccttcctgctaccatctgtgacagatccgctcgctaatatgggacctgagattagctttttgctgct

SEQ ID NO: 20 - DNA, 396 bp, Zea mays
  Clone ID: LIB143-015-Q1-E1-F12
actccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggacaagctgctgcacatctg

SEQ ID NO: 21 - DNA, 363 bp, Zea mays
  Clone ID: LIB143-025-Q1-E1-H7
cctcagctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcaggaaccccgaggagatcccgtggggtgaggctggtg

SEQ ID NO: 22 - DNA, 417 bp, Zea mays
  unsure at all n locations
  Clone ID: LIB143-057-Q1-E1-E6
cacacactcgagaactccatttcgatcgcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgacgtcaaggtgaacgactccaagacccttctctttggtgagaacgacggtgctgtgtctggctgcaggaaccctgaggagatcccatggggttcggttggcgctgaatatgttgttgagtctactggtgtnttcactgaccaggagaaggctgcagctc

SEQ ID NO: 23 - DNA, 456 bp, Zea mays
  Clone ID: LIB143-006-Q1-E1-F5
aaccgcacgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggatgttgctgtgtttggctgcaggaaccctgaggagatcccgtggggttcggttggtgctgaataggttgttgagtccactggtgttttcactgacaaggagaaggctgcagctcacttgaagggtggtgccaagaaggttgtcatctctgctcctagcaaggatgcccccatgt

SEQ ID NO: 24 - DNA, 422 bp, Zea mays
  unsure at all n locations
  Clone ID: LIB143-040-Q1-E1-H8
acgcctttctttcatcatattgaccaaattcgtcgtctctgtcgcgctgttgtaaacgggttagcagaagaacacacagggtgacaacaaatccttgttcggttatttctaatacatatggattggatgagattggaaaaaattaagaagaagtttaacttgtttgcgattcaaacacatccaatctcattcaattcacatggattgagagctaaccgaacaagcctgtagttggacaagggtgtaacacttatttgtcaggcgtaccgggcacagaccgcttcctatttgttcgtggggatgtaactgtaagccttgtgnaccctaagcagtctgcgtcttgtgcctgctgctgtancggtagagcagagagagagatcanatgtanattacattttttagctcaaattcacgacaaattg

SEQ ID NO: 25 - DNA, 424 bp, Zea mays
  Clone ID: LIB143-053-Q1-E1-G9
taaacctgtgctccaaaatcactggtcaaatccttgcgagcctcgtcatgaatccaccaaaggttggggacgaatcatatgcttcctacaaggcagagaaagatggaatccttcagtctttagctcgccgtgcaaaggcactggaagatgcattcaacacgcttgagggattttcatgtaacaaggctgaaggagcaatgtaccttttccctcagatccatctgccacataaggcaattgaggctgctaaagctgccaagaaagcacctgatgcattctatgcgctccgtctccttgaatcaactggaattgttgtggttcctggatctggatttggccaagttcctggaacatggcacgtcagatgcacgatcctgccgcaggaagataaaatccccgcggtgatcacccgcttcaaggcttt

SEQ ID NO: 26 - DNA, 416 bp, Zea mays
  Clone ID: LIB143-017-Q1-E1-C8
agttgctaccatactcagggacagcgagatgttcaacgaatggactctggaactgaaggccatggttgaaaggttaatatacataaggcaacaccaattaatgccccggaatccaaaagaaaccctggtgaatggagccatatcaataagcaaattgggatgtttactttcactgggctgaatagcgaacaagtcgcattcacgaggcacgaataccacatttatatgacatctgatgggaagatcagcatggccggtttgagcatgaggactgtgccccatcttgcacatgccatacacgctgcagttactcaactgaaatgaggatagtatcgcagctttcgtgaataaaacctgaatcatccacaacaatgttctaagtactcatccactggtatttactggttgacctactg

SEQ ID NO: 27 - DNA, 389 bp, Zea mays
  unsure at all n locations
  Clone ID: LIB143-022-Q1-E1-G3
agacacctccgccacctccaccctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacgtgtcaaggagtacctaccaatcaccggtctggctgaattcaataagctgagcgctaagcttatctttggcgctgacagccctgctattcaggagaatanggttgctaccgtgcagtgcctatcgggtactggttctttaagag

SEQ ID NO: 28 - DNA, 382 bp, Zea mays
  unsure at all n locations
  Clone ID: LIB143-048-Q1-E1-G12
gcagcagacacctccgccacctccaccctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacgtgtcaaggagtacctaccaatcaccggtctggctgaattcaataagctgagcgctaagcttatctttggcgctgacagccctgctattcaggagaatanggttgctaccgtgcagtgcctatcgggtactg

SEQ ID NO: 29 - DNA, 337 bp, Zea mays
  Clone ID: LIB143-001-Q1-E1-H6
ctcgaatcgatccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacgtgtcaaggagtacctaccaatcaccggtctggctgaattcaataagctgagcgctaagcttatctttggcgctgacagccctgctattcaggagaatagggttgctaccgtgc

SEQ ID NO: 30 - DNA, 429 bp, Zea mays
  Clone ID: LIB143-002-Q1-E1-H2
gtccgacgtcccaccggcccccgctctcgttttcccccgccggaacaagcacgctcaagcgctgcgcaacggattggccctgctaacgttcgccccgggcaagggcaaggccccaacgcccaacgcaaggtaagttagccaattgggcaactggcggctttctccccaagaaaaacaacaagcaaaaacttcggcaacctcaaccctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacg

SEQ ID NO: 31 - DNA, 360 bp, Zea mays
  unsure at all n locations
  Clone ID: LIB143-067-Q1-E1-E12
acgcttcactcgtttccttccgatccatacacaccgcgcacgtacgcgtactccatcgtcccggtgcaggcgggttcacgtcacgacctcgggcgagacgagatggcgacgccgaacgggcttgctcggatcgagacgaacggggcgaccaagcccgacaacggcgtgtgccacgacgacagctcggcgccggtgcgcgcgcagaccatcgacgagctgcactcgctgcagcggaagcggtcggcgccaaacacgcccatcaaagacggcgccgcctcgaccttcgccgccgcgctctccgangangagcgccacaggcagcagctgcagtccatcagcgcgtcgttggcgtctctgaca

SEQ ID NO: 32 - DNA, 237 bp, Zea mays
  Clone ID: LIB143-052-Q1-E1-E4
cggacacgtgggtctgccgccgccaccgcacaagaagctagctcctgcctgtaccaccccggcatggcgatgctatcccgcgcagcctcctccgcggcccggcgcccgctgctgccgccgcctaggcttctggcggtgagggcgatggcgtcgtcgctcttcggccacgtcgagccggcgcccaaggaccccatcctcggcgtcaccgaggctttcctcgccgacccctcgtccgac

SEQ ID NO: 33 - DNA, 362 bp, Zea mays
  Clone ID: LIB143-054-Q1-E1-F1
acccacgcgtccgggaaacaagagatggagctaatggctggacggatcaagaatgtaagacagaagctctacgacagtttgtctgccaaggacaagagcggcaaggactggtctttcattctgaggcagattggcatgttctcctacaccggcttgaacaaagcgcagagtgacaacatgacggataaatggcatatttacatgaccaaggatgggcggatctcgttagctgggctgtccctggctaagtgtgattatcttgccgacgccatcatcgattccttccataatgtgaactaggctgaggtacgatagttgagggtcaagctattgatgtttagttccgtggacgctaggctggg

SEQ ID NO: 34 - DNA, 257 bp, Zea mays
  Clone ID: LIB143-029-Q1-E1-E1
gctacagcaaccgcgtcgtcgacctgatccgccacatgttcaagacccagtagaggggttttttccccctgcttctcatggatggttgctgcttgtgtatgccgagaataaatgtggatggcgcgtgcctctgggtcgccaggttcatgctgagtctggacatgttttgcacttttgcttcccttcctgctaccatctgtgacagaaccgctcgctaatatgggacctgagattagctttttgctgcttgtggtgat

SEQ ID NO: 35 - DNA, 375 bp, Zea mays
  Clone ID: LIB143-066-Q1-E1-D11
gaaaggcactcgggtcagaacccttggctctagggaatttatgcgctactatcgccagaaaccacggccttctgttgcaccagaccgtgcgcttgcactttcactagcttccagctacaagagcatgggtttggtgacagtgcagtctaaggagcagatggtgaggctgaaagttctccgtgctatgaacaggaccggggtcgagactatgcggaacaagatcggaatgaagagcaatgtgatccggaacctccctaagaattgcccgcactagacaacactgccttctcctgcaccctatctggagcttctcctggcatttatatggtgtcttatggtttcttgtctgtcgctgacaacgttggcgcttaagat

SEQ ID NO: 36 - DNA, 334 bp, Zea mays
  Clone ID: LIB143-004-Q1-E1-H5
accacttgctcgccttcgccccttctgtctcccttcgtccgtagcagaccaggaacgcccaaggcgctagcgtctccaagatggtgctgcaaaacgacattgacttactcaatccaccggcagagcttgagaagctaaagcacaagaagaagcggctagtccagtcccccaactccttcttcatggatgtcaagtgccagggctgtttcagcataaccactgtgttcagccactcccagactgtggttgtgtgcccaggctgccaaactgttctgtgccaacctaccggtgggaaggccaggctcaccgaggggtgctccttccgtcgcaaggg

SEQ ID NO: 37 - DNA, 413 bp, Zea mays
  Clone ID: LIB143-057-Q1-E1-C3
acaccagtctgccgcagtgccgcaccccgcacgagacgcgtccttgaggggcacgtccgagatcggtggcgcctgcctctcgccgccgatactgtgcctctcgcggtctcgctccccctcgcaggtcttttggtttttttagttcctccctttgcttcttggaggtgtttgttgccgtctcagccgcagttcttgagacatgcagagccagatagtgtgccacgggtgcaagacccttctgttctacgcaaaaggtgctccgaacgtgtgttgtgcggtatgccatgtggtcaacaatgtgcagcctccagcaatggacatggctcgacttatatgtggtggctgccagacattattgatgtatgctcgcagtgcaacaactgtaagatgctcatgttgtgacacagtcaatc

SEQ ID NO: 38 - DNA, 416 bp, Zea mays
  Clone ID: LIB143-026-Q1-E1-C1
cccacgcgtccgcatccatgtccaggaggtctgttgctgcacacccttggcatgatctggagataggtcctggtgctccaaccatattcaactgcgtcattgagataccaaggggcagcaaggttaaatatgaacttgacaagaaaactggactgatcaaggtggaccgtgtgctgtattcatcagttgtttaccctcacaactatggattcattcctcgcacgctttgtgaagacagtgatcctttggatgtactggttataatgcaggagcctgttatcccaggctgtttcctacgtgcgaaggccatcggccttatgccgatgattgatcagggagaggcagatgacaagatcattgcagtgtgcgctgatgatcccgagtacaggcattacaatgatatcaaggagctccca

SEQ ID NO: 39 - DNA, 411 bp, Zea mays
  unsure at all n locations
  Clone ID: LIB143-057-Q1-E1-F6
acactaattcgcagtgggcatctggatgaccggtcaaagcccaccctcttctccatggcaagactcgacagggtgaagaacataacggggctggtcgaagcttttgctaagtgcgctaagctgagggagctggtaaaccttgtcgtcgttgccgggtacaatgatgtcaacaagtccaaggacagggaagagatcgcggagatagagaagatgcatgaactcatcaagacncacaacttgttcgggcagtccgctggatcctgccagacaacaggcccgtaacgcgagctctatcgctacatcgctgataccaatggtgctttcgtacacccgggcctctatgaagcgttcggtctcaccgtcgttgaggccatgnactgtgggcttcctactttcgcgacgctccatgga

SEQ ID NO: 40 - DNA, 420 bp, Zea mays
  Clone ID: LIB143-065-Q1-E1-C10
agggccatggaaaggcagggtcttgatatgaaagttgcagctctggttaatgacactgtaggcacattggctggtgggagatatgctgataatgatgttgttgctgctgtaatattgggcactggcacaaatgcagcttatgtggaacatgcaaatgcgattcctaaatggaccgggctgctacctagatcagggaacatggtaatcaacatggagtggggaaacttcagatcagataaacttccaaggtcggagtatgataaatccttagacttcgaaagtttgaaccctggtgagcagatatatgaaaagatgatttctggaatgtatcttggagaaattgtccggaggatcctgctgaaactggctcatgatgcttcattgtttggggatgttgttcctccgaaactggaacagcta

SEQ ID NO: 41 - DNA, 376 bp, Zea mays
  Clone ID: LIB143-024-Q1-E1-B4
aattaagctgccgagctacaggggcgacaacgtcaacggcgacgacttcaccgagaagagccgcgtgccggacccgcagaggatgatccgcgcctacgcacagtcggtggcgacactcaacctgctccgcgcgttcgccaccggagggtacgctgccatgcagcgcgtcactcagtggaacctcgatttcatggatcacaacgagcaaggtgataggtaccgtgaattggcccatagggtggatgatgctcttgggttcatgactgcatcggggcttacagtcgaccacccgataatgacaactactgactttctggactccgcacaattgcctcccctaacccaacgaacaaggtcctaacccttaaggatccaa

SEQ ID NO: 42 - DNA, 420 bp, Zea mays
  Clone ID: LIB143-022-Q1-E1-G5
agggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatg

SEQ ID NO: 43 - DNA, 387 bp, Zea mays
  Clone ID: LIB143-023-Q1-E1-A7
acacgcaccccgctgccgcggctcgaacataaaccctagagccgccggcccggtcgcgctagcgacacaaatctcaaatcacccggagagaactcgctcgcgaaggctgaactcatggctcgcgtcttcgttgggaacctggatccgcgtgtcacggcgcgggagattgaggacgagttccgcacgtttggggttctgaagagtgtatgggttgctaggaaaccaccagggtttgccttcattgacttcgatgaccgcagggatgcacaagatgccattcgcgatttggatggtaagaatggttggagggttgagctgtcaaccaaagatggtggtggccgtggccgagaccgtaatggttctgatatgaagtgctatgagtgtggt

SEQ ID NO: 44 - DNA, 406 bp, Zea mays
  unsure at all n locations
  Clone ID: LIB143-024-Q1-E1-F11
caggagccaaccaggaggatgccctcgcgcaaattgaaaacctttcaaaagtaaacccgatgcttggcttccttgggtgaaggcttggaaaaccgtaccctgaattgacaaaaatgcaagcccgggcaatttttgaacctgcaatagaaatgacaaaccagggtgtcaaattgtcccaaaaaataagggtcccccttgttggaacaacacaggaactggggcatcaagtgactcttatccgcaaagttgctgagaaagtgttcgcaaatgtgggcaagactatcgggtacaaagttggaacaatgattgagatcccaaggcaactctgggggctgatgagataacggagcaagctgaattcntctccttcggaacgaacgacctgacgcagattacctttgggtac

SEQ ID NO: 45 - DNA, 182 bp, Zea mays
  unsure at all n locations
  Clone ID: LIB143-027-Q1-E1-C10
cccacgcgtccggtgccatacatcctatcactcggtatgttatgaactatctccgtgctgcgtgtgggtcgcggcagacattggaagaggtgatggaaggtgactttggtgttaatagaggtgcgcctngtggctgttgaccctgaccgccccacatcatcccttgctgtgcacatcgcatg

SEQ ID NO: 46 - DNA, 403 bp, Zea mays
  Clone ID: LIB143-059-Q1-E1-D6
ggcggcttgttccatcgaggcgggagaccgatgcttggccttgaagaagggcgcggcgtaaaacggcccttcttcacctcgcccgacgagctcctcgaggaagagtactacgacgagcagctgccggagaagaagcgccgcctcaccccagagcaggtgcttctgctggagaggagcttcgaggaggagaacaagctggagccggagcgcaagacggagctggcgcgcaagctgggcctgcagcctcgccaggtggccgtctggttccagaaccgccgcgcccgggtggaagacaagcagctcgagcgcgacttcgaccgcctcaaggcctccttcgacgctctccgagcggaccacgacgccctcctccaggacaacaaccgcctccgctcacaggttgtgt

SEQ ID NO: 47 - DNA, 413 bp, Zea mays
  unsure at all n locations
  Clone ID: LIB143-058-Q1-E1-G4
ccaagcctctactgtaaatctgataagattctgctttgcaaaatgagtttgaaactgtgaataagcgaatggatgatgaagctaacaaggcttctcggcttgagcagaacattaagcttctgacacaaggatatcatatacgggctggaaaactgtggtcacaggtccaagatacattcaagcagatggacactgccgcaacagagctcgaatgcttccaagagctgcagaaacaggaacatctcgctgcttcatatcgaatccaaaatttgtctgaagaagtgagtaaacagaaggcactagaaaggaccctccagagccgctacggcgagctggtttctggtttccagaggatccaagaacaagtctatgagcacaagangcaactcaaggtacaagangcggtataagcc

SEQ ID NO: 48 - DNA, 352 bp, Zea mays
  Clone ID: LIB143-031-Q1-E1-B4
tagcgacaggtcacgataaaccgcgcgagccgcgccaactccctactgcatgaggtgcctcggccttcgtcgtgctctccgccggcaacgagtatagactggcgcgcatgggcagcttcgagctgtaccggatgtccaccatcggcatgtgcctcaccgagacgctcgacgatatggtctccaacggtaccctcagcccggagctcgctatccaggtcctcgtccagttcgacatgtccatgacggatgctctggacaaccaagtgaacagcaaggttactgtcaagggtcacctgcacacctacacgttctgtgacaatgtgtggaccttcatcgtgacagacgcaagctt

SEQ ID NO: 49 - DNA, 370 bp, Zea mays
  Clone ID: LIB143-017-Q1-E1-A1
agatccgcgccgccgcaagagaggaggagagaccacctccaacgccacccggaaaaaggacagcgcggcggggaggaggaagaagaagaacatggggaagggcgtcctggaggtgcacctcgtcgacgccaagggcctctccggcaacgatttcttagggaagctggacccctacgtgatcatgcagtaccggagccaggagcgcaagagcagcgtcgcccgagaccaaggaaggaacccgtgctggaacgaggtgttcaagttccagatcaactcggccgcggccaacgtgcagcacaagctcatcctacggatcatggaccacgacaacttctccagcgacgacttcctcggcgaggcgacgatcgac

SEQ ID NO: 50 - DNA, 399 bp, Zea mays
  Clone ID: LIB143-061-Q1-E1-G4
gttcgcagtgggcagtggcagccagccagtgagctagcctcccgagccctatctatccttttctcggcacctcgcgggtctcccgtccgccccgtcccgcattcgtatcctctcctcactctcgccgccgccgcttcccctgcgccccgagccaagatgaatgttgaaaagctcaagaagatggcaggtgctgtgcgcactggggggaagggtagcatgcgcaggaagaagaaggcagtccacaagactacgaccacagatgataaaaggcttcagagcaccctgaaaagaataggagtgaacaccattcctggtattgaagaggtcaacatctttaaggatgatgttgttattcagtttgtgaatcctaaagtgcaagcttcaattggtgctaataca

SEQ ID NO: 51 - DNA, 402 bp, Zea mays
  Clone ID: LIB143-059-Q1-E1-F6
gttcgcagtgggcagtggcagccagccagtgagctagcctcccgagccctatctatccttttctcggcacctcgcgggtctcccgtccgccccgtcccgcattcgtatcctctcctcactctcgccgccgccgcttcccctgcgccccgagccaagatgaatgttgaaaagctcaagaagatggcaggtgctgtgcgcactggggggaagggtagcatgcgcaggaagaagaaggcagtccacaagactacgaccacagatgataaaaggcttcagagcaccctgaaaagaataggagtgaacaccattcctggtattgaagaggtcaacatctttaaggatgatgttgttattcagtttgtgaatcctaaagtgcaagcttcaattggtgctaatacatgg

SEQ ID NO: 52 - DNA, 402 bp, Zea mays
  Clone ID: LIB143-003-Q1-E1-F9
agcttcctgctgagctcaaaccccttccgcctccccatcaaccattccatccgccgccgccgccgcctgcgcatgatgaatgtggataagctcaacaagatggctggcgctgtatgcaccggacggaacggcagcatgcgcatgaagaagaaggcagttcacaagaccacgatcacagatgataagcggcttcagatcaccttgaaaaggatcagggggaacaccattcctggtaacgatgaggtcaacatcttcataggacgatgttgttatccagtttcagaacccgaaagtgcatgcatccattcctgcaaatacataggtggttagtggagtaccccagacaaaaagtctgcaagaccttctgccatcagttatcaaccaactgggccttgataacct

SEQ ID NO: 53 - DNA, 195 bp, Zea mays
  Clone ID: LIB143-028-Q1-E1-G8
cgacgacacccgcatagggcttgcgtttgacgtaatgggtcgtgtgccatacggaacatcgtttctggataaacaggccgaagaaaggtcctgggacatcaacctaggatggttcttagagccagtggttcgtggtgactaccccttctccatgagatcattggctagggaacgactacccttcttcaaggacga

SEQ ID NO: 54 - DNA, 404 bp, Zea mays
  Clone ID: LIB143-037-Q1-E1-E3
cgaacatcacccccgatctgatcgaatcgaaggctgcggcggcgatgggcggtgaccatggcggtgggcacgccggcggcgacttccgccagaaggtatggagcatgacgggcggcccgtactgccgccccgtccactggcgccgtaacaccgccatcgccatgttcggcgtcttcctcatctgcatccccatcgctatgaagtccgcagagctcgagcaacgcccgcatcacccagtccggccaatcccatctcaactgtggtgcaaaaactttggtaagaaggaatactgaaggaccctccaactagcatgaagtgcgggcaccttgcttttgccttctttttgtggaaacctgtgcctagccataatgctgggttaagtgttaggagcatctctggaatgc

SEQ ID NO: 55 - DNA, 259 bp, Zea mays
  Clone ID: LIB143-029-Q1-E1-H3
ggagatctgtgacttcgacttcgagccctgtggctactccatgaatgctgttcatggccctgctttgtcgaccattcatgtgaccccagaggacggcttcagctatgcaagctacgaggtcatgggctttaacccgggctctttctcttatggtgacctggttaagagggtgctgaggtgctttggtccaactgagttctctgttgccgtgaccatcttcggtgatcgggacaatgcgaagacctgggggacgaaactg

SEQ ID NO: 56 - DNA, 328 bp, Zea mays
  Clone ID: LIB143-004-Q1-E1-C5
atacaatttagaagcgcccctcctcctctcccccatccgtacccaatctaatcgacacccggccgagatgggccgcaagttcttcgttggtggcaactggaaatgcctggaagagcccgcgttcttcttccaatgcgcctgtgcttccaggctccagcccagagcaaatcgtaaaagcccttcataagtttcgtgatgcatgttgtctgtaggagcagaggagttcgatatccaacttttggagacccattctcgtttgctgcacgaattaaccttacgtttcttgtcatggagctcggggcttgctcaatctgagcataggttggag

SEQ ID NO: 57 - DNA, 413 bp, Zea mays
  Clone ID: LIB143-031-Q1-E1-E5
aatccaatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcattcttggacactctgaaaggaaagctctgctgggaaaatcaaatgaatttg

SEQ ID NO: 58 - DNA, 260 bp, Zea mays
  Clone ID: LIB143-029-Q1-E1-G4
atccaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccat

SEQ ID NO: 59 - DNA, 246 bp, Zea mays
  Clone ID: LIB143-001-Q1-E1-H1
ttaatacccagctggggatctccagccacacgacatatgtagcacttaacccttgcatatgtctaccattcccacgggtcctccactacgtgaaccggtccgcgccacccgagagtacggtactccaccatccagccacatgccaggtgggtacacgccactcccgccatctctccactcccagtgcgcgattgtcttttcacatatggagtagccgggttcaggctttcccatgacgaggtatgt

SEQ ID NO: 60 - DNA, 315 bp, Zea mays
  Clone ID: LIB143-068-Q1-E1-H4
ggccgaggcacgcgtcagtcccatcgcatcccatcccactaccacccatctcgtcgtccgccgattcgaccggttctccaacccagggctgtgatggcgacgaagaggagcgtgggcaccctcggcgaagcggatctgaaggggaagaacgtgttcgtgcgcgccgacctcaacgtccctctcgacgacgcccagaagatcaccgacgacacccgcatccgcgcctccgtccccaccatcaagttcctcctcgagaatggcgccaaggtcatcctcgccagccacctgggtcgtccaaaaggtgtccacccaaag

SEQ ID NO: 61 - DNA, 377 bp, Zea mays
  Clone ID: LIB143-068-Q1-E1-H5
ccggatggctcgcctatggtgctgtactggagaatttacaatcaagagctgacctaactgagagaataagaggatgtattgtagactctgcaccagttctagagataagaccagaggtctgggcggccgggttctctgctgcaatgttaaagaaaagcagttccatgactggacctacgactgaatctcttgatgggcctgttgtaaatggcaccttgaacagagttggctccaatgtgatccaaccttcatggggtgaatgttttcttctgtcaactctgcggaaattcttcgagattgttctttacgtacctgatgtaaacaagcggctgtgcaaggttctctcggtgctttcagagcagcagcctcctgcccgc

SEQ ID NO: 62 - DNA, 322 bp, Zea mays
  Clone ID: LIB143-068-Q1-E1-H8
ccgggcagacccacacgtcaggagcatcagccatggcgatcgcggcgcgcgtcctgcgccgcctcccgctccacctctacccctcgctcgctcgctctttctgcgcagtttccccggccgccggctcggccgccccggggtccgcctcggtcgcccccgggtccgccaaagtccccgatcgcatcgtgcgcgtcctcgccatcgatctcgagggggcgctccgcgaggtcgtcggcctctacgggcagacactcctccgcgcgctcgccaacgcggagctcatcgatccggcctcccatcgcctccaggatatcgacgcgtg

SEQ ID NO: 63 - DNA, 250 bp, Zea mays
  Clone ID: LIB143-068-Q1-E1-H9
aaacagcggcagctcacctccacgcgagccaagcgcccgcaaaaccctagccccgcccgccccaaaccctaggcggctacggtctccgattccggggtcacgttctaatggcatcttcgccggacttgttccccaacgttaccttctccgacgtctccgaagccgcaacaaggcctgccgcccaagggggcaacgccgccttccgtctccgggccgccactggaaccccgcggcttaaactccttaaagg

SEQ ID NO: 64 - DNA, 320 bp, Zea mays
  Clone ID: LIB143-068-Q1-E1-H3
ggctgttctggtcgacgacggcggagaaggcggcggaggcgctcggcgtcgtcgtccccgtggtggagacgctggagcaggcgttcagggagtgctccaaagggagagccttcttcggcggcgacgccgtcgggctcgtggacatcgcgctcgggagcttcgtggtgtggatcagggtggtcgacgaggcggccggcgtaaagcttctggacgaggccaagttcccggccttgacggcgtgggcggagcgcttcttggcagtggacgccgtgaaggaggtgatgccggacgccggaaggctgttggagcactacaaggga

SEQ ID NO: 65 - DNA, 247 bp, Zea mays
  Clone ID: LIB143-068-Q1-E1-F12
aggagcggttggagcttcgacgtgcggtttccatttcctgccctgctctgatggccgtcgccgaagtggcgatcgagattctcccgcagcagcagcagcagcagccgccgccgccgccgcgggaaccggcggtagtgcctccgaacctctccgtgccgagagtgctccagtatctgtacctcctgagcgcgtgggtcgcctgcgccggcgttgctgccgggaccgttgcgcccccggccttggggcg

SEQ ID NO: 66 - DNA, 318 bp, Zea mays
  Clone ID: LIB143-068-Q1-E1-F2
cgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaaggaggagttcccaatcctctcttacgccgatttctaccagctcgcgggagttgtggccgtggaggtcaccggtgggcctgagattcccttccaccccggtagggaggacaagcctcaacccccaactgagggccgccttcctgacgccactaagggttctgaccacctgaggcaagtttt

SEQ ID NO: 67 - DNA, 343 bp, Zea mays
  unsure at all n locations
  Clone ID: LIB143-068-Q1-E1-F3
cgggtcaaaccctaagcagggagttgatttatccgctgcagccatgagtaagttgcagtctgagtctgtcaaggatgccatctcccagattgttggggatgccaaggagaagaatangaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaag

SEQ ID NO: 68 - DNA, 354 bp, Zea mays
  unsure at all n locations
  Clone ID: LIB143-068-Q1-E1-F4
agctaagaacaatgcatcctcggttgatctangaatgtaaacccaatttatgagtctgaataggaccaggcatcaggatcctatatgtgggcttcggttaaaacaacgaggcgacttcatttttttatccagattccaataacagtccgaattcgagacaaacatgcgtgcatgcagttcgaagttgccttgttattatatttttcacacgctttcagtgagatatactagaactcgtcactacagcattacatgaatttttgcaggattcanatctgccggaaacctgtatcttcatccagtatcaaggggaagttctgttgttgtgtgttcggtgatggatacatccaaaag

SEQ ID NO: 69 - DNA, 326 bp, Zea mays
  Clone ID: LIB143-068-Q1-E1-F5
atgcaagactctacattgagtcgtagtagccgccgccgcgtccaggacgatcgatgcctctccccgccgcgatgagatcatccatgctcagaggtcggtgtaacctcttcctccctttcgctgctcgctgttcgcaggccggaggaggatgcggcggcggatgctcacttctgctcacgcgccggtggcagtcgtcgctgccgcagctggaccacgtcgccgacaggtccaacgaggagagcggcggcgatatctactgggacaacctcggcttcgggctcaccccgaacgactacatgtacgtcatgcggtgctcgcaggaggat

SEQ ID NO: 70 - DNA, 221 bp, Zea mays
  Clone ID: LIB143-068-Q1-E1-F6
ttgagtcgtattaggcagctcggcacgtggtcgcagtgccgtaccccggccgatgtcacgtcaaccccatgctcgtcgtgtgccgcctgcacaccgccgcggacgctgcctttagcgtgaccgtcgtcgtcacatacgattggaactcggctgctggacgcaacgaaggtgcccggcacgctccactatcgcgtccgcctcgccatgatcaacaacgtcat

SEQ ID NO: 71 - DNA, 364 bp, Zea mays
  unsure at all n locations
  Clone ID: LIB143-068-Q1-E1-F7
gcagtgaccaactcgaagcttgcgttcttgtagtagaggtcggcagcaagcggtagagcgagaggtcgagaagatgaagagcagcactctgttggcgatcctagttctccaggcccttctggtctctacggccgtggccaaaggacctgcagggccgaagaagcagtgctggtgcggcgagtgcaccagctggtcgggcgtgtggacctgcgacgacctcctcaccaagtgcgccgccacctgcaagaactgcgtcnccgtctccacggacaagggcgccaccaagtacagatgccgcgacttcctccccgaaaactgcggctgcaagattcactagactcatccacagcggcacagccgatgg

SEQ ID NO: 72 - DNA, 366 bp, Zea mays
  Clone ID: LIB143-068-Q1-E1-F9
agggcacacctcaagctcgcgcccaccttccacgtcgaggtccgagtcctgctttgatggcgaccgacgtggctgagactcccgcgccgttggtggatgcggccccagaggcgcccgccgacgccccggcggcgcctgctgccgacgcgaagccggccaaggccaagaaggccaccgcgccgaagaagcgcgccagcccgacccacccgccgtacgccgaggtaattggtgccctccctttgatccttctgccgtgccgtgctgtgcgtgcctctccgccgcgtctggatcttactgaatagtggatggtcggtgcgcagatggtctcggaggcgatcacgtcgctcaaggagaggacgggtccag

SEQ ID NO: 73 - DNA, 346 bp, Zea mays
  Clone ID: LIB143-068-Q1-E1-G1
ctctacaatacaccgagctggtctgtttagttggaaagccatctgtacgtttttcgccgatcatggaggatgagaggaacacccagcagcaccagggcggtgagcaggcccaggaccaggagaacgaggtgaaggacaggggactcctggacagcctactcggcaggaacaagcacgacgaccaggagaagaagaaccagcaggcggaggaggagctggcgaccggcatggagaaggtcacggtggccgagcccgaccacaaggaggagggacacgaggccgccgagaagaaggacagccttctcgccaagctgcaccgcaccagctccagttccagctcgtcgag

SEQ ID NO: 74 - DNA, 361 bp, Zea mays
  unsure at all n locations
  Clone ID: LIB143-068-Q1-E1-G11
cttatcttacgccgtcgtcgtcctgctccggcgacggccaggcagccgagcagataaaaagagccgaagcagcaccaccaccacgtgcctctcttctcagcttgcctgcctcactgcacccggccacaagggcaagatgcccgcctctgtcgctgtctacccggccaagatggcatgctgtctccagctccaccatcttcgccggccgtcccctgctccactccctgctcgggtcctcttcctcctctcgaccccgcgcctgcgccccgtcagagcttctcccggcccgtcnccgcccaactccttcgctggctggtcctccgactccgacagcgcggatgacggcgccgacaaatctact

SEQ ID NO: 75 - DNA, 351 bp, Zea mays
  unsure at all n locations
  Clone ID: LIB143-068-Q1-E1-G2
gggccgacccacgcgtcaggaccatctggctttagcttgggaagcagttatccaccccgtcaacatcagcagagtgctaattcagttcaaaatgctgggctggaaactattggactaagaccggcaaattctccaagtctgtcaactaattcaggggtttatgagcaattcatgcagaagtaccatcaaccacagactcaaaattcacttaggttgcangcagcttcaggtcctcaacagtacaaggatcagagccaaaaatccgttcaaggaacacaggctgtgccggatccatatagcttacttggactgttgagtttaataagaatgaaagagcctggaccaacaact

SEQ ID NO: 76 - DNA, 315 bp, Zea mays
  Clone ID: LIB143-068-Q1-E1-G3
aagaccctagagtaacgtcgcattagcttgggaagcagttatccaccccgtcaacatcagcagagtgctaattcagttcaaaatgctgggctggaaactattggactaagaccggggggttctccaagtctgtcaactaattcaggggtttatgagcaattcatgcagaagtaccatcaaccacagactcaaaattcacttaggttgcatgcagcttcaggtcctcaacagtacaaggatcagagccaaaaatccgttcagggaacacaggctgtgccggatccatatagcttacttggactgttgaatttaata

SEQ ID NO: 77 - DNA, 345 bp, Zea mays
  Clone ID: LIB143-068-Q1-E1-G4
accgcgagtcgtcctcctctctgtcttcgctcggcgatctatcaaggaggccaggagggtgagggggagatggcggagaacccgcagctgtttgggaacgggatgccggtgccgttctacggcgagatgttcgtcctcgtccgggacggcgtcgagttccacgtcgacaagatcccgtcagctcctggaggtcatgtgaaaacaaaaggcacaatttacctgtccaatataaggatggtgtttgttgccagcaagcctgttggcaacttctttgcttttgatatgccactgttgtttgtgcatggggagaagttcaatcagcccatatttcactggaacaacatc

SEQ ID NO: 78 - DNA, 392 bp, Zea mays
  unsure at all n locations
  Clone ID: LIB143-068-Q1-E1-G9
acggcggtcaaggggtccgggcatctcgtccgcaagggcaccggagggaggtcttctgtgagtggaattgtagccacggtgtttggagctactgggtttcttgggcgctatcttgtgcaacaacttgccaagatggggtctcaagtgcttgtcccattcagaggttgtgaggattctcctcgccacctgaagattatgggtgacttgggtcagattgtgcccatgaaataccatccgagagatgttgattcaattaaggctgttatggccaagtcaaatgtggttattaacctcatangacgagagtatgaaacaaggaactacagcttcgaagaagtaaaccaccatatgcctgaacagcttgcaacaattgctaaggancatgggggtat

SEQ ID NO: 79 - DNA, 377 bp, Zea mays
  unsure at all n locations
  Clone ID: LIB143-068-Q1-E1-H10
gtgagccgttggacgggtattccagtgacccggcttggccagaacgacaaggagaggctggtcggcctggctgacaggcttcaccagatggtggtcggccagacagaggctgtgagcgccgtcgcagangcggtgctgaggtcganggccggtcttggcaagccacaacagcccactggctcgttcctgttcctgngtccgactggcgtggggaaaactgagctagccaaggccctagccgaacagctgttcgacgacgagaaccttcttgtccgcatcgacatgtcggagtacatggagcagcactcggttgctcgcctcatcggagcaccgcctggctacgtcggccatgaagagggtgggcagctgactgaaca

SEQ ID NO: 80 - DNA, 343 bp, Zea mays
  Clone ID: LIB143-068-Q1-E1-H11
gcgaaacatgcgaacctactgtatatccattcagatatgttttaggcaacctacagggctcagtgcctatccctatggtgccattcagaatcatagtgcctttagttagttgatggtggtggtggttggaacacaataattacctgacgtcacgcccctggccaccggaaggtcaccggcgacgtgagccacaccaattcggcgacgaagcgccaggaacacagacgcaactcgaagcacgaaggtcaattacttatacacaaatcttggcatgaaagcccatcacaccattacagaatctctatacactaatagcttctacttcctcgttcagcgacatagc

SEQ ID NO: 81 - DNA, 367 bp, Zea mays
  Clone ID: LIB143-068-Q1-E1-F11
cagctgctgatcttgatcctgcaccccgagccgtacacaagagctagtcggtagaacttgcaggagcggagcagaactaagtgcagagaacaggacatatggctacgccggcggtgaaggtttacgggtgggctatctcgccgttcgtatcgcgggctctgctggccctggaggaggccggcgtcgactacgagctcgtccccatgagccgccaggacggcgaccaccgccgcccggagcacctcgccaggaaccctttcgggaaggtgccggtgctcgaggatggcgacctcacgctcttcgaatcacgtgcgatcgcgaggcatgttctccggaagcacaagccggagctgctgggcggccgcaa

SEQ ID NO: 82 - DNA, 335 bp, Zea mays
  unsure at all n locations
  Clone ID: LIB143-068-Q1-E1-D2
gagcttatcatctgaggacgttggtcaagttcttgcagtcactggtgccagtcttcttgtttatcaactctttctataccctagaatcaataaggttctcgggccgatcaaatcttctcgaattgcagctatcctgtgcatacctatcctctttgcctacccctacatgacatacatctcagaaccaggactgtcaatcattttgaacattgcgtcagcgataaagaataatcttgctgttacgatcattacaggcactttcatccttcaaaacaatgcagtgcctcaggatcaacgangagctgcgaacggactgtccatgacagggatgtcct

SEQ ID NO: 83 - DNA, 372 bp, Zea mays
  Clone ID: LIB143-068-Q1-E1-D4
gacaatggccccccgatattgcccgaagcctacttggatatctctggaagttctattaaccccagtgagagaacctatccagaggagatgatccaaactgggatatccaccattgatgtcatgaattccattgctcgtggacaaaagattccactgttttctgctgctgggctccctcacaatgaaattgctgctcagatttgtcgtcaggctggtcttgtgaagacattggagaaaggaaagcatgctgagggtggtgaagatgacaactttgctattgtgtttgctgctatgggagtgaatatggaaacagctcaattcttcaaacgtgattttgaagagaatggttccaatggaccggtcaaccttttt

SEQ ID NO: 84 - DNA, 395 bp, Zea mays
  Clone ID: LIB143-068-Q1-E1-D5
aaggcaacaagggagaagctcttaaagggatccgaggctgtgcgcgctccagattctgcacctgttgcacagccacctcgagagtcagcagcagcgcctgcagctgctgcggcggcggctgctcctgctcctgctcctagtaaatatattcccaagtttaaacgcggtggtgatagcagcagcatcccttctggcagccgcgatgaagatcgctggggttcacgtggtccgctcaggcaagatggtcctcctgcacgactggatgcaccctcatcacggcaagatactgatcgctggcgtggatcaagatttccctctaactcaacgtcctcttcatcaacctggagccgttcacgggactgattctatgctgcaagacttttttccaacccaag

SEQ ID NO: 85 - DNA, 355 bp, Zea mays
  Clone ID: LIB143-068-Q1-E1-D6
aggcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagatcatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgacccgtc

SEQ ID NO: 86 - DNA, 307 bp, Zea mays
  Clone ID: LIB143-068-Q1-E1-D7
aacgacgaatgaggaacgaacggacaggttgttgcacagaagcgacatggctttcgcgcccaaaacgtcctcctcctcctcgctctcctcggtgttgcatgcagctcagtcgccgccgctgctcctgaagcggatgtcgtctaccgcaacaccgagacggaagtaagacgcggccgtcgtcgtcactaccagcataactgctaaagctgctgctgctgctgtcacggttcacatcgcaccgacacaagtgtcggcgacggagtcggtctctccatgcacaagatgcatgttacgatgagagacagag

SEQ ID NO: 87 - DNA, 326 bp, Zea mays
  Clone ID: LIB143-068-Q1-E1-D8
tcgacgaaggaggaacgaacggacaggttgttgcacagaagcgacatggctttcgcgcccaaaacgtcctcctcctcctcgctctcctcggcgttgcaggcagctcagtcgccgccgctgctcctgaggcggatgtcgtcgaccgcaacaccgagacggaggtacgacgcggccgtcgtcgtcactaccaccaccactgctagagctgctgcggctgctgtcacggttcccgccgccccgccgcaggcgccggcgccggcgccggtgccgccaaagcaagcggcggcacccgccgagaagaggagccgtccggtgtcggacaccat

SEQ ID NO: 88 - DNA, 394 bp, Zea mays
  Clone ID: LIB143-068-Q1-E1-D9
aggagctaagctcagcctcacacagcctctcctctcgagctagctagagtgctactagcttagaagaagcagcagcttacagctgaagctgcagcaatggcgaaatcttacaccttactgttcgtcgcactggtcgttctggcccttctagtgagccccattgcttgctcccgcaagctcgccaagccgaacaagcccaagccgacccacaagccggcggccagggtcacgcccggcagcaaccacaccggtatccccgcagtgtccgccgcctacggttccggcggctggttgtctgccggcgcgacgtactacggcgccccaaacggcgacggcagtgacggcggtgcgtgcgggtaccagaccgccgtcgggcagcgccccttctcgtcga

SEQ ID NO: 89 - DNA, 145 bp, Zea mays
  unsure at all n locations
  Clone ID: LIB143-068-Q1-E1-E1
tggggcaaccggctcgccacctactccgcgcccgcaaccctgggggtaaggtttatggtcaaagatatgcccaattgaaatgagacttaagagatgggagcganagaagtgtaaaccaaacagtcttcctgtgctgcacaagatg

SEQ ID NO: 90 - DNA, 372 bp, Zea mays
  Clone ID: LIB143-068-Q1-E1-E10
gagtgctgcagccacagaatcagttgctgctgacaaaaagcttgctatatttgataaaatattttctgcataccatgatgctcggagctgcatccgcaatgacctggcttctgctggcaatgctgaggatataaaagatgacctgaatggtcttgacaaggctgttagtgctgttctaggattgagaactatagaacgtaaccagttacttgttagcattggtaaaagtaaattcacaaagcatcgagatgaaaaaaatgagcgaatcacaaagccagaagaacttgttcggctatatgatctgcttattcaggtatgtttgttttctgtcacatcctctttttagacatatttatcatgtctttactagac

SEQ ID NO: 91 - DNA, 434 bp, Zea mays
  Clone ID: LIB143-068-Q1-E1-E11
ctcgcgggtcgatacaagcctctaggcagcatcatgaccacctcctctttcagcaaacacagctagctagcagcacctgctcccttcgcctgtaatcatggcgtattgctgcgacgacggctgcaactgcccccctgactgcgggtgcccatgcgactgctgcaatttgtaccctgaagtggagaccgccgccgccagcggcatcctcgctgcgccgaccaccaaggccagcgccggcggctgcaacacctgcaagtgcggcggcaccagctgcaactgcaactgcagctgagccggcccaatggtggcgcacgagaggacgacgacgacgaggcgtagtatatatgtatgtagcagcgtctaaataagatcctgtcaagagtcaactgcacccgccattgtatggtcgcctgcctcgccttcgtctcctggtc

SEQ ID NO: 92 - DNA, 325 bp, Zea mays
  Clone ID: LIB143-068-Q1-E1-E12
cggacgcgtgggcaagcagcgatccgaagctcaatcaattcactcaaacctcttccccaaatcttcgattagattctcgttgacaagaagactagaaccgaacctgaccatgtcgctgatccgccgcagcaacgtgttcgatcccttctccctcgacctctgggacccctttgagggcttccccttcggctccggcaacagcagcagtctcttcccctcgttcccgcggaccagctcggagaccgcggccttcgctggcgcgcggatcgactggaaggagactccagaggcgcacgtgttcaaggccgacgtaccggggctgaag

SEQ ID NO: 93 - DNA, 140 bp, Zea mays
  Clone ID: LIB143-068-Q1-E1-E3
ctgcgccatgttatggaacaggcttactgtagctccccatgcctgaaaatttaatttgtatgattatgaacagtacatttgtcctcgaaaaaatgtaagatataatatttgacaaatggaatatgcttatgtagtcttcc

SEQ ID NO: 94 - DNA, 374 bp, Zea mays
  Clone ID: LIB143-068-Q1-E1-E4
acgcgtcaaagttattgaacctgcagttggatggatagagctgaacgaatacctgaagccctatggcctagtttttcctcttgattcaggggcctggggccaccattggacgaatgtgtgctactcgttgttctggttcattagctgtgaggtatggaacaatgccggataatgtgattaatcttcgggctgttttgccaaatggtgatgttgtcacgacaggctcccgggctcgaaagagtgcatctgggtatgaccttgctcgtttgatcattgggagtgaaggaactttgggtggtattacagaagtgactttacgactccaaaagcttccatctcactctgtagttgcaatgttcaatttcaaaacaatt

SEQ ID NO: 95 - DNA, 365 bp, Zea mays
  Clone ID: LIB143-068-Q1-E1-E5
agagttgttgaacctggagttggatggatagagctgaacgaatacctgaagccctatggcctattttttcctcttgatccagggcctggggccaccattggaggaatgtgtgctactcgttgttctggttcattagctgtgaggtatggaacaatgcgggataatgtgattaatcttcgggctgttttgccaaatggtgatgttgtcaagacaggctcccgggctcgaaagagtgcagctgggtatgaccttgctcgtttgatcattgggagtgaaggaactttgggtgtaattacagaagtgactttacgactccaaaagcttccatctcattctgtaattgcaatgtgcaatttcaaaacaat

SEQ ID NO: 96 - DNA, 319 bp, Zea mays
  Clone ID: LIB143-068-Q1-E1-E8
ggaaacaggaagagttgattggaaaaagaaaaaatgggatgtgtttttctttttgttcaactgagatacgacttaataaactatatcttcgaatgatgctctgacccccccccccccccccttttaatgttttttcattgactaaaacggttatgtaatgataactatgtgacacttgttttgtttggtgtgattcttcagcgtagcctggtgatcgagactcatgcgggcaaaaaaaaaaaaaaaaaaaaaaaaaaaaaaaaaaaaaaaaaaaaaaaaaaaaaaaagaaaaaaaaagaggaaaaaaagaaaagggggg

SEQ ID NO: 97 - DNA, 394 bp, Zea mays
  Clone ID: LIB143-068-Q1-E1-D12
gtgattcgggttgcaatggtgggctaatgacgacggcattcagttatctccagaaggccggtggccttgagagtgagaaggattacccttacactgggagtgatggcaaatgcaagtttgacaagtccaagattgttgcttcagttcagaacttcagtgttgtgtctgtggacgaggctcaaatttctgctaacctcatcaaacatgggccattggcaatcggcatcaatgctgcctacatgcagacatacatcggaggcgtgtcatgcccatacatctgtggcaggcaccttgaccatggtgttctccttgttggatatggtgcttctggtttcgcccccattcgcctgaaggacaagccttactggatcatcaagaactcgtggggcgagaa

SEQ ID NO: 98 - DNA, 270 bp, Zea mays
  Clone ID: LIB143-068-Q1-E1-F10
aaaaacaactcccggccatggcgaccgcagaccgggtcgccgccaccttcctctcctctttccccactcaccatccccgccccttttcctccgtttccctcgtgacaaaccctgtcctacccgtctcccttcgggccgctgtcacaggtggcccacggctcgcctcccgtctccgggtccaccgcgtcggcgccgccgtcgcccagcttcccaccacgaatccggaggtagcttctggggagaagaagatcagatggtcatcaagggctg

SEQ ID NO: 99 - DNA, 374 bp, Zea mays
  Clone ID: LIB143-068-Q1-E1-B10
cccggactctaggggcagaagctgcagcgtcgagatggtgaaggggcgcacggggcagcgcgtgaggctctacgtccggggcaccgtccttggatacaagcggtccaagtcgaaccagtacgagactacgtcgctggtgcagatcgagggggtgaacaccaaggaggacgtcgcgtggtactgcgggaagcggatggcctacatctacaaggccaagaccaagagcagcggcacccactaccgctgcatctggggcaaggtcgcccgcccgcatggcaactccggcgtcgtccgcgccaagttcaagtccaacctgccgccggaatccatgggccgtaaggtcagggtgttcatgtaccccagcaacatctaaa

SEQ ID NO: 100 - DNA, 374 bp, Zea mays
  unsure at all n locations
  Clone ID: LIB143-068-Q1-E1-B11
aggtgaccgagcatgcccgtcgtcctcttcctcctggtggccggctgcagcaggcaagatgccctttgtaaatatagccataggtgacggtcccgcgtgcgtgcggccgtgcgggagcgtcgtcaaatgggaagaaaaccgcgaggtgtgactgtgatgtaacaccccgtctgtaacattcgccagagtatataggaaatccatgttaatataccctccattccaactgacaaaggcatgcgctggcgcgtggcggcttgctgccggtgcagaacctcttctttctcctcacccgggcctatttggttcagcttttttctgaccagtttttctgagaatctagctgtggaaagaatctggctgtgagaganaaa

SEQ ID NO: 101 - DNA, 92 bp, Zea mays
  Clone ID: LIB143-068-Q1-E1-B12
aggaaaaatcttgtttaaagaatgggtctgctagcatatttctcctccaatttggagacaagatttcatttgtagatcattttgctcggtag

SEQ ID NO: 102 - DNA, 347 bp, Zea mays
  Clone ID: LIB143-068-Q1-E1-B3
acgcgtcagagaagagcaacccaagtcgccgagagtgactcccacacgaccacctacccgccgccgccgccgccgcatccccccgattccgtctggcgatcgggggctcccagacacatcacagatacaccacgccaagccaaatcgagcaacgcctatcaccatattataatttcccctcattcatctcacagtcccaggcctcccctccctcctcccccgtcgccaactaacctccaacccccagccgatcgcgtcggagatgctgggcgtcgcgcggaagcggctcggatccggatgcgtgctcgcccagctggcgcaggccctccgccccggcggcgctcccg

SEQ ID NO: 103 - DNA, 356 bp, Zea mays
  Clone ID: LIB143-068-Q1-E1-B4
acccacgcgtccgcccacgcgtccgcgtgaagttgactacgccgacaaatctgtcaccgagaacactcgggctgcctacccgatcgagtacatccccaacgccaagataccatgcgtcggcccacaccccaagaacgtgatcctgctggcgtgcgacgccttcggcgtgctcccgccggtgagcaagctggacctggcgcagaccatgtaccacttcatcagcggatacaccgccctggtcgccggcacggaggacggcatcaaggagccacaggccaccttctccgcctgcttcggcgcggccttcatcatgctccacccgaccaagtacgccgccatgctcgccgagaagatgc

SEQ ID NO: 104 - DNA, 252 bp, Zea mays
  Clone ID: LIB143-068-Q1-E1-B5
gacccaaacgtcagacgaaatctgacccgggccacactccgctgctccgccatggagatccgctccaaggcctggatctcgctgctgctcgcgctgaccgtcgctctctccgctcgggcggaagaggagcccgccgccgcggcagatggcgaggccgtgctcaccctcgacgtcgacagcttcgaccatgccgtcgccaagcaccccttcatggtcgtcgagttctacgcccccaggtgtgggcactgcaag

SEQ ID NO: 105 - DNA, 325 bp, Zea mays
  Clone ID: LIB143-068-Q1-E1-B6
agcagtaccatacaaagatgttcagctggatataaacatttctccacgtctctcttctgaatacataagttatctggaaaatcctgttgagttgctcaatgaagcggcaaaagctgcagagaaagatctatggaaaatcctgttgagttgctcaatgaaggcttttgcgaatcacttgaagcgttagtacttttgtgaatgattttgtaaagtgtttgtaaatatgtgcaaaacataataacatgtgtaggttttgtgaatgattttgttgtggtgcttgttgatggtttatgtgatgtggatctatcattgtgcaatactaatt

SEQ ID NO: 106 - DNA, 178 bp, Zea mays
  Clone ID: LIB143-068-Q1-E1-B7
aggacactcacacctctcttcttctctttcccttcgcattaatggacgctctctctctaaccacattcgtcacgcgcacggagtaggacactcgcccgcttcaggcgtaaacttcacaattcaagatccacggcaaaactcgtcgagcttgggaaggaacggcaccgtcaggatctgg

SEQ ID NO: 107 - DNA, 160 bp, Zea mays
  Clone ID: LIB143-068-Q1-E1-B9
tgctgagggtcgtcaaggtattcacggggcaggaaaaacgcctggtgtcacagttttatcaaatccccctgggttcaatgcttcagatgcatgtgaaaccatagacctcagaaattacaccgtacatagcttgtgctgtcctaagatgggtaacttttga

SEQ ID NO: 108 - DNA, 360 bp, Zea mays
  Clone ID: LIB143-068-Q1-E1-C1
cctacatcgccgatcgatcagtgagtcgcctgcatccctgatcgatcagtaacaccggtacaaagacatgaatcggcaacaaataagaagtttcaaaggctggctagagggttcaacctttttgagattggtggtttcgccatcgtcttctgcgtgtatgtctcttggaatatggaaggtttagtggtatgtaggtttaaatatcttgttgtagcttgtactacctccgttctcgaatatttgtcgttggctagtttatttttaaactaaaccgcgacaaataaaaaagaacggagggagtatgttagggatgatttagccttaggaactgcacctacatacctcatggcatctatgcac

SEQ ID NO: 109 - DNA, 210 bp, Zea mays
  Clone ID: LIB143-068-Q1-E1-C10
agcggacgcgtggaaaaaaaaaaaaaaaaaaaaaaaaaaaaaaaaaaaaaaaaaaaaaaaaaaaaaaaaaaaaaaaaaaaaaaaaaagaaaaaaaattaaaaaaaaataaaaggaaaaaaaaaaaaacatgcaaagaataaaaaagaatgggagttagttagagtcatttaaaattaattgacgaggtcaactacttgaatttcccatct

SEQ ID NO: 110 - DNA, 369 bp, Zea mays
  unsure at all n locations
  Clone ID: LIB143-068-Q1-E1-C12
accggcaagactatcaccctcgaggtggagtcctccgacaccattgacaacgtcaaggccaagatccaggacaaggagggcatccctccagaccagcagcggctcatctttgctgggaagcagcttgaggacgggcgcacgcttgccgactacaacatccagaaggagagcaccctccacttggtgctgcgcctcagaggaggcatgcagatcttcgtgaagaccctgaccggcaagactatcaccctcgaggtagagtcttcagacaccatcgacaacgtcaagggcaagattcaggacaagganggcattcccccagaccagcagcggctcatctttgctgggaagcagcttgaggacgggcgcacg

SEQ ID NO: 111 - DNA, 316 bp, Zea mays
  unsure at all n locations
  Clone ID: LIB143-068-Q1-E1-C2
cccggcagtgccatccgactccctgcacctgccatggctgccgctctcgtgtctgtgcctcgcatcaagttgggctcgcangggctggaggtctccgcgcaaggcctcggctgcatgggcatgtccgccttctacggcccgccaaaacccgagtctgagatgatcaagcttatcgaccacgccgtcgacgccggggtcaccttcctcgacacctccgacgtctacggcccgcacaccaacgaggtcctcctgngcaaggcgctgcaaggcggggtgcgggagaaggtcgagttggccaccaaattcggcgtctcct

SEQ ID NO: 112 - DNA, 328 bp, Zea mays
  Clone ID: LIB143-068-Q1-E1-C4
acccttgctaagttcctcgtccgcctctctgtcctagtctcgtcagcaacagcacagtgttgttactgacgcgccttcactctgttgacctgcatctagccaagtttatttggagactccaacctttggtctcccaaacttggagctcccaaggggagatgttctgccaaaattttggcttctgagcatccattttcagggggaggttctgccaaaatctgctcctgtgaacatagatttctcaaggggaggttctgccaaaatttcctcctgtaaccaccagctttccagggggagattctgccaaaatttcctgcactgatcatca

SEQ ID NO: 113 - DNA, 340 bp, Zea mays
  Clone ID: LIB143-068-Q1-E1-C5
cgctgcgccattcgccagcgacgagcacccaacaggctcagaaacatcgctgacatccacatgcaccacagtagttcagtagagtagctgttggaacccacacaccggcgatggcaactgctcctgtgacatcctccatggctacgaactccacctgtgtgcggctgcctagcatgcccctgaggcgtgcacccgccatcgtctcctttgcctctcgtccatggtcaaccgcaatgacctcatgtactggattgtcgcggcactctgatgtggttgccgccgcggggcaccagaagttgatggggtctttgaacaacaacgagggactcatgtttggggt

SEQ ID NO: 114 - DNA, 319 bp, Zea mays
  Clone ID: LIB143-068-Q1-E1-C6
tcgtatgaggcgctgcactcgctcttcctctggctgctgctcctcgcccgcggcctccgccggtaccgggctgggactaggcgccgacacctcggcgtcggacgcggcggctggggccgggacctgctccacgcggacgtggtcgatgcggctgcaggccgctgacgaggaggacatgcgccgcatgcacggcgctcgccgttgaagtgcctatcaacgacgaccggggcactatcgtgggccaccttcatcgtcaccgtcgccagtaggaacgcccttttctgacgactctgtgctccggtcgttgacgaaatgaggg

SEQ ID NO: 115 - DNA, 144 bp, Zea mays
  unsure at all n locations
  Clone ID: LIB143-068-Q1-E1-C8
aaaaaatttgcctcttttagcgtcagtatattaaggccgcagcacgtaatgtgcagtgctgangccttaanagactgacgcnannagaggcaaattttagcgggtgtagattgaagcgtgaacaccggacaggtacctatacga

SEQ ID NO: 116 - DNA, 405 bp, Zea mays
  Clone ID: LIB143-068-Q1-E1-C9
aacctctctgggaagatacctccggccatctctggaatgcgaatactgaactacctcaacctgtccaggaaccatcttgatggagagatacctccatccattgcaaccatgcagagcttgacggcggtggacttctcgtataacaacttgtctgggcttgtgccagggactggccagttcagctacttcaatgccacatcttttgttggcaatccaggcctgtgtggaccatacctcggtccatgtggtgcaggcataggtggcgccgaccacactgtccatggccatggctggttgactaatacggtcaagctgctcattgtccttggcttgttgatctgctccattgcattcgctgtggcggcgattctgaaggctcggtcattgaagaaagctagtgaagct

SEQ ID NO: 117 - DNA, 398 bp, Zea mays
  Clone ID: LIB143-068-Q1-E1-A9
aggtggcctctcggttggccgctgggcggctaccctgggcctcagggaccttactactgcgccgtcggaacggacaagtcctacgggcgggacatcctggacgcgcactacaaggcctgcctctacgccggcatcgacatcagtggcatcaacggcgaggtcatgccggggcaatgggagttccaggtcggtactgccgtctgcgtctcggccggcgatcagctctgggtggctcgctacattcatgagaggatcaccgagatcgccggcgtggttgtctccttcgaacccacgccaagtcagggggactggcatggcgctggtgcatacaccaactacagcaccatgtctatgaggagtgacagcgggtacgaggtgatcaataatgcgatcggcaa

SEQ ID NO: 118 - DNA, 337 bp, Zea mays
  Clone ID: LIB143-068-Q1-E1-D1
agactcatcactagcctctgctcctctgaaatggcggcggcgacttcctcttccacctacctcgccatcggccgcaaaaccctaaaccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgtgaggggtgggagggatctgttcccgctgttaccgg

SEQ ID NO: 119 - DNA, 397 bp, Zea mays
  Clone ID: LIB143-068-Q1-E1-D11
gtcttgctcgctccaagctagacaccataccacccaggtgacttcgcgcgccactccttccttccctccctttccccacagctttactctcccctcccgcgtccagatcccgaggcccctctccctcgatcgccgcctcccggtagcggatccggcgccggctcgcgccccccgacaggttttgttttatgcttgttcatttgtctatggacaatggactagttgctgcactgcttttgtgagtcaccatgggaagcagtggagcagatacatcgtctaagccaaacaaggcatccgccccacaggagcagcaacaacctgctacctcaggtgctgcaacaccggctgtttatccagactggtccagcttccaggcatatcctccaatcccaccaca

SEQ ID NO: 120 - DNA, 374 bp, Zea mays
  Clone ID: LIB143-067-Q1-E1-H2
gtccgccaccacagcagcgaaggagaaagcagaccaacctagccacccagggagaaaggccaaaagggaagggaaaatgtcctcatggcttccaatgtcccctccaagaagggcgttcccccaatttcccgctctgaaaaacctcatcgcagcttcttccgcgcccggaactggctccgccctcaggccggtggaagtccccggcggcctccgtggctacaacaccggcgctccgctccgacgctacgagggggccgagtcggaagacgatagcgtccgcgagtacgatgggcggcacggcggccgggactacgccgtgcccagcctgttctcaagtaatattttccgtgatccgcttagtgcgccgcacagca

SEQ ID NO: 121 - DNA, 375 bp, Zea mays
  Clone ID: LIB143-067-Q1-E1-H3
ccgacccgtccaaacagcgacagctcgcctccacgcgagccaagcgcccgcaaaaccctagccccgcccgccccaaaccctaggcagctacggtctccgatcccggggtcacgtcctaatggcatcttcgccggacttgttccccaacgttaccttctccgacgtctccgaagccgcagcagggcctgcggccgagggggccaccgccgcgttcggtctcggcgccgccactggagccccgcgcctcagcctcgtgaaggccgaggcggagcccacggtcgagatcgacctcgccgacgcgcaggtatttaagttgggaccgacggagtggctgtgtgtgtgcgacgagtccgaggctaaggatggcgtggaaga

SEQ ID NO: 122 - DNA, 349 bp, Zea mays
  Clone ID: LIB143-067-Q1-E1-H4
actctccatccaacagtctacagtgtaaccgccatgagtcctttctgcgcggtgatcacgccagaaaccctcaagtacatgtccatgtaccagggacgtgagatcacgcaggtggactgcgcacgggaggcgatgaggctgatccacgcggaagacaagaacctcaaggccgaggactcagcgtgggagctgaagaagaagttcggcaacggcgtgagcaccatggtcctcgtctacaacgccaccggggccagcctgagcctggtggacgacgggaaagactggatgggctccgtctacagctcgccgatcccggacaccttccacaacgggcaatggatcgccttcc

SEQ ID NO: 123 - DNA, 388 bp, Zea mays
  Clone ID: LIB143-067-Q1-E1-H5
gcagtacagtacaggagcaccctaaactaatccatgacgtcaatacggagaccctctgacctgtatacgagacgagactacacaacagtctggaaaaaacaaaacactcgtgtgcgtcattgcaaacgagcgtgctttgacctgttttgatgttcaccgctctgctacgtgccgtggctgaaccggtcgcacgcagcagcactactctcgccagtcgctagagagggggcagcaccgcgctggtcactggatttggatgcatgcgtgctcgcttgcgttcgctgaaacgcaaggcgtcatctgatctggccgatcgaccgatcacgcagcccgcagcgcgcagcccgctaaactaaacacagatgcatgcaaccagctccagcggtcc

SEQ ID NO: 124 - DNA, 377 bp, Zea mays
  Clone ID: LIB143-067-Q1-E1-H6
gatgttatatctttcttagggatccgtttcccggcctggtaaacgattaagcactctattggggctgcccagtcaaacatttcctctggatctaatgatatggtgggcagaaggggatgcacatcccacgttttcgtgatgacctagccacctggaattgctatgtcaaacgtctctcaagaatccgaagatagctgcaataaacaaagtacttcaaacgttgaagtggagagaaactcgataccaggtcattaataagttactgatcctttttggatgtggtgctgttatttgggctatttggcgtactcgtaatgattgctgcttcaatgctaggctgattgatgatctatctaatgtgattttctcctgctgtt

SEQ ID NO: 125 - DNA, 374 bp, Zea mays
  Clone ID: LIB143-067-Q1-E1-H7
ggctcgtggctgccctgctcatactgcttgccctcgccgtatcgtccacccgcaacgcacaggaggattccatggccgacaacaccgggacgttggcgggcggcatcaaggacgtgccggggaacgagaacgaccttcacctccaggaactcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtgaagaagctctacgaagctaaggtctgggagaagccatgggagaacttcaaggagctgcaggaattcaagcctgttgaagagggtgct

SEQ ID NO: 126 - DNA, 340 bp, Zea mays
  Clone ID: LIB143-067-Q1-E1-H8
aggctccaggccaacctccagcccggaatcgagagcaatggcgctcgccaaggccaaggagatcgttgcctccgctcgcctcgtcgtcttcagcaaaagttcctgccctttcggcgtccgtgtgaagcagttgttcgagaagctcggagcaagctacaaggccattgagttggataagggaagtgatggagctgagctccagaatgccctgaaggagtggactggagagaggactgtcccaaatgtcttcagcaatgggaagcatattggggggtgtgatggtactaggggactgggcagtgatgggaagctggggcctctgctgactgaggctggagcc

SEQ ID NO: 127 - DNA, 321 bp, Zea mays
  Clone ID: LIB143-068-Q1-E1-A1
agcccacgcgtccgagttcacccagctctgctccgcccgaggtacgtcgtctatcctcatctggttaacgtacctttcgtgcgctgcgagtcaaagttgcgttttttttccgccgctcgtgcgagtcgagctgaaagggaaaacgttagtcggtcactcaatcgatctgtaacttgtctgcatcaaagagggcaaacatgtccgtccgccacaccacccgcggtcgccgtcgcgcgtcagcggtcgtcggcgtcgctgtctggacgtgcacacagtgaatgaagttagtgtatgttttggatggttgcttgagagagatat

SEQ ID NO: 128 - DNA, 276 bp, Zea mays
  Clone ID: LIB143-068-Q1-E1-A10
ctgtgcctgtgcctctgctccacctcccctgcccctgcgccccaagtccacgtccaccactcagcactcacgctgctcgctcgctcgctcgtacacgcgcccgcttcgcgcagggaaggaaccgtggtggggggagcggacggacatgatgcacgccaagtcggagtcggacgtgacgagcctggcggcgtcgtcgccgccgcggtcgccgaagcggggcggcggcgccggcaacggcggctactacgtgcagagcccgtcgcgggagtcgcacga

SEQ ID NO: 129 - DNA, 408 bp, Zea mays
  unsure at all n locations
  Clone ID: LIB143-068-Q1-E1-A11
agcaccgaatcgcaacgacagcgagaacgtccaaacgagcgcgagtctccggcgataaccaagagcgcgggcacgcaaagcggcgaagcgggaaggaagcagtaacgatggggcttgactattacaagatcctaggcgtcgacaagggcgccaccgatgacgacctcaagaaggcctaccgcaagctcgccatgaaatggcaccccgacaagaaccccaacaacaagaaggaggccgagaacaagttcaagcagatctcggaggcgtacgaggtgctgagcgacccgcagaagcgcgcggtgtacgaccagtacggcgaggagggtctcaaggggcaggtgccgccgccgggcgccggcggngcgggccccggcggcgcaaccttcttctccaccggcggcgacgggc

SEQ ID NO: 130 - DNA, 205 bp, Zea mays
  Clone ID: LIB143-068-Q1-E1-A12
aggtaggacgaagcaggttcttctttaagtattttaggaagtgcaagcaatggcgagtagctagggaagggactaccatatgctatagctgccttgctagctagctagggagaggggggggcatccaagagaccaagctcacgggggcggatcggaggtgatggagaacgacgacgaggaagaggggtacgtgaaggtggggacg

SEQ ID NO: 131 - DNA, 376 bp, Zea mays
  Clone ID: LIB143-068-Q1-E1-A2
ctcgcctcgacgcgcctctgaaagttcggagccgccggcccgtccgcctccctctccgcctcccgtccccaaggccaatagttttcaagtggcaatggcggaccaggctaaccaacccactgtccttcataagctcggtggccagttccacctgcgctcgatcatctctgaaggtgtacgggcccgtaacatatgcccatctgtctcatcttatgaaaggagatttgccacaaggaactacatgacccagagcctttggggcccttcaatgtctgttagcggtggcatcaatgtcccagtgatgcagaccccgctctgtgctaatgctcctgctgagaaaggaggcaagaacttcatgattgatttcatgatgggc

SEQ ID NO: 132 - DNA, 345 bp, Zea mays
  Clone ID: LIB143-068-Q1-E1-A4
acggacgcgtgggtgactgtggaaaccgaacctgcccaaaaactcagcagaagctccagaacctttcgttgaccccaaactacgtgcttagaagcttaatactgcagtggtgcgaggaaaaggggatggaaccacctagcaggtctaaaagcgacggttctcctcttgaggttgctggcaacagattagcaattgaagcgttagtccgcaacctctcgagcagttcattagatgatcggaaatctgctgcggctgaaataagatccttggccaagaaaagcacagacaaccgtatacttctagcggaatctagcgctataccggctctggtgaaactcctgtcgt

SEQ ID NO: 133 - DNA, 105 bp, Zea mays
  Clone ID: LIB143-068-Q1-E1-A5
gtgagtcgtatgataagcgtgtgggcgacccggtccgggaggatacggggctcactacggtggtggcgccgcctattgagacgcatgcccatcaccattcaggaa

SEQ ID NO: 134 - DNA, 254 bp, Zea mays
  Clone ID: LIB143-068-Q1-E1-A7
aaggactgtgggaaggtgaaggctggtggtgcttacaccatgaacactgctagtgcggtcaccgtcaggagcacgatccgccgcctgagggagcagactgaagcatgatatagctctttatattattggggtttcctgtagttgctcttgtcaggcatgttgtgggggccttatctagtggaaatgtggaatcactgtactggctgttttgccgagacaatgctccttatatttggtttatgctctaggatctc

SEQ ID NO: 135 - DNA, 426 bp, Zea mays
  Clone ID: LIB143-067-Q1-E1-H11
gggtccagcacgcgtccgacgcaaatccgctcccctacctctccagcatcctcccgtctccgtcgtctcgtctccgctcctcacctcgccagccatgggcaagatcaagatcggaatcaacggtttcggaaggatcgggaggctcgtggccagggtcgccctgcagagcgaagatgtcgagctcgtcgccgtcaacgaccccttcatcaccacggagtacatgacgtacatgttcaagtacgaaaccgtgcacggcaaatgaaagcaaagcaaaatcggccttcaaggaccccaaaacccttcccttcggcaaaaacccggtcaccgtctttggaatcaggaaccccaaggaaatcccttggggtaaggctggtgctaagtatgtcgtggagtccaccggtgtcttcactgacaaggacaaggctg

SEQ ID NO: 136 - DNA, 363 bp, Zea mays
  Clone ID: LIB143-068-Q1-E1-A8
aggcgtagggtaatagtggaagctgaagcaagagaagaaggtgaaatttctgaatcggaggcagagaccaggtatcgtcaggacaaagaggagaagtggcttgaatggtgctctgaagttttagatgaggagcaggaaactttgaagcgcctggataggctgcagaatacaagtgtaaacctcccaaaggaaaaggttctttcaaggattcgcaagtatctcctgataattggggacaaaattggagaagttgtccggcaacacagtgaatcttataggcaatcccgcatggtcatgaggttatggaattatgttgccaccttttcaaacatgtctggggagcaactgcatgatctctatatg

SEQ ID NO: 137 - DNA, 364 bp, Zea mays
  Clone ID: LIB143-067-Q1-E1-F12
ggtcgagcacgcgtccgatgatacttgccgtgagattaattcctctatcaaggtagtagagtatcaccatactctgaagccatgcaatgctttggaggttgcacggaaatatgatatagttgttgatgcaactgacaaccttcctactaggtatatgatcagcgattgctgtgttttgctgaacaagccacttgtatctggtgcggcattaggcttagaagggcagttgactgtttatcatcataatggaagcccatgctatcggtgcctctttccaactccaccacctgtggcagcctgccagagatgctcagacagtggtgtccttggggttgttccgggagtgattggttgcttacaagct

SEQ ID NO: 138 - DNA, 365 bp, Zea mays
  unsure at all n locations
  Clone ID: LIB143-067-Q1-E1-F2
gctcaatcaattcactcaaacctcttccccaaatcttcgattagattctcgttgacaagaagactagaaccgaacctgaccatgtcgctgatccgccgcagcaacgtgttcgatcccttctccctcgacctctgggacccctttgagggcttccccttcggctccggcaacagcagcagtctcttcccctcgttcccgcggaccagctcggagaccgcggccttcgctggcgcgcggatcgactggaatgagactccagaggcgcacgtgttcaaggccgacgtaccggggctgaagaaggangaggtcaaggtggaagtcgaagacggcaacgtccttcagatcagcggcgagcgcaacaagga

SEQ ID NO: 139 - DNA, 343 bp, Zea mays
  Clone ID: LIB143-067-Q1-E1-F3
aagacgtagtccctcatcagggctgtgttttacatcatcattcagtgcctgggcgccatctgcagtgcgtggcgtcgtcaatgggttccatcatgggctgtacatgggcaatcgctgccgtgccaacgtcgtctcgcccggctataccaagggtcaccgtctccgcgccgagatcgtcggcaccttcatcctcgtctacaccgtcttctccgccacagacgccaataggaacgccagtgactcccatgtgctgatcctcgcccctcttacaatccggtttgccgtgttcctcgtccacctggccaacatccctatcaccggcaccgggatcaagcccgctctg

SEQ ID NO: 140 - DNA, 308 bp, Zea mays
  Clone ID: LIB143-067-Q1-E1-F4
cccacgcgtccgcccacgcgtccgcggacgcgtgggcggacgcgtgggtttacactgcatttaccgagtataaagtgcttgccaaatgaactgtgtgaatgctactggcatcgctgacctgattatgctgttgcagtgctgagcattgtgggcgcaactgttagagatccgactttattcctgaaggcatttgtctgaactttttcggaaatgagtgccggtggtgcttttggtggaaatagggggctgaggcctgtaccccctgaaaaaggtgtattcccattggaccacttacatgagtgcaactt

SEQ ID NO: 141 - DNA, 402 bp, Zea mays
  Clone ID: LIB143-067-Q1-E1-F6
cttgtccctacgaccagcgacacgcactctgcacccagcgcgagaaaaaactacatcgatcatcaccagcgagccagccggccgagcgagcagcaccgatggcggcgtacatgcgcgtgacgcaccgcgacgaggaaggcaagaaggtgacggagaagatgccggtcccggagacgcggcgcccggacacggccaagcacttcgagcgcaagctggaggagcagggcctccaccgcttcgagcggcacccggcgaacgcgccccggggcgtgggcatcggcgccccgccgcccaagtccgggcgcggcggcaagtacacctgggagggccccggcggcctcgtcgaggaccagctcgacccggcgccgcccgccatcgaccccaacgaacccaactaacaag

SEQ ID NO: 142 - DNA, 400 bp, Zea mays
  Clone ID: LIB143-067-Q1-E1-F7
atttcatatctattttccctaataaactagcagttcatagtttttatctaatcaaagtaggattttggtaacagtttctctttcataatgaattaaccttagtttgtctagtgttagccaattgtagtggtcaagttgcagtatgtctcaaaatacttataagtaggtaaacctttttgctgaatgagctggttacctaacgggtatttcgaggccaactgatcccactcatctctttgatctataaaagtattagaaatgtattttaatgattgaatcaagttatttgctgcttgtttgtctttagcaaatcattaatttgtagttttaatttttgcatattggcaatatcctaggataattttcccaagtggagattaggtctactatgtgagtgttc

SEQ ID NO: 143 - DNA, 347 bp, Zea mays
  Clone ID: LIB143-067-Q1-E1-F8
gtggcctctcggttggccgctgggcggctaccctggccctcagggaccttactactgcgccgtcggagcggacaagtcctaacggcgggacatcctggacgcccaataaaaaggctgcctccaagccgggatccacatcaattgcatccaacgggaaggtacacccggggaattggaattccaagttcggccttgcctctcggttctcggccgcgaacaacctctggtgtggctcgcatacattcttgaaaggttcaccgatatccccggtgtggttgtctctttcgaccccaacccatttccgggagactgaaatggctctggtgcacacaccatctacagcacca

SEQ ID NO: 144 - DNA, 348 bp, Zea mays
  unsure at all n locations
  Clone ID: LIB143-067-Q1-E1-F9
agcgaaagtatgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaanccctgctgcaaagaaggataatgctganggacaag

SEQ ID NO: 145 - DNA, 390 bp, Zea mays
  unsure at all n locations
  Clone ID: LIB143-067-Q1-E1-G1
acgccgcttcgttctctaaccttggctcccgctccctccgcaggagcatctcaacaccgccttgaggaccccccaactcgccggctgcagccatggtgaaatattcgacggagccaaccaaccccaccaagtcaaccaaggccatgggccgtgacctacgtgttcacttcaagaacacccgtgagacagcttttgcccttaggaagttgtcactcaccaaggccaaaaggtaccttgaggatgtgattgcccacaagcaggccatcccgttccgcaggtattgtggcngtgttggacgtaccgctcaagctaagtctcgtcactcaaatgggcaaggacgctggcctgtcaaatctgctagattcattctagaccttctcaagaatgctg

SEQ ID NO: 146 - DNA, 363 bp, Zea mays
  unsure at all n locations
  Clone ID: LIB143-067-Q1-E1-G10
gctagaccgagctgaatatgacagaaagtccaaggaaaagagccgggaacgtgccaaggattcgaacaaggatcgctacataaaacgcaacagcagccgtgacagggagtatgaccgcagaagaagccatgatcgcttacatgacagggaaagagagagagattccaggcagtctcgtagttatgattccagaagccaccgcaagtcatattccacaaggggaaattctanggattatgatcgatctgggtatgtttacttatacttcagttagcatgtattaatggaactccaaagagctgctttgttatctcttgctattgtggtaacactgattgttgtctttaaacaatgatagaatgt

SEQ ID NO: 147 - DNA, 437 bp, Zea mays
  unsure at all n locations
  Clone ID: LIB143-067-Q1-E1-G11
accaagaacagatacccgagtcgacgaagcaaccgctcacaatcccaatctcccgcgtcactcataacccgaagtaacaaccgtcggtccgaccaacaatgtcgctgattcgccgtggaaacgcattcgaccccttctccctcgacctctgggaccccttcgagggcttcttccccttcggctccggcgacgtccgcagcctcgttccctcgttgccgcgcaccagctcggagaccgcggcatttgccggcgcgcggatcgactggaaggagacccccgaagcgcacgtgttcaaggcggacgtgccggcgctgaggaaggangaggtcaaggtggaggtcgangacggcaacgtcctgcagatcagcggcgagcgcaacaaggagcacgaggagaagaacgacaggtggcaccgggtggaacgcaacaaccggaag

SEQ ID NO: 148 - DNA, 385 bp, Zea mays
  Clone ID: LIB143-067-Q1-E1-G2
aaaaaaaaacaaaaagggtaccggaagcggcgaaagcctcgccccccgccgctctcgcatcgtctccggagcgcacgtcagatcaggtgcgccgcgcccccctcgcctaagctgcgacgaccatccatcgaacaggaaggatgacgggctccatggatctcccggccaagggcgggttcagcttcgacctgtgccgccggaacaacatgctggagaagaacgggctcaaggtcccgggattcaggaagaccgggacaaccatcgtcggcctcgtctttcaggatggggttgttcttggggcagacacaagggcaactgagggccccatagttgctgataagaactgtgagaaaatccactttatggcaccgaatatatactgctg

SEQ ID NO: 149 - DNA, 383 bp, Zea mays
  Clone ID: LIB143-067-Q1-E1-G3
ttagaacaatgccgagaccgagatgagctagacggttttgacagaatggaagggcctcgcttcggtggtttgcgcttgccaagcgccgtgtggcccacgccaagcttggtaccacgataatacttacaagatatacattaaaggctagtttatatacttacaagatatacattaaagactagtttggaaactctatatttctaagagaatttccaaattccaaaaaaataatttaattttacgtgaaaaaaatagaaattcttttgaaaaatagagtttccagactaaccctattactcctacaaacgcgcgtgtctgggaaatgagtacaatttggactcgcaatgttttttgtactagcaacttctgctttccgcttggga

SEQ ID NO: 150 - DNA, 369 bp, Zea mays
  Clone ID: LIB143-067-Q1-E1-G4
gtccgcgaagggaagggaggactcctcgagttcgtcgagaggcggctcaaggacaacggccacatggtcatcgtggtggccgagggtgctgggcaggacctcatcgcgagaagtatgaatttcgtggacacccaagacgcttctggaaacaagctgcttctggatgtcggcctttggctatcccagaagataaaggatcatttcaagaagaagcccagcttcccgataaccctcaagtacatcgacccgacctacatgatccgcgccgtccggtcgaatgcttctgacaacgtctactgcactctgctggcccacagcgccctccatggcgccatggcggggtacaccggcttcacggtcgctccggtc

SEQ ID NO: 151 - DNA, 130 bp, Zea mays
  Clone ID: LIB143-067-Q1-E1-G7
tgcacgcctctaaaatgggtcgggttaactcgtctagttcgtctagatgctgctcaacgacagcggcgtcgtgtccatcgtgttggcctgcggtgctgggtatgacctcggccgcacatgtggtgctttc

SEQ ID NO: 152 - DNA, 409 bp, Zea mays
  Clone ID: LIB143-067-Q1-E1-H1
ggagaatacatctgacaaagatttaaaccagggaactcttgttatttttaacttggatccatcggtttctaatgaagaggttcgccagatttttggggcatatggggaagtaaaggagataagagagacaccaaacaagaaacatcataagtttatagagttctatgatgtaagagcagcagaggctgctcttcggtcactgaataaaagtgagatagctggaaaacgaatcaagttggaaccaagtcgtcctggtggaacacgcagaaacttgatgcagcagctcggtcacgatttggacaaggaggagcccagaagctacagacatcctcatgttggttcaactattgctaactctcctccaagggcatgggctcactatagtagtccaaacagatacaatatgctg

SEQ ID NO: 153 - DNA, 374 bp, Zea mays
  Clone ID: LIB143-067-Q1-E1-F11
gcaccacacctcttcttcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactgaaccggtcaggcgatggcgcacgagagtcgagaggacgacgacgagtccgtataatataat

SEQ ID NO: 154 - DNA, 375 bp, Zea mays
  unsure at all n locations
  Clone ID: LIB143-067-Q1-E1-D4
tccttctcagcgaaaaagcagaggacgatacaagtgatggatatccacgacataccgaagccgaagaacaggaacaccttcgtgcgcaagagcggcagcagcgccggattcccggcaaagcaccggtgatctctgcctgaccaccatcggatctgtagcggactcagcgtatttatttctgtactagcaaaaagaaaaaaaagaaagaaattttaagaagcaaactcttgttttcccagtttgatttgtagccctgcagtccagctcactgatattatagggatatatatactgcctagtccatgaggctacgcttttgtacctctctttaagattggagaacagaaggaaagcanattgtgttattattcaatg

SEQ ID NO: 155 - DNA, 358 bp, Zea mays
  Clone ID: LIB143-067-Q1-E1-D5
cgtgtcatttgaaactcagaagacgatagaggtgagggatatccattacatatcgaaacccaagaccaggtccaacttcgtgcgcaacagcggaagcagcgccggattctcggcatgtcaccggtgatctctgcctgacgacgatcggctctgtatccgactcagcgtatttatttctgtactaactagcggaagaggtctaccgaaattttaggaagcactctcttgttttcccaatttgatgtgtagccctgcagtctaactcactgatattatgtggatatagatagtgcctagtccatgaggctacgcttttgtacctctcgttgagattggcgaacatgaggaaagcagagtg

SEQ ID NO: 156 - DNA, 426 bp, Zea mays
  Clone ID: LIB143-067-Q1-E1-D6
agcacacacggatcaatcacactcactcgcggccattgtcctgctcgtgcgtgctctgccttttcaggcgatcgaccaaccaacttctcgtcactgccatggctctgctctccgacctcatcaacctcgacctctcggaccgcaccgggaagatcatcgccgagtacatctgggttggcggttccgggatggacgtcaggagcaaagccaggacgctgtccggacctgttgatgaccccagcaagcttccgaagtggaacttcgacggctccagcaccggccaagctccgggcgacgacagcgaagtcatcctttgccctcgggccatcttcagggacccgttcaggaaggggcagaacatactggtcatgtgcgactgctacgagccgaacggggagccgatcccgagcaacaagcggcatgggg

SEQ ID NO: 157 - DNA, 392 bp, Zea mays
  Clone ID: LIB143-067-Q1-E1-D8
cacaacagcgaaggagaaagcagaccaacctagccacccagggagaaagaggccaaaagggaggggagagtgtcgtcatggcttccattgtcgcttccaggagggccgttcctctagttcgcgctctggagaagctcatcgcagcgtcctccgctcccgggactggctccgccctcaggccggtggcagtcgccggcggcctccgcggctacaacaccggcgctccgctccgacgctacgagggggccgagtcggaagacgatagcgtccgcgagtacgatgggcggcacggcggccgggactacgctgtgcccagcctgttctcagatattttccgtgatccgcttagtgcgccgcacagcattggccgcctgctgaaccttgtggacgac

SEQ ID NO: 158 - DNA, 363 bp, Zea mays
  Clone ID: LIB143-067-Q1-E1-D9
gcccaatgcgtagttgtatctgcatctccaacaccaccagcagaggttccagttagttttttttagattagaaaaatcgagtccaacagactcgccgcactgcgcgggatcgacctcgtcgcaactcccgtgtgcgccgccaataatggagacccgggacacggatgcgacgccgctcccctactcgtacacgccgctgccggccgccgacgccgcgtcggccgaggtctccggcaccggcaggacgcggagcaggcggcggcccctctgcgcggcggcgctcgtgctctccgccgcgctgctcctagccgtggccgcgctcgtcggcgtcggtagccggcccggggcggtggggatgacaga

SEQ ID NO: 159 - DNA, 335 bp, Zea mays
  Clone ID: LIB143-067-Q1-E1-E1
ggtgggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccg

SEQ ID NO: 160 - DNA, 52 bp, Zea mays
  Clone ID: LIB143-067-Q1-E1-E10
atcagacaaaaaaaaaaaaaaaaaaaaaaaagaaggaaaaacagacagatag

SEQ ID NO: 161 - DNA, 353 bp, Zea mays
  Clone ID: LIB143-067-Q1-E1-E11
cggacgcgtgggcagatgggaggcggaaatgaagagaaggctcgggtggttcagaccatactgttcgttgctggcataaacaccctgttccagacgttattcgggacgcgccttccggtcgtgatgggcggctcgtacgtcttcgtcgggccgaccatctcgatcgtcttggctggacggtacagcaacgaagcagaccctcacgagaaattcctgcggacgatgagggggacgcagggcgctctcctcgttgcgtcgacgattcagatcatacttgggttcagtggcctctggcgcaacgttgtcaaattactgagtccgctggcagctgttcctctggtatcactggtccg

SEQ ID NO: 162 - DNA, 362 bp, Zea mays
  Clone ID: LIB143-067-Q1-E1-E2
caaattcccctaacccgtcggtctgctatcccatctgagctcacggcgatcctctttctcctcatcggcatgagcggcttcttggcggtggtcggcaaggtcggcacctttctgctgtgggtgctgttcctggtcttgcagaccgccaccaggatcgtcggcagcctccttgccagctcagctgagcagcaggatgaccaccatcaggaatcggcggcggcacggcgcaggtcgccgccagcctccccacatcccgaactttacgagccggcgtctgcgtctctggcgcagctgtgggacccaccgcctcttccgcaccttgcttttgctcccgctgcggatgagagctcttcgtcctccag

SEQ ID NO: 163 - DNA, 375 bp, Zea mays
  Clone ID: LIB143-067-Q1-E1-E3
cgaagaaccagcgtgaggcgacggcggcggcggcggctacatcagcggctacctacgaggctacgacacgaagatcagcgtggagaacatcaggctttacatctccaggacacttttgctattactatataaagttttaaacttagaagcctggccaaacttgatggtaggctgtaaccatgcctagaactgtgagccatgagtgatgtctgcattttgttggattgaaccttggtctacgagtgggacaaaatgactgcaagcaccaactctactttgttctttgtttttatctatttaaatcatgtgcaaactatgaccaacatattgtctgtttgctaggacatacagttatcttgttgaattgaaacttta

SEQ ID NO: 164 - DNA, 408 bp, Zea mays
  Clone ID: LIB143-067-Q1-E1-E4
cgcggcctgctcgttctatctgtccagcagacttgaggttccgagcggccggaaaccagcggcaaccgtcggcatggcgctcgtattgcattctggggctggaaacaaaaatgccttcaaggcacttattgctgcagaatacagtggggtcaaggttgagttgaccaaggattttgagatgggtgtctcgaacaagacccctgagtttctaaagatgaacccccttgggaaggttcctgttctggagactcctgatggccctgtttttgagagtaatgctattgcgcgctatgttgctcgcttgaaggatgacaaccctcttttcgggtcttcccgtattgaacaagcccacgttgagcagtggatggactttgctgcaacagaagttgatcctgggtgttgatggta

SEQ ID NO: 165 - DNA, 381 bp, Zea mays
  Clone ID: LIB143-067-Q1-E1-E5
gcaaaaattgtggggatattgttcatcaacagattgttgagcgcgacatattgagtgaaatggttaagatagtaaagaaaaagccagacttgagcgtccgagagaagatattgagtttgattgacacatggcaagtggcttttggaggtccatctggaaaatatcgacagtatcatgcggcttaccaagaactcagggctgctggtgttgattttccgcctcgcgaggaaaattcagtcccgttgtttacaccacctcaaactcaaccattaagacatccacatctatatacacctccaggtcaaagctatgaagatgctgctatacaagcttctcttcagtctgcccctcctgcatctgccctcagtctgagtgagattc

SEQ ID NO: 166 - DNA, 414 bp, Zea mays
  Clone ID: LIB143-067-Q1-E1-E6
cttcggagtcctgatcttggagatcatcacaggaaagagggctgtgagcttccactgtcacgaggactccttgaacatcgctggatatgcgtggcggcaatggaacgaagacaatgctgcggagctgatcgatccagtgataagagcatcgtgctcagttcggcaggtgctgagatgcatccatattgcgttgctgtgcgtgcaagatcacgcagatgagcgacctgacatccccactgtcatccttatgctgagcaacgacagctcgagccttcctaatccgaggccgcctacgctgatgcttcgaggccgtgagatcgaatccagcaagtcaagcgagaaggaccggagccactccattggcactgtgacaatgacacagttgcatggaagatgaagtatacacgaaaatat

SEQ ID NO: 167 - DNA, 394 bp, Zea mays
  Clone ID: LIB143-067-Q1-E1-E7
ctcaaatgattagctctgcaactggagtacgtgttgaaaatatactctatcttggaggaccaaacatcgcctcggaaatttataacaaagaatatgcaaacgctcgaatctgtggatccaacaagtggaggaagcctcttgctaagtttttgaggcagccacatttcattgtctgggacaacagtgatcttgtcacccatgaggtgatgggtggcctgaagaatgtctatgcaatcggtgctggaatggtggcagctttaacaaacgagagtgcaacaagcaaatctgtatattttgctcattgcacgtcagagatgatattcattactcatttgctgacagagcaacctgagaaactcgctggtcctctgctggctgacacgtatgtaactct

SEQ ID NO: 168 - DNA, 389 bp, Zea mays
  Clone ID: LIB143-067-Q1-E1-E8
aaccagaagcgctcgcgagaagtaagggagagagaggggggacgacgacagccttgggacccgcggactgcatcgctcgccggtagctgacgtcactcggccccgtggaattttcaagctttggtggtggctcgtctgtctgatccgcgctctgctgctttttcttcgcccgccgcactgtatcacaactataacagtacctacgtgttcacaggtctaggcatttgtcctaccagtacagtacattggactagtaataactagtatgtatccagcaaaccgccacatggatccatactactcgcactatagaaaccatgttccttacccatactatcctcctgccagatgggaaatcccatccggtcatccacaggcaatggactcat

SEQ ID NO: 169 - DNA, 352 bp, Zea mays
  Clone ID: LIB143-067-Q1-E1-E9
gggtcgagcccgcgtccgaacaaagcagcagcacaagcaagaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaagccagcgccggcggcttcgaggcagccaccgagggcggcggctgcgactgcaacacctgcaagtgcagcaccagctgcggctgctcctgctgcagctgcaactgaactggccccggccggcgattgcgcacgaga

SEQ ID NO: 170 - DNA, 364 bp, Zea mays
  Clone ID: LIB143-067-Q1-E1-F1
gggtcgaccacgcgtccgaggaaaccgacgacgtcggcgatggtgcaaaagggacgactgcgaaccacggctcggcagtcgtgccgccgcacgttcttgtcgcgcggcggaggaggctggtgcgcggccggacggcggcctactccatgtgcgctggcaaggggaggacgctcaaagggcgagacctccgcgacgtccggaacctcgtcctcaagatgacaagcttcatcgaagagtgaatgaatgcgtgccgtcgcatcgcatggattcagaggattcttttcagcaagccaatgggaagaagcaccgtagcagtctagcagaaggatatacaactatacaagaagatgacgactgttcacgc

SEQ ID NO: 171 - DNA, 245 bp, Zea mays
  Clone ID: LIB143-067-Q1-E1-D3
actgggacccgtgtttttttagactcacaataaagccggtttgtgtttgtgcctaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaacaaaaaaaaaggttaaaacttaaaacaacgatgtatttaatgtcacaccacttaaagaacgtaactttaattcaattcacaggatttaaattaagaa

SEQ ID NO: 172 - DNA, 364 bp, Zea mays
  unsure at all n locations
  Clone ID: LIB143-067-Q1-E1-F10
tccagatccagcgggcggaggagggggtgcggtgcggccgtgaccatgaagcagccgaggggccggcangagccgcgccgggtgggcaacgccgccatggtcgtcaccatggtcgtctcgctctgcgtcctcacgtacatcaaggcgcgatactgctccaaccctttccccaaggcggtggcggaggtggaggtggacgaagactacgacagcacgcggtacaagctgacgggccccgtgggcgaagaggacttcgacccgtcncgccccacctgctacaacaccagcaagcggtccgagcggttcgccgccgtgggcgacatccgcgttgacggcaaccactcgcggatctacatcagcccgc

SEQ ID NO: 173 - DNA, 249 bp, Zea mays
  Clone ID: LIB143-067-Q1-E1-B4
attcttactacggcctggcagccctctccttgttggaagaggaagggctggaacccctctgcgtcgaactggggatcctctccgctgctgcattatagaaacttgtgtttctaccgaatccagttactgtacaatgtttgtggggggggggggggggggggggtaatccagtgcttaccacaggataatcagctgaaaaatcgaagggagtaatttattgataaagtgaggccttgttcggttattccc

SEQ ID NO: 174 - DNA, 401 bp, Zea mays
  unsure at all n locations
  Clone ID: LIB143-067-Q1-E1-B5
aggtgctggaacaggtttggtacgtttagcactagctcgagttgctagaaggatttttgttacagatagaggcactgatatccttgataattgcttggctaatctccatatcaactctggtatgctaaggttcgatgaagctaaagtctgtgtacgagaactggactggaaaatggcatggcctccacctgtgggtacatatgacccttctgatccaagtcggtatttatggtctgcaagtgaagttgaggacgctgagaaagcaacagtcctgtttgctgcagatgttatttacagtgatgatctcacaaatttgttcttcaacacggtgaagaaattgatgtcngtcggtgctaagaaggtgctatacttggccctggaaaagagatacaacttcagtg

SEQ ID NO: 175 - DNA, 412 bp, Zea mays
  Clone ID: LIB143-067-Q1-E1-B8
ttctcgtttcaccgtgcgccacaagcacacaactagggcgaccgccgccgacctacggccagctgtgcccatgtcttcgtcgggccctttgctggcgacgggaacccaccacaccggccgccaacctgaggttttgtgggctcagcgctccgagaagattttcttgactatctcattgccagatgcgaaagatgttgtgttaaagaccgatcctaagggcctctttaacttctctgctgttgtccatggggaaccttttagcttcactttggagctttttgattcaatactgtcagagggaagtaaaacgaagacaaagatgggcctgcgaaacataatctgctcaatccagaaagaaaagaaaggttggtggaagcgcttgctaaagtcagaggaaaagcatccatacatc

SEQ ID NO: 176 - DNA, 155 bp, Zea mays
  Clone ID: LIB143-067-Q1-E1-B9
acggaagtggaaagacaaagagggatagggagctcgcctccttcttttttgtaatcgccgaaatggaaattgtatgacgacccttcttgttccaggcatacgaccctgagacgtgacggtgtcacttttccggcccggtaaagtgacagttatat

SEQ ID NO: 177 - DNA, 407 bp, Zea mays
  unsure at all n locations
  Clone ID: LIB143-067-Q1-E1-C1
ctcatccgaacccgatcatctccggccgccgctccctccggaccctccgtcgacatgggcaccgtcactgccgccgatccgcacccgtccttcctcgccgacaaggacgccaaggtcttcgtcgccggccaccggggcctcgtcggctccgccatcgtgcgccgcctcctctcgctaggcttcacctccgtcgtcgtcncgcaccacgccgagctcgacctgactcgccaggcggacgtcgaggccttcttcgccgccgaacgcccgcgctacgtggtcctcgccgccgccaaggtcggcggaatccacgccaactccaccttccccgccgacttcatcgccgccaacctccagatccagaccaacgtcgtcgacgccgcgctgcgctgcggctccgttcgcaagct

SEQ ID NO: 178 - DNA, 250 bp, Zea mays
  Clone ID: LIB143-067-Q1-E1-C10
ataagacttgcaaaagtatacttcgtactcagggttttcaaacccatgttgttgtaggtgaggaaacaacggagttttgttgtttttgttcgaaggtggtaccaaaggaggagccaaatcagtgatcgtgtgtgcgggaggatgtttgcctcccaatttgaaaacactaaacttttgttcgggagggtgttttgcctccctggtatgtaataatattttatgcactcataacatctggtactgtaataat

SEQ ID NO: 179 - DNA, 393 bp, Zea mays
  unsure at all n locations
  Clone ID: LIB143-067-Q1-E1-C12
cgcaagtgctatgcacgcctgcaccccagggctgttaactgccgcaagaagaagtgtggccacagcaaccagctgagggcaaagaagaagatcaagaactgaagcttgccaaatcggttccttgcatggtttgcgtcaacaagacgtagaagtttcaaagcttttgtatgccataggctgctgcaacgtttttaagtcggaactcttgtgttcctgttcagggtcttcagcatgacatanatcgtttcagaagtctagtaataatattactataatggggtcatgtcgtatttgtggctctccctttttgtttgctggtggtgctgcagtagaaggaaacattcccgttaatttcctcaaccgcaaatttaaccctgcttaattaactcagct

SEQ ID NO: 180 - DNA, 130 bp, Zea mays
  Clone ID: LIB143-067-Q1-E1-C2
gtcctgaattctagggatatgtatatgtgtgcatatataggattcgtgatttttttgtatacagtggattgttaaccgaacacgctaattaattccattatattattgttgactgctggaatttgttcag

SEQ ID NO: 181 - DNA, 416 bp, Zea mays
  Clone ID: LIB143-067-Q1-E1-C3
atcaatctttgctgcgagctcccgatctgtggtacttccggcatcgcgaactgaagtttaccaccgatccgttggctccttggcattccttttcctccagcagcggcaaagcctccatctttttgccaaccgacttgaggaatggggtgcatgaagctgcttggagtagacgcaagctttatggaagatttctagtacttcattcccaacaagcaatcagataaaaacaaaaggagcaacttcaacagaacctgcggctccagtgattggaccgaccgatatttgcaaactgctgaaattgaatccatgggtagaggaagaggaagagggaagaagctaaccactgtcaggagccacgaagataaaggtagcagcggcgaagaagttgtgcctgcaaaaaaaaaaaaggcgggcgc

SEQ ID NO: 182 - DNA, 376 bp, Zea mays
  Clone ID: LIB143-067-Q1-E1-C4
cggacgcgtgggagcaggccattctgctcgccttactccctcacagaacccagtaaaatattgccagtcccgccgtcgagatggccccacgccgcctgctcgtcctcgccgtcctcgccctcgcggccaccgccgccgcggccaactccggcttcgcggactccaacccgattcgccctgtcaccgaccgcgcgggcttcgcgctcgagtccacggtcttcgccgcgctcggccgcacccgcgacgcgcttcgcttcgcacgcttcgccgtcaggtacggcaagagctacgagagcgcggcggaggtccataagcggttcaggatcttctccgagagcctccagctggtccgctccaccaaccgcaaaggcctctc

SEQ ID NO: 183 - DNA, 278 bp, Zea mays
  Clone ID: LIB143-067-Q1-E1-C5
aggactcttgggagcaagccattcagctctccttactcccgcatagcacccagtaatttattgccagtcccgccgtccagagggcaccactctgcctgctcatcctcgccatcctcgctctctcggccaccgccgctgcggctaagtctggcttcacgggctcgaaccagatgcgctctgtcaccgagagttctgcctcctcactcgggtcaacggtcctcgcagcactaggaggaacacgttaagcgcttcgtgtcgcacgcttcatcgtcaggtac

SEQ ID NO: 184 - DNA, 409 bp, Zea mays
  Clone ID: LIB143-067-Q1-E1-C6
ggaaccacatggatttgcaaggaataggacatggagtgttgatgatgatcctccgccatttccagtgccaacctccaatagcgcttatgttgacttgatcctcaaacctactgaagatgatttgaagatctggcctcatagttttgaataccgcctgagggttgcacttagtcctggtggtgatttgatgctaacttcacgtataagaaacactaatgcagacgggaagccattctctttcacttttgcataccacacctacttcaagatttctgatatcaggtatgttgtttcaaattatggtcatcatctttgaaatattcaatttgccagcatagtttttgaagtaatcttgtggcagcatgtttatccccagtcccaattcgtttgaccaaactctggtattaaa

SEQ ID NO: 185 - DNA, 417 bp, Zea mays
  unsure at all n locations
  Clone ID: LIB143-067-Q1-E1-D1
gtggtttggcatttggcaatgatgcgtgacgtggcgcctgcaggctttcttggtcctaatcctaatcctaatcctaatcccaatccatccagctaagacgtccacgcccgtggttttgtcctgttgatttgccaccggagacgacgatgcagcgcttgctctttgatttccatggcttattatcgatcagcctccgattcttctcctgcactactactacttgtaccatttcatctattgattgaatgaatggtcacgatgatgacgataattatgtttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaaaaaaaaaaaaaaaaaaaaaaaaaggggggcc

SEQ ID NO: 186 - DNA, 324 bp, Zea mays
  Clone ID: LIB143-067-Q1-E1-D10
gcgttcgcaacaaaggaacaaaactcctcctcctcctcctcctcctcctaacaaaactaacgcctggtccccctcgcctgtgattaagtcctgcaacaaccgcaaattccaatgttggtccagccggtcctggcggaactcaatcaactgcaagtccctaacgttgagaccgcggcgccagcagcatcaagacacggtcctcgccgcgccgaacaccaagccagcgccggcggcttcgaggcggccaacgaagggcggcggctgcgactgcaacacctgcaactgcggcaacagctgccgctgctcctgctgcagctgcaactg

SEQ ID NO: 187 - DNA, 412 bp, Zea mays
  Clone ID: LIB143-067-Q1-E1-B3
ggaagttgtccctcaccagggcggtgttttacatcatcatgcagtgcctgggcgccatctgcggcgcgggcgtcgtcaaggggttccagcaggggctgtacatgggcaacggcggcggcgccaacgtcgtcgcgcccggctacaccaagggcgacggcctcggcgccgagatcgtcggcaccttcatcctcgtctacaccgtcttctccgccaccgacgccaagaggaacgccagggactcccatgtgccgatcctcgcccctcttccaatcgggtttgccgtgttcctcgtccacctggccaccatccctatcaccggcaccggcatcaaccccgcgcggagccttggcgccgccgtgatttacaaccagcaccatgcctgggcctgacactggatcctcggggtcgggcc

SEQ ID NO: 188 - DNA, 301 bp, Zea mays
  Clone ID: LIB143-067-Q1-E1-D12
aaaaaaaaaaaaaaaaaaaaaaaaaaaaataaaaaaaaaaaaaaaaaaaaaaaaaaaaaagaaaaagtcacaatagggtggaccctcaagaggatcagatcttgattattcaagcatattttgtaacacctctgcaatagggtcacagccattcaatttaatgaatgttcattgacaacttcttaactgaaaacaccttggagttattccaataaatctccttgcagtagctccgttttacagcacctgtgatgatacctatggggcttgcaaatatttaccctcccaaaatttacccccc

SEQ ID NO: 189 - DNA, 407 bp, Zea mays
  Clone ID: LIB143-067-Q1-E1-D2
gtgcgagcaaattagcaagacaaaatttgtaaaatttgctgtatctgtcgtgctgctcagcacagggcattatcttgtactcccttatatgggaaaatatagacgtatatatagcaatggaaataacagaggcccggaagaataatgtacagacactgatagtcactgaaagaagacatgggtagtgaacaatctgcgtggacgtgattttgccttgccattttatgttggggcaattgtgagtggaatacaatatgtttttttatgaggaagattcttcaataggcacaccgaattgaattggtgtaacgtgtgccccaacatgaaatgtaatcatcaggtatggacgtattacagtacaacacactcatgttgaacagcaaaaaaaaaaaaaaaaaaggcgggcg

SEQ ID NO: 190 - DNA, 369 bp, Zea mays
  unsure at all n locations
  Clone ID: LIB143-066-Q1-E1-H4
cttcaaccaacgtacagtgtacccgccatgagtcctttcggggcggtgatcacgccagaaaccctcaagtacatgtccaagtaccagggacgtgagatcacgcangtggactgcgcacgggaggcgatgaggctgatccacgcggaagacaagaacctcaaggccgaggactcagcgtgggagctgaagaagaagttcggcaacggcgtgagcaccatggtcctcgtctacaacgccaccggggccagcctgagcctggtggacgacgggaaagactggatgggctccgtctacagctcgccgatcccggacaccttccacaacgggcagtggatcgccttcctccacgtcaagcccggctcgctggcg

SEQ ID NO: 191 - DNA, 421 bp, Zea mays
  Clone ID: LIB143-066-Q1-E1-H5
aggagcagtacagtacaggagcaccctaaactaatccatgacgtcaatacggagaccctctgacctgtatacgagacgagactacacaacagtctggaaaaaacaaaacactcgtgtgcgtcattgcaaacgagcgtgctttgacctgttttgatgttcaccgctctgctacgtgccgtggctgaaccggtcgcacgcagcagcactactctcgccagtcgctagagagggggcagcaccgcgctggtcactggatttggatgcatgcgtgctcgcttgcgttcgctgaaacgcaaggcgtcatctgatctggccgatcgaccgatcacgcagcccgcagcccgcagcccgctaaactaaacacagatgcatgcacccagctccagcggtccgtgtatgggatccgtacgctggccttttg

SEQ ID NO: 192 - DNA, 369 bp, Zea mays
  Clone ID: LIB143-066-Q1-E1-H6
agccgatgttatatctttcttagggatccgtttcccggcctggtaaacgattaagcactctattggggctgcccagtcaaacatttcctctggatctaatgatatggtgggcagaaggggatgcacatcccacgttttcgtgatgacctagccacctggaattgctatgtcaaacgtctctcaagaatccgaagatagctgcaataaacaaagtacttcaaacgttgaagtggagagaaactcgataccaggtcattaataagttactgatcctttttggatgtggtgctgttatttgggctatttggcgtactcgtaatgattgctgcttcaatgctaggctgattgatgatctatctaatgtgattt

SEQ ID NO: 193 - DNA, 332 bp, Zea mays
  Clone ID: LIB143-066-Q1-E1-H7
cgctcgtggctgccctgctcatactgcttgccctcgccgtatcgtccacccgcaacgcacaggaggattccatggccgacaacaccgggacgttggcgggcggcatcaaggacgtgccggggaacgagaacgaccttcacctccaggaactcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtgaagaagctctacgaagctaaggtctgggagaagccatgggagaac

SEQ ID NO: 194 - DNA, 389 bp, Zea mays
  Clone ID: LIB143-067-Q1-E1-A1
cttcctcacctgcgtcagacagagaaagccgagattagcggcggcggcgatggcactcccggcgtcaagctccgggctcttccgcttcctcccccccgcagccgtcgccagtccactgacatcgtggccgctgcctcctgcggagtcttcgccggcaccgccggcctttacctcgtccagccatttgactggattaagaagactttcttccagaaacctgaaccagatgcatgagtctccaggcacgaaaaatgctgcaaatctgcaactttggtacaccacttttgtccgggatgattcctgatgataactcagcagataatatgagacaccctcgtctttccttgtttgattttattcagatgtaggcattcctcttgcatgtaata

SEQ ID NO: 195 - DNA, 321 bp, Zea mays
  Clone ID: LIB143-067-Q1-E1-A10
gcgtccgaccacacgtccgcccacgcgtccgctcgtttccttccgatccatacacaccgcgcacgtacgcgtactccatcgtcccggtgcaggcgggttcacgtcacgacctcgggcgagacgagatggcgacgccgaacgggcttgctcggatcgagacgaacggggcgaccaagcccgacaacggcgtgtgccacgacgacagctcggcgccggtgcgcgcgcagaccatcgacgagctgcactcgctgcagcggaagcggtcggggccaaccacgcccaacaagggacgggccgcctccaacttcggcggcgcgctct

SEQ ID NO: 196 - DNA, 95 bp, Zea mays
  Clone ID: LIB143-067-Q1-E1-A11
acacatactagaataaaatatagcagcgcgtgtgcgcaacaaagactaagagtgtgatatcaaagttgtgcttgcaatgcaacaactgctagctt

SEQ ID NO: 197 - DNA, 367 bp, Zea mays
  unsure at all n locations
  Clone ID: LIB143-067-Q1-E1-A12
aacggaacgcgtcgcaggccgtccgcctccccgagcaacagacgagcggagtagtaggtggcctcccgacccggggttctcctccactcccgcagtcncgctccagctttctctgccccgaccccgatcgatgctaaattcccgcgccgagccgctcgcccgcctcccaccccatcaccgagccgcctcgcgcggccccccgtcattttcgcccgactctctcgcctcggaggacgtagagagaggagaagggagtcgtcgtcgtcctgcgcccggcgctcgggccactggattcaaggggttccggtggatttggaccccggagtggactgaatgctgatggtaatcccccaaggaagaaggcagg

SEQ ID NO: 198 - DNA, 278 bp, Zea mays
  Clone ID: LIB143-067-Q1-E1-A2
cagagaaagccgaaattagcggcggcggcgatggcactcccggggtcaagctccggcctcttccgcttcgtctccccccgcaggcgtccccagtccactgacatcgtggccgctgcctcctggggagtcttcgccggcaccgccggcctttagctcgtccagccatttgactggattaagaagacgttcttccagaaacctgaaccagaggcatgagtctccaggcagaaaaatgctgcagatctgcaactttggtacagcacttttgtccgggatga

SEQ ID NO: 199 - DNA, 366 bp, Zea mays
  Clone ID: LIB143-067-Q1-E1-A3
gtagccgccgtcgccgcctcgctttctcctcttccgccccaccccggtgaggcgctgatccatcgcctcggacagcggctccagaacctccgcgttgcagtggttggggttggcttcgtgctattcagaaacacagtagcgagaactattcggtggggccgaagatggtgtcgctgaaggtgccaaagcgcctcgccgcaagcgttctcaagtgtgggaaaggcaaagtgtggcttgaccccaatgaagttagtgagatctccatggcgaactcccgccataacatccggaagttggttaaggatgggtttatcatcaagaagcctcagaaaatccactctagatctcgtgcaagaagggcgcacg

SEQ ID NO: 200 - DNA, 377 bp, Zea mays
  unsure at all n locations
  Clone ID: LIB143-067-Q1-E1-A4
gttctggaacaagaacaagtccatggaacgtctatcggcaaaatctgtggttctgaattttgtgtgtcaactaattgttttcctgtaccttcttgacaatgacacttcatggatgatccttgctaactctggaattggtgtgtgcattgaattttggaagattggtaaaggcaatgcatattgaagttgataaaaattggaanaattcccatgttgaaggttccgagaacgtgaatcatatgcacagaatatgactaaaaagtacgatgccattgcaatgaagtaccttacctatgtacttttcctccttgtggtcggtttctctatctattcacttaagtatgataagcacaagagctggtactcatggatacttt

SEQ ID NO: 201 - DNA, 362 bp, Zea mays
  Clone ID: LIB143-067-Q1-E1-A5
ctcaatctttgctgcgagctcccgatctgtggtacttccggcatcgcgaactgaagtttaccaccgatccgttggctccttggcattccttttcctccagcagcggcaaagcctccatctttttgccaaccgacttgaggaatggggtgcatgaagctgcttggagtagacgcaagctttatggaagatttctagtacttcattcccaacaagcaatcagataaaaacaaaaggagcaacttcaacagaacctgcggctccagtgattggaccgaccgatatttgcaaactgctgaaattgaatccatgggtagaggaagaggaagagggaagaagctaaccactgtcaggagccacgaaga

SEQ ID NO: 202 - DNA, 357 bp, Zea mays
  Clone ID: LIB143-067-Q1-E1-A6
atcagtctttgctgcgagctcccgatctgtggtacttccggcatcgcgaactgaagtttaccaccgatccgttggctccttggcattccttttcctccagcagcggcaaagcctccatctttttgccaaccgacttgaggaatggggtgcatgaagctgcttggagtacacgcaagctttatggaagatttctagtacttcattcccaacaagcaatcagataaaaacagtaggagcaacttcaacagaacctgcggatccagtgattggaccgaccgatatttgcaaactgctgaaattgaatccatgggtagaggaagaggaagagggaagaagctagacactgtcaggagccac

SEQ ID NO: 203 - DNA, 371 bp, Zea mays
  Clone ID: LIB143-067-Q1-E1-A7
acgggtcgatccaagcgtccaatcagtctctgctgagagctcccgatctgtggtacttccggcatcgcgaactgaagtttaccaccgatccgttggctccttggcattccttttcctccagcagcggcaaagcctccatctttttgccaaccgacttgaggaatggggtgcatgaagctgcttggagtagacgcaagctttatggaagatttctagtacttcattcccaacaagcaatcagataaaaacacaaggagcaacttcaacagaacctgcggctccagtgattggaccgaccgatatttgcaaactgctgaaattgaatccatgggtagaggaagaggaagagggaagaagctaaccactgtcag

SEQ ID NO: 204 - DNA, 404 bp, Zea mays
  unsure at all n locations
  Clone ID: LIB143-067-Q1-E1-A8
cgtcgaaccgcacagcccctgcgctccttccccagccgcgcttagccctatcctccctgctcgatctccttcgagccgtaacggctccctggcgtgtccggctccctgcccctctccatggcgtcgcccagctctagctcgccccccctctgatctgtgcgcaggggtttcttccatggcgagctcccctgcaaacttcatctagccgccggccgagtttctttggtggtcgcttacccccagcatcggccagagcttgctgtcattccccaacaaacatgtggttgtaggtgagagatttcagaagtctgttggacgaagaaaagagaagtgaaatttgtgcagcgcccgtcaggtgttaggtttaatagatattgtgtctaccgtgtganggaatcgtgcca

SEQ ID NO: 205 - DNA, 324 bp, Zea mays
  Clone ID: LIB143-067-Q1-E1-A9
cccacgcgtccgcccacgcgtccgctcgtttccttccgatccatacacaccgcgcacgtacgcgtactccatcgtcccggtgcaggcgggttcacgtcacgacctcgggcgagacgagatggcgacgccgaacgggcttgctcggatcgagacgaacggggcgaccaagcccgacaacggcgtgtgccacgacgacagctcggcgccggtgcgcgcgcagaccatcgacgagctgcactcgctgcagcggaagcggtcggcgcccaacacgcccatcaaggacggcgccgcctcgaccttcggccgccgcgctctccgaggagg

SEQ ID NO: 206 - DNA, 412 bp, Zea mays
  unsure at all n locations
  Clone ID: LIB143-066-Q1-E1-H3
aacagcggcagctcgcctccacgcgagccaagcgcccgcaaaaccctagccccgcccgccccaaaccctaggcggctacggtctccgatcccggggtcacgtcctaatggcatcttcgccggacttgttccccaacgttaccttctccgacgtctccgaagccgcagcagggcctgcggccgagggggccaccgccgcgttcggtctcggcgccgccactggagccccgcgcctcagcctcgtgaaggccgaggcggagcccacggtcgagatcgacctcgccgacgcgcaggtatttaagttgggaccgacggagtggctgtgtgtgtgcgacgagtcggaggctaaggatggcgtggaagagaagtcattttcaagagcaattaaggttgttcttangacagaagctgag

SEQ ID NO: 207 - DNA, 74 bp, Zea mays
  Clone ID: LIB143-067-Q1-E1-B1
cacacacgtgacctctaattcgctcacatctgaacccttcctaaccgcatggctgccgtctaggaacctcacac

SEQ ID NO: 208 - DNA, 334 bp, Zea mays
  Clone ID: LIB143-067-Q1-E1-B11
aaagcaacaaggcagcagcacaagcaagaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgatgcggccaccgagggcggcggctgcgactgcaacacctgcaagtgcggcaccagctgcggctgctcctgctgcagctgcaactgatctggcccggcccggcgatggcgca

SEQ ID NO: 209 - DNA, 338 bp, Zea mays
  Clone ID: LIB143-067-Q1-E1-B12
ctctaaagtgagtcggattaagcacaagcaagaaccacacctcctcccttcgcctgtgatcatgtcgtcttgctgcggcggcaattgcgggtgcggctccagctgctcctgcagcagcggatgcaacggctgcggtatgtaccctgacgtggagaccgccgccaccagcagcgtcaagacgacggtcctcgccgcgccgaccaccaaggctagcgccggcggcatcgacgccggcaacgaggggcggcgctgcgactgcaacacctgcaagtgcgggaccagcctgcggtgctcctgctgcagctgcaactgatctgggccggcccggcgatggcgca

SEQ ID NO: 210 - DNA, 420 bp, Zea mays
  unsure at all n locations
  Clone ID: LIB143-066-Q1-E1-F5
aagcgaaagtatgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctganggacaagaggttgaggcagcagctgaggaaacgannaagagcaacatgtcacgaagaagcttgagaagcgcaaggagg

SEQ ID NO: 211 - DNA, 395 bp, Zea mays
  Clone ID: LIB143-066-Q1-E1-F6
cggacgcgtgggtgcagatgaaaaggcttttcataaatcacattctgtaagacgaacccgctctcctgacatgcataaccacagaaagaggagcagagaggcagatgtgcggtctactaagagtgcaacacacccagttaatggtgcaccacgtcggcttcttcagtttgctgttcgtgatgctgtcagaactgtgcccccagttacttctggttcagaatcagcttccaagcgactttgttctgtagtgtctacattggcttcagattccacacttgatattactcatattaggttacagaaaacaaattcagatttgagaataccagttgccacagcagcactaagagctgcagctgaggctgctgaagatgctctcaaggatagcttttgtg

SEQ ID NO: 212 - DNA, 417 bp, Zea mays
  unsure at all n locations
  Clone ID: LIB143-066-Q1-E1-F7
gaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgaggcggccaccgagggcggcggctgcgactgcaacacctgcaagtgcggcaccagctgcggctgctcctgctgcagctgcaactgagctggcccggcccggcgatggcgcacgagagtcgagaggaggaggacgacgacgaggcgtataaatataatagcggcgtccagtanataagatcctgtcaactgcacccgccattatccatggtcgctcgctcct

SEQ ID NO: 213 - DNA, 417 bp, Zea mays
  unsure at all n locations
  Clone ID: LIB143-066-Q1-E1-F8
cccacgcgtccggcgagagacgggcaggggagaggaaaaaaaaatctaaccctagcatccgcagcgctagggttcgggggttgcgatggcggcggcggcgagacagcgggggacggtgaagtggttcaacgacaccaagggcttcgggttcatctcccccgaggacggcagcgaagatctcttcgtgcaccactcgtcgatcaagtcggagggcttccgctcgctcgcggagggcgaggacgtggagttttccgtctcggacggtgacgacggccgcactaatgccgtcgacgtgaccggccccgacggatccttcgtcaggggcggcggatgcggaggatgatgctgcagcggctacggctcccgcggcggtggcggatctggccgcggcggtcgcagctacngtggtagctgggg

SEQ ID NO: 214 - DNA, 377 bp, Zea mays
  Clone ID: LIB143-066-Q1-E1-F9
gtttgttgtttttcttctcccgtccgcagtccgcttggcgtgcgcgacggctagggcgaccgccgccgccctacgccctacgtccagctgcccatgtcttcttcgggccccttgccggcgggaactcaccagaccaggaatcgtgctggcaaccggcgcaagtctggagatagggctgataaagctaattactcctacaataatgatggagagaagagcaatgttccttcattaaagaaccttcctccaattgttcatcatgaaacattcttcagcaatgttcagaatgactacaatcaaacaggattagtgcctttggagggatgttctgccagtgaggcttcacagcttctcagtgatcgctggactgctgcaat

SEQ ID NO: 215 - DNA, 423 bp, Zea mays
  Clone ID: LIB143-066-Q1-E1-G1
gaaatcttccgttctcaaaccaacctaggcaattcgccgcagcctctcaccctcgcgagtcccgacctcccgcagccgccgcacagatggcacccaaggcggagaagaagccggcggccaagaagcccgcggaggaggagcccgcgacagagaaggtggagaaggctccggcggggaagaagcccaaggccgagaagcgcctcccggcgggcaagtccaaggagggcggcgagggcaagaaggggaaaaagaaggcgaagaagtccgtggagacctacaagatctacatcttcaaggtgctgaagcaggtgcaccccgacatcggcatctcgtccaaggccatgtccatcatgaactccttcatcaacgacatcttcgagaagctcgcggccgagtccgccaagctggcgcgctacaacaaga

SEQ ID NO: 216 - DNA, 246 bp, Zea mays
  Clone ID: LIB143-066-Q1-E1-G10
aaaaaaaaaaaaaacaagaaaaaaaataaatataacaaaaagaaaaaagaaaaagaaagaggaaaataaataaaagtttcaaacaaggaataagtaacttaaatcacgacaataaaacgtgacacggatgcgggccgcggctgaagtgacgatctctaccttgacatggaacgacataaagattccatgcagtcgcgtagttatgattccataagccaccgcttgtcatattcaccaatgcggaag

SEQ ID NO: 217 - DNA, 378 bp, Zea mays
  Clone ID: LIB143-066-Q1-E1-G11
acaatactctgagatgagtcgtattagaccggcggtcccttcggtactatgaagtgcccggcggaactggctcacggcgccaacgcggggctggacatcgcggtgcggctgctcgagcccatcaaggaggagttccccaccctctcctatgccgatttctaccagcttgccggagttgtggccgtcgaggtcaccggtgggcctgagatccccttccaccccggcagggaggacaagcctcagccgccacctgagggccgtcttcctgatgccaccaagggttctgaccacctgaggcaagtctttggcaagcagatgggtttgagtgattaagacattgttgccctctctggtggccacaccttgggaaggtgccac

SEQ ID NO: 218 - DNA, 299 bp, Zea mays
  Clone ID: LIB143-066-Q1-E1-G2
aggaagaacaattcgaactcagtcctcgcttgattgattggattgggaggcaaattgggtgtagaaatttttggttgggaaggacggtggcacgtacgcaagctctaatacatagttttttttgttgcatttatctccaaggagagaaggttagggatattttattaaggaccgtgcaggtgggttgtaacgggaaaatactgattttgttcccatgtacaatacccgtttcttcactcaaattttagaaattgtaagttgtagattaagaatgagagtgcacacaatcttttttaagt

SEQ ID NO: 219 - DNA, 422 bp, Zea mays
  Clone ID: LIB143-066-Q1-E1-G3
gggaagccgagtctatctctaggaagactctcaggagctcagccgagaagtttgagttccaagctgaggtttccagactcatggacatcatcatcaactcactctacagcaacaaggatatcttcctgagggagctcatatctaatgcctctgatgcgttggataagattaggttcctttctcttactgataaggaagttctaggtgaaggggacactgcaaagcttgagattcagattaagttggacaaagagaagaaaatcctctccattcgggataggggtattggtatgaccaaggaagatcttattaagaaccttggaacgattgctaaatctggcacttcagcttttgtggaaaagatgcagtctggaggttgactcaatcttattggacagtttggtgttggcttctactctgtg

SEQ ID NO: 220 - DNA, 271 bp, Zea mays
  unsure at all n locations
  Clone ID: LIB143-066-Q1-E1-G4
cacacgtccgagggtcattagcaaactggagcgccgtactgttgcttaccatgaatctggacatgcatttgctggatggttcttggaacatgctgagcctcttctaaaagttacaattgttcctcgtggaacagctgctttaggctttgcacaatacgtcccaaatgaaaatcttttgatgacaaaagagcagctttttgatatgacatgcatgacattaggtggccgtgctgcanangaggttttgattggcaaaatctcaactggtgct

SEQ ID NO: 221 - DNA, 417 bp, Zea mays
  unsure at all n locations
  Clone ID: LIB143-066-Q1-E1-G5
agcttgccctcgccgtatcgtccacccgcaacgcacaggaggattccatggccgacaacaccgggacgttggcgggcggcatcaaggacgtgccggggaacgagaacgaccttcacctccaggaactcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtgaagaagctctacgaagctaaggtctgggagaagccatgggagaacttcaaggagctgcaggaattcaagcctgttgaagagggtgctagcgcctaaggatctctccttctccatgtgcgagcctgaagctcanagcanagttgcagaataagga

SEQ ID NO: 222 - DNA, 390 bp, Zea mays
  Clone ID: LIB143-066-Q1-E1-G6
tgccctcgccgtatcgtccacccgcaacgcacaggaggattccatggccgacaacaccgggacgttggcgggcggcatcaaggacgtgccggggaacgagaacgaccttcacctccaggaactcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtgaagaagctctacgaagctaaggtctgggagaagccatgggagaacttcaaggagctgcaggaattcaagcctgttgaagagggtgctagcgcccaaggatctctccttctccatgtgcgagcctgaagctc

SEQ ID NO: 223 - DNA, 363 bp, Zea mays
  Clone ID: LIB143-066-Q1-E1-G9
cggtcgcttgggtcatggtgtaccttgccactctcaccaatcatgttttcatgtctgatcgcgacattcagatcccaactgccctcgatcccttcgctgaggccaatgctggggactcgggtgcggcaacgtggtcaaaggactacttacacgtgggcatccagcatcgtaatggtcgcaagagcctgactaccgtccagggattgaagaatgagttcagctacagcaagatcctcagatatctcaggaaagagttctgctgcaatggtacagtggtccaggacccagaacttggacaggtcattcagctctagagtgatcagaggaagaacgtctcgagtttcctcgtccaggtacgcatca

SEQ ID NO: 224 - DNA, 455 bp, Zea mays
  unsure at all n locations
  Clone ID: LIB143-066-Q1-E1-H1
ccggtccagaattagcgggccaccgctgcctccgcagtttcgcttccccccgtcttcccaagcctttgcttcgctcttcgcttcggattccctctgctcatggccgggagagggaaggcgatcggctcaggggccgccaagaaggccatgtccaggagctccaaggccgggctccagttcccagtgggaaggatcgccaggttcctcaaggccggcaagtacgccgagagggtcggcgccggcgcccccgtctacctcgctgccgtgctcgagtaacttgctgctgaggttctcgagcttgccgggaacgcggctcgggacaacaagaagacccgcatcgtcncgcgccacatccagctcgccgtccgcaacgacgaggagctctcncgcttgctgggcacggtgaccatcgccagcggtggtgtcatgcccaacatccataacctgctgttgcc

SEQ ID NO: 225 - DNA, 437 bp, Zea mays
  Clone ID: LIB143-066-Q1-E1-H2
taaggtctacagttcccaggccgcgtccgcgtccaactcctttactcttttctcctcgtgtccgccgctacacgcgccgccggaaccctagcctccgccgccacaggcagccgggatggagaaaggagcctcggaggcgtcgcccccttgcgctcgctgcggcaagcccgctcagcttcaatgccccaagtgtgtcgaacttaagttaccgcgtgagaacgcagctttctgcacacaggattgttttagggcagcatggagctctcacaaatctgttcacccaaagcctggtgcaccggcatcccagcagtctccagaaggttggaaatattgtttgagaaaagggcgggaacgtgcattgcaacttcctcgttttgattggacaggtccattgagaccacatccaatatcaaagatgcgtgtggtgccagatgaaa

SEQ ID NO: 226 - DNA, 394 bp, Zea mays
  Clone ID: LIB143-066-Q1-E1-F4
cgtttgcctcttctccctcttgccggtcccgaataaagagcagcagcgcaagaggtcggtagagcgagaagaaggcaatggcggccgagagcttccttttcacctcggagtccgtgaacgaagggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcacctccgacgacgtgggcctcgacgccgaccgctgcaaggtgctggtgaacatcgagcagcagtcccccgacatcgc

SEQ ID NO: 227 - DNA, 416 bp, Zea mays
  unsure at all n locations
  Clone ID: LIB143-066-Q1-E1-E1
acctgtttcgctgctcgcccgatctcgcgctgccggcagcgatctgagatcgagcgaagctaagctttttcatcgagatggtgcttgtactgcatgctaacagtggtaacaaaaatgcattcaaaacactaattgccgcagaatacagcggtgtcaaggttgagttggtgaaggactttcaaatgggtgtctccaacaaaactccagagttcctcaagatgaaccctattgggaagattcctgtcctggagactcctgatggtcctgtttttgagagcaatgcaattgcaagatatgttactcgcttgaaggctgataacccactttatggatcttcactgattgattatgcccatattgagcaatggattgactttgctgcaacagagattgatgcanacattggaaagtggttg

SEQ ID NO: 228 - DNA, 366 bp, Zea mays
  Clone ID: LIB143-066-Q1-E1-E10
cagcgaaggagaaagcagaccaacctagccacccagggagaaaggccaaaagggaggggagagtgtcgtcatggcttccattgtcgcttccaggagggccgttcctctagttcgcgctctggagaagctcatcgcagcgtcctccgcgcccgggactggctccgccctcaggccggtgggagtcgccggcggcctccgtggctacaacaccggcgctccgctctgacgctacgagggggccgagtcggaagacgatagcgtccgcgagtacgatgggcggtacggcggccgggactacgccgtgcccaacctgttctcagatattttccgtgatccgcttagtgcgccgcacagcattggccgcct

SEQ ID NO: 229 - DNA, 344 bp, Zea mays
  Clone ID: LIB143-066-Q1-E1-E11
aaagagccacatgcaaccggagcagcgcacagcaacagagcacacgccgcacaccgccgcctccgcaccagcagcaatggagcgcgccggcgctctctgcctggtgctgctctgcctcgtggccgcacattcacccgcggtgcacaactccacgaaagcgtcggccgctgcgccggcctgccactaccacggcgccggcgatcgctacaacaaagacgctcgcgcccgccgctgcgacgcggacgattccggacaccatagcctctgccacctcgcatgggaggaacgttggccatgactagcccgtggctaccgtgttcacaaatactgtcagtgatgcactt

SEQ ID NO: 230 - DNA, 415 bp, Zea mays
  Clone ID: LIB143-066-Q1-E1-E3
ctcgacgaaggaggaacgaacggacaggttgttgcacagaagcgacatggctttcgcgcccaaaacgtcctcctcctcctcgctctcctcggcgttgcaggcagctcagtcgccgccgctgctcctgaggcggatgtcgtcgaccgcaacaccgagacggaggtacgacgcggccgtcgtcgtcactaccaccaccactgctagagctgctgcggctgctgtcacggttcccgccgccccgccgcaggcgccggcgccggcgccggtgccgccaaagcaagcggcggcacccgccgagaggaggagccgtccggtgtcggacaccatggcggcgctcatggccaagggcaagacggcgttcatcccgtacatcaccgcgggcgaccccgatctagcgacgacggccgaggcgctg

SEQ ID NO: 231 - DNA, 294 bp, Zea mays
  unsure at all n locations
  Clone ID: LIB143-066-Q1-E1-E4
cagtacngcaacccagtcggcggcgtcgagcacggcaccggcggcatgaggcacggcacgggaaccgccggcggcatgggccagctgggtgagcacggcggcgctggcatgggtggcgggcagttccagcctgcgagggaggagcacaagaccggcggcatcctgcatcgctccggcagctccagctccagctcgtcggaggacgacggcatgggcggaaagaagaagaanggaatcaangagaagatcaangagaagctgcncggangccacaangacgaacagcacgccacg

SEQ ID NO: 232 - DNA, 412 bp, Zea mays
  Clone ID: LIB143-066-Q1-E1-E5
cgcacgcaacaagtacgcaggcagcgcagcctcgagccgtcgccatggcgagcaagcacctcgtcctcgccgcatgcctcctcctcctgcccaccgcctcggtcgccaccgacgtcgactactgcagtaagaaggactacccggtgaaggtgagcggggtgcagatcgtgcccgatccggtcgaacccggcaagcccgccactttcaagatctccgcttctactgataaaaccatcgagaaggggaagctggttatcgacgtcaagtatttcttcttctacgtgcactcggagacccgcgacatctgcggagagacttcctgcccagcgaccggcgacttcgtgctgtcccaccagcagacgctgccaggcttcactccgccgggctcctacacgatctacatgaagattgt

SEQ ID NO: 233 - DNA, 394 bp, Zea mays
  Clone ID: LIB143-066-Q1-E1-E6
tcccgggtccgatcacacgtccacgcatgcaacaagtacgcacgcagcgcagcctcgagccgtcgccatggcgagcaagcacctcgtcctctccgcatgcctcgtcctcatgcgcaccgcctcggtcgccaccgacgtcaactactgcagtaagaaggactactcggtgaaggtgagcagggtgcagatcgtacccgatacggtcgaacaaggcaagcccgccactttcaagatctctgcttctactgatacaaccatcgataaggggaatctggttatcgaagtcaggtacttcatcttcgacgtgcactccgacactcgcgacatctgaggtcaaacttcttggacaacgaccggatacttcgtgctgtccaaccaggagacactgccaagc

SEQ ID NO: 234 - DNA, 252 bp, Zea mays
  Clone ID: LIB143-066-Q1-E1-E7
tactctacatccatgtggaggttgctacatcagataactgctattgggtcagcacaattcacttcatcggccgtcattttacaacctctagacggggaaactgctgccgtttcccaacataatcgccgtgtatcagatcgccctttcaccagctggcggtataacgtggaggccagctccgatcacacttctcatcaattgatcatcctgaatgcagaatgggacgcgcactgtaccagagcatcaaccgcg

SEQ ID NO: 235 - DNA, 414 bp, Zea mays
  unsure at all n locations
  Clone ID: LIB143-066-Q1-E1-E8
gggctggcttctcctccccctcttatcaagtcctcctcgggttagggttccttagggttttgtggaggggcgatggcggcggctgatgtggagtaccgttgcttcgtcggcggacttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggcggcggcggccgcggcggcggtggctacggccgcggtcgcggcggcngcggctatggtggcgggcgccgtgacggc

SEQ ID NO: 236 - DNA, 371 bp, Zea mays
  Clone ID: LIB143-066-Q1-E1-E9
cacaggttgtccttaccaccaagtcgacatcaattgtcgttcatagcaacatccagtaacaagttactaaaagggttgcacagatcaaaagtctcattaatgcagcacaccaagaatattaaaaggaaaagctcactgatacgatagagattcttgctgacgatgttgctgtcattcatgtatcgtggttaatcatacttcatgtatcgcgtagcttgactcgtgcgagcaatgacacaaactgatctataatacatgaacttgagatttgtggataccctatatgcaactaaggatgccgttcaagaacgtattatagtacgcgtaggatgcactcttttgctgcttgcatctatagtcaactccatcaa

SEQ ID NO: 237 - DNA, 419 bp, Zea mays
  unsure at all n locations
  Clone ID: LIB143-066-Q1-E1-F1
cccacacgtccgggacgtgattattggttgctatgaagagtttaagagcaagaaaataagccgaggtgaactagtgaagaagctgaggcatgtagttggtgatagagtgctaatatcgacgataatgcgtctccaagataagttacctccagtggataagcgtgaggaaccagacacatcggcgtccaaggtggtggcggaaccatgagatgggtgtcaggaggtgggcgaggaatgcagaaagggaggaaccagccgacttgacatagaaaaccctgtgggaagcagcaactatgaagcctcttgcatcagtcttgtgcatggaggctgctgtttgttctctgtatcgtaggtgtctacgtntgcgaagaaattgtatccggtgtttctctttcttcaaatttaaacacgcacatgca

SEQ ID NO: 238 - DNA, 379 bp, Zea mays
  Clone ID: LIB143-066-Q1-E1-F10
atggagctcacgtgggacgaatgggatgtcattatactggctgcctgcagcttcctcatccctctcgtgttcctctgcaatgctacgaagcggcggcggcggcgcgcgccccctggcccggccaccgtacccatcatcgggaacctggcgtggctaacgttgcgcgacgggttgggtgagctggacatcctgcgacgactgcactcgcgctttggcccgctgctgtcggtccgcttgggttcatcggagcaggtgaacgtggcggaccgccgtctcgcacacgccttgctcgtggagcgtggcgccgctgtggctgaccgctcgccgctgctggtgtcgaccgagaggttcggggccttcggctctttcagcatacacg

SEQ ID NO: 239 - DNA, 364 bp, Zea mays
  Clone ID: LIB143-066-Q1-E1-F12
acgcacgaatccaatgtgtctcgtatcatctcccgtccatattccgcttggggttccctacagcttcggcaaccgtcgcctcttgatccgctaggtgaagctgcccatgtcgtcgtcggcgcccttgccggcgggcactctacacaccatcaggcgtgttgccaacctgccctggtctgaagatttggctgatctggctatctagtcatacattcatgctggctttaagagccatgttccttcaggagaggatcttccgccaattgttcatcatggtacattcccctccagcgtacaccatgattacgaacagtcaggcttagttcctttggagggatgttctgccagtgtggcttcacaggtt

SEQ ID NO: 240 - DNA, 426 bp, Zea mays
  unsure at all n locations
  Clone ID: LIB143-066-Q1-E1-F2
cttcgactttaacagggtggaaaccaagaaggccaaggtcctgggaatggatctttcggtgacaatggttccatttgcaattgaacgtgcaattggacccaagtgccctgttgaattcgaagttgctgattgcaccacaaaggattacccagaaaatagttttgacgtcatctacagccgtgacaccatccttcacatacaagacaagcctgctctgttcagaagcttcttcaaatggctaaagcccggcggcaaagtcctaatcagcgactactgtaagaatcctggaaaaccatcagaagaatttgctgcgtacattaagcagagaggctatgaccttcacgacgtgaaggcttatggacagatgctgaaggatgcntgggttcataatgtcatcgcnggagatcgcactgagcagttcttgaa

SEQ ID NO: 241 - DNA, 180 bp, Zea mays
  Clone ID: LIB143-066-Q1-E1-F3
ccacgcgtccggctagcagttgttgcattgcatttgcatgcttggatcggatatgcatgtgttcttctgcctgcgacatcggtagcgcgtgaggctgtgactctgtgagctgcgatttccgcagttgaatcggtagtgtaagcggaaatgtcggaatttaaatctggctggatttcgttc

SEQ ID NO: 242 - DNA, 381 bp, Zea mays
  Clone ID: LIB143-066-Q1-E1-D9
ggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcgaggcggccaccgagggcggcggctgcgactgcaacacctgcaactgcggcaccagctgcggctgctcctgctgcagctgcaactgagccggcccgcccggcccggcgatggcgcacgagagtcgagaggacgacgacgacgaggcgtataaatataatagcagcgtctaaataagatcctgtcaactgcacccgccattatcgatccatggtcgctcctggggttcatgttcatctgtg

SEQ ID NO: 243 - DNA, 348 bp, Zea mays
  Clone ID: LIB143-066-Q1-E1-C12
gcgcgtttcgatgcacgcctctagacagattcgcattagtacggttgaatgaagccaaaaacaaaaataaaaacagacacaaaatcaacagaaaataagatggtacaacagagggtggatgcgctagaggatccagccgttcgtacgtcagctcaggacgtcggaggtctcctaaagtgtcagctatttgtcgttcactggatcttcgttatcagtgttcgctgactgggacatcactggcattgcccagtttattacacgttgccaacatcggcctttctccagctggattactagcaaatggggccgcaacggtcgctggtctcaccatttgtgcagctgtaatgg

SEQ ID NO: 244 - DNA, 416 bp, Zea mays
  unsure at all n locations
  Clone ID: LIB143-066-Q1-E1-C2
gccaaccgcatcgtcaagggtccctggatcgtccgcgccaccgtcngcaactacgcggcctgcctgctcggccgcgcgctcacgtgccgctaccacaagggcgacgactacctcgagatcgacgtcgacatcggcagctcagcgatcgccagcgccatcctgcatctcgcgctcggcgccgtcacgtcggtgaccatcgacatggggttcctcgtcgagtcccagtccgaggaggagctgcccgagaggctattcggcgccgtgcgcatcgcgcagatggagatgagcgcggccaagtacgtggagctgccccctgatgaggccatgcctgagacggccggcaaggccggggccgggttcaaggtaagctcggcgaaggtggtcaatcatagcggccaacaaagacacgccggcgg

SEQ ID NO: 245 - DNA, 220 bp, Zea mays
  Clone ID: LIB143-066-Q1-E1-C3
attgccggaatggtccaagaattgcaattggtaattgaaaacgtcagcaactacgcagactgcctgctcagccgcacgctcacgtgccgcatccacaagggcgactactaactcgaaatcgacgtcgacatcggcagctcgggcgatcgccagcgccatcctgcatctcgcgctcggcgccgtcacgtcggtgaccatcgacatggggttcctcatccag

SEQ ID NO: 246 - DNA, 413 bp, Zea mays
  unsure at all n locations
  Clone ID: LIB143-066-Q1-E1-C4
agcacgcaacaggtacgcaggcagcgcatcctcgagccgtcgccatggcgagcaagcacctcgtcctcgccgcatgcctcctcctcctgcccaccgcctcggtcgccaccgacgtcgactactgcagtaagaaggactacccggtgaaggtgagcggggtgcagatcgtgcccgatccggtcgaacccggcaagcccgccactttcaagatctccgcttctactgataaaaccatcgagaaggggaagctggttatcgacgtcaagtatttcttcttctacgtgcactcggagacccgcgacatctgcggagagacttcctgcccagcgaccggcgacttcgtgctgtcncaccagcagacgctgccaggcttcactccgccgggctcctacacgatctacatgaagattgtc

SEQ ID NO: 247 - DNA, 375 bp, Zea mays
  Clone ID: LIB143-066-Q1-E1-C5
cccacgcgtccgcccacgcgtccgctcccttctctcctcttcgatcccgacgaacgccgagggccgcggcgatggaatactcaggcggcggtgcgacgctgtcggagatgtaccagagcgcgcggcggctgctactctcggcgcgggatggcgtgggccgcgtcgagcgccttgcctcggcacccacttcgtcctcctactcctcggcgccgctcgtcggtggtgcgtcgggggaccccgcggttgctgaggaggtgcggcgagaggtggcgcagatccaggggctgtgcgcgcagatggaccgactctggcgatccatccccgccaaaggccaacgggacctctggaagagaaaagtggagcagctctctgaag

SEQ ID NO: 248 - DNA, 350 bp, Zea mays
  Clone ID: LIB143-066-Q1-E1-C6
gcggcttccacaccacctgagctcggccggtggcggtctgcttccgaccgtccgccggtttgcttgcttcatctgcctccgccgcacctcgcctccgtccagccagccagccagccagcgccaagtcaagcgatccggccgcacccagcctcgacctccccggccgacccgtgagggcggtgtgtttggccttcaacggcctcgactcgcctcgagggcggggctcttccaccacctgcaggccgggagaagaggtgcaaaggcagcagcttggattcctgctaggggcgcgcggttggtcagctcgagagagaatctgaccgggtttgggcgtcgagatttcgattgac

SEQ ID NO: 249 - DNA, 344 bp, Zea mays
  Clone ID: LIB143-066-Q1-E1-C7
cagaggtgggttggcttctcctccccctccggttcgggttcgggttcgtgaggttctccggggttcggtttcgtgggtgggcggatcgagatggcggcgtcggatgttgagtaccgctgcttcgtcggcggactcgcctgcgccacggacgaccactccctccacaacgccttcagcacctactgcgaggtcctcgagtccaagatcatcctcaatcgggagacgcacaggtcccgcggcttcggcttcgtcaccttctccacggaagaggcgatgcggaacgccatcgagggcatgaacggcaaggagctggacggccgcaacatcaccgtcaacgatgccca

SEQ ID NO: 250 - DNA, 404 bp, Zea mays
  Clone ID: LIB143-066-Q1-E1-C8
gcactgcgcccaaaccggaggcgatcacaagtcacaacacagcccacttgtgagctgtctcctatcgaatccttgcgggggaaaggaatgggcgtcagcgctcgagctcaccatccgaagcaccggtgccaccaggaggcgtgcgtgcccgacagcgcgtcgctcgcggcgatgtacctctacggcgacgtgctcgagtccgtggtggaacgggtgccggtggccgacctcgccgccgcggagcgggtctcgcgggagtggctccgcgcggtgcacgccgcgctgcgccgccgcccgctgcggctgccctggctcgtcgtgcagctccagggtcgcgggggcctccggtgcgccgcggcgtatgacccgtgctcgggcgcctggctcgccgtgccggcgccgcg

SEQ ID NO: 251 - DNA, 361 bp, Zea mays
  Clone ID: LIB143-066-Q1-E1-C9
actacgtggacacgacgggcgaggagggacggttccacggccctcacagccacagcaccagcacgaccccgacgggcggcgcggcggcggcggcggcatcgtccgcgcaacttccggcgcagcttctcctccgcgtcctccgcgggccacatccaccgcggcggcggcggcgaagacattggagctaaattggtcacgcaagctgcagctaagaccaacgatcttgctggagatgggacaaccacctctgtggtccttgctcaggggctgattgctgagggtgttaatgtcgtggcagctggtgctaatcctgttcagattactcgtggtattgatagaacagctaaagcactagttgaag

SEQ ID NO: 252 - DNA, 246 bp, Zea mays
  Clone ID: LIB143-066-Q1-E1-D1
acatgtaaaaacatcatgcaggcttcctattcttgtaatgtcgttgtggccctgctgctttgttcatgttataaccctcctactggattatgcaaacactttgttgtttctgagtaaaaaaaaaaaaaaaaaaaaaaaaaaaaaaaaaaaaaaaaaaaaaaaaaaaacaaagataaaatataaaaaaaaaaaaaaaaagaaaataaaaaaaaaacaaaagggaaaagaaagcgcctaaaaagtaca

SEQ ID NO: 253 - DNA, 377 bp, Zea mays
  Clone ID: LIB143-066-Q1-E1-D10
agcaagtgtgactgaggctctcgctgctcctgcggcatctcatgcaactgcatgtcccctgacgtcgtgaccgccgccgctagcaccatcgataccatggtcctcgctgctccgaccaccaatgccatcacctgcaggttcgaagcagccacccacggcggaggctgctactgcaacacctgcaactgcagcacgagctgcggctgctcctgctggagctgcaactgacccggcacgcccggcacggctatagcgcacgtagactctagaggacgacgacgacgaggcgtataattataatatcagcgtctaaataatatcctgtcaactgcacccgccattagcgatccatggtccctcctggggttcatgttcat

SEQ ID NO: 254 - DNA, 373 bp, Zea mays
  Clone ID: LIB143-066-Q1-E1-D12
gaaaggcactcgggtcagaacccttggctctagggaatttatgcgctactatcgccagaaaccacggccttctgttgcaccagaccgtgcgcttgcactttcactagcttccagctacaagagcatgggtttggtgacagtgcagtctaaggagcagatggtgaggctgaaagttctccgtgctatgaacaggaccggggtcgagactatgcggaacaagatcggaatgaagagcaatgtgatccggaacctccctaagaattgcccgcactagacaacactgccttctcctgcaccctatctggagcttctcctggcatttacatcgtgtccgaaggttccgtgtctgtcgctgacaacgttggcgcctaag

SEQ ID NO: 255 - DNA, 411 bp, Zea mays
  unsure at all n locations
  Clone ID: LIB143-066-Q1-E1-D3
accacctcgaacagtaagcacacagaaccctacacgcgcatcgcagcatgggtatcgacctcgttgcccggttggagggaaaangaagacaaagcgcacagcgcccgaagtcccgacgatgtttatctcaagctccttgtcaagctctaccgtttcttggtcanganngacaagagcaacttcaatgctgtcattctcaagaggctcttcatgagcaaaaccaatcgcccaccaatctccatgcgccgccttgtcaagttcatggaaggaaaggagaagaacattgctgtgattgttggcacagtcacagatgacaagaggatccaagaggttccagcaatgaaggttactgccctgaggttcaccgagacggcaagggccaggattgtcaatgctggtggggagtgcctc

SEQ ID NO: 256 - DNA, 421 bp, Zea mays
  unsure at all n locations
  Clone ID: LIB143-066-Q1-E1-D4
ccaacacggcaaaacggaatgttccaaatccaggtcaaaattcaaccagccctaaccaataaaaaaaacggcttgggggcaacggaaaaaggggtatttccattataattacctttggatcaaaaagcaccactcgacaatgcatcaaggacggttctccttcttcctcaacctgtaccctgtggaaggaaaggccggcaaggcctcccatggatttccccaactcatcacttcttgttggccacctgctagctgttcgttctctcagcaagtaactagagatgatcttgctttaattttgtgctgatctcatactcgtcgtgtacgctcatagtcatggagcgacngatatgtctctgatcgttcacatgccgcctcttgtaacttgacttggatctatatatcaatgcaaataaatcat

SEQ ID NO: 257 - DNA, 255 bp, Zea mays
  Clone ID: LIB143-066-Q1-E1-D5
gggtcacaacccttggctctatggactttcatcgctaccatcgccagaacccacggccttctgttgcaccagaacgtgcgcttgcactttcacgaccttccagctataagaccctgggtctggcgacagtgcactctaatgagcagatgctgaggctgatacttctccgtcctacgcagaagactcgggtcgagactatgcggaaccagatcggaatcaagagcactgtgattcggaatctcgctaagaattgcc

SEQ ID NO: 258 - DNA, 443 bp, Zea mays
  Clone ID: LIB143-066-Q1-E1-D7
gtccagaagtcccggggccgctcaaacggctgcacacgcatctgcgcatgcatccgaggtgatggcgccgttcgtgatcgccaccaaccggcatctcagcgtgacgcaccccgtgcacatgctgcggcagccgcactaccgcgacaccatgaacatcaatgccctcgcgcgccataacctcatcagcgccggcggcatcttcgagatgaccgtcttcccgcgcaagtactccatcgacatctcctccaaagtctacggcagctggaacttcaccgaacacgccctcgccgacgacctcatcaagcgaggcatggccgttccagatacgtcgagcccctacaaggtgcggctgctgatcgatgactacccgtacgcctcggacgggctggccgtgtggcacgccatcgagcagtgggtgacggagtacctggccatctactacc

SEQ ID NO: 259 - DNA, 398 bp, Zea mays
  Clone ID: LIB143-066-Q1-E1-D8
tggcggtggccgcccggcgccgacgggcgcggcgggacgcggcagcggcagcaccagcgccggtggcagcggatggggcgcgatgcgtggctggagcgcgcgtggcgcatgcggaagcatcggcggcagctgcaggaggaggtggtgcccgtggtggtcctcggcggcggcggcgactccccggcgagccgcggcggcgtggcgatggatatggaggaggtccgcgcgtgcctcgacctgagcctggacctcccctgcgactggaccgtggagataccctcctactacgcgctctccggcgtcgacaccgccatcagcggcggcaattcgcgggactccgccggcatctggcgcatctccagtctcggagacgattccaaagatgttaacgcgctgct

SEQ ID NO: 260 - DNA, 378 bp, Zea mays
  Clone ID: LIB143-066-Q1-E1-C10
agcatcgcttccacttcggtctcagcgacggtcgccaccaccgctcccctccctctccccctcctcgcccagcggcaattaccacagcctccccagcaagccgggatggctgcactcaaggcatcgttccggggtgagctcagcgccgcttccttcctcgactccagcaggggacctctcgtccagcacaaagtggattttacgtttcaaaggaagggcaaacgagctatttcactgagaaggacatgctgttctatgcaacaggctccaccaccagcatggcctgggcgagctgttgctgagcctggccggaggtcatgggatggcccaaagcctatctcgattgttggttcaactggttccataggaacacagaca

SEQ ID NO: 261 - DNA, 358 bp, Zea mays
  Clone ID: LIB143-066-Q1-E1-A10
agaatcgcaacgacagcgagaacgtccaaacgagcgcgagtctccggcgataaccaagagcgcgggcacgcaaagcggcgaagcgggaaggaagcagtaacgatggggcttgactattacaagatcctaggcgtcgacaagggcgccaccgatgacgacctcaagaaggcctaccgcaagctcgccatgaaatggcaccccgacaagaaccccaacatcaagaaggaggccgagaacaagttcaagcagatctcggaggcgtacgaggtgctgagcgacccgcagaagcgcgcggtgtacgaccagtacggcgaggaaggtcttaaggggcaagtgccgccgccgggcgccggccggg

SEQ ID NO: 262 - DNA, 371 bp, Zea mays
  unsure at all n locations
  Clone ID: LIB143-066-Q1-E1-A11
tccccgcctcaccccgagccagccgtctcgctagggtttctccgccgccgccgccgccgccaatgcctcgccgcagctcaggaaagtctgccccacgcccagctccccgtgctgctccagtgaggaacccggcacaggcagcacgccaggctcctcctccagctcctgttcgagatggtggtggctccatgttttggangaattgggtcccacattgctcaaggtatggcgtttggcacgggtagtgccatggcacacagggctgttgatgctgtattaggtccccggaccattcagcatgagactgttgcctcagaagctgctgctgctgcccctgcccctccagtgatgaatgctgatgcctgcagcat

SEQ ID NO: 263 - DNA, 348 bp, Zea mays
  Clone ID: LIB143-066-Q1-E1-A12
aaaccgagctcatcccgagccatccgtctcgctaaggattctccgacgccgctactacgtggatgcctcaccggaggtcatgaacgactgccgcagtcccacttcagcgtgctgcgccactgaggagatcgatacagacatcacgcgacgatcctcctcgaggtcctgtacgagatgatggaggctccacgtgtggaggaattgcatctacgattgatcatcgtaccgcgtttgacatagatagaggcaagggaaataggcctgttcatgctgtcggaggtcgggggactagttagaatggtagtggtggatcagaagctggtgctgcagtgactgctgatcgaatgc

SEQ ID NO: 264 - DNA, 421 bp, Zea mays
  Clone ID: LIB143-066-Q1-E1-A3
cgggtccaggacgcgtacgcgtccgcttgggtcagcaccggtgatgcttttcatgaagggcactcccgatgctcctcgctgcggcttcagttcgaaggttgtgaacgccttgaagaaggaaggggtcagctttgggtccttcgacatcttatctgacgaggaagttaggcaaggtttgaagacgtactccaactggcctaccttcccccagctctactacaaatcggagctgattgggggatgtgatatcgttcttgagatggagaagagcggagagctgaagtcgaccctgtcagagtagacacctagcattcttgcttcgctggcgtttttaccatattgcctgcattggatcactctactctggtattcatgccattgtattcatagatccacgttggtacttgtctgcagtgccaca

SEQ ID NO: 265 - DNA, 352 bp, Zea mays
  Clone ID: LIB143-066-Q1-E1-A4
gcgatacctcagtcgccgtaaccctagactcgccaccgccggagcgatgctccgctcgccgggcaattcgctccgccggctctcaccgtcgcccacacccgcgcactcaacccctcgctcggtctccatgctatcctccaacgccctctcgtcgagtctccgcaggtcggcagtgcgcgacgacgacacctacctcgccgccatctagcgcatcatcgagcgcaactacttccccgacctgcatcgcctccgggaccgcctcgactggctgcatgtcgtgctgtcccacgacccgctcagcctacgcgacgcgcatctcatgatgctagaccgccgtcgctgcacccagcgc

SEQ ID NO: 266 - DNA, 385 bp, Zea mays
  unsure at all n locations
  Clone ID: LIB143-066-Q1-E1-A5
gtcngaagtccagtaaagggaggcagatgcccattcactatgggtcgaaccgtctgaactatttcacagtctcgtcacctatcgcaacacagctcccgcatgctgttggagctgcctactctctgaagatggacaagaaggacgcgtgtgccatcacatactttggggacggtgggacaagtgagggagacttccatgcagcgctcaacttcgcggctgttatggaggcaccggtgatcttcttctgccgcaacaatggctgggccatcagcactccgactactgaacaattcagaagtgatggagttgtcatccgtggccaggcttatgggatccgtggcatccgagtagatggcaatgatgctcttgctgtgtacagcgcaat

SEQ ID NO: 267 - DNA, 415 bp, Zea mays
  Clone ID: LIB143-066-Q1-E1-A6
agcacgtctctgtgtccgtccgtcgccggatctggtcgtagtggagacgtagtgtctgatcaggcagcaacagcagcgacgcgtcgatagatactagttgacgatagggttgttgtggcaggggcagctgcgtgttggacgacaacgcggtgcccatgccgttggcaagcgtcgcggccgtggcggcaccgcccaaggcgttggcggccaccacagacacggttggccttgtacgaaaacactaataaattcttgtttattagtgttgtcttatctcttggtttaataccatccaaagaagtactgtcctgtcaggaaaacactaataattcttgtttggacgaatcttcactccacgtggatggtccacatgctcagttgtgataacaagacagatccaagctgggttacaacg

SEQ ID NO: 268 - DNA, 389 bp, Zea mays
  Clone ID: LIB143-066-Q1-E1-A7
ctactaccccaacgacggcgtgctgcaggccgacgtggagctgcaggcgtggtggaaggaggcgcgcgaggtcgggcatgccgacctcaaggacgagcactggtggcccaagatgcagacggtgccggagctcgtgaaggcctgcaccaccatcatctggatcgcgtcggcgctacacgccgccgtcaacttcgggcagtacccgtactgcgggtaccacccgaaccggccgtccgtgagccggcggcccatgccggtgccgggctccgacgcgtacaaggagctggagaagaacccggagaagttcttcgtgcgctccatcaccgcccagttccaggccgtcgtcggcatctcgctgctggagatcctgtccagccactcctccgacg

SEQ ID NO: 269 - DNA, 347 bp, Zea mays
  Clone ID: LIB143-066-Q1-E1-A8
gctcgccgtggaatttggcccacgcatcgtggtgatggcgttcgtggggactgccatcgcgttcgcctgcgtcaccggcgcggacatggtggccaagcgcagggagtacctctacctgagtgggctgctctcgtcggggctctccatcctgctctggctgtagctacccggctccatcttcggctactccgcagccagcttcatgttcgaggtctacatcgggctgctcatcttcttgggctacgtggtgtacgacacgcaggatatcatccatagggcgcaccgcggagacatggaccacgtcacgcacgccctcacactcttcacaaacttcatggccgtcctcg

SEQ ID NO: 270 - DNA, 364 bp, Zea mays
  Clone ID: LIB143-066-Q1-E1-A9
cctctgctagtcctcctacgtctcttctcttcgcttaatcttggtcggtgatttgattcttcacttcttgcgcgcattgcagagggtgctcggtctgcagctatcttaggttaaccagtcgtgtgtggtctatcggtttcgatatagtattactactgctctgttataatcagcggggaggaggaagatgacggtgacgccacggatcacggtgagcgacaggcggctgaccgtgcgcggccgtacggtgctcaccggcgtgccggacaacgtgtcggcggtgcacgctgccggggcggggctcgtcgacggggccttcgtcggcgcccacgccggcgaaggcaagagccatcacgtcttcaac

SEQ ID NO: 271 - DNA, 404 bp, Zea mays
  Clone ID: LIB143-066-Q1-E1-B1
acgcgtacggcaacgtccagtggacaatgaccgctatgtcaggaactgccgcaacgggaggtcgccgaaggagaccagatggtggttccatgacgacacggtgtaattgagcgcctgtcagccttccttgctgtggtatatctcgtcaaggggagattggggatgatttaggcctatttgtaagcatccctctatcggattgcgaagcttaccttcctgtggcggtgtgttaaatgagttgcacacatgtgtcgagtctgagaatacatattaccatcatcaatgatataagtaatatagaataagcatgagtgtaccctgcctgaatcactggaacgagctcaaaaggaattaactgtgcaggtttaactatgacttgctttgctcaatgtgcctttgtatca

SEQ ID NO: 272 - DNA, 189 bp, Zea mays
  Clone ID: LIB143-066-Q1-E1-B12
tgagtcgtattattcgtacacagggatttcatactcatgttgttgtccgtcacgaaacaacggctttttgttgttttcgttcaatagtcgtacataacgcggagcgaaatcagttatcttgtgtgcgggacgatatctgcctcccattttgcacacacgaaacttttgatcacaacggtgttttacctc

SEQ ID NO: 273 - DNA, 395 bp, Zea mays
  Clone ID: LIB143-066-Q1-E1-B2
cccacacgtccgtcatcctctccgccgcctgccgcccgccgcatcagcaccgaccgggcaagatgaagactatcctgtcgtcggagacgatggacatctcggagggcgtcacggtcacggtggccgccaagctggtcacggtggagggctcccgctgcaagctcacccgcaacttcaagcacctcaacctcgacttccagctgcatgaggccggccgcaatgctcaaggtggacgcctggttctgcacactccgcaccatggccgccatccgcaccgccatctcccacgtccagaacctcatcagaggggtcaccaatggctaccgctacaagatgacgttcgtctacgcccacttcgccatcaacgcctccatcatcaacagcaacaccgccat

SEQ ID NO: 274 - DNA, 319 bp, Zea mays
  Clone ID: LIB143-066-Q1-E1-B3
agctcctcacgccgccgccgccgccgccgccgccgtcgccgccaccacatccgtagcgcccagccgccggagaagaggagggagccagcaccagccaccatgggtcgcgtccgcaccaagaccgtgaagaagacctccaggcaggtgatcgagaagtactactcccgcatgaccctcgacttccacaccaacaagaaggtgctggaagaggtctcgatcctcccctcgaagcgcctccgcaacaaggttgccggcttcaccacccacctgatgcgccgcatccagcggggccccgtccgtggcatctcgctcaagctgc

SEQ ID NO: 275 - DNA, 375 bp, Zea mays
  Clone ID: LIB143-066-Q1-E1-B6
cggacgcgtgggcggacgcgtgggcggacgcgtgggatcggatacagggttcgtctccttcgctcgttgtggtcctgcctttaggctgctccgagttgggccatgggacatcgaggcccatcgcgtggtgagccggtgccgggtgttacaggcaagtaactagtttactgagcatcacatacaattaattttctagtaagcttgctcttcagtatgacagaacatatgactaattttggatagttcgcttaggttgcaccataactcagccagatacctttatggcttcatatgacacttgtcttgattttgatccaactatcagatatatatttctacaaacaataacctcctggccatattaaggatctggat

SEQ ID NO: 276 - DNA, 376 bp, Zea mays
  Clone ID: LIB143-066-Q1-E1-B7
acggacgcgtgggcggacgcgtgggcggacgcgtgggatcggatacagggttcgtctccttcgctcgttgtggtcctgcctttaggctgctccgagttgggccatgggacatcgaggcccatcgcgtggtgagccggtgccgggtgttacaggcaagtaactagtttactgagcaacacatacaattaattttctagtaagcttgctcttcagtatgacagaacatatgactaattttggatagttcgcttaggttgcaccataactcagccacatacctttatggtttcatatgaaacttgtcttgattttgatccatatatcagatatcatatttctacaaacaataacctcctggccatattaaggatctgga

SEQ ID NO: 277 - DNA, 191 bp, Zea mays
  Clone ID: LIB143-065-Q1-E1-G4
tactccctaataagagtcgtattaaatcggcatatattgggccaggttctggtatattacatgtacacataactttggcatttgaaaccgtacgttcccggacgcctgtggcgttcgggggttatcagccattgatgcaagccttgttgatccaccaaagacgtagcacagtcgcttcgccagtactattc

SEQ ID NO: 278 - DNA, 380 bp, Zea mays
  Clone ID: LIB143-065-Q1-E1-G5
actgtcgggcgccacatccgtgttcggcgccgcgcccgtggaggtctccgtgaaggtggccggcatccactggcactacggcagccggtcccacgccccggagctcaccgcgggctactacaacacgcggcgccacgacgggtacctcaccatcgcgcgcctcctggcgcgccacggcgccgtgctcaacttcacctgcgtggagatgcgggaccacgagcagccgcaggaggcgcggtgcatgccggaggcgctggtccggcaggtgggcgccgcggcgcgcgccgccggggtgggcctcgcgggcgagaacgcgctgccgcggtacgacggcacggcgcacgaccaggtggtcaccacggccgccgagcgcgccgccg

SEQ ID NO: 279 - DNA, 405 bp, Zea mays
  Clone ID: LIB143-065-Q1-E1-G6
atatcctactgccggcgttccagagttcgagctgagcagttgcacacagctgctcgtgaagctagctagcgaagccacaggcccccagtgactttgctcccccacaccgtagcggccgtataaaccagctccaaccgatccatcgaaatcgaaccacagtacgtgagcccgtactagagacatatggcctccgcgatcaaggctgcatcgacctcctcccggtggtcttcgtccccggcggcagtccactcgtcgccgttatcgaagcggctaccagctgcagtggccatgccggggcggcggaggtctgtggccactgtaagggcggtcgccgcggtagctccggctgccccggcggcgccggccaagctcaccgccggtgccggcggccgatgcctgccggtg

SEQ ID NO: 280 - DNA, 380 bp, Zea mays
  Clone ID: LIB143-065-Q1-E1-G7
ctccagtctctgggcaccaaatttccggcggcgatggcggcggatgtggcgaggtcagggttccggcacatgttcgccgtctctgccttcgcgccgacgaaagagcccgccgcgcgcaccaatgacgatccagcccccaacctcgtcgactccggcttaaccaagcgtaccacaagtgaaggacttagagatgcctttgcggagtttggtgaagttttgcatgctcgagttgtgatcgatcgtgtcagtgggttttctaatggatttggctttgtaaggtatgctatgaacgatcaggcatccaaagcaatacaatgaaacgatggcaagttccttgatggatgggttagttttgcagaatacgctaaatccagaccacc

SEQ ID NO: 281 - DNA, 384 bp, Zea mays
  unsure at all n locations
  Clone ID: LIB143-065-Q1-E1-H1
gcgagcgacgaggcggtctccgccgttcctgcgatggctatcgtcggacgcagcctcctctaaggcgccgcggcagcgcgtagcggcgctgtgggggaacggtgactacgggcggctggggctgggctcgctggagtcgcggtggagccccacggtttgccccttcttcctcgcccgcgccgccgacccgcccgcctccctcgcctgcggcggcgcacataccctctttctcacccagaatgggcgagtgttcgctacagggctgaacgactttgggcagctggggatangaacctctgttacacatatgctggagcctgttgaaatttctggatttcacganagagttgtagaagtttcagctggcaaccatcattcttgtgc

SEQ ID NO: 282 - DNA, 422 bp, Zea mays
  Clone ID: LIB143-065-Q1-E1-H10
acgcatccacccacgcgtccgggctccaagatcggccgctgccaactggggggcctcaccgccacccgttcttggaaaacagcacgctacttacttgaaagtaaagggagatacttgccgcgttgggattctccaactccaaccaagacgaacgatttcatcccactaatcctttttcttttcttttcgtttttatttttaatttcttggttcggttcttgatcacctgttcttccttatgaccttatccaggaaattagattatcaggtgcttctatttgtttgtgcatctcttgtttgcgcctgcgatctggaccttttttggctcctcaacaaaagagaagatgagcctttcttgttggtagttacaaccggtggcgtctcttgttgtgcaggtgcattttgtgtgaggatccagacgc

SEQ ID NO: 283 - DNA, 429 bp, Zea mays
  unsure at all n locations
  Clone ID: LIB143-065-Q1-E1-H12
acaataatctataatgaatcatatcactgcgctgataattattggatcaatttcgataattattagtagatctatgagatatgccgcctggaagaggcgaggtaagctgcagcatgtaaaaaagagaaaaaagatgtgacatcctagaggaggaggcctttgccatgatgggtgcgctcgcatggcaggccaggcaataataaaaagatgattattgcgtgccgggggaggagatcgcacgggggttgatgtttttggccccgggttctcctccctcatcttgttccgtgttcctgtatgcgttgcttccgctcctgttggtccgctacgcacgccggatttttgcatcgagcacggagatctacaacanaaacatggagctacgacgcgattcccaaggtacaatcgtaattatgttcaaacaatttt

SEQ ID NO: 284 - DNA, 197 bp, Zea mays
  Clone ID: LIB143-065-Q1-E1-H2
ggcactatgcgagtttgcgttatgccatgttttgggaaattttgtagctgcctaggcctcgtgctgttgtggtggttcattagtatgaagacgaaggctctgctggctatgggagtcctttctctttttgttagtactttgtttagaactatgtatgaccgaattatttgtcatccttgactcaagtctgctgcaga

SEQ ID NO: 285 - DNA, 386 bp, Zea mays
  Clone ID: LIB143-065-Q1-E1-H3
atccaaagtcgagagggaaacttgtgtaccagtacaccaagaagcgcgcgagcggaccgaagtgcccagtcaccgggaagaagatccaaggaattccacacctgagacctgctgagtacaagaggtccaggttggcaaggaaccaaaggactgtgaatcgtccatatggtggtgttctgtctggtactgcagttagggagaggatcatccgtgcctttttggtcgaggaacagaagatagtgaagaaggtgttgaagatccaaaagaccaaggataaggcctccaagagctagacgatataggccacaatgtttgagtccattcgaatttatttcagcaggaaaatttctcgcgggtatggggaatcttggtacttatgctagtag

SEQ ID NO: 286 - DNA, 402 bp, Zea mays
  unsure at all n locations
  Clone ID: LIB143-065-Q1-E1-H4
tcggcccacgcgtccgatcacaacgaacagaagctctcgatctcaccgacaccgaggaagaagagatcaatggcgtccgagcagggagtcgtgatcgcgtgccacagcaaggctgagttcgacgcccacatgaccaaggcccaagaagccggcaagctggtacgcgtccccgtgcctcgtcttcctcgatccccattcccgtgattttgtttggaaagctgtttaagggattccgcggttcaaatcgattcgtctttggtttccttattatgcggtcgcccccctgttcaaatttgctctgaatcgcatctgggatgcttgtgttcgggggtgattaaggtgcggcgcgtgtantgggcaagattttanggattttagcgggtccgtacagtccgtctccgt

SEQ ID NO: 287 - DNA, 402 bp, Zea mays
  unsure at all n locations
  Clone ID: LIB143-065-Q1-E1-H6
aggcggcttccctggccctcagggtccttactactgtggaatcggcgcggagaaatcgttcgggcgtgacatagtcgacgcccactacaaggcctgcctgtacgcaggcatcaacatcagtggcatcaacggggaggtcatgccggggcagtgggagttccaggtcggaccgtccgtcggcatctcttcgggcgatcaggtgtgggttgctcgctacattcttgagaggatcaccgagatcgccggcgtggtggtgacgttcgacccgaagccgatcccgggcgactggaacggcgcgggcgcccacaccaactacagcaccgagtccatgangaagganggcgggtacgaggtgatcaaggcggccatcgagaagctgaagctgcggcacaaggagcacat

SEQ ID NO: 288 - DNA, 397 bp, Zea mays
  Clone ID: LIB143-065-Q1-E1-H7
acaaggcaccacacctcttcttcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactgagccggtcaggcgatggcgcacgagagtcgagaggacgacgacgagtcgtataaatataatagcggcgtctaaataaga

SEQ ID NO: 289 - DNA, 398 bp, Zea mays
  Clone ID: LIB143-065-Q1-E1-G3
cccacgcgtccggcaaaagaacatatattgggccaggttctggaacattacttgcaaacaaaactttggcatttggaaaggtactttctcggactccggtggagttcgcctattatcaaacaaagatgatagcgttgttgatcgtctaaagatgtatgacagccgcatcgccaaccgagttcgtcgtcggccgatggcaagcatcccctccagtgttactgatgtagaatacgaagatgcaggttacgcttcattaatgaagtctttaactcatcatgatgtgacgcacaaattgagaaccttggtccgtgttgtggcagcacatccatgtgaagctagtttgctttcaactggtaactgtcatcttcggttgactcttgaggattctacagcgagaa

SEQ ID NO: 290 - DNA, 74 bp, Zea mays
  Clone ID: LIB143-065-Q1-E1-E6
aaaaaaaaaaaaaaaaaaaaaaaaaaaaaaaaaaaaaaaaaaaaaaaaaaagggcggacgcacaaaaggaataa

SEQ ID NO: 291 - DNA, 386 bp, Zea mays
  Clone ID: LIB143-065-Q1-E1-E8
gcagtgcagggcgcaggcgtcgatctccccgtacctgcaactgccaccgaaccccgccaccaaaaggcccgccgcgacattcgacccatggctgccgccgatggcaggggtgcgccgctgtccagctcccgcgtggcggtggcgaggggactcgtgcacgcggcgcaggtcgctgcaggcttggccgtgctcctctgcgccttcgccgacttgccctgggctgccgccgcggcccccgcctgcatcctccgcgtcgccgcctccttcctcgccccgccgcgcctctgcttcctcgccgcgcacgtcatcctgatcgccctcgccacgctcttccgccgcgacgcagcctcgtcctcgccgccgtccgcggaccctcccggctccag

SEQ ID NO: 292 - DNA, 390 bp, Zea mays
  Clone ID: LIB143-065-Q1-E1-F1
cgcagcagccaaaacctacctagccgccgccgcaggcggccccccatcgccgccaagatgcagatctttgtgaagactctgacggggaagaccatcactttggaggtggagtcctcggacaccattgacaatgtgaaggccaagatccaggacaaggagggcatccccccggaccagcagcggctcatcttcgccggcaagcagctcgaggacggtcgcaccctcgccgactacaacattcagaaggagtccaccctccacctggtgctccgcctccgcggtggcgccaagaagcgtaagaagaagacgtacaccaagcccaagaagatcaagcacaagcacaagaaggtgaagctctccgtgctgcagttctataaggtggacgacgcc

SEQ ID NO: 293 - DNA, 424 bp, Zea mays
  Clone ID: LIB143-065-Q1-E1-F10
acccacgcgtccgggactttggctaaaggacaagacaccttcaccccaattagtgcagtagttccaaaatcagctgtcactaatcccgatgatctcgagctctggctgaaggtagatgatgaactaaggcagaaaggaccgacaagcgacatgctattcaagattccttttctgataagctatatcagttccatcatgacattaatggagggtgatgtgatattaacaggtactcctgagggtgtgggtcctgtcagagtaggtcagaagattacagctggtataactgacctaattgatgttgagttcgatgttcagaggcgaaatcggtcattttccacatgatgcaataagcaagaaagtaatggtgaatacaaagtggcagtactcgtcctcgaccttgaatcgcattactggacctgca

SEQ ID NO: 294 - DNA, 364 bp, Zea mays
  unsure at all n locations
  Clone ID: LIB143-065-Q1-E1-F11
cggacgcgtggggtccaacaagaaccaaggtggaactgtaaagccttgtgtctttgaactttgcagccacgtattcagatttttttttgagttattgtaatttatttacattccctctagaaccgagattagcgctacctcagtacactgccggtgcaagataaacgaaggaagctgggattgcatggcactgcggtctgttatgtagccgtggaacagcaagacaaaaagacatggatattccttgtttggattggggtgtttgatccagaaacagtctcattgctaattgtttcattattactacaannaaaaaaagaaaaaatcaatcaatttcaaaaagaggcaattaacactgatagtt

SEQ ID NO: 295 - DNA, 416 bp, Zea mays
  Clone ID: LIB143-065-Q1-E1-F2
ggacttgtttcttgctcatatctccggaatggacaccctggcccgtggcctccgcaacgccgccaagctgatcgaggatggttccctagatgctctcgtccgcaagcggtaccagagctttgatagtgagattggtgccttgatcgaggctgggaaaggagactttgaggcgctagagaagaaggtccttgagtggggtgagcccactgttccgtccggcaaacaggaactggcggagattctgttccactctgctctatagatggcgccatgtccgtagcggtagctcctggaataagcaagcactgagcctgcgccctcccaacgcgcgcggtcgtcctcaccagtcaccaccaagggaatgtttctggttgcgcgcgaatgaacatgtacaatacaccgttggaactgaaata

SEQ ID NO: 296 - DNA, 431 bp, Zea mays
  Clone ID: LIB143-065-Q1-E1-F4
ggtgtgccccagttcgctgcccgttccccagccgccgatccctcgatctccgctagcttcgttccttcgtacaggaacggtcgagcagaaactagcagccactcccgagtcccgactcccgatcgcgattacttgccgcggcaccagtactccagcggccaccatgagcagcgggaagcgatccttcttcgcgcccaagaagaaggccaccaacccgttcgattccgactccgacgacgacaaaccgcagcagcggccagcgcgggcgtcctccgtgcctcccccggacgagcagcggggctcctcctctctcttcggcgccggcgacagaggcgggctcttctcttccgcggccaaccatcactaccggaacgacttccgcgacgctggcgggcttgaagggcaatcccttgcaggagctggagggctac

SEQ ID NO: 297 - DNA, 402 bp, Zea mays
  Clone ID: LIB143-065-Q1-E1-F7
cccacgcgtccgcgcggcgtggtatcgctttcgcgtctgcgtgcgtgcgtgtgcaggcaggcaggcggctggcctccgtccgcgcatcctcttctggcgaggagctcccccacgcagccgctgctctctccacgtcctctgttccttcccctccccgatctcccccaatccgaccaaaccggcagagccggggggcggcgatggcgctgcgacgggcgctcctcagatcggcagagatctctttcgaacgcaaggctgcaattgagtacattcattctttatcaagggcacagcctgctcgttctctcaatggtgctggcctttgtcctgctagtagattacttagcacccaggccgccactacgtcaagcacaccacaacctccgcctcccccaccccctc

SEQ ID NO: 298 - DNA, 396 bp, Zea mays
  Clone ID: LIB143-065-Q1-E1-F8
aaaaggcactgaagaagccagtcaatagcgagttctactactagtagctagcctgctgatctgttctgttgtttagttcgcaaagccttctgtttcggcgaccatggaggatgagaggaacacccagcagcaccagggcggtgaggcccagcaggacgccgccgatcaggtggacgtgaaggatagggggctcctggacagccttctcggcaggaagaagcacgacgacgaccaggagaagaagaagcagacggatgagctggcgaccggcatggagaagaaggacaagaagaagaaggataagaagaagcacggcgagggccacgaccacgacggcggccacagtagcagcagcagcgacagcgactgagatctggtgtcgcagatgtcgatgct

SEQ ID NO: 299 - DNA, 418 bp, Zea mays
  unsure at all n locations
  Clone ID: LIB143-065-Q1-E1-F9
gcctcggctcgtttgatccccgcggggagctctagttccgccaagcgtgcgtaccggcgtccggatccgggaccgaagatgacggagtccctggtgcggaacaagccggggatggccagcatcaaggagatgccggtggtgcaggacgggccgccgccgggcggtttcgcgcccgtgcgcttcgcccgccggatccccacctcggggcccagcgccaccgccatcttcctcaccaccttcggtgctttcgcatatggcatgtaccaggtcggtcaggggaacaaggtccgccgctcaccagtcttagctacatgggggtggaatcatgcatgcanggcgctcaaagaagagaaaattgctgctcgcagtgctatactgccgatgctccaagcagaagaggatgaaagatttgtcaaag

SEQ ID NO: 300 - DNA, 389 bp, Zea mays
  Clone ID: LIB143-065-Q1-E1-G1
ggcgcgctgcagcgcctcccacggatcatcggctacggcaacgctgctgacctcgcgctcaccggacgcaagatcaccgccatggaggccaaggagatggggttggttaccagggtattcgattccaagcaagacttggatgcgggcgtcgcaaagatcgccaaagaaatagctgacaagtcggcatgggcggtgatgggaaccaaggccgttctgctgagaagcagggatgcgaccatagaacaaggcctggagcatgtagccacatggaacgcgggtatgatgaggtcgaacgatctgaacgaggccatcagagccttcctggagaagcggaagcctgtgttctccaagctgtaatgatcagataccatcataccatacctctgtgt

SEQ ID NO: 301 - DNA, 392 bp, Zea mays
  Clone ID: LIB143-065-Q1-E1-G10
gccaattcgctcgagttcagatcgagcgcgcgccaagcaagtcttccggccggccgcgaagagcgcaatcaagcaagacaagatggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttct

SEQ ID NO: 302 - DNA, 375 bp, Zea mays
  Clone ID: LIB143-065-Q1-E1-G11
cccacgcgtccgccgccgctcgacgccgacgccgacgccgacacctctccctcccccattccccgtgccccggaccgcggagcagacagaggcgagatccggagcgccgcgcgatggcgaacatcgacatggcgaagatcctggcggacctggaccgcggcgccggcgacgcgcggctgcccaagaccaagctcgtctgcacgcttggcccggcctcccgctccgtgcccatgctcgagaagctgctccgcgccggcatgaacgtcgcgcgcttcaacttctcccacggcacccaccagtaccaccaggagacgctcgacagcctccgccaggccatgcacaacaccggcatcctctgcgccgtcatgctcgaca

SEQ ID NO: 303 - DNA, 399 bp, Zea mays
  Clone ID: LIB143-065-Q1-E1-G12
acggagcatgacgcaagcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaacgaggagggtcgaggcaatgaggaccgtgtaacactcatcaaggactaccgtggcaagattgacactgagctcaccaagatctgtgatggcatcctcaagcttctcg

SEQ ID NO: 304 - DNA, 430 bp, Zea mays
  Clone ID: LIB143-065-Q1-E1-G2
ggtgtgccccagttcgctgcccgttccccagccgccgatccctcgatctccgctagcttcgttccttcgtacaggaacggtcgagcagaaactagcagccactcccgagtcccgactcccgatcgcgattacttgccgcggcaccagtactccagcggccaccatgagcagcgggaagcgatccttcttcgcgcccaagaagaaggccaccaacccgttcgattccgactccgacgacgacaaaccgcagcagcggccagcgcgggcgtcctccgtgcctcccccggacgagcagcggggctcctcctctctcttcggcgccggcgacagaggcgggctcttctcttccgcggccaaccatcactaccggaacgacttccgcgacgctggcggcctttaagggcaattcggtgcaagagctggagggcta

SEQ ID NO: 305 - DNA, 372 bp, Zea mays
  Clone ID: LIB143-065-Q1-E1-E4
gcgtggagcgcagcagcggccagttcgtgcggcgcttccgcctccccgagaacgccaagaccgaggaggtgagggccgcgctggagaacggcgtgctcacggtcaccgtgcccaaggccgaggtcaagaagcctgaggttaagagcatccagatctccggctgaagaagacatggacgcgaggtgaatggtcgcgtcgcgttcgcgtcgcggcgtcgggtcttgggtttcagcgacgcgactcgtgtgtgtggtactgtggttgctctgctttggtatgtctggtgtgtacgtgtgctgttcagtgtttcgtggtcatcgtctgtacattgtgctgttcggtgagctccccgactcagtgtgttgtgttctg

SEQ ID NO: 306 - DNA, 387 bp, Zea mays
  Clone ID: LIB143-065-Q1-E1-C9
gccacataacaagatggatttcctgcctaagaaagagttcgatacgtacttctgcgcgtatgagccctacgagcagtgtcccagatcagattcaagagctacttacagttcaagagacgatgacttgtggagcaagaattcacgctttggctcgaatctactctgctggagagccccaaaacagtccatgtaatggaggaaagaacgagtgaactgggtggaacaaatcgattctgctacgagattttaccaattttgcccgaagctggagacatggacaccacccgcagctgcggggacaaattttgaagggaagtctgggaggggtctgtgctattcttgatcttggtaggcagctgaggattgaggaactatttagtgatgttt

SEQ ID NO: 307 - DNA, 382 bp, Zea mays
  unsure at all n locations
  Clone ID: LIB143-065-Q1-E1-D1
cgaaaaggcaggcaagggaaaggcaaaggccaacccatcccctgcctcctccgttgctctgctgctccccctccttatctaatcctctggttcctggacaccggcctgcaagctccagcagcagcggcgccggcgacgaaaggaggaggattgctaccatcctatatcatatcatacatatacacaaggaggaggagaaggtgtgtagcgaggttgaggtccggaggatgccttccagtgccatgagttccgggctggagccggtgctctgcgcgcctcggccgcgcagggtccagcagctgcacccctgcagcgccgacctcatccttggcgcaccgcccttcncgcgcaacgccaacagcaaggccagcggcagcagcag

SEQ ID NO: 308 - DNA, 392 bp, Zea mays
  Clone ID: LIB143-065-Q1-E1-D11
gatttgctcgcgttcgaggcctccttttgtttccgctagattctgccaagatcagcgattccctccgccagcagaatcgctcgctctctttccatcgagcgtgcattcttttctgctgctgagtcgggcaggatcggcgtaaccgctccaaaccccagacctttgtccagcagcctcgcgccctcgccgcgtcggtatggtttttccttgccccccgtcctagttgctctgttcgcttgatttcctggtcgaggttctcgtgcgctgttccaatttcgagctaatcgtcctgctcctgcctaggattaatccccttctgttcttggagttcacacacatcccgtgcgcgcggattgctggtgcagcagtcgtcggcggcgcgtgcattttgc

SEQ ID NO: 309 - DNA, 384 bp, Zea mays
  Clone ID: LIB143-065-Q1-E1-D12
aagcttctgcttgctctggggggaaggagagagagagagcgagagagatctagtagagaggctagctaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcctccgagccggccgtgtccgtgcagctcggcgaccacggccacctcgcctactcccacaccaaccaggcgctcctccgccccaggtcgttcgcggcgaaggacgaggtgttctgcctgttcgagggggtgctggacaacctgggtcgtctgagccagcagcacgggctgtcaagcaagg

SEQ ID NO: 310 - DNA, 326 bp, Zea mays
  Clone ID: LIB143-065-Q1-E1-D2
agctgcactggcccgaggcgcggccatgaaaggcggcggcgacaagaataagaaggtggcggcaggtggcatgttgctgtccgtcgtcgccgtcggctgcttcctcctcttcgtcgtcgtcgtcttcacgctctcctcccgacgctacaccaacctcgtcctcgacgctcgtgatcgtgagccgatgtgacttccacacgtcgcagctgcatgggggcagccacggcggggatgcggtaaaggttacttcaagcatcggcatgttgctcaacgaagcaacgatgacgacgagaacgcgtgtcacggaagcgtgttcttgacgaatc

SEQ ID NO: 311 - DNA, 398 bp, Zea mays
  Clone ID: LIB143-065-Q1-E1-D3
accgtcgtccgccgccgccgaaggacggaaggagaagagggtacggccgtctcctcgcccccatggcccacgagaagaagctgtccaacccgatgcgggagatcaaggtgcagaagctcgtcctcaatatctccgtcggggagagcggcgaccgtctcacccgcgccgcaaaggtgctcgagcagctcagcggccagacccccgtcttctccaaggcgaggtacacggtgcggtcgttcggcatccggcgtaacgagaagatcgcctgctacgtcacggtgaggggcgagaaggccatgcagctgcttgagagcggcctcaaggtcaaggagtacgagctgctcaggaggaacttcagcgacaccgggtgctttggtttcggcatccaggagcacatc

SEQ ID NO: 312 - DNA, 394 bp, Zea mays
  Clone ID: LIB143-065-Q1-E1-D4
cccacgcgtccgccttcactcagtcttaggctcttagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgaggctgctgctcctgctgatcccgaggagcttcccgcggccgagcagcaggcagccgccgagcccgaggccgctgctcctgctggtgccgaggaacccggcgcggccgatccggccgccgaggctgaggctgctgctcctgctggtcccgaggagactcccgcgg

SEQ ID NO: 313 - DNA, 390 bp, Zea mays
  Clone ID: LIB143-065-Q1-E1-D5
cggcaatctcgatctcgttcgttcccctgagcggcagtcagtgcgagcgagcgcgcacacagacaactcatcctctcccctctctctctcacacacacacatccatcatcccatccctgtgacgggcgatccgagggcctaccgacgatggtgtccgccgtgctccggaccatcctcgtgacgggcggcgccgggtacatcggcagccacacggtgctgcagctgctgcagcagggcttccgcgtcgtcgtcgtcgacaacctcgacaacgcctccgaggccgccctcgcccgcgtcgccgagctcgccgggcacgacggcgccaacctcgtcttccacaaggttgaccttcgcgacaggcacgcgttggtggacatcttctcgtcgcac

SEQ ID NO: 314 - DNA, 384 bp, Zea mays
  Clone ID: LIB143-065-Q1-E1-D6
tccgttactcgatctccaccatgctcaactttggcatcttcggcatgcccatggttggctctgacatctgcggtttctacccgtcgccgactgaggagctctgcaacaggtggattgagctcggggccttctaccccttctccagggaccatgccaacttcgcgtcaccgaggcaggagctgtatgtctgggactccgtggcgaagtctgctcggaacgcgctcggcatgcggtacaagctgctcccctacctgtacacgctcaactaccaggcgcacctgaccggggcccccgtggcgcggccggtgttcttctccttccccgacttcacgccgtgctacgggctgagcacgcagttcctgctcggtcccggcgtcatggtgt

SEQ ID NO: 315 - DNA, 357 bp, Zea mays
  Clone ID: LIB143-065-Q1-E1-D8
cccttttccctccccacgccgaacgcacccgatcgcaaacaaagcgagcagcagaaacatgcgagacatgccggttgtccgccgccaggaacccaccgtcgtcaggacggaggacgacgtggtttccggcggtgaggactcggacggcgagttcgagttcccctccgtgagccgggagtccgcggcgggcgttggcggcgccgcgtctgccgacgagctcttcgcgggcggccacgcccgggcgttctacccggtgtttggccgagtgctggacgaggccgcagcgccggcaccgacggcgccactagggcggctgttccagctggagcaggcgcggtactcgtccgtcgcgtccac

SEQ ID NO: 316 - DNA, 398 bp, Zea mays
  Clone ID: LIB143-065-Q1-E1-D9
gaaatcgggggcaatgactacaacggacctcttctttctggagttcccatggagaaaatccgtgccatcactccgagtgttgttgcaaaaatttcttctacaatcagcgaattgattcggctaggagccaagactcttgtggttccaggaaacctcccaattggatgcatcccagactatctgatgatattcaagagcaataaggaagaggattatgaaccacagacaggttgtcttaggtggatgaacgagttctcacagtatcacaacaaggttcttgtggagcagctcaagaagcttcgcaagcttcatcctggagcaaccatcatctatgctgattactatggagctgctatggaaattttcctttcccctgaacaatatgggatcgaatatcc

SEQ ID NO: 317 - DNA, 81 bp, Zea mays
  Clone ID: LIB143-065-Q1-E1-E1
cgcgtccagacattttggcaatgttgcagcgttgagatacaattctgttcacccccagaatgatctagactgcatgagcta

SEQ ID NO: 318 - DNA, 388 bp, Zea mays
  unsure at all n locations
  Clone ID: LIB143-065-Q1-E1-E10
cccacgcgtccgcaaccgttgtcgttgtctctgttcctccgcttcctgctctcttggcttgctgcttgccctcggagcagtgccttccgccgccgccgccgccgcctgttgtgagaaggagaggccggggctgggaggagatgagcgtgaccaagttcatcaagtgcgtcacggtgggggacggcgcggtgggcaagacctgcatgctcatctgctacaccagcaacaagttccccacggattacatccccacggtgttcgacaacttcagcgccaacgtctccgtggacggcagcatcgtcaacctgggcctctgggacactgcaggacaagaggactacagcagattgcggccactgagctacangggcgcggacgtgttcgtgct

SEQ ID NO: 319 - DNA, 384 bp, Zea mays
  Clone ID: LIB143-065-Q1-E1-E11
cccacgcgtccgcccacgcgtccgcccacgcgtccgcgcagatttttgtacccgccggctgggcctcggcctcggcgtgcaagaaactagaaagaggagcagacaaacaaaatcgattagaattaaccccaggccagaaacccactctctctctcccccgattcctttcctcgtcctcgtcctcatccgtccaggggagcaaacaagcaagcaagtaaacgggcgaggagctggatagaggccggcgacgcgaagcaaccgccgatcggagccgcggctgaggaggaggagcaagctcgagatggtgggtctcgtcggcggcagcacggcgcgggcggagcacgtcgtggccaacgccggaggagagacggagtacgtgcgccg

SEQ ID NO: 320 - DNA, 373 bp, Zea mays
  Clone ID: LIB143-065-Q1-E1-E12
acccacgcgtccgcccacgcgtccggcgtgcgctccacgcctcctccaggaaagcgagagcttctgcataagaacaacaaatcaaaagcgtgatcagctcggtgccaacaaaacctcaacaaccaagtttcatgtctgatctcgacgtccagcttccatctgcctttgatccgtttgctgaggcaaatgctgaggactctggtgctggtcctggaacgaaggattatgtgcatgtgcgcatccagcagcgcaacggcagaaagagtctgactacagtccagggtctgaagaaggagttcagctataacaagatcctcaaggatctgaagaaggaattctgctgcaatggtactgtagttcaggacccagagct

SEQ ID NO: 321 - DNA, 385 bp, Zea mays
  Clone ID: LIB143-065-Q1-E1-E2
ttcaaaaccattctccactgttcctccgctccctctgtctcgtcgtctcccatctccggctagggtttgccctttccaccgcgtccgacgcctacctcgcccgcgccactgcagggaccaaggatgtcgcaacagcaaggtgtggaggagccgccgccggcaccgctgccggcggcggaaggcgaggcacaaccggccgccgatatccccatgagcgaggccgcggcggtggaggatgaggaggaggaacccgtcgtgggggaaggggaggacggtgcagacggggccgccgacgccgtcgattccgtcaatgcttcagcgaaacccgaagcagagggcgcggaggaagggggcagcgacaggaaggagcggaatggtggcccga

SEQ ID NO: 322 - DNA, 426 bp, Zea mays
  Clone ID: LIB143-065-Q1-E1-C8
cgagagagaacccaaacggagagagacaatcgagagagatggcaaactgttttggtgacgtcgtggacaattacaagctagacacaatgccaagatatatcggcaaaaagaagactcgagaagaccgggcacgagaggcctcctatctcagtaatgagaatgagaagtacaagaaagctaaagactatgtgaacatgctgaaggactggtacggcaatggagcgtcgacgctgtgcgtgatctacaaccagacgggcggaaccctgcggtacgtcgacgacaaggactggctgggctacccggggccgacgccctacccgacggagatcggcaacgggcagtgggcgtccttcctccacgtccacaagaccggcgcctcgttcgggtccatggcccgctggtctctaccgcgggaaggacggcggc

SEQ ID NO: 323 - DNA, 425 bp, Zea mays
  Clone ID: LIB143-065-Q1-E1-B1
cgcagcagccaaaacctacctagccgccgccgcaggcggccccccatcgccgccaagatgcagatctttgtgaagactctgacggggaagaccatcactttggaggtggagtcctcggacaccattgacaatgtgaaggccaagatccaggacaaggagggcatccccccggaccagcagcggctcatcttcgccggcaagcagctcgaggacggtcgcaccctcgccgactacaacattcagaaggagtccaccctccacctggtgctccgcctccgcggtggcgccaagaagcgtaagaagaagacgtacaccaagcccaagaagatcaagcacaagcacaagaaggtgaagctctccgtgctgcagttctataaggtggacgacgccacaggcaagggtgaccgcctccgcaaggagtgccc

SEQ ID NO: 324 - DNA, 437 bp, Zea mays
  Clone ID: LIB143-065-Q1-E1-B10
ctcgcgggtcgacacacgcctctacaggcatccccaccacctcttatcaagtcctcctcgggttagggttccttagggttttgtggaggggcgatggcggcggctgatgtggagtaccgttgcttcgtcggcggacttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggcggcggcggcggcggcggcggtggctacggcggcggtcgcggcggcggccgctatggtggcgggccccgttacggcgg

SEQ ID NO: 325 - DNA, 414 bp, Zea mays
  Clone ID: LIB143-065-Q1-E1-B11
ctcgcgggtcgacacacgcctctacatcgaccctgcatatatagtctcggcggctctagaagacgatgggcaaggacgacgtgatcgagagcggcgctggcggcggcgagttcgctgccaaggactacacggaccctcccccggcgccgctgatcgacgcggctgagctggggtcctggtcgctgtaccgcgccgtgatcgccgagttcatcgccacgctgctgttcctgtacatcacggtggccaccgtgatcgggtacaagcaccagacggacgcgtcggcgtcgggtgccgacgcggcgtgcggcggcgtgggggtgctgggcatcgcctgggccttcggcggcatgatcttcgtcctcgtctactgcaccgccggcatctcggggggccacatcaaccccgccgtcacct

SEQ ID NO: 326 - DNA, 386 bp, Zea mays
  Clone ID: LIB143-065-Q1-E1-B12
tacacgcatctaaattgagtctgaatatatcgtctcagctgctctacaagacaatgggcaatgacgacgtgatcgagagcggcgctggcggcggcaagttcactgccaatgactagacggacgctctgccggcgccgctaatcgacactggtgagctgaggtcctggtctctgtacggcacattgatcacccagttgatcgcaacgctgctgttactgtaaagcaccgtggccaccgtgatgggatacactcatcagacagacccatccgcgtcgggtgccgaaacatgatccggcggcatagcggtgctgtgcataccctgggccttcaggcgaatcatgttcgtcctcgtctactgcaccgccggcatctcgacgggccacatc

SEQ ID NO: 327 - DNA, 407 bp, Zea mays
  Clone ID: LIB143-065-Q1-E1-B4
atggcctgcccactgctcacagtagtctagtccctgcccaccaagtacggatctcatctcaccagctgcctgtgcagcagtccaattcctcttgctggagcataccagaagcagaatcgggtgagaggaaatgggatcaacaagaacgtctcatccatctttcccggtcctcctgctcttcctcctcgctaccgccgccgccgccggaagcaacaaggctgaggaggtggacgacctccagtaccttattgacaactccgaagacatcccacccaacgaccctgacgggtggcctgaagggcgcgcggcggcgactacgacgacgaccttctcttccaagatcaggaccaggacctcccagactacgagccgcagatcgacgagacccacgtcgtgggcctcaacgg

SEQ ID NO: 328 - DNA, 384 bp, Zea mays
  unsure at all n locations
  Clone ID: LIB143-065-Q1-E1-B6
cccacgcgtccggctctctgttcctacgccgtttcctctcccgactctctcctcgccggcgacgccgcggagtaggtgcaacagaaactgctcgaggcggaggcggagcctgcggctgcacagacatgggtgatcacgaggcgcgcggtgatgacttcgagaagaaggcggagaagaagctctcgggctggggcctcttcggctccaagtacgaggacgccgccgacctcttcgacaaggctgcgaactccttcaagctcgccaagaactggagcagagctgcatcagtttacatcaagattgctaactgtcatttgaagggagatagcaagcatgaggctgcctcagcgtacgtcgaggcagcanattgctacaaaaagtttt

SEQ ID NO: 329 - DNA, 413 bp, Zea mays
  Clone ID: LIB143-065-Q1-E1-B8
ctcgtgcggtcgacacaagcctctagacagcgtcgctagatccacaccgatcccggcctcctccaccatgaccaccgagttcatcttctgctccgcgtacatacgccagcaaagcatatgcactccggccgtgaccgcctcgatcaccgagttccacccgcagtgcgtcacgaacgcacctgtggccctgtggttgagcacgttcacctgcggcgcccatagcttgacaactacgccgcgagctctggtcctctccaataacccggccggcaggagcgcacagaggtcgaagtcggcgcgcgggtcgaacagcctctctgggtccatgccctcggtggggagaggagccctcaccacccacaggaaccggtgcccggacctctccaggccgacggcaatctccttgagctgct

SEQ ID NO: 330 - DNA, 331 bp, Zea mays
  Clone ID: LIB143-065-Q1-E1-C1
acctcctattccgctacaagcccaattctcgcgttcctcgcatacacgcgcagcggtggatctgagaccaactaagaatacgtaggacaatcggagcattcacaagcttaacgaacttggattgtgtccaaggctacgacggtcgccgcgccaggctagtcaaccatctgctcatcactcctaactgcggatcctactgctggcgctgacgtctacgtcagtactgaactccgtctcggcctgcccggaggaagccctcatgcggccaaggctgccaagacgggcttcgacgacaccatcgacctcagtctcaacctgccgcacgccggca

SEQ ID NO: 331 - DNA, 359 bp, Zea mays
  Clone ID: LIB143-065-Q1-E1-C11
acacaagtttaggctggtgtattatctcgagcaaattgccgatgatggtgttaaatatactttgtagcgattccgctgtgaaaaaaacttaaatctgaggcatttgcagagtattgccgtacattttcatcttccctttacatagtgaccctcacaaaaaaatttcatcgtctataggtttgtgtttcattttctacagactttatacttcctacgatgttatattacattctgatagttaattgactggatcgtgtgaacaactgcaaaaaaaaaaaaaaaaaaaaaaaaaaaaaaaaaaaaaaaaaaaaaaaaaaaataaaaaaagtaaataaaaaaaaaaaatcaaggggaggccg

SEQ ID NO: 332 - DNA, 406 bp, Zea mays
  Clone ID: LIB143-065-Q1-E1-C12
gctgtggacacacagaccatgatgcagatcatccctgctgatccaggtcagcttgattcccatgagcgatctgtccctcgtgctggacaagtgtggttcccagattctgcaaccaagaccgctcaggcattattagacttcaaccgtgaaggattgcctctgttcatcctggctaattggagaggcttctctggtggacaaagagatctctttgaaggaattcttcaggctgggtcaacaattgtcgagaaccttaggacatataatcagcctgcttttgtgtacattcctatggctggagagcttcgtggaggagcttgggttgtggtcgatagcaaaataaatccagaccgcattgagtgttatgctgaaaggactgccaaaggtaatgtcctcgaacctcaag

SEQ ID NO: 333 - DNA, 330 bp, Zea mays
  Clone ID: LIB143-065-Q1-E1-C2
gttctagatcgcgagccggcgcgcaggatgactatatacagttcgaggacgaggacatcgacaagatctgatgatcgcctcttccacacggtccctttccatggtaaactaaacgtatgcaaaacaattgtatccttctgttttgtggtggctaccattactgaagaatggtagtcgtggtgatggtataatgatttgggcggagagtactgtgtataatgatttgggggcacttgttgtgcccaataaccccatatggtaatatagcaagtatgggactgaacgaaccgttcctctccctttctgttaatatgatatatttggttgggc

SEQ ID NO: 334 - DNA, 390 bp, Zea mays
  Clone ID: LIB143-065-Q1-E1-C4
cccacgcgtccgatcgtcgtctcccacaacacgctccactaaccctagcgacagcctcgggtcgtcgtttgatccccgcggggagctctagttccgccaagcgtgcgtaccggcgtccggatccgggaccgaagatgacggagtccctggtgcggaacaagccggggatggccagcatcaaggagatgccggtggtgcaggacgggccgccgccgggcggtttcgcgcccgtgcgcttcgcccgccggatccccacctcggggcccagcgccaccgccatcttcctcaccaccttcggtgctttcgcatatggcatgtaccaggtcggccaggggaacaaggtccgccgggcgctcaaagaagagaaaattgctgctcgcagtgctatac

SEQ ID NO: 335 - DNA, 359 bp, Zea mays
  Clone ID: LIB143-065-Q1-E1-C6
tggctatagatagtcatacgacgcgcaggatgactatatacagttcgaggacgaggacatcgacaagatctgatgatcgcctcttccacacggtccctttccatggtaaactaaacgtatgcataacaattgtatccttctgttttgtggtggctaccattactgaagaatggtaatcgtggtgatggtataatgatttgggcggagagtactgtgtataatgatttgggggcacttgttgtgcccaataaccccatatggtaatatagcaagtatgggactgaacgaaccgttcctctcgctttctgttaatatgatataattggttgggcaaaaacaaggtccgccgggcgctacag

SEQ ID NO: 336 - DNA, 401 bp, Zea mays
  Clone ID: LIB143-065-Q1-E1-C7
ggcttccatagcgctgaagcgaggcgtgccgcattgggttgttcgagagctcctagtgttgccctactacatgatggagggcgatctccccacgcccgcgaacgctagggttgttgccgtggtcaccggcggcaacaaggggatcgggctggaggtgtgccggcagctggcctgcagcggcgtcaccgtcgtcttgacagccagggacgacgcgaggggcgcggcggccgtggagaacctcagaggcctggggctctccgatgtcctcttccaccgactggacgttaccgacgctccgagcatcgctcgactcgctggtttcctcgagacccgtttcgggaagctagacatcctggtaaataatgccgcgattggcggggttgagtatgttcatgaccaag

SEQ ID NO: 337 - DNA, 379 bp, Zea mays
  Clone ID: LIB143-065-Q1-E1-A8
gtgccacatgaccaagagtactacctttcgattgtatctgaaaggcttggcaacaccattagtttctcagaatgtggaggtattgagatcgaggagaactgggacaaggttaagactatctttcttcccacagagaagcaaatgacacctgacgcatgtgctccattgattgccaccctgccattggaggtccgcacaaagataggtggtttcattagagctgtattttctgttttccaagacttggatttctcatttcttgagatgaacccattcaccttggtaaatggtgaaccgtatcctctggatatgagaggagaactagatgacacagctgctttcaaaaacttcaataagtggggcaatattgtgtttcccc

SEQ ID NO: 338 - DNA, 448 bp, Zea mays
  unsure at all n locations
  Clone ID: LIB143-064-Q1-E1-H3
acggacgcgtgggcgcgtcgcgtcgcgtcgcgtccagtccaatcctcggagcctcacacgggcggacgagcgggagcttctcccaatctcccctgccctgccctgccctgccgccgcgcttagcttcgcatcttcccctcctcctcctcctccttcctcggccaagcgaggagcgaggcgcgggcgcgagcgcgtcgttgagatggattcggaggcggtgcagcacggctgcgcgcattacagccgtgggtgcagcgtcgtggcgccctgctgcggccaggccttcggctgccgccattgccacaacgacgccaagaactcgctggaggtcgacccgcgcgaccggcacgagatcccccgccacgaaataaagaatgtgatctgttctctctgctccanggnacatgacgtgcancagaactgctccagctgtggggcctgcatgggc

SEQ ID NO: 339 - DNA, 451 bp, Zea mays
  Clone ID: LIB143-064-Q1-E1-H4
agagtcactgcattcatcacagttgcactgacatacttccagcttgctgctgaggaccatgagtggtggtggaggtcattcctatgcggaggatcaactggatttttcgtatacggctactgcctgtactactactatgcgcgatcggatatgtctggcttcatgcagacatctttcttctttggctacatggcctgcatctgctatgcattcttcttgatgcttgggatggtgggcttccgtgcctccttgttctttgtccgccacatatacaaatctatcaagtgtgagtgagctgttgttggaagatcaagagcagcagagctgtacccgtttttggtgccaccgagaagtcccaaatatagaaaaaaaatggtttgctctcgcgtgcaacaagagcagctagtgattgccatgtttcagattaggccattatttatagtaacagcta

SEQ ID NO: 340 - DNA, 441 bp, Zea mays
  Clone ID: LIB143-064-Q1-E1-H7
cccacgcgtccgagcgaagaagaatcgccatcacagcaagctacgcgcactgaaatcctccaatccacaggacacagctctacttccacagttcgcagactcgcacgcaccgagcggctagcgatcaacgagaaatgtcgctggtgaggcgcagcagcgtgttcgacccattctctgtggacctcttcgaccccttcgacagcatgttccgctccatcgtgccgccgtcgttgtcgtcgtcggcggcctccgagaccgccgccttcgccagcgcccgcatcgactggaaggagacgcccgaggcgcacgtgttcaaggccgacctccccggcgtgaagaaggaggaggtcaaggtggaggtggaggacggcaacgtgctgctcatcagccggcagcgcaacaaggaaaaggaggacaagggcgacaagtggcaccgcgtgg

SEQ ID NO: 341 - DNA, 461 bp, Zea mays
  Clone ID: LIB143-064-Q1-E1-H8
gggccgacacacgcgtccaggagaacggagggaaccagggagctccggccgcctagaaccggagctcccaaatagatcgatccatcggtcgttgagcggacacggcaatggaagcccacgcctcgcggggccgccgcaccctggaggagatccggcagaagagagccgccgagaggatgcagcacgccctcccgatcgcggcgtctcacgtcgactctcacgggaaccaaagagccggagctgagcttcttgctcgagttcaagaacttgaaaatgggaacacggaattgattgatgagaagggagttgagaaggatgcccttgtaaaccgtttgaatgatctcgagcggaatgtagttccctctttgcaaaaaaacttgaatgacatttctttggagaaagatgctgctgtatttgctaaagaggatgctctagctcaactcaggagcatgaagaaacgg

SEQ ID NO: 342 - DNA, 425 bp, Zea mays
  unsure at all n locations
  Clone ID: LIB143-064-Q1-E1-H9
cttcactcactcgtcagctccctgtcgcgcaaacaacggacgcaagaggcaaaaccaagaacaccggccccccccggattcggagcaggcaacggcgccacggtccgtccgtcccaaagggcgcggcaacaacaacggtaccccggcgtgccgcagcgccaactggggctcctgggtctcggagatccgccaccccctccctgaagacgaggatctggctgggcaccttcgagacggccgangacgcngcgcgcgcctacgacgaagcggcgcgcatcatgtgcggctcccgcgtgcgcacaaacttccccgaggacgcaggcngcggcggcggcggcgacgggcagcagcagcagcaggccgcgccgtcgctcctctcncccgcgctcgtcgccaagcttcaccgctccaacctcgcgttcgct

SEQ ID NO: 343 - DNA, 392 bp, Zea mays
  Clone ID: LIB143-065-Q1-E1-A1
gcataaaacagaaggcccggctgcggctgcggctgcggctgcctttggtttcgtcgtcgtctccgcctgttttcccctctttccatggcaggctgatgctcttcaacacacacagtccactgtcgctcctcagttataagtagctagggcatctggctgctggaaaatcaagcacgcatccaccacacacacagctagctagcagatcgtttcgagtgaagatccaaagaggtagagagatggaaaggatgagttcgtcgctgcagtactgggtggaggagcacaagctctcaaccatcggagccgtgtgggcgacggcggtgggcgcgtcggtggcgtacagccggcggcgggcgccggcgcgggcgacgggcatgcgcctcatccacgcc

SEQ ID NO: 344 - DNA, 389 bp, Zea mays
  Clone ID: LIB143-065-Q1-E1-A10
gcaaagcagcggctcgcagtccgggtctcggcagggcccgctccagttctccagggcaggtatggccgtcggtggcggcgacgacagcagcagcagcgacgacgacgaagacgacgacaagtcggaggatggctacagcctgaaatgcgtgtgaggctgaggcaggctgcgtttgcggaagatcggatgagagtgtagagagatagcgttgtcgcggcttgagcatgcatcggtggattcttgagtctgtccgagagagtggttgtagtgcaggcaggcatgtatacagggagattaggcgcgcgcggcccgtgtgcgcccaagagatgaactgatcatgcggcgtttggaaagctgataggcgttttgtttgagtctttgctgacttc

SEQ ID NO: 345 - DNA, 411 bp, Zea mays
  unsure at all n locations
  Clone ID: LIB143-065-Q1-E1-A3
gcacgatttcaccacagagtgcacgagagtgaaggactgcctgcttcgagaaatggcgaaggcgctagatgagctcggcgacgacgacgactacttcatcgaccagttcggcgacagggccgacacccatgccaggttcagctactaccctccgtgcgcgcggccggacctcgtcttcggcctgaggcctcactccgacggcacgttcctctcgcttctcatgctagacgacagcgtcggcgggcttcaggttttccgggacggagtctggtacgacgtgcgcaccagacctcacaccctgctcgtcaatctaggagaccaaatagagataataagcaatgggatcttcaagagcccagtacatcgggttgtaacaaacgcggagaaagagaggctatcantgggtccggt

SEQ ID NO: 346 - DNA, 431 bp, Zea mays
  unsure at all n locations
  Clone ID: LIB143-065-Q1-E1-A4
gaccgaagcatcaatcagcgagcgaaccggccagaaaagcacaaagtagtcctccatttcgaatcgcgctcatagtcacagggctttagcagagatggcgggcaagggcggcaacaagggagagggcccggcgatcggcatcgacctcggcacgacctactcctgcgtcggggtctggcagcatgaccgggtggagattatcgccaacgaccagggcaaccgcaccacgccgtcgtacgtggcgttcaccgacaccgagaggctcatcggcgacgccgccaagaaccaggtcgccatgaatcccaccaacaccgtcttcgatgccaagcgactcatcggccggcgcttctcggacccgtccgtgcangcggacatgaagatgtggcattcaaggtccttccaaggccccgccgacaagccaatgatcgtgg

SEQ ID NO: 347 - DNA, 381 bp, Zea mays
  Clone ID: LIB143-065-Q1-E1-A6
tgaaaacctaaggcgatctgttctgtccacctcatggatcagcgcacaggcacgcaacgttcacaggggttcggtttcgtgggtgagcggatcgagatggcggcgtcggatgttgagtaccgctgcttcgtcagcggcctcgcctgtgccacggacgaccactccctccacaacgccttcagcacctacggcgaggtcctcgagtccaagatcatcctcgatcgggagacgcagaggtcccgcggcttcggcttcgtcaccttctccacggatgaggcgatgcagaacgccatcgaaggcatgaacggcaaggagctggacggccgcaacatcaccgtcaacgacgcccagtcacgcggcggccgtggacgccgcagcggc

SEQ ID NO: 348 - DNA, 444 bp, Zea mays
  unsure at all n locations
  Clone ID: LIB143-064-Q1-E1-H12
gcgcgggacaacacaccagtctaaactgaatcatatcaggggaccaacctggccaccaagggcatgggcccaacctcttcgaccggccgcagcccaactcccccaccgtctacgactggctctacagcgacgagaccaggagcaaccaccgctagatcgggcgagatggatggacagtgaagaggccatgtttgctggtccttgtggttatctaaaacgcacgcatgctctattatagctagtcatcactatatatatacttgtgtttgtgtattgttgttcttgttctgctggtgtctccgccgtttaatttgacctatgttatggagtgagtgatatatgtgccgtcactcctagtatatagtagtgagtgactagttggtatgtgtagtactgtactatcttttctccatatgcatngtttgccagcgcgtaatgaatgta

SEQ ID NO: 349 - DNA, 374 bp, Zea mays
  Clone ID: LIB143-064-Q1-E1-F8
aggagattcttagcaagatgaaccgtggaataactgtgaaactaaaccgtggaagatgaattctcaatcaggtctaaataggcaaccgacagcctagcctggacactgcttggttctagcgggctatagtagggcaggctaaaatatctaaactgaacctgactacaaccattacacgccttctactgctacagctatctggatgaaggaatacgataataggagataatagaacagggtatggaattatgttgtatcattcatatccttttatggtatacgccttcgctctttaaaaaaacttcaaaaggaaaggcacgtataaaaaaaaaaaaaaatacgttgtgtcccgaaatctcagtggtgctttcttt

SEQ ID NO: 350 - DNA, 193 bp, Zea mays
  Clone ID: LIB143-064-Q1-E1-G1
ctcgggtttaaggcaacagtagccaacttgcccttcgcagccaccatgatcacaccgacataaccgttacgaattcgaatggttgctagatcagctaaataccacatgtttgtggacttcagttacatgtaatattttttttgtgattccacagatgagaactcttcaaagtttaaaccgtcgatttagcctt

SEQ ID NO: 351 - DNA, 394 bp, Zea mays
  Clone ID: LIB143-064-Q1-E1-G10
tacactaatctccattaggatctcgcattcagcgcagcgcaggtgtgaaggaagggggacccggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaggacaagatcagacctctttggaggcattacttccagaacacccagggtcttatttttgttgtggacagcaatgaccgtgaccgtgttgttgaagccagagatgagctccac

SEQ ID NO: 352 - DNA, 294 bp, Zea mays
  unsure at all n locations
  Clone ID: LIB143-064-Q1-E1-G11
gcaagagaatttcccttccaccacagtgctatgcggagaagcagctcctcggaaaggcgagccaagagttcctggacatgagaatcaatccagcaatctgggagctcagtggccatctggtactgaagcggaggaaggactacgaggaggcctctgaagcanacatatgcaggtttttggttgaagcagctctttctgaaacagaatttcaggagctgaacctatgcgtgctcgacttcctgaacagctctcttggttgaaactcggatgtaggttcctatagatagtaacagt

SEQ ID NO: 353 - DNA, 412 bp, Zea mays
  Clone ID: LIB143-064-Q1-E1-G12
gtcgacacaagcctctaggctgatgctcatcaccaaccccgcgcgcgggggagcgataaaccctagtcttcgccgtcgtcgcaggaggacccgcgatgtcgcacttcgggaggtcaggcccgccggacatccgcgacaccttctcgctcctcgtcctcaacatcagcttccgtgagggagatctaaccctagccccaccctctctcactctctccctaatcgcttccttctcgtgtccgtctccccccgcttcacaggcaccacggccgacgacctcttcccgctcttcgagcgctacggcaaggtcgtcgacgtcttcatcccgagggacaggaggaccggggactcgaggggtttcgcgttcgtgcggtacaagtacgccgacgaggcgcagaaggctatagatcggctc

SEQ ID NO: 354 - DNA, 229 bp, Zea mays
  Clone ID: LIB143-064-Q1-E1-G2
gatacacgcctctagtctgattcggaatagttccagattaaaagcaaatcacaagcaacataatgacaacgactttaatcgtggcgaattccactggatggggaatcatctgtataggagctatgtgtgggtgtcactaacgtgacatcccttctttgtgattccataacccatatgtcgtccacttggtcttcggtctacatagcacttggacgggaaaaccctcgcc

SEQ ID NO: 355 - DNA, 385 bp, Zea mays
  Clone ID: LIB143-064-Q1-E1-G3
gacagggcgtactccgacggcacggggaaccccgacaccggcgccgacttcggcggcgcgccggacatcgaccacctgaacccgcgcgtccagcaggagctcaccggctggctcaactggctcaagacggacgtcggcttcgacgcgtggcgcctcgacttcgccaagggctactccgccgacgtcgccaaggtctacatcgacggcacccagccctgcttcgccgtcgccgagatatggacctcgctggcctacggcggcgacggcaagcccttctacgaccagaacgcgcaccggcaggagctggtgagctggctggaccgcgtcggcggcaaggccagcccggccaccacgttcgacttcaccaccaagggcatcctcaacg

SEQ ID NO: 356 - DNA, 442 bp, Zea mays
  unsure at all n locations
  Clone ID: LIB143-064-Q1-E1-G4
gtttataacaacacttctagtcactttagtaatggttatgatatggaagacaagcctgctgtggattgcactctttctagtaataattggtggagcagagctcgtatacttatcttccgcattctacaagttcactcaaggtggctacttgccattagcttttgcaggaattttgatgtttataatggccacatggcattatgtccatgttcatcgatacaactatgagctccagaacaaagtatcaagtaactatgtggcagaattgtccgcaaggagaaatctggccaggttgccaggaataggctttttgtactctgagcttgtacaaggcatcccacccatacttcctcacttgatagaaagggtaccttccatccattcagttctcgtgattatctcaataaagtacttaacgatcagcanaatagaaacaagcgag

SEQ ID NO: 357 - DNA, 415 bp, Zea mays
  Clone ID: LIB143-064-Q1-E1-G5
ctctttctgttcttctcctgctctgttctttgcttctttcttccccaccgaacagctcaaaccggtgagctagccgctgcctgagcgcgcagccggctcacatatccgaggatgaccggattaatgttcaggggcatgcgggttttaccgccggtgtgcgcgtcccctcagtagggcgcgccgccgtcggtcaaacgccgacagctgtccctgttgacagcagagaaaaggggtcgacctcttggtcgacttctgtgactgtgcacgcccagatcttatctcccttacctctttgactcgatctcgttctctgtgatgtatgagatggatctaatgtaatattcgggatcgagttatgagttgatagaacgtagattttctgtgaggatttttttgtaccttttctaatctgctc

SEQ ID NO: 358 - DNA, 413 bp, Zea mays
  Clone ID: LIB143-064-Q1-E1-G6
aacatgataacgagatttcccccagcaatgaggcaatccaaggtgatgagttggctcatggcgaagagctgttccaaggtgatgatcttgttcaaggaaatgagttggttgtttctgaggtaacaacacctcctactactggaatcagacgtaggaggaagaagaagtccttggtatgggagcacttcactattgaagccgtcgcgggcggggccacaagggcctgctgcaatctctgcaagcaaacctttgcttacagctctggctcaaagattgctgggactagtcatctcaagaggcacatcaccttgggctcttgtcccaagataaaggaccaagatcagaggctggcactgccttcaactggtgggactgacaactatggcgaggcaacttcggagcggccaaccaag

SEQ ID NO: 359 - DNA, 361 bp, Zea mays
  Clone ID: LIB143-064-Q1-E1-G9
aggccaagatcaagtaagacccggtgcaacgagccaccgtttaattcctaaggttcttggagtgttttttttttctctctcgtcgtcgagtcaaaaaaagaaaaaagaaaagaaatggtcaaaacgcgcggacagtgagtttggacgtctgtgtatttcggtgacctgtgtttttttttttctctggagggcttttggtccgcatgtaatttagccgggtttgtgacttgtgactttgtgagtgagtagcggagtttagaagcggtagaagaatatgggtctagggataggtgaagtcagaatcaggacaaggtttttcgtttgttttcatccttcttttttcagttttttaagatgatgc

SEQ ID NO: 360 - DNA, 354 bp, Zea mays
  unsure at all n locations
  Clone ID: LIB143-064-Q1-E1-H1
caatacgaaacgaattaatccccaatcaacacagcaagtcagcaacaagcaaagcagcgatccgagagatggacgcgaggatgttcgggctggagaaccccctggtggcggcgctgcatcacctgctggacgtgcccgatggcgacgccggagcgggcggcgacaaggcgggcggcggcgccacgcgcacctacgtccgcgacgcgcgcgccatggcggccaccccggccgacgtcaaggagctcgcgggagcgtacgcgttcgtggtggacatgccggggctgagcacgggcgacatcanggtgcangtggaggacgagcgggttcttgtgatcagcggcgagcggcgccggg

SEQ ID NO: 361 - DNA, 429 bp, Zea mays
  unsure at all n locations
  Clone ID: LIB143-064-Q1-E1-H11
tacctcactctctctcaccctctctcgacgacacaccaggccaccacgcacatgctttgtcncatggatgccgaccacctcatggtgttcaagaccatgctcgccgtcaggtggtagtcccggcgagcgagatctccccactccaggctctctcccatcgctcgctgccgcctcatgttgtttgcggccgtgctcgccaaccgcggcacggaggcgtcgatccgaccgggagcccttcgcaatggacaaagccttcctcctctccggcaatgagggcatcgtcggctcgtcgctaacgtgagcacgtggcagaccctgctgcncccatccttcttcatcttcactaagtgaggaactctctcgaacccctttcccacccttcttgtcttcggagtccggatggctggagaacacggtgtttggtcatgg

SEQ ID NO: 362 - DNA, 389 bp, Zea mays
  unsure at all n locations
  Clone ID: LIB143-064-Q1-E1-F5
agaagagctggggcgatcctagtgttcctgctcgtcgtcctggtctgggatgtggcggcggtcgccgagaccgagcctggcagcgtgcggctagtacaggaggcgccacataggaaggtggtggaggatggggccaaggcggggagggtgccggtgtcgaccgtcgcgtggtccacgcttgccatggccgcggcgacggggttgggagcggtgcccttctttttcatggagctcgaagcgcagtgggctggcctttgcaatgggctggcggccggggtgatgctggccgccagctttgaccttgtgcangaagggcangtgtatggcagtgggagctgggttgtgttcggaattctgagtggaggtatatttatttggctttgtaagaa

SEQ ID NO: 363 - DNA, 383 bp, Zea mays
  Clone ID: LIB143-064-Q1-E1-D9
gagccggagcctggggatcccggtgaagttgctccatgaggcagcgggtcacgtggtgacggtggagctcaagaccggcgaagtgtatcgggggtcattggtcgagtgcgacgataactggaattgccagctcgagaacataaccttcactgccaaggatgggaaggtttcgcagctggagcacgtcttcatcagaggaagcagagtgagatttatgattatacctgatatgctcaagaacgctcccatgttcaagcgcttggaagcgacgattacgggcaaaggatcagctattggagttggtcgtggacgtgctgttgcaatgcgtgctcaggctgctgctggtcgtggtggtggtcctgttggacgatgtagcgcgcctc

SEQ ID NO: 364 - DNA, 373 bp, Zea mays
  Clone ID: LIB143-064-Q1-E1-E1
ctcgcgagtcgacacacgcctctacacctactgatgccagggccagtacaaggacaagtgcccgcccacggactactccaggttcttcaagaggctgtgcccggacgcctacagctacgccaaggacgaccagaccagcaccttcacctgcccacagggctccaactacgatgtcgtgctctgcccgtgagccacatgttcgagagatcaacgaccatgcattcgcagctcgcaacaagtgcacactagtacaactatacacaagaaataagagtcgcgatatttattattatcgcgcgtggagtagttggtaaataaatcgcttattgcgagtattttggcccatgaataaggccttacttactggccatca

SEQ ID NO: 365 - DNA, 416 bp, Zea mays
  unsure at all n locations
  Clone ID: LIB143-064-Q1-E1-E11
acaatgactaccctcactaccctgcaggccggcactgcactgcactgcagtctacagaactcgtcagtcacagatcggtgcaggcggtctgcacctgcatcacctaaccaattcctcgattagtctgctgttgcgatttgcgaagcangtcagctgcaatctttttgcagcagccactaaacctgtaccaagtcttcttgcctgagggcagaggcaggctccgtcagtcacgccggcggcgtacagatcatggaggactttggcggctggaatatgcagtatgcagcagagctatgcctgccaagccgccgggacgacgacgacgacggcctcctcggtgatttcctaagcggcggcggtttggacatccgttctgaccatggcggcctcaacctgccctcgtcgcaccctgctgt

SEQ ID NO: 366 - DNA, 409 bp, Zea mays
  Clone ID: LIB143-064-Q1-E1-E12
gacgatccaacactctagactcagtcctagtataaggacggacctaaccttcaaccaacttaaattgtacccgccataattcctttcggggcggtaataacccaaaaaaccctcaattacatgtccaattacaagggacttaaaatcacgcaggtgaactgcgcacggaaggcgataaggctgatccacgcggaagacaagaacctcaaggccgaggactcagcgtgggagctgaagaagaagttcggcaacggcgtgagcaccatggtcctcgtctacaacgccaccggggccagcctgagcctggtggacgacgggaaagactggatgggctccgtctacagctcgccgattccggacaccttccacaacgggcagtggatcgccttcctccacgtcaagcccggct

SEQ ID NO: 367 - DNA, 469 bp, Zea mays
  unsure at all n locations
  Clone ID: LIB143-064-Q1-E1-E2
tcacgggtcgatacacgcctctagaataactctatatagcaatagtgctgaatccactctcagcaatcatgtatggtactagagcatctgtgtttataaaaatgaagaaaccagctgctgccattcgtgatgccaatgctgctctagagatcaacccagactctgcaaaaggctataaaactcgtggaatggcatatgccatgcttggcaaatgggaggaagctgctcatgatctgcacacagcatctaacatggattacgacgaggagatcaatgctgtgctcaagaaggtggagcctaatgctcacaagatagtggaacatcgcaggaagtatgagaggttgagaaaagagagggaggaaaagagagcgcagcgtgatcggcttcgtcaacgtgcagaggcgcaggctgcttacgacaanggcaaanaggaaagagcaatcgtcaagtcgctcatcaggaggtgcat

SEQ ID NO: 368 - DNA, 451 bp, Zea mays
  unsure at all n locations
  Clone ID: LIB143-064-Q1-E1-E3
cccacgcgtccgcggatcgctaggcaagcttgcgtcgcgcgccctctccgtcgccgggagatggcagcaccagcagcttcgccgcctcaacatccacgagtaccagggtgcggagttgatggggaagtacggtatcaacgtacccaggggtgcggcggcggggtccgtacaggaggtcaatgacgccttgaagaacatgttccccagtgagaaagagatagttgttaaaagtcaaatccttgctggtggccgagggctgggaactttcaaaagtgggctgcaaggaggtgtccatattgttaaggctgaggaagctgaaagcattgcacgtaaaatgttaggccagattctggtaacgaaacaaactggtccgganggaaagattgtgagcaaggtctacntgtgtgagaaactgtctcctactaatgagatgtattttgccatcaccctt

SEQ ID NO: 369 - DNA, 225 bp, Zea mays
  Clone ID: LIB143-064-Q1-E1-E4
agtgggacgctatgctatgctatgccatgctatgtacagggagggagaagcagagggtgtgaaggtgagggggaggtgatttgtttattggcggagtgtctcggtgaccagagtgagtcatgtatcatcaggtgggctttggttgaagtgtttgctcgccgagcctgaaactgaaacccttcttcactgtgatttcaccaaatctcagacctgggagctttgttg

SEQ ID NO: 370 - DNA, 440 bp, Zea mays
  Clone ID: LIB143-064-Q1-E1-E5
aggccactgcagatactggggtacggctgggctgggttgctgaggaggtacctggtcgaccctgccgagatgtggtggccttctaaccttgcccaggtctcactcttcagggcgctgcacgagaaagaagaggagggcggcaagtcccgtggcccgtcgcggatgcgcttcttcctcatcgtcttcttcgcgagcttcgcgtactacgcgctgccggggtacctgctgccgatcctgaccttcttctcgtgggcgtgctgggcgtggccgcacagcatcacggcgcagcaggtcgggtccgggtaccacggcctcggcgtcggcgcattcacgctcgactgggcgggcatctcggcgtaccacggcagcccgctggtggcgccgtgggcgtccatcgccaacacgggcgtgggaatcgtcatgttcatctacgtcatcgt

SEQ ID NO: 371 - DNA, 313 bp, Zea mays
  Clone ID: LIB143-064-Q1-E1-E6
acccacgcgtccgactatgtatgagatctcatctcctttctcctactgaatgaatgaatcattattggctttgctttgcttcaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaacaacaaaaaaaaaagagtattacacttaactggggtacgttttacagattctgaacttcaaaaattctgcctaaaaagaattaaagacacattattataaaagcaccatttcggaaaaaggtata

SEQ ID NO: 372 - DNA, 401 bp, Zea mays
  unsure at all n locations
  Clone ID: LIB143-064-Q1-E1-E7
cagccaattcgctcgagttcagatcgagcgcgcgccaagcaagtcttccggccggccgcgaagagcgcaatcaagcaagacaagatggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgnaaccggccgtgacgttcgggctggccgtgggcggccacatcaccatcctgacgggcgtcttctactgggt

SEQ ID NO: 373 - DNA, 450 bp, Zea mays
  unsure at all n locations
  Clone ID: LIB143-064-Q1-E1-F1
gccacgcctgctgcagcacctcgctctccgctccgttggccccatggagtccgtcgcgtccgccgcgatcgccaccacctcccgctctctcccgctccccttctcttctaccccggtccaccgccggcgccgtgccgccttcctccccgttgccgcctccaagcgtcacgacgacgacaaggaggccgcgaaagggtccggctcggaaccacggcgcgagcctaccagcctcgcgccgtacggactctccatctcgccactctccaaggacgcggccatggggctggtggtgagcgctgccacggngagcggctggacgacgggatcggggatggagagcccgccgacggcgagcanagccggtggggctggcaggccggaggtgtcgacgctgccttggtccctcttcacgannatcacgcggcggcgcatgcgggtggcctttcactg

SEQ ID NO: 374 - DNA, 419 bp, Zea mays
  Clone ID: LIB143-064-Q1-E1-F12
gggtcggcccacgcgtctaaatcactcctcgtcaaaaagacccaaaccttcggtgacctcggtccggcggccgcctcgggtcaacatctctctaccccgcggccccgccgtcaaccgataccgcagcgctgggaaggatcacgggggaccggagcgaggcggggggcccgcggttttgtcgcccggatggcggcgcagcgatgacactggcggcgggagcggcgcggcgttgggatgcggacgatctgcgatgtgtgcgagagcgcaccggcggtgctcttctgtgcggccgacgaggctgcgctttgccggccttgcgacgagaaggtacacatgtgcaacaagcttgctagtcggcatgtgagagttgggcttgcagaccctaataaactggcacgttgtgatatatgcgagaattc

SEQ ID NO: 375 - DNA, 382 bp, Zea mays
  Clone ID: LIB143-064-Q1-E1-F2
ctatccccgcgtggacgcgtgtagtcctagtctctcgccagcaccatcatcatcaatcacggcggcgatcccgccccgcctcgatcgcccacgctgcccgactggaaccggacgctgctgctgctgctgctatgctgacagcgacgacgatggggccatggctcatatcttgctccacggcacgctccacgccagcatcttcgaggccgaatcgctctccaatccgcaccgcgccacctgcggcgcccccaagttcatccgcaagccggactactgttctagcatgctcaagagaacgctcctgcactgcactagttccctttgatcactctaccctaagctcgtctccaacttgtggaacggattgacgataccgtgggta

SEQ ID NO: 376 - DNA, 441 bp, Zea mays
  unsure at all n locations
  Clone ID: LIB143-064-Q1-E1-F4
agtccatcaccttcaatggcggcggcggcggctgctgccacctccttcaccaccctcgccgtcgcgcgttcggcggggcagcggtcccttcttgcctccaaggccgcaccttcgccgctcctctccctccgtggcgcccgcatcccctcgcaggccgtctccttctccgggggccttgcggcgtcgccctctcacagccgcgcgcgcttcgctacatccgccagcgccgagcccaaggaagcagatcttcagtctaaaatcaccaataaggtgtattttgacataagcattgggaaccctgtggggaagaatgttgggaggattgtcatcggcttgtatggggatgatgttccacaaacagcagagaactttcgtgctctttgcactggagagaaagggtttggatacaagggatccagtnttcaccgtgtcatcagcgac

SEQ ID NO: 377 - DNA, 399 bp, Zea mays
  Clone ID: LIB143-064-Q1-E1-D8
gccgcggagggatgggcggcaggagggaggccatagagcgggagctgaagaagcttcgggcagagcgggaggagctcgacggccggatacggctgctggaatcgcagctcgaggcagggcctgcgggattcaacggtgcggcggcggggaaaggagtaggggacgatgcgtgcggcgggagtggagcgtgccagagccgcgtgggtaacgagtttgctccggacggtagcctcccggcggatatgatctaccggtacagccgccacctccttctcccggacttcggggtcgaaggccagcggaagctgtcacagtcgtcgattttagttgttggggctggaggtttgggctctcccctggcattgtatctagcagcttgtggtgtcggtcgcttgggca

SEQ ID NO: 378 - DNA, 387 bp, Zea mays
  Clone ID: LIB143-064-Q1-E1-B9
aaacagacgttctggcattccgtcctgcccccgcctccagctcgccgcgaccacacctcctctcctctcctccggctcctcctcgtcgcatggcgacagcctctcgtccctagcccgccagatccagcggcgcgcacctacacacgcgcaaggaaccgtagacgcgcccccgcgccacccgtctctcccgtcctccgccacccatggacgcggggaatggctgcagcgcgcgggcgctggcggcgtgcgtcgtcggcggcatcgtgctgggcgcgtcggtgctcgcgctccacctcgcgggcgggcccgacgccatcccgctcctgcgcctgccgccgcccatcggcgcgcttctccgtcgccgccgccgccgccgcaccgtgcgcg

SEQ ID NO: 379 - DNA, 217 bp, Zea mays
  Clone ID: LIB143-064-Q1-E1-C1
tgagtcgtattatgtcgagtggcgtcgttgtgtgaggattgatctgttcttggtactttgtctatggttgaatcggaacccattttccgtttgcctagattcgtagggttctggtggggtatccagctgaaacgagtacatctatgatcttgtggctgcagcatgttcgtggcacttttatctggtctccgttgggtcggttcacaggttgagtgcg

SEQ ID NO: 380 - DNA, 394 bp, Zea mays
  Clone ID: LIB143-064-Q1-E1-C11
gtcacttagcttcactcggtacggttctgcttctacatctatatatcgttagtttggtatgtactaacggctcgatctgcacaaggcaaagaaaagaggcaacgacgatggctgctgcggcggcgatgatggtctccggaggacgggcggcgctggtggtggcaggcgtgctctgcgcagtggcggccatggcggcggcgcagcaagcgtcgaacgtgcgggcgacgtaccacctgtacaacccggcgcagaacgggtgggacctgaaccgcgtgagcgcgtactgcgccacgtgggacgccgacaagccgctgtcgtggcggcagaagcacggctggacggccttctgcgggcccgccgggcagaagggccaagccgcctgcggcaagtgcat

SEQ ID NO: 381 - DNA, 401 bp, Zea mays
  Clone ID: LIB143-064-Q1-E1-C2
atgacataatggcagaggtctacaaaaatggtcctgtagaagttgctttcacagtttacgaggatttcgcacactacaaatctggagtgtacaagcacatcaccggtggcattatgggtggccatgccgtcaagttgattggatggggaaccagtgatgctggagaggattactggcttctggcaaatcagtggaatagaggctggggcgatgatggatacttcaagatcataaggggcaaaaatgaatgtggcatcgaggagggcgttgttgctggaatgccatcgacaaagaatatggttccaaacttcggcggtgccgttggaagagctatagtttaattggttacgtttgcatggcctcaaatgctgttggaattaactaaagtaattttaaaatgc

SEQ ID NO: 382 - DNA, 121 bp, Zea mays
  Clone ID: LIB143-064-Q1-E1-C4
atgatttctttgaacatcagtcacttctcttttcaccttgtgttcaacatgaagggttcgtcttccatgtagatgaatgcaagcccttcatgtggcatacccggtggaaagataagtgact

SEQ ID NO: 383 - DNA, 211 bp, Zea mays
  Clone ID: LIB143-064-Q1-E1-C5
acagattgtctagtgtcttctttgtaataaatttatctgttcttggtactttgtctatggttgaatcggaacccattttccgtttgcctagattcttaatttctggtgctgtatccagctgaaactagtagatctatgatcttgtggctgcagcatgttcttgtcacttttatctggtctccgttggttcggttcacaggttgtgtgcttt

SEQ ID NO: 384 - DNA, 383 bp, Zea mays
  Clone ID: LIB143-064-Q1-E1-C7
ccacgcgtccgatcaagtcccacggcggcatcaccaccgagtccgcgtacccgtaccacgcctccaacggcacctgcgacggcgcgcgggcccggcgcgggcgggtcgtggcgatcgacggccaccaggctgtgccggccggcagcgaggacgcgctggccaaggcggtggcgcaccaaccggtgtccgtggccatcgacgcggggggccaggcgctgcagttctactcggagggcgtgttcacgggcgactgcggcacggacctggaccacggcgtggcggcggtcggctacggcgtcagcgacgacggcacgccctactggatcgtcaagaactcgtggggcccttcctggggagagggcggctacatccggatgcagcgc

SEQ ID NO: 385 - DNA, 387 bp, Zea mays
  Clone ID: LIB143-064-Q1-E1-C9
gtatgacgggccaactctctaaactaagtcgtagtacttcatggagcatggagcacttgtaccgcatgggaaagcgatctggggatgaggctcatctcatgactacctcctgcaatagcctctctgcaatggtccatctcatagttaaggcgcagcctcgagggcctccggcgttctgcaaagcactctgcacgcgcttacgctttagctgctcattgtcgtgcttcactgagaatgtctgatgaggatgcacccggggagtgtcatacattagcagtcttcttgacacagctgcagagaggcttgcatatgttttcagacggtactgtactgaagggacatgtgacagcagaactaaactacgtcactgacggcggaactgcccaa

SEQ ID NO: 386 - DNA, 450 bp, Zea mays
  Clone ID: LIB143-064-Q1-E1-D1
aagcggccttgcccacgtttcaaaccatcttgaagaaggagatcgagaggcattcctacggcaccgtctttttttcccgattctcctgttcttgtttgtgagtgaaagcgggatccgacatccgaggagaggtcgaggccgggcaaagtcgaagtccgcgctccggtctccagctgacgaagcaggatgcactgtgacgcgctggtccatcgtgagcttctgatgccaattaggactaaacatgcttcctcgctgcgctcaagtgggagaacaagaaatcagcctagacactagtcatctgctgcaagcagaaaatgcacccttattcacttaagagttccaagggagcaccaattctgccacggccagtcttcgttttcttcatcgcgacatttgggttccaaggtatgctaactctccttcattcagataacgctagagaacaacaga

SEQ ID NO: 387 - DNA, 402 bp, Zea mays
  Clone ID: LIB143-064-Q1-E1-D11
aacacatcggaggtgtaagagttggtgaacaccacgattcggaaaagttccagtttggaaggccaagaagatttaagcacatggatatgattatcacgagtacatcaagcgctcatttgaggaaaacatcgctgcgcaagtgcctcaaagagtggaatggggtacaactaatgattgggggaaatcaggcagacgagggcatgttgacagaccaagtggcgaggcaaaattttctaatgactttgaagttcattatattggcagtaactgatgatcccttctgtgatggaccgagtaaaccaagcaattcgggatattcaactccactttgatgactgccataattactgaaatcaatgaaaagattggtgctgctggtgtaatcagccaggagtgcaagac

SEQ ID NO: 388 - DNA, 136 bp, Zea mays
  Clone ID: LIB143-064-Q1-E1-D2
gacccacgcctccacggcctaataatcttgctaaggccctgattgaatggaaaatatttttttgggagttttaggaaaatactacaattttgtgaaataccttggttttggagtaacatgaagatgatgtttggtt

SEQ ID NO: 389 - DNA, 383 bp, Zea mays
  Clone ID: LIB143-064-Q1-E1-D3
agcgccgttggttctccggcggcagcggcgccaccgtcttaaggccccccgccaaatcgaggcggaacatggcgtccgccaagtggagcgagacggccatgctcgttatcgacatgcagaaggacttcgtggacccggcgatgcgcagcccgatgctggtggccggtggcgaggccgtcgtccctgccgttgccggggccgtcgccgtcgcaagggagcgcggcattttcgtcatctgggttgtcagagagcatgacccttctggaagagatgttgaacttttccgtaggcaccattattctgggggaaagggtccaacagtgaaaggtctgaaaggagcggagctggctgatgggcttgttatcaaagaaggggaatacaag

SEQ ID NO: 390 - DNA, 332 bp, Zea mays
  Clone ID: LIB143-064-Q1-E1-D4
accccccaagtccagatcatttattgcagacatcagaaaccacacctttgtcatagaaaggactatggtacgatgtttaagattccagtgacgtcaagtaaatgcagcatcgatgcactcaagcttctaagactaccgccatggcatacatggtacaatgatgacggtgaggtcagtggatggacccacaggtagacgggactcaattttgtgagtgtgacgggagcatgtcacaaagtccacgttaacgacgagacaggttcgcatgctagatgaatcgtgcgcgactgggagctcaatgcctgtgcaatccagctgacacagcaacgtgt

SEQ ID NO: 391 - DNA, 441 bp, Zea mays
  Clone ID: LIB143-064-Q1-E1-D6
gtgactgtgatctatactataaggtgaacaagatctctttgtctactgtagttgcagcaccagcagcagcagcagaagagcagcgcctgagctccagcaataatggccgagaagggcgtgaaggtgttggggatgtgggcgagccccatggtgatcagggtggagtgggcgctgcggctgaagggcgtcgagtacgagtacgtcgacgaggacctcgccaacaagagcgccgacctgctccgccacaacccggtgaccaagaaggtgcccgtgctcgtccacgacggcaagccggtcgcggagtccaccatcatcgtggagtacatcgacgaggtctggaagggcggctaccccatcatgccgggcgacccctacgagcgcgcccaggcgaggttctggggcaggttcgcggaagacaagtgcaacgctgctctgtacccg

SEQ ID NO: 392 - DNA, 383 bp, Zea mays
  Clone ID: LIB143-064-Q1-E1-D7
cctctctcgtttagtttgcctccgcattcaagtgaacaaagacaacaaagaattcaaggaccttcccccagaaagggcctttgctgatttcgtcctatgcaatctggtgctccacctggtgatcatgaatttcctcggataagcaactgctgcaccatgttggttaaaggttttgtagccccaggttgtggtcgctgattgttgcctttaaatgtttggaactgttgtgatcgtgatgtcgaatatccatatgatctgttgaaggattacttgtgtaagctgagtattcccggagggaactattagtcgaatggacagtttgcccagcgctgagaatgtgacctagcatgttctttatttgaagaagatataattcatttttc

SEQ ID NO: 393 - DNA, 422 bp, Zea mays
  unsure at all n locations
  Clone ID: LIB143-064-Q1-E1-A12
tacaacactctatactgactcctagtacctccgagcccaagagcaaccccgcgccaagaagaaatttggtcctttaacaataagttcaaggaaggaaatgtttaaaatggcaaatttgctgaacaaggctaaaaggtataaggaaatggttaattaaatgaaaaaggtggtaaaaacggtaaatgtggaagagctcaatgtttaaggagcgtaaaccttctgtctgtttgcatacaaagaatgtgattgggggctcgccgcgcttcatggcgcattgtttcatccaatgaacaaaaggangagtcccgtaagaacgaagagcatgtgaatcttatcaaggaatatcgtggcaagatcgaggctgaactgagcaatatctgtgatggcatcttgaagctgcttgactcccacctagtgccttc

SEQ ID NO: 394 - DNA, 280 bp, Zea mays
  Clone ID: LIB143-064-Q1-E1-A3
ccaggctctccacagacgtccaggcgtgggttgcatacctggcgtcaagccttgaggcttgaacgaacaacgtacgtccatgtgcttatagtggcacagttatcgcgtggaacggcctaatgtatttcggttgcctcagatcgatctatatgtgcgtatacattatgtactgaaaagtgtgtagcgtctggttaatgtacgagcagtgtgtatgtgaccaggacccggtgtgtagttgctactactaccatatccggtgaatgatcaaaccttttggtgt

SEQ ID NO: 395 - DNA, 384 bp, Zea mays
  Clone ID: LIB143-064-Q1-E1-A4
acgttccccgaaacttcaggctattagaggagctcgagcgtggagagaagggcattggtgatggaacagtgagctatggaatggatgatgccgatgacatctacatgcggtcatggactggtaccatcattggccctcacaatactgtacatgagggtcgcatctaccagctgaagttgttttgtgacaaggactatccggagaagccaccatctgtcagattccactcaagaatcaacatgacatgcgttaatcacgagacaggaatggttgatccaaggaagtttggtttgctagcgaactggcagcgggactacacgatggagaacatcctcacccagctcaagaaagagatggctgcctcgcagaatcgaaagttagtgc

SEQ ID NO: 396 - DNA, 432 bp, Zea mays
  unsure at all n locations
  Clone ID: LIB143-064-Q1-E1-A5
gggttgtacagcggnctcaagccctctctcatcggcactgccgcgtcgcagggaatctattactacttctaccagatcctcaagaacaaggtggaagatatagcggttgctcgtagcaagaagggccttggggatggtactgtcgggatgctttcttggcttggtattgcagctgttgctgggtcaatcaatgttcttctaaccaatccaatatgggttcttgtgacacgtatgcagacacatactcaagcgaaaagaaaaatattggagtctaagagggagcttttactgaaagaaatgtctagggcgaattcgttggaggttgcagttctgaaggatangctggttaaattggagtcagaaaaagctcgtccatatggtactcttcaagcgattcaaagaggtttacatgaatctggtgtaagaggattt

SEQ ID NO: 397 - DNA, 372 bp, Zea mays
  Clone ID: LIB143-064-Q1-E1-A6
gaaagcctatcagccagtgaagcccactacggtccgaccgatgtctcgctgacgtcacctcgtgttcaccagttaccaccggagtccggagtgaagcgcaggtcgggttcgcttttttcctcggcttcttctctctcgtccatcaacccagggggaaggagcgggagggagcgagccatggtagtcagcacgttcaatggacccgggattgggatcgggttcggtgtcggctgcgggttcggcgtcgggtgggggttcggaggaatgcctcttaacatgttcggcttgggtatcggtgggggttgtggatttggtcttggactaggatggggctttggaaatgcttttggttgtcagtatcgatcttcaaga

SEQ ID NO: 398 - DNA, 452 bp, Zea mays
  unsure at all n locations
  Clone ID: LIB143-064-Q1-E1-A7
tacaactcctcctgcaaggggttccaaggtggcatcaagaggcacaacttcaagcgcgggctgatgacgcacggttccaagagccaccggcagctgggttccatcggagccgggacgacgccgggccgcgtgtacaaggggaagaagatgcccgggaggatgggaggaaccaagaccaagatcaggaagctcaagattgtcaagatcgacaacaacctccgggtgctcatgatcaagggggccgtgccagggaagcccgggaacctcctccgcataacgccagccaagatcgtcggcaagaacatccccaagaactagacttcttttttttcaggggggtgaatgttgagtgtttgtgtttgttaccctgctacaaactggatgttatccttttgcaaattccaagtttttgancacatgcaacttcagattagtanaactataacctgtac

SEQ ID NO: 399 - DNA, 412 bp, Zea mays
  Clone ID: LIB143-064-Q1-E1-A8
tcgcgggtcgatacacgcctctacacctcgtcgtcataccacctcgcggagatccagtccagccctagggtttcgccagcggcgagccaaactccacgagcgggggaagaggggaaagcagggacgacgagggggcagccatggggcagcagtcgctgatctacgcgttcgtggcccgtggcacggtcatactggccgagtatacggagttcaccggcaacttcaccaccatcgcctctcagtgcctcatgaagctccccgcaagcaacaacaagttcacctacaactgcgacggtcacactttcaattacctcgtggaagacggattcacatactgtgttgttgctgttgaatcggtggggcaacaaattcctattgctttcatggatagggttaaagaggatttcacaaa

SEQ ID NO: 400 - DNA, 368 bp, Zea mays
  Clone ID: LIB143-064-Q1-E1-A9
aaagtaacgtgggctaacacatgcggtcaatgactcctccagactccgatggttcaatcaaccgacggccacgatggttgcagacggcagctcagcgagcctccgatctggtaacatgacctcgcgcccttccagcaatacagccacccaggctgagatacgcatagcgaagctggaagccttgctgtacaacaaagatggtccgagcggtggatccgaggcaacttcctctgccgtgaaggatctccagtcgaagctagatgtggttactgcagaatgcttgactgaaaacgagaagaacaagaagctgaccatggagaacgagaagctccagtaccgcatgacgcatctgattcgtgcgataaaag

SEQ ID NO: 401 - DNA, 399 bp, Zea mays
  Clone ID: LIB143-064-Q1-E1-B11
aaacacacgtctgcccacgcgtccgcggacgcgtgggcccgccgccgctgcgccctcctctcggtcctgccgtccgtcgaggtaaaaggacagcatggtgagggtcagcgtgctcaatgatgctctcaagtccatgtacaatgctgaaaagatacggaaacgtcaggtcatgatcaggccgtcatccaaggtgatcatcaagttcctgacggtcatgcagcgccatggctacattggcgagttcgagtacgtggatgaccacagagctgggaagatcgtggtggagctgaatggaagactgaataaatgtggtgttattagcccacgttttgatgtaggtgttaaggagatcgagggatggacggcgaggcttcttccatctcgccagtttggctacat

SEQ ID NO: 402 - DNA, 424 bp, Zea mays
  Clone ID: LIB143-064-Q1-E1-B12
gcgggtcgatacaagcctctagaataaatcatatgacctcgccttcccttgcgtgtttaccgacgccaccggccgcctgtatatcctcacccaactccgtccctctctcccggcccagatagatctttcccccgtcctccctcgccttcgccttcgccggcaggagatttccaccaccaccgccgaaccgccccgaccctcctcccctctcgcgctatggcccagactgttgtgctcaaggttggcatgtcctgtgagggctgtgttggagctgtcaagcgggtcctcggcaagatggaaggcgtcgagtcctacgacgtagacatcatggaacagaaggtcaccgtgaagggcaatgtgacacctgacgccgtcctgcaaactgtttccaagactggcaagaagacttcgttctgggaagctg

SEQ ID NO: 403 - DNA, 467 bp, Zea mays
  unsure at all n locations
  Clone ID: LIB143-064-Q1-E1-B3
gacccacgcctccacactcccacgccagtacccacagtcctacgagcagtcgcacgcaagtgtcaagagacaaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgccagcaccgccgccgacaggcgcgccgcctgcaactgcctcaagaacgccgccaggggcgtcagcggcctcaacgccggcaacgccgccagcatcccctccaagtgcggcgtcagcaatccctacacaatcaagcactcccacgactgctccagggtgaactanaacctagaccacgcgcga

SEQ ID NO: 404 - DNA, 375 bp, Zea mays
  unsure at all n locations
  Clone ID: LIB143-064-Q1-E1-B4
gcgagcacagcagcagcgcagaaaaaaaattctggaataatttttcttccctttggctccgtgaggttccggtgctcgctcgctcgcctgagcttcgatcgagcccggtcggcgaggcangcgcccgatcgccgctctccgggagcttccggggggccgtcggatggagccgtacgcggcggcgaagagcggcggggccgacgccggcaccggcaccggactggaagactcgatgcggaggctggggctcggcgacgacggggaagcangggaggagaagcttccggagcggccgggcgaagcggactgcgcctactacctccgcacgggcgcctgcggctacggggagcgctgccgctacaaccacccccgcga

SEQ ID NO: 405 - DNA, 391 bp, Zea mays
  Clone ID: LIB143-064-Q1-E1-B5
acaaccagctgctctcactcatcatcaacaccttctattccaacaaggagatcttcctccgggagctcatttccaactcttccgatgcgttggacaaaatcaggttcgagagcctcactgacaagagcaagctcgatgcgcagccggagctgttcatccacattgtaccagacaaggcttcgaacacgctctccatcatcgacagcggcatcggcatgaccaagtccgaccttgtcaacaacctcggtaccatcgccaggtccgggaccaaggagttcatggaagcccttgctgctggcgctgatgtgtctatgattgggcagttcggtgtcggtttctactctgcctacctcgtcgccgagagggtcgtcgtgaccaccaagcataacga

SEQ ID NO: 406 - DNA, 414 bp, Zea mays
  Clone ID: LIB143-064-Q1-E1-B6
gaaggtttcacatttgttgtggctgatccatataacgaagctcttgaagttgatgtcatcgactgggatcaggttgggaaccatgaaaagatgggaatgaccatgatcacacttatcgaactcgcaccaggtgacactaaagttacaactcttaacgtgcgtagcaccatggacccaaatgaggtagagaatgagacatcacatggtgagcttactctacagctcatatacatccctttcaatgtcgatgatatagataaatacgatacagctagtgctgatgtgctagcgagcgctccagatggtactccagctggtgatgccgtgcttcatgtgactgttcatgacgcccacgatcatgaggggaaagatcatccaaacccatatgcagcaagtactttcaatggcgaagac

SEQ ID NO: 407 - DNA, 428 bp, Zea mays
  unsure at all n locations
  Clone ID: LIB143-064-Q1-E1-A11
gtcggacgttacaatactctaaattaagtcgtatcatcncgagtcncgacggcctccagctccatcttgattcttgaggccaacccccgttcgtaagagtctgccatgccagcgagaataagtctttgggttcgacgaagtccccaagcacaacgtcaccaaggactgctggatcatcatcgccggcaaggtgtatgacgtcactccgtttatggatgagcatcctggtggagacgaagttttgctagctgtaactgggaaagatgctacagctgatttcgaagatattggccacagtgattccgcaagggacatgatggagaagtaccacatcgggcagatagatgcttcaacaatcccagcaaagcgtgctcatgtgcagccccagcaagcanccagccatgcagacaaggataatgacctcccca

SEQ ID NO: 408 - DNA, 360 bp, Zea mays
  Clone ID: LIB143-063-Q1-E1-G12
aaacgttttcgtgctcaaacaaccaaaccttaatccccattaaggcccaagggctccagaataaatccatggcacagtccaacggctggcaacccaggctctccgttaaggaaaaaaaggttgaaaaggacccaacaatcccaaaaaggcccccaaccccttcctcctcctcaagggagaatttaaggaaggattccaaggaaaaccaccccaagttaaagcaagtctccctgattggcaaggctggttgtgacaagtgaagtcctgtccgattccgagaacgctcactacgtgtctaaggcagagaagctcaaggctgagtacaccaagaagatcgacgcttacaacaacaagcagtct

SEQ ID NO: 409 - DNA, 377 bp, Zea mays
  unsure at all n locations
  Clone ID: LIB143-063-Q1-E1-G2
aggtctgatttaatgatgcaactggagaaggggcaattgccgatgggaactccaaaattgggtaaaccaaagaagcaacaatttcaacaacctgaaaagttcaatggccactttaatcctgggtgcaatgggttcaaccgggccggtgaacaagttgttgggggttaaaaaccaaaaacgacaagaaggcaacaagggttcaacaacggagcttaaaaatttcacccattaaaaaacaaggaagcatatttgccgggttgccaattctgtacgtgtgctctcagccctaagattcactctgaccgtcgaactgataatcganaccatggaagcaagtgcgtcatcaaatgtagagataaatgacatgctcggggctg

SEQ ID NO: 410 - DNA, 382 bp, Zea mays
  Clone ID: LIB143-063-Q1-E1-G3
accaccgccgagcccaaccgcacaagcgcgcgaggcatgagagagagagaggcggggagcaaaacaatggaggggaaagaggaggacgtgcgcctgggcgccaacaagttctcggagcgccagcccatcgggacggcggcgcagggcgccgctgacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccacctccaagtgcgccaccgtcggcatccagggcatcgcctggtccttcggaggaatgatcttcgcgctcgtct

SEQ ID NO: 411 - DNA, 430 bp, Zea mays
  unsure at all n locations
  Clone ID: LIB143-063-Q1-E1-G4
tagcactacacctgcaacgacgaggaccgccgtagcaatttgcgaagcaagggacgggagaggaacccgaggaaggcgaaaatgatctaccgcaactggtcgctgctctcgtccacagtcgtcatttggggcggcgtcgccaccgccggcctcgccggtatcttcctcttgggcggcaaggagaaattcaatggttatctgtgccgcgaaggcgagaggcttaagcagcaggacagagccacgatgggccgaagctaagcgttagcttctttggtatctcaagggagcaatagcccttggaaatttcacaagattcctgcgtccctaccagaacaagtccctatctangatggaatccatccttctgcaggctttcacntttcctgatataacagttacaataaattgaccatggtttggggtcctccgc

SEQ ID NO: 412 - DNA, 408 bp, Zea mays
  Clone ID: LIB143-063-Q1-E1-G7
agacgcctgagaaaaacgcaacccttttttgggctttggctttttgctgcaaacaaaaggcgacgccgctgggatctagcacgcgagcgagcgagagagccgcgcacctatctggcaagcgacgccgcggcctcgatcggagtcggaggcgaacacccccatggcggcggctggcggcggcgcaggagggaaggtatccttcaagatcatcctcacctccgaccccaagctccctttcaaagtgttcagcgtgcccgaggcggcgcccttcaccgcggtgctcaagtacgccgcggaggagttcaaggtcccgccccagaccagtgccatcatcaccaacgatggaattggcatcaacccccagcaaagtgcaggcaacgtgtttctgaaacatggttcggagctgcg

SEQ ID NO: 413 - DNA, 390 bp, Zea mays
  Clone ID: LIB143-063-Q1-E1-G8
gggccgacccacacgtccattcaaatccatccatcctcgtctcctccgtcccgcagcatctcaaccccatggccaagatcacgatcgggatcaatgggttcggcaggatcggaaggctggtggccacggtggccctgcagagtgactatgtcgagctcgtcgccgtgaacgacgccttcatcagcatcgactacatgacctacatgttcaagtacgacactgtgcacggacagtggaagcaccatgaaatcaacgtgaaggactccaaaacccttctctttggtgagaaggaagttgctgtgtttggctgcaggaaccctgacgagatcccgtggggttcggttggtgctgaataggttgttgagtctactggtgttttcactgaccagg

SEQ ID NO: 414 - DNA, 428 bp, Zea mays
  unsure at all n locations
  Clone ID: LIB143-063-Q1-E1-G9
aacaattcacacagcgaaccgagaaaccaacacagcaacaagcaaagcagcgatccgacatccgagagatggacgcggtgatgttcgggctggagactcccctgatggcggcgctgcagcacctgctggacgtgcccgacggcgacgccggcgcgggcggcgacaacaagacgggcagcggcggcagcgccacgcgcacctacgtccgcgacgcgcgcgccatggcggccaccccggccgacgtgaaggagctgcccggcgcgtacgcgttcgtggtggacatgccggggctgggcacgggcgacatccgggtgcangtggaggacgagcgggtgctggtggtcagcggcgagcggcgccgggaggagcgcgaggacgacgccaagtacctgcgcatggagcggcggatgggcaagttcatgcgcaag

SEQ ID NO: 415 - DNA, 354 bp, Zea mays
  Clone ID: LIB143-063-Q1-E1-H1
gtttaattcagatccgtgttctgagcacgtttattcaagccaaagctcgcgccaaagacagttgttccagtaacgaagtctctttcaaaaatagttaaaacactagggctcgcacgcgcgctctttctgcgcaattgcgccggccgccggctcggccgccccggagtcggccgcgggcgcgccggcgtcggccaaggtcgccgatcgcgacgtgcgcgtcctcgccatcgatctcgagggggcgcgccgcgaggtcgtcggcctcgccgggcagacactcctccgcgcgctcgccaatgcggagctcatcgagccggcctcccagcgccacgaggatatcgatgcgtgatccgc

SEQ ID NO: 416 - DNA, 425 bp, Zea mays
  Clone ID: LIB143-063-Q1-E1-H11
aacaatacgaaacgaattaatccccaatcaacacagcaagtcagcaacaagcaaagcagcgacccgagagatggacgcgaggatgttcgggctggagaccccccgggtggcggcgctgcatcacctgctggacgtgcccgacggcgacaaggcgggcggcggcgccacgcgcacctacgtccgcgacgcgcgcgccatggcggccaccccggccgacgtcaaggagctcgcgggagcgtacgcgttcgtggtggacatgccggggctgagcacgggcgacatcagggtgcaggtggaggacgagcgggtgctggtgatcagcggcgagcggcgccgggaggagcgcgaggacgccaagtacctgcgcatggagcggcggatgggcaagttcatgcgcaagttcgtgctgccggacaacgccgacg

SEQ ID NO: 417 - DNA, 342 bp, Zea mays
  Clone ID: LIB143-063-Q1-E1-H4
aggacgagcacgcgtaccgcacaggatacgcttcaaatccactgatgcgactcagtcatcgtgcccccaaactcccaccccgcagcatcaccacgccgccgcacctcgtcgcgtcgcgtcgtcaccggcgtgaagatggtcgggccaggcctctacaccgagatcggcaagaagaccagggatctgctgtacaaggactaccagactgaccacaagttcaccctcactacctacacctccaatggcgtcgctgtaactgcttctagcacaaagaaagctgacctgatccttggcgagatccaatcacagataaagaacaagaacatgaccatagatgtgaaa

SEQ ID NO: 418 - DNA, 382 bp, Zea mays
  unsure at all n locations
  Clone ID: LIB143-063-Q1-E1-H7
aggagggacatcttgggaaatacaattacggtggtaatacatttgaagcatcaggctcaccttctggtgctagttattccaagtgcagggctcttgcagttagagctcttaaagttgatgagccagcatgcacacacatgaaatgcacatttggtggtgtgtggaatggtggtggtggagatggacaaaagaatctttttgtggcctcctttttcttcgatagggctgccgaggctggttttgtggacccaaaagcagcagttgctaaggttaaaccttcagactttgaagaaactgcacgccgggtttgtaaattgaacttgaaggatgcacatgcaacctaccctgatgtctcagangagaacattccctacctttgcat

SEQ ID NO: 419 - DNA, 376 bp, Zea mays
  Clone ID: LIB143-063-Q1-E1-H8
cagaataaaattcacatccactaatatgagtatgtacaatgtactaccactgcaacatttgacgcagccagaagcacgagttcttggtgaagcaagttttggtttattggatgttgtaggcagctaagttacaaatgaccagtcagtcgctaggttacggttgaacttttctgagtttcagatgataacaacaggtgaattttgaacctttaagtgggcggagcaactgataacattgaggaatcctgtgcagtctttacttcgcgtgcattaggattggaaacgccattgctgacgactcaccagattgacaactgctctgaaggctggtttgtctatcactttaattgtaaaaacctaattgccaaaatgttgg

SEQ ID NO: 420 - DNA, 434 bp, Zea mays
  Clone ID: LIB143-063-Q1-E1-H9
cacgcgtccagaaatccacataccgtgtatagctagtggtaccattgaagccggcgggggcaaagaacggggggaccctacgtactgcatggccgcgttgacatctgccaagggcgctctccttccgtcgtgggctcgcagcagcagcagcggccatggcggcgacttgtggagggtcctgaggaaggcgttggctacggccggaggaggaggaggcggcggatgctcccttctgctcccgcgccggtggcagtcgtcgctgccgcagctggaccacgtcgccgacaggtccaacgatgatagcggcggcggcggcggcaagatccactgggacaacctcggcttcggtctcaccccgaccgactacatgtacgtcacgcggtgctcgccggaggaccgcggcgacttcatccgcggcgagctctgccgctacg

SEQ ID NO: 421 - DNA, 453 bp, Zea mays
  unsure at all n locations
  Clone ID: LIB143-064-Q1-E1-A1
atccgcatagagcttgttccgtccaggcaaccaaaaagcaagttgccccgccgcgcagaggaagaagagagcagaagaggatggctcgtacgaagcagaccgcccgcaagtccacgggaggcaaagccccccgcaagcagctcgccaccaaagccgcgaggaagtcggcgccgacgaccggcggcgttgaagaagccccacaagtacangcccggaaccgtggcgctgcgcgagatccgcaagtaccagaagagcacggagctgctgatccgcaagctgcccttccagcgcctggtgcgcgagatcgcgcaggacttcaagacagacctccggttccagagccacgccgtgctggcgctccaggaggccgccgaggcctacctcgtccgtcccctcgaggacacaannctctgcgcatcaaagctaagcgcgttcacatcatgcccaaggaca

SEQ ID NO: 422 - DNA, 51 bp, Zea mays
  Clone ID: LIB143-064-Q1-E1-A10
aaaaaaaaaagggggggcggcccaaaaggttcaaacctaagttaccgttga

SEQ ID NO: 423 - DNA, 387 bp, Zea mays
  Clone ID: LIB143-063-Q1-E1-G11
acgcaaccggccctcggtgacgctagccgtgccagcctcgcatcccaggatcctagctagatgcaggttctcctccatctagaccctaacacagcttcaccactgcgccgccagcctcaccgcagtcgtctccatctcgacctcctgctcctccttctccgcgtccccgaccacctcctagccgtcgtcgtcgcactcgcagcgacaccagccgcagaggcccgtggtgacgtcctcctcggtatcccctctagccgggtggctccgcagcgcatccggccccgaccccggatccgacgcaactcacacatcgctaagaaaacaatcatgcatcgaatcagtgttattgggggggggggggctcttcagcattgctgacctttacct

SEQ ID NO: 424 - DNA, 391 bp, Zea mays
  Clone ID: LIB143-063-Q1-E1-E6
cggacgcgtgggtttctccccaatccatacgtactccccgtgttttttttcctgtgcagttgttgtggtcgaggcggcaagcggcagcggtgacccagagaggaggcggcggcaagcgcggcgatcgatcgaagaggaggcaacgacgtttgaggaggcggtggcgggcgatgtgatgctttcggaagggatgctgctgtttctcgtcaggactgtacattacgggatgtctccttcgacgggagggtcctgccatggcaggtggccggtgatggagctctggattctgatggaggaggagccttccgaggcgtgtgcaaacttcaatgaaacagcccatcacttcctgcactgcattcaggtgcatatggagctgaccattcaagtgaac

SEQ ID NO: 425 - DNA, 376 bp, Zea mays
  Clone ID: LIB143-063-Q1-E1-E7
acgcacctgcatggtgcgccacgatgaggttgtacgcgtccagcgtgaggaagtcgtccagctccggcgcggtgcactgccggctgaagatcctgcccgcctccgcgtaccgcccctttcggaacctgtcggggccgacctctgcctcgaccctcgccatctcctcctcgacgacgcgtgcgagtagctctggcgtcgcgcgcacctccacaccgccggcgtccagcgccgctccgtggcgcagccactgccagttctggacgcggctgatctccgccgtagccgcgtcctccatcaggttgtacagcgggacggagccggagccggccagccacgccgcgaggtactgcacgcccacgcggacgttgagccgcag

SEQ ID NO: 426 - DNA, 400 bp, Zea mays
  Clone ID: LIB143-063-Q1-E1-E8
cgggctctcctcccccccaatccccaattccccattgtcttcgtccgtccagcaccagctttcctccgcaccccgatccggacagcctcgccggaaccctaaccctagcgcgccatggcgggatacgcccagcccgcatccagggccgtcgtgctccgcctggacgacctggcgctgcccccgcggcacctcaccgtccccccccacctccccgtctccgacctcctccgctccatcccgctcccctcgccctcctgctactacctcaccgccgacgggcgcccgctgccggcctcctccccggtggcggcgctcccgccgtcggcctccgtccagctccgcctccgcgcgctccgggggcgcggctgtgactgctgcgccacaggtcgccgagtcccgc

SEQ ID NO: 427 - DNA, 300 bp, Zea mays
  Clone ID: LIB143-063-Q1-E1-E9
agtgattgccttcattggtgatgggagcttccaggttacagcacaggatgtgtcaactatgctgcgatgtgagcagaacagcataatcttcctgatcaacaacggtgggtacacgattgaggtggaaatccatgacgggccatacaacgtcatcaagaactggaactacactggctttgtggacgccatccacaatggcttgggcaagtgctggacctccaaggtgaagagcgaggaggagctgacggctgccattgaaacagccctagggaaaaaaaaggattgctggtgctcaaccaa

SEQ ID NO: 428 - DNA, 418 bp, Zea mays
  Clone ID: LIB143-063-Q1-E1-F1
cgggtcgacacaagcctctacacacacgcctgcgacgcgccatcgcgcctccaccaccccgaccctgaccccgaactcgccgtcgcaacaggccaagacgcagcagtagaagcaccaccaccaccaccaccggcacacgaccccggcggcagcgagtgccggttctgcgagatgacgcggcagcaccagccgcagtgcgcgcggcggctgccgaagcgcatcatcctggtgcggcacggcgagagccagggcaacctggacatgtcggcctacaccaccacgcccgactaccgcatcccgctgacggcgctgggcgcggagcaggcgcgcgccgcggggcagcgcatccgcgacgtggtggcgggcagcggcaactggaaggtctacttctacgtgtccccctacgccgcgcaccgcg

SEQ ID NO: 429 - DNA, 424 bp, Zea mays
  unsure at all n locations
  Clone ID: LIB143-063-Q1-E1-F11
aaccacacttctgcttgcgaggcaacgggaaggaggtataacagggagagtaaagtagcgcgccgcaaccgcagcgtgatgaaatgcaagggcggcaagggaacacgcggttgcttgcggaaacccgctcgactcggtctctccgcccgcgagttgggttgatcggagggtttgatgacgggggctcgggagccggtggccatggagataccatcggacgaagggccagctgcggcaacggcgccgccgcggcggattaggatgacgctggtggagggggcgcgcggccgttgggctccggcgatcgtggacgagaatgangccaggcttaaggacgccgagctccggatgcagcaattccgtgaatggttggcctgcaaagcattgaagaagccacggaacccgtcgtggtcctctcaagaat

SEQ ID NO: 430 - DNA, 410 bp, Zea mays
  Clone ID: LIB143-063-Q1-E1-F12
atcaatttgggaaatttccaaatttggaagaaataaggtggcaagccaatggggaccctcaaattttccaagaaacaaccaaacataaggttgccaatggttcaaactttaaagccaaggctcaacaacggagtggtcggctacaaggtagggaggattaataacgagaaacatggaacaagatttgtgacattagcatgagcgaatttgacttggtctacaagcgcctaaatgtggtgcttgaagaaaagggggagagtttctataatccttatattcctcaagtgctggaggaattgagtaacaaaggcttgatcaaggagagtgacggtgcccgagttatatttattcaaggtcatcaaatccctttgattgttgttaagagtgatggtggcttcaactatgcctca

SEQ ID NO: 431 - DNA, 336 bp, Zea mays
  unsure at all n locations
  Clone ID: LIB143-063-Q1-E1-F2
caggaaggaatccacaaccaaaaaacctggtccaacggaacaaggtccattttaataaaaccggcaggtaattgtgacacaaatcggctgcatggaaacaatacaacctgcaaaaaagatgaaatgtttctccgacccaacctacaatgtgtctgttctttttgggaagagagatgagccactcctactagcttgcgcacgtcaacttattgagcacataagtggctcagcccggtcattggtgatttctctgggtctgaaagatcattctcanggaacgctgaaggatattactgtagctgtgatgattgaatagctgatgagctgggcatgggg

SEQ ID NO: 432 - DNA, 339 bp, Zea mays
  unsure at all n locations
  Clone ID: LIB143-063-Q1-E1-F3
attcccagtaacatgcagtggtggtgaatggaaaatcgttcaaggcctcncgattgatgagttctcaaggaagaagatggatgccactgcccaagagctgacggaggagaagacgcttgcttactcatgcctcgagtaaattctaccacatccagagagcaattgccaccccaatgttttgaatataaaaagaaactccaactccattcatagattctcactcagaactgctgcacgtcgcagtgcangcgtgttgctggcttcgcccagcttctttttttgcctgtgatttgcacgacatttatatttattgaaatcttgcagaatcgcttgacgatg

SEQ ID NO: 433 - DNA, 373 bp, Zea mays
  Clone ID: LIB143-063-Q1-E1-F4
ctccattcgcgcaaagacgccaagcccacccagcgaaatctctccccaaactacccctcgccagcgcccggcgatgtgcccaacgaagcccgatcgccctggccaggccgccgccggctccggcgagaagagctggcgggaggaggccgtggccgcctgctcgctgcggctggtcgacctggaccgtggcaccaacggctgggcctcgccgccgggggacctcttccacctgcgcgcgcgcggctacttctccagcggcggcgggaagcgcggcaaggcgccgtccgccgcggactggctgctccgccccgccggcgtcgactggctacgctcccacgcgcgcctcgaccacgtgctcgcccgcgacgacaac

SEQ ID NO: 434 - DNA, 406 bp, Zea mays
  Clone ID: LIB143-063-Q1-E1-F5
agtacaattttatgctgcagatgaaagatgtatcaggtgctttcagaatgcatgatggtggcgaaattgatgtccgtgcttcctacaccgctatatcggttgccagccttgtgaatattcttgattttaaactggcaaaaggtgtaggcgactacatagcaagatgtcaaacttatgaaggtggtattgctggggagccttatgctgaagcacatggtgggtatacattctgtggattggctgctttgatcctgcttaatgaggcagagaaagttgacttgcctagtttgattggctgggtggcttttcgtcaaggagtggaatgcggatttcaaggacgaactaataaattggttgatggttgctactccttttggcagggagctgccattgctttcacacaaaa

SEQ ID NO: 435 - DNA, 385 bp, Zea mays
  Clone ID: LIB143-063-Q1-E1-F6
gttgggaagaagattaaaaagacaccaatagtcgtcgggaactgtactggctttgcagttaataggatgttctttccatacactcaatcagcactcctttatgttgatcttggtatggatgtttataagattgatcgtgcttgtaccaaatttggaatgcctatgggtcctttcagactggcagatctggttggttttggtgtggctgtggccactggtatgcaataccttgaaaatttcccagagagggtctacaaatcaatgctacttcctctgatgatggaggacaatagggcaggtgaagccacccaaaaaggattttacaagtatgagggcaagaagaaagcgactcctgatcctgaaattatgaaatatattgaaaaat

SEQ ID NO: 436 - DNA, 386 bp, Zea mays
  Clone ID: LIB143-063-Q1-E1-F7
actacctctggcgtttaagtagggaaagaagcaggacaaaaggctggaatctctttctgccttagaagagaaaataagagtagttctctctgttctaggattgctaccttcaagttatcatgaggctttgcaacagctgcgggataaggcactgagacgagcttccatcaccgaggagcttgtggtgcagaagattgaagagaggactgcagcatggaaggcaaagcagtatgaaaaatctgacgagatccggaaagaactggctgccataggaattgccctcatggatggccccgacggaaccacttggagaccatctttgccaattttagaggaagcggtggttgcgaaaacatgatctgtgcaagggattccaattggaacca

SEQ ID NO: 437 - DNA, 302 bp, Zea mays
  Clone ID: LIB143-063-Q1-E1-F8
aaaaaaaaaaaaaaaaaaaaaaaaaaaaaaaaaaaaaaaaaagaaaaaaaaaaaaaaaaaaaaaaaaaaaaaaaaaaaaaataaaatcgcgcaaaacacaagattggaaggttcaagttaacaataggggtttgggcgggcggctttaaaggttcaagcccaggttcggcatcaccgtacgctcttgtcgtgtccaacatggtctaaaaccgcggtccatggttggccgttttattgggggaaactcccgagatccgtgccagttctcaccgttaccggcattgcccccatcccccttccgg

SEQ ID NO: 438 - DNA, 377 bp, Zea mays
  Clone ID: LIB143-063-Q1-E1-F9
gcgatctcactcccgatcagcatctgatcgctcactcttgcagctcgatcattctttagctgctctagctctagcctctagccctagctagtagctagccactcggtcgtgtagtcatcagccttctgatcgtcacccatggccactgccgaagtccagaccccgaccgtcatggcgaccgaagaagcgcctgtggtggagaccccggctccgcccgccgtcgtgcccgaggaggctgcccccgctgcctaagccaaagtggacgagccagctgccccggcggagaccgagctagctgccgccgctgagcccgaagcggcccccgtggcagctgatgaagagacgccaattgaggaagagacagcacatgaggcaga

SEQ ID NO: 439 - DNA, 146 bp, Zea mays
  Clone ID: LIB143-063-Q1-E1-G1
agatactcacagatctcggagaacaaaacagccaattgtgttctgcaatactaagaagacagcggacatgcgtgctaaggatctggacaagtcaggcttccgcgtcacaacccttcatggtgggaagtcacaagaccagagagaga

SEQ ID NO: 440 - DNA, 427 bp, Zea mays
  unsure at all n locations
  Clone ID: LIB143-063-Q1-E1-G10
agcacctcatgatcctatgcaatcgagccttctcaatgctacactagaggataaaaacctttcagaaatcccaaatttcaggttattgctgaagcagctggttaccatggaggtcatccagtggacagcattgtgggaattctctaagcacgaatttgaaaacgagaagaatctgctaggaggagctttgggtgccaaagctgcagaagatttgaagctaagaataattgaacataatatcttggttgtgtctaagtactattcgagggttaccataaagaggcttgctgatctgctctgcctgagtttgcangaggcagagaagcatctttcagacatggtgaactcaaaatctctgactgcgaagatcgacaggccgatgggagttgtgagcttccgggtagttcaagactgcaacggcacactt

SEQ ID NO: 441 - DNA, 440 bp, Zea mays
  Clone ID: LIB143-063-Q1-E1-E5
ctgcacctgcattctgcaagcctcgtctggagctcttcccgttgcattggcggcggagatggcggcgaatctggaggacgtgccgtcgctggatctgatgcacgagttgctccgccgcatgaagtgcagctccaagcccgacaagcgcctcatcgtcatcggcccacctggctctggaaagggaacccagtctcccattattaaggatgaatattgcttgtgccatttagccactggtgatatgctgagggctgctgtggcggccaagacacctctaggtatcaaggcaaaagaagctatggataagggagagcttgtttcagatgacatggttgtggggattattgatgaagctatgaagaaaccttcatgccagaaaggtttcattcttgatggctttcctagaactgtcactcaagcacagaagctcgatgaaatgt

SEQ ID NO: 442 - DNA, 424 bp, Zea mays
  Clone ID: LIB143-063-Q1-E1-D10
aggacgcgtgggtcttccttccgcggactagttttttccgaagaatccgccaaggccggcaaccattcaatccgttaaaggcccccaaaatcttttgacacccccggaaccccacaatccaaggccacgtgttttgcccaaaatgaacctttgcaaagggcaactgttcccaagtgggagcatcaaactggtgtaaaagaaagctcctgaatttaaggattggggctctgactaattggggaaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcatt

SEQ ID NO: 443 - DNA, 426 bp, Zea mays
  Clone ID: LIB143-063-Q1-E1-D11
aaccgattgccttcccccctcccaacccaagaccgatggcgcccaaggccgagaagaagcccgcggcgaagaagccggcggaggaggagcccgcggcggagaagacgaccgccgggaagaagcccaaggcggagaagcggatccccgctggcaagtccgccggcaaggagggcggcgagggcaagcgtggcaagaagaagggcaagaagagcgtggagacgtacaagatctacatcttcaaggtgctgaagcaggtgcacccggacatcggcatctcctccaaggccatgtccatcatgaactccttcatcaacgacatcttcgagaagctggccggcgaggccgccaagctcgcgcgctacaacaagaagcccaccatcacctcccgcgagatcccagactccgtgcgcctcgtgctccccggcg

SEQ ID NO: 444 - DNA, 394 bp, Zea mays
  Clone ID: LIB143-063-Q1-E1-D12
cccgcccaagccaagaccgatggcgcccaaggccgaaaagaagcccgcggcgaagaagccggcggaggacgagcccgcggcggacaagacgaccgcggggaagaagcccaaggcggagaagcggatccccgctggcaagtccgccggcaaggacggcggcgagggcaagcgtggcaagaacaagggcaagaagagcgtggagacgtacaagatctacatcttcaaggtgctgaagcaggtgcacccggacatcggcatctcctccaaggccatgtccatcatgaacgccttcagcaacgacatcgtcgagaagctggccggcgaagccgccaagctcgcgcgcgacagcaagaagcccagcaccacctcccgcgagatccagaccgccgtgcgc

SEQ ID NO: 445 - DNA, 376 bp, Zea mays
  unsure at all n locations
  Clone ID: LIB143-063-Q1-E1-D2
gattgaacgaagcagcccaaccaaattcccctcgccgcctcgtcncttcgcgacatttctagtcncgtcgtcgcctcaatctcgaagcctctccggcgcagccgcctcatcatcgatccgaaggcctccaaccaaacatcctctaaggtttccgcatcgtccgtcgcgatgggcttcacgaagcggtcgccccagcatcccgcctccccagccggcggcgaggtcggcgcccagacggcagggaaggtcacaccagtgccggcggcgccggagtcggcgcccgtggcggtggtgccgaggcctccagacgtggcgcccttcctgaccaaggtctacgacatggtctccgacccggccaccgacgcggtcatctcct

SEQ ID NO: 446 - DNA, 409 bp, Zea mays
  Clone ID: LIB143-063-Q1-E1-D3
ccttcctccacttgccttcgtgttcgtgattcgtgatttcgccgccggaaagccgagggagagggagcgatatggggttcgtcggagacacgatggagtcgatccgctccatgcagatccgccaagtgctcatgcagatcatcagcctcggtatgattgttacctctgcattaatcatatggaagggtttgatagttttcacggggagcgagtcaccagttgtagtggtgctctcgggtagcatggagcctggatttaaaaggggtgatatcctgtttttgcatatgagcaaagatcctattcgcacaggagaaatagttgttttcaatatcgatggtcgtgagattccaattgtccaccgagtgattaagggtcatgaacgtcaggacactgcagaagtggacatcct

SEQ ID NO: 447 - DNA, 406 bp, Zea mays
  Clone ID: LIB143-063-Q1-E1-D4
cgtccagctgatcttgatcctgcaccccgagccgtacacaagagctagtcggtagaacttgcaggagcggagcagaactaagtgcagagaacaggacatatggctacgccggcggtgaaggtttacgggtgggctatctcgccgttcgtatcgcgggctctgctggccctggaggaggccggcgtcgactacgagctcgtccccatgagccgccaggacggcgaccaccgccgcccggagcacctcgccaggaaccctttcgggaaggtgccggtgctcgaggatggcgacctcacgctcttcgaatcacgtgcgatcgcgaggcatgttctccggaagcacaagccggagctgctgggcggcggcaggctggaacagacggcgattgtggacgtgtggccggaag

SEQ ID NO: 448 - DNA, 371 bp, Zea mays
  Clone ID: LIB143-063-Q1-E1-D6
atcgcttccagccgccgccgccgcgtccgcctcgcccagcgcagcagccgccgcagcacatcgctatctcgatctcagccatggcggaggtggagcagcaacagtgacacgccgaagctgttcaaccgctggaccttcgatgatgtccaggtgaacgacatctcgctgaacgactacctcgctgtgaacgcgacgaagcacgcgatgtacctgccgcacaccgcggggcgttactccaagaagcggttccgcaaggcgcagtgcccgatcgtcgagcgcctcacaaactccctcatgatgcacgggcgcaacaacggcaagaaggtcatggctgtccgcatcatcaagcataccctggagattaatcacct

SEQ ID NO: 449 - DNA, 364 bp, Zea mays
  Clone ID: LIB143-063-Q1-E1-D9
gcgtccgatccaagcccttctccaatcgctccgccaggacatccccgacgcccgggatgcggtgcaaccacccactccaacgcaaacgcacggcgggtccgacccaacgaccgaccgttccgggtaacataccacgcatatacactctatgaccgccgcacacttcatcaacctcatcagcttgaatgagcacctacacatccagtgctggagaacatcctccagagatacaaaatcatccactcctccgcgagactcaactctcgtgggcgctttcgtaacccgtcgaatgacgtacaaagccgcccctactgttggcaactcagtatccgagtttccgtcgggcatcagcggcgggaacaca

SEQ ID NO: 450 - DNA, 420 bp, Zea mays
  unsure at all n locations
  Clone ID: LIB143-063-Q1-E1-E10
attgtgaccctccctcagccgcgtcgcgtcgcatcctacgattcaaagctctctctgctcccagccatggcgaagaactacccgaccgtgagcgccgagtacagcgaggctgtggagaagggcaagcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaaggangagttcccaatcctctcttacgccgatttctaccagctcgcgggagttgtggccgtggaggtcaccggtgggcctgagattcncttccaccccggt

SEQ ID NO: 451 - DNA, 384 bp, Zea mays
  Clone ID: LIB143-063-Q1-E1-E11
aaacggatccgtgtcagagtccttcttgtgcttctcctgctctgctggtgccgctgccatgggtttccccagcacccccaacctgaagctggagcctcgccctcgcacgcggaggctcctgcgctgcgccctcagctctgagcctgtgcctcccatgactgtttccatcactggagccacaggtttcattggacgcagattggttcacaagcttctatcggatgatcacaacgtttgcatcttaacaaggtctgcctccaatgctgcgtcagtttttcctgcttccacctatcctggactcagaatagcccagcaaggggattgggatgcatgcgtcagacgctccactgctgttgtcaacctggcaggcatgcccataagcac

SEQ ID NO: 452 - DNA, 444 bp, Zea mays
  Clone ID: LIB143-063-Q1-E1-E12
ccggggccaaccaagccttcgaaaaaaaggtaataaattaacaaggctaaaataagaagatcgaattaaattaatccattaatcaagttattaagatacaaaatttaaagagtttataaaaagctaaggattaaaataaaatttccaatggaaaaagtcaaattgggtaaagggagtaatccaaggcccggcaagaaaaccaagggggctaaagcctgggttttaaatggttcaacccttttaatggtaaataaccaaaaaaaaacccgtaaacccgtgcaaaatgtgaaccatgcacctcataaggtacgataaataatcgcgtgatgcggaagaagagccaagtcgacccaagcgcgggctaacctacaggatgatgcagatggataacccgatcaagtaccaagacaaaggctgctcgtcaagcgaacgtcgtctaacaac

SEQ ID NO: 453 - DNA, 349 bp, Zea mays
  unsure at all n locations
  Clone ID: LIB143-063-Q1-E1-E2
cgggtcgagcacgcgtccagaataacgaataaaagaattccgaacgataaagaaagggcttttccgcaaattttgttaaaccgggttttaaccaaccctaatttttggcaattccccaacctaataacaattaacaattgtaataatctgggtcggaacccagtcaagctcagcgcctgggttgcgtttggactccagtgcagaattgcgtaaaggatttagaggaagagcggagctgagctgagcgaggcangagtaaaggacaacctgtatgtcactgttagtgggcccagtgccacgtgaaagtcaggcactgttggtgcccattgaccgccggacttgccagcga

SEQ ID NO: 454 - DNA, 392 bp, Zea mays
  Clone ID: LIB143-063-Q1-E1-E3
aaaaccactaatgctccaaccctagccgcgatccgacaacgcctccatccctagccgactgctgcaagcttcagagctcaagagtcagggcgccatggcgacagagacggagaccttcgcctttcaggctgagatcaaccagctgctctcactcatcatcaacaccttctattccaacaaggagatcttcctccgggagctcatttccaactcttccgatgcgttggacaaaatcaggttcgagagcctcactgacaagagcaagctcgatgcgcagccggagctgttcatccacattgtaccagacaaggcttcgaacacgctctccatcatcgacagcggcatcggcatgaccaagtccgaccttgtcaacaacctcgggtacatcgcca

SEQ ID NO: 455 - DNA, 397 bp, Zea mays
  unsure at all n locations
  Clone ID: LIB143-063-Q1-E1-E4
cttagtcgcacaacgcgcctccctgctccagttttccattccttgcgcccccttcagatccgatctgatccacgccggcgagacaccggaggaccgccatgacgctcagcctccgtcgcaagcagctcgatgttatcgtgcggatgctgcacctgaaccagcagcagttgccgaacggcggcgagggacagggagaggacgatgcgtacaagatcctggttatggatccgccctgtatctccatcctctcgcctgtgctcaagctcggcgacctccgccaccaaggtgtcaccctcaccctcgccatcgatcgtccgcggcaggcggtgcccgatgcgccggccgtctacttcgtccggcccanccccgggaacgtggaccgagtagcggccgacgc

SEQ ID NO: 456 - DNA, 367 bp, Zea mays
  Clone ID: LIB143-063-Q1-E1-C4
acccacgcgtccgctgctcctccgccttcttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggtcatgccaaatgccactttgttgccatagatatattcaacgggaaaaagctcgaagatattgttccttcgtcacacaactgtgatattccgcatgtgaaccgtactgagtatcagctgattgatatatcagaggatggatttgtg

SEQ ID NO: 457 - DNA, 424 bp, Zea mays
  Clone ID: LIB143-063-Q1-E1-B10
agggagagagagaatgggaaacccccaaaaggcgcccttttaggaacaaggaaccttaaataaaccacaccaaaggaggaaaaggggaatggccggaatcggcccgataagacaggactgggacccggtggttgtgcgaaagaaggcacccaccgccgctgccaagaaggatgagaaggccgtcaacgccgcgcgcccgctccggcgcggagatcgagaccatgaagaagtacaacgctggtatgaacaaggcggcgtccagcggcacatccctcaacaccaagcgcctcgacgatgacacagagaacctcgcccatgagcgagttccaagtgacctgaagaaaaatctcatgcaagcaaggctcgataagaagttgacccaggcacagcttgctcagatgatcaatgagaagccacaggtgat

SEQ ID NO: 458 - DNA, 385 bp, Zea mays
  Clone ID: LIB143-063-Q1-E1-B11
cacgaccccctgggtgcactgctcatactgcttgccctcgccgtatcgtccacccgcaacgcacacgaggattccatggccgacaacaccgggacgttggcgggcggcatcaaggacgtgccggggaacgagaacgaccttcacctccaggaactcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtgaagaagctctacgaagctaaggtctgggagaagccatgggagaacttcaaggagctgcaggaattcaagcctgttgaagagggtgctagcgcct

SEQ ID NO: 459 - DNA, 425 bp, Zea mays
  Clone ID: LIB143-063-Q1-E1-B12
aacgctgctctcgtcaccatctctccgactcacccctctgtcctcgcaagccgccgccggccaagtcctgtccctctcccttgtctggttcggatcgtcgttgctagccaggtgctggatccgtagcggcggcggcggccatggacaagagcatgctcggcgacctggacggcctccccgaggaggacaagatgcggatggccgccatgatcgaccagctccagatccgcgacagcctgagaatgtacaattcgctggtggagaggtgcttcacggactgcgtggacacgttccggcgcaagaacctggacaagcaagaggagtcgtgcgtccgccggtgcgcggagaagttcctgaagcactccatgagggtcggcatgaggttcgccgagcttaaccagggtgtggccacgccggactaagaa

SEQ ID NO: 460 - DNA, 427 bp, Zea mays
  Clone ID: LIB143-063-Q1-E1-B2
cgggtcgagacacgcgtctagccacaattttccgaaaaggataatggacgggagcattcaaacattggaccaaattcttacaatatgttcaaaacggatttcaaattgctaaaggaaatgggcatggacccatataggttctctatcctcttggcctagaatactgcctaagggaacggtcgaaggaggttataacaggatggcatcgattactacaaaaagctcatcaacttgttgctagagaatggcatagagccatatgtaacaattttccactgggatgtccctcaagcactagaagagaagtacggcggattcttagataagactcataagaggattgtaaatgattacaaaaacttcgctaaggtgtgcttcgacaactttggtgacaaggtgaagaattggttgacctttaatgaacccc

SEQ ID NO: 461 - DNA, 383 bp, Zea mays
  unsure at all n locations
  Clone ID: LIB143-063-Q1-E1-B3
acattaaccgtctgcagtcggcataacataatcgtcgtcgcgtgcagtccccattcccttttccagtggtctgttgctcgcgcttcgtccagcttccccggaagaggtagcacggcaagggcagaggatgagtgaccccaagtacgcctacccctaccccgcgcaaggttactaccaagggccgtaccagggcccgccggtgatggcgccgccacagtacgccgcgccgccgcccagaagggagccgagcttcctggaaggctgcctggccgcgctgtgctgctgctgcttgatcgacgagtgctgctgcgacncgtccatcatcttcgtcagctagactagacgatgaaacgaggaagaacctantggtatatataatatgt

SEQ ID NO: 462 - DNA, 306 bp, Zea mays
  Clone ID: LIB143-063-Q1-E1-B4
accaagcggatgttgctccgggatctgctcgacgaccaagacgatgacgaggattcgatgacgtttcgtcggacgggtactggcatcaccgtcttcgtcaagtcgtcagcccgggcagggaccagtcagtggacatcagaggtagcaccaccagcagcttccgcgagttgagcagtacacggttgatagatattgtcgacggacgcggccgccgacatagagagcatgatatggagaggccgctcgtgctgcgtaataatgcaccaaggtgacgatagcagctgcaatgatggtgcctaaatttcc

SEQ ID NO: 463 - DNA, 429 bp, Zea mays
  Clone ID: LIB143-063-Q1-E1-B5
ctgagccgcacccacgctcaccgtacctcctccgaatccggccgacggcggggaagcccctcctcctccacgacacgcgcttccccggctatcatggattcagatccatcatcacagaacccaacagatatgactgcatttgtccagaacctccttggacagatgcaaacaaggttcgagtccatgtcgcagaacattgtgtcaaagatagatgaaatgggaaccaagattgatgagctcgagcagagcatcaacgatctcaaagctgagatgggcactgagacgccggtcaagaagcctgatgagccaaagcctgctgactctgcctaacttgggtgtaacccagagattgttgtgtgaagatttgatgatggtgtgacaaatttcagcagtacgtgatcgtatccgttttcatgagtcctggcagtt

SEQ ID NO: 464 - DNA, 374 bp, Zea mays
  Clone ID: LIB143-063-Q1-E1-B6
ctcaagcaagcgagcaagcttaagccccacctcctagcaacatggagacggcctacgttgtcgttctgtcgttcttcttcatcgttgctatccaccgccttctcaaccgcggcgaaagcaagaatatgagcaagcagccgctgccaccgggccctcgcgccatcccggttctcggccacttacacctcctcgagaagccgtaccacctggcgtttatgcgcctcgccgcgcgctacgggcctgtgttctccctccagctgggctcgcgcgccgccgtggtcgtgtccaccgcggactgcgccagggagtgcctcgcagagcacgacgcgacgttcgcgaaccggccgacctaccccacgctgcacctgatgacc

SEQ ID NO: 465 - DNA, 312 bp, Zea mays
  Clone ID: LIB143-063-Q1-E1-B7
acccacgcgtccgggaaggacaatttcttcatgaatgactcgccctagaatcatgtagcctcttgccaacagcttatacatccacatatttaaactctactctgcgaacaaaaaaaaacaaaaaaaaaaaaaaaaaaaaaaaaaaaaaaaaaaaaaaaaggcaaacacacaaaaggaataaattcaaaacataaacataaaaaataagaaaaagctctataaagggcgtcacctaaatagaattcaatgtgagttccttgaaaatgtaatcactaggacaactagacgtttacacaacttaatgtcctaggg

SEQ ID NO: 466 - DNA, 409 bp, Zea mays
  Clone ID: LIB143-063-Q1-E1-B8
atcctatccccccacgctgggtcgcccgatctgcatgcgcacggcggcttcctcttggcgtttctagatgggctcctcctccgtcctcctcttcccctcgtcctcctccgccgcaccctccgcccccccattcctttccccactctcatgccaccgccatcgcctcctcccactccttattgccgccgctgccctgctccaaccccccgcctcctctttcctcgcaagaccacgtcctcatccactacatccaccagctagacgatttgaggttatttttgtttccccaactggtgaggaaattaaaagcaagagacagctgactcagtacctgaaagctcatcctggaggccctgcatcttcagagtttgattggggaaacagtgatactcccagacgctcagcacgc

SEQ ID NO: 467 - DNA, 421 bp, Zea mays
  Clone ID: LIB143-063-Q1-E1-B9
ggtacctagtctagcgggccgagccacgcgtccgcagcgatctaggccgccgcctctcctactgcatctccctcgctctcgtcgcctcgttcgcttcgcctcctccccgccccgccccgagccgagcagagcgcagccctatccggagctgggatggcggacgcgaagcagcagcagcagcagccacagcaggcggcagcggcagccaccggcgtgtggaagacggtcaagcccttcgttaacggcggggcctctgggatgctcgcgacctgcgtcatccagcctatcgacatggtcaaggtgaggatccaattgggtgagggctccgctggtcaggtcacaaggaacatgcttgcagatgagggtgtccgttctttctacaagggtttgtctgccggattgctgaggcaagcgacgtaca

SEQ ID NO: 468 - DNA, 196 bp, Zea mays
  Clone ID: LIB143-063-Q1-E1-C1
ggtcgagacaagcgtctaaagaggctcatcatcaagctctccgaactggggtttgctgatgcttaaatagaccctatcttggagtgatacattctgctgcctgtatggaatcatgtggtcttttgcatctggagtcaatgtgaacaagcagattgtcgtattgtctttctcgtaataaatttgtcgatattgagcc

SEQ ID NO: 469 - DNA, 341 bp, Zea mays
  Clone ID: LIB143-063-Q1-E1-C10
gtgcgggatgacctcgtccgcgccctcctcaacgccgacctcgtcggcttccacaccttcgactacgcgcggcacttcctgaccgcctgctcgcggctgctcggactcgactaccagtccaagcgcggctacatcggcatcgagtactacggccgcaccgtcacggtcaagattctccccgtcgggatcgacatgggccagctcagatcggtggtctcggcgccggagacggaggatgcggtgcggcgggtgaccgaggcgtacaagggacggcgcctcatggtcggcgtcgacgacgtcgatctgttcaaggggatcgggctcaagttcctggcgatgga

SEQ ID NO: 470 - DNA, 355 bp, Zea mays
  Clone ID: LIB143-063-Q1-E1-C11
gcgtccagcattagtgtaccgaaacagggtaacctcgtgctaactgggccatcattggccacctcggcatacagtccaattgctttcttcctctagctccatgatggcagcccgcaagccggagaagccaccgaggacgacgaggatatcgggaggatactctgcgactgcatcggcgacgacttctccaactataacagggccatagtcgagattgtccaaaccggctatggccacgctgaagtgctcgatgccgtcctgagcaacggcgtccaaagcctggtcaccgtcgtacttgctcgaccgccatcgtacacagctggtgtagaagacgccaccagcattcttgggagga

SEQ ID NO: 471 - DNA, 382 bp, Zea mays
  unsure at all n locations
  Clone ID: LIB143-063-Q1-E1-C2
gggaagtcctctgtcacagatatcgagggaagaatcgagctcgggcgaaggcggaggtcctccgaaggtaacaccgaacctgtcctgaaacttgatgacgcgtgtcacagtcgacggaatggccggagcgggagagcaagtagcagaggcctggttcgggcgaagcggagcttacgcccgaggttgagtttagcttcgggcgaagcggaacttgcgcccgaggtcttggtccgtgtcctgtcgtattatgcgtcacgaccgccaggtggcgtgcgcacgcttaatgatgttggtgaatctttgacaagactgttgtcctattgaaagattcacatgcagcctgacgtgaggtangtgtgcgcattgaatacggttgtctccc

SEQ ID NO: 472 - DNA, 318 bp, Zea mays
  Clone ID: LIB143-063-Q1-E1-A8
acattcactcgaatgagtgcagctgggatgacggtatggacactggtcatgcactgagatctgtgttgattgcaagcagaaattggactggcgtagctatctactgcgtcgcaccggacgctctccaccgtgtgccagatcgtcacatgggtccactgccacagtgtcgatgatcagttccgctcaatcatcacgtagtctgcataccgtatcgctgatactggtgtctacactagccgtggcaccaagctgattcgttgaactctacggatgcgtctgcagcgtgcacttcaccgacgtgatgacggaggacgtcga

SEQ ID NO: 473 - DNA, 127 bp, Zea mays
  Clone ID: LIB143-062-Q1-E1-H11
cggataacacctaatggtaagttttggagtttgtggttgcacacgcaacgatggaccgcctgtgatatctttaataaatgtaaccgcagataataatgaaataaaaagaacgcatggctattgtatt

SEQ ID NO: 474 - DNA, 216 bp, Zea mays
  Clone ID: LIB143-062-Q1-E1-H12
tgtgtaacgtcaccaaggacgatctaggtatcccacttttgaaaggggtggtttcacattcctatgttgaatcaacgttcagcctttgggagtggtaatatagctgggccgccaacatgggtaaggttctcacagcttaagccctgagggaatctagctataagtgatacatttttagccaaaagaccattgtgatttacccaatgaaccctattc

SEQ ID NO: 475 - DNA, 396 bp, Zea mays
  Clone ID: LIB143-062-Q1-E1-H3
tttggtcaaaccttgggaatccaacccgatttccaagttaaggaaagtaatggtttaagggaggacaattgatctaagaagcataattactcagagaatgaacaaaatattcagggaaaatattgactttcaacttgagcgctttgaaaatggaaatctttgtggtgttgtggaactgcaacaactgctggatattttggagcttacacaccaatcaatatcaagatttcttgaattggattcttactctcttatgcttagcgagatgcaagaaaatctgtcattggtttcttattcaagtcgcatctcttctcagatatggagtgagatgcagacagatttcttgccgaatttcatcttatgtaataccacacagcggtttgtccggtccgcaaa

SEQ ID NO: 476 - DNA, 396 bp, Zea mays
  Clone ID: LIB143-062-Q1-E1-H5
acggacgcgtgggcgactcgtcagacgtcagccagcagttcgaaaccaaggattgatccaggagcttccggaaggcgaggcgcgcgcgcagcgtcgaggtgctggtgccggtgccgcccatggatcgggctcgcggatccgcgttcctgctcggcgtcctgctcgcaggatccttgttcgcgttttcagttgccaaagaggagaccaagaagctcgggaccgtgatcggtatcgatctcggtaccacctactcctgtgtcggtgtgtacaagaacggtcatgtcgagatcatcgccaatgaccagggtaaccgtatcacaccctcatgggttgccttcaccgatagcgagaggctcatcggtgaggctgccaagaaccaggcagccgtcaaccctg

SEQ ID NO: 477 - DNA, 376 bp, Zea mays
  Clone ID: LIB143-062-Q1-E1-H7
actaaatcgaattacgccgtcgcgatgaggccggcgctgctcaagtccacggcctagctcctccgccgcatccgcggctacgcctcctcggtcaacccggagcggaaggtggccatcctgggcgctgcgggcggcatcgggcagccgctctccctcctcatgaagctcatcccgctcgtctcctcactctccctctatgatatcaccgggacccccggcgtcgctgctgacgtctcccacatcaactcccccgccctgatgaatgggttcatgggggacgaccagctcggggaggcgctctagggctccgacgtcgtcatcatctcagctggggttcccattcatcccggcattaatcgggactacctctttaaaa

SEQ ID NO: 478 - DNA, 188 bp, Zea mays
  Clone ID: LIB143-063-Q1-E1-A10
ggcgcccacgcgttaaaaaggcgcgatccatggaccggtcgatcaacttccgcggcatcgccgggagcgccggcaacatcatgcagggaatggggaaattcgttttcggcaacgagggactcgactcaaaggaagatagctatgttgagagataccttgaccggataagcaatggcaccatacctgat

SEQ ID NO: 479 - DNA, 449 bp, Zea mays
  Clone ID: LIB143-063-Q1-E1-A11
gtgcggtccagtcgagaagtgccgggtcgacgacccgtccacacagtagcagcaccaggcggcgccgagtagcggctccccacctcgagcttgccaccatggctagaggattgaagaagcatttgaagaggctcaatgcgcccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaatgagaactacaggctgctgtacgataccaagggccgctttcgccttcaaccaatcaaggaatga

SEQ ID NO: 480 - DNA, 367 bp, Zea mays
  Clone ID: LIB143-063-Q1-E1-A12
ccccaaaacgtaaccggcgtataaaacaactccaaacgattcaaccaaatccaaccaaaatacgttaaccccttctaaaaaaatatgggctccgccattaaaggtggaaccaactcctccccgtgggcctcctccccggccggaattcaatcctccacgttaaccaaaccgctaacaactgcaattggcaatcccggggcgccgaaggtcgttggcaactgaaaggccgtccccccggtagctccggctgccccggcgcgccggcaaactcaccccggtgcggcggccgatgcctccggtgtcgcagaccatgtccaggctcaaggcgcaaggcaagacggcgttcatcccgtacatcaccgccggc

SEQ ID NO: 481 - DNA, 387 bp, Zea mays
  Clone ID: LIB143-063-Q1-E1-A2
tacacacacgtctgcgccggagctcccaagaagaggacgttccgcaagtacagctaccgcggcgtcgacctagatgcgcttctcgacatgtccacggacgacctcgtccagctcttccccgcgcgcgccaggagaaggttccagaggggtctgaagaggaagcccatggcgctcatcaagaagctgcgcaaggcgaaaaaagatgctcctgctggtgagaaaccagagccagtcaagacacatctccgtaacatgatcattgtccctgagatgattggaagcattgttggtgtctacaacggcaagaccttcaaccaggttgagatcaagcctgagatgatcggccactaccttgctgagttctccatctcctataagccggtcaag

SEQ ID NO: 482 - DNA, 411 bp, Zea mays
  Clone ID: LIB143-063-Q1-E1-A3
aaaataaatctttttaatacttcttctttgtctatattactcttttgatcacttgctcccactatcacatttgatgtttctgttttctggaaggaaaaaggtggtgacatcgagagtgcagctgaccccaaggtgtctgctcaaatgccagtaaggtctgacactatcgtgtacatgttacatctctcgctgcatatatatatctcatcctcctacctattagactattagcccaactagctatatactctggttctgttaccatgtacccatcattcgtcattagaacattctcttccagaatgatcgtttctgcatgttttgagcaaggaaggacttatattacacaggtaaaatcttggatcacatgttggcagtaatagtgctctctttctgtttcctgtcacctga

SEQ ID NO: 483 - DNA, 357 bp, Zea mays
  Clone ID: LIB143-063-Q1-E1-A4
aaaggcaccacacctcttcctcctcttcctcctcctagcacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcgaggcggccaccgagggcggcggctgcgactgcaacacctgcaactgcggcaccagctgcggctgctcctgctgcagctgcaactgagccggcccgcccggcccggcgatggcgcacgagagtcgagag

SEQ ID NO: 484 - DNA, 382 bp, Zea mays
  Clone ID: LIB143-063-Q1-E1-A5
tttaagtattagaaccttcactttgttgaagctgttgctctgaagccaccagaagtgcagattgatatggccctgcagcagcattaagctttccagctcttcctttgatttctggcaacagcaaaaattagccgtgcaaatgttgtcctgaaagtacttgacttaaattccattgggattagcaccacgtaccattgctaactgcaccttttcccatgatcttaagcatgaagctgagcttgcagctgccgctgcgcagcccctccccgatgacgatgatgacctgatcgaatagatatgttatacatggcccttgttgatgactcttgttaaaaatctgtggtggttcaatccttgttagtgttaggcggtacctgaatgt

SEQ ID NO: 485 - DNA, 400 bp, Zea mays
  Clone ID: LIB143-063-Q1-E1-A6
ctcccgggtcgatacacgcctctacagtaactcgtagtagtatgtgttattagaggtcatcggtccgtgagtgctaatctctcattggcacagtgttacatatcggtgcagctccagctagcacagaagtaggcactacatcagctggcagaatatatctagattgcgggactttttccataaactgtctcaagattacagccatctacttgctgatcatgatggacaacgcaagaaggtgctccgcagcaacctctctgcgcggttgatatggtaatacttccatgtacggcacaactacggcctcctcctagcctaactacatctgcgctagccagactcaggcatagatcattacaatcgtcagggggtggaagactacgaatcctgaagatattac

SEQ ID NO: 486 - DNA, 408 bp, Zea mays
  unsure at all n locations
  Clone ID: LIB143-063-Q1-E1-A7
aattcacaaagcgcctagcaaaagcatacttcccgaagcactcttgcaatccactgagttctgtttgttgagacgcatagagctagctgctagcgtcgacaatgtcgctcgtgaggcgcagcaacgtgttcgaccccttctcgatggacctctgggaccccttcgacaccatgttccgctccatcgtcccgtcggcgacctccaccaactctgagactgccgccttcgccagcgcccgcatcgactggaaggagacgcccgaggcgcatgtgttcaaggccgacctccccggcgtcaagaaggaggaggtcaaggtcgaggtcgaagacggcaacgtgctggtcatcagcggccagcgcagcagggagaagganngacaggacgacaagtggcaccgcgtcgagcgca

SEQ ID NO: 487 - DNA, 430 bp, Zea mays
  unsure at all n locations
  Clone ID: LIB143-062-Q1-E1-H10
ccgggccaagcgtcaaactaatgcctgcctgcctgcctgcgtctctcctccaggctccaggaatccaccccccacctcctcggattctttccccctctccagctcccccgtcctgcagccgcctgcactgtgctgccgccccgttcgcctcccggcctccagcctcctcggttcccgcgggagggccatgaagttaaggacaaaacgacctgaatggaagtcccttgtgcctctacaactgagcagattgagcaggaaatctgccatgcgtttctttttgttccccaaggttcagtcggctggtcaatcgccagatgataccccagtttatcttaatgtgtatgatttgacgccaatgaacggttatatatattgggcaggcctgngcatatttcactcaggaattgaagttcatggtgttgaatatgca

SEQ ID NO: 488 - DNA, 358 bp, Zea mays
  unsure at all n locations
  Clone ID: LIB143-062-Q1-E1-F3
tgaccgggcctccggggcacaataaatttggttgctgccaacttgcttgcggtcctcgctgggaacgccagcccctccgctgaggatttgactgccattctggagtcagttggctgtgaagttgacaatgaaaggatggaactcctgctgtcccaactgagcggtaaggacatcaccgagctcattgccgcgggcagggagaagtttgcttcagtcncatgtggtggcggtggtgtcgctgttgcggcagcttcacctgctgctggcggagctgctcctacagctgaggcaaagaaagaagagaaggtggaagagaaggaagaaagcgatgatgatatgggcttcagcctcttcgact

SEQ ID NO: 489 - DNA, 252 bp, Zea mays
  Clone ID: LIB143-062-Q1-E1-F4
tttgctgcactgacctcgtcaagctcaacctctcggacaagaccgagtgagatgagcgtggaatacatatggatcggtggatctggcatggatcccaggagcaaatccaggaccctctcaggaccagtgacctatcccagctcgctgccccactggggctacgagtgctccaacacggattaggcgcccggcgaggacacggaggtcatccctgtaccggatgctatcggtacagacccaatcaagaggggc

SEQ ID NO: 490 - DNA, 396 bp, Zea mays
  Clone ID: LIB143-062-Q1-E1-F5
tcgccggtcgatacacgcctctacactgcgtcctaataaagcagaccacagcaagaagcgtagtcgtcgccggaaggaaaggcgcggagcaagatgtcgtggcaggcgtacgtcgatgagcacctgatgtgcgagatcgaaggacaacatctcagcgccgccgccatcgtcggtcacgacggcagcgcttgggcgcagtccgagagcttccccgagttaaagcctgaggaggttgctggtatcataaaggactttgatgaacctggtactcttgcaccaactggtcttttcgttggaggtacaaagtacatggtgatccaaggtgaacctggagttgtcatccgaggaaagaagggcactgggggcattactatcatgaaaaccggcatgtccttg

SEQ ID NO: 491 - DNA, 285 bp, Zea mays
  Clone ID: LIB143-062-Q1-E1-F9
ccgtgatcaacattcacagcggtggccctgacgattcttgctgtgacaaccatgatggccgaggcccgagacctgtcatccagctccaccggtggctatggcgaggaagccatgaaagtgaggcatcagcagtggatggcggagcatggccgcacctacagggactaggctgagaaggcgcaccggttccaggtattcaatgcgaacaccgattttgttgacgcgtccaatgccgcatgtgacgacaagaagagctatcggctggagcccaacgagttcgccgac

SEQ ID NO: 492 - DNA, 221 bp, Zea mays
  Clone ID: LIB143-062-Q1-E1-G10
cggcggcggcaagaacaataataaccaaaagcctttcctggcattggacctaaggcatgcataacggattcctcccggttggcaaaccgtacaaaattacacagcgtgctaccatgaaacttgtacataaaacgccggttaattaattgtaaccttaccatggaaatgtgctttatacgtatccccgtatgcaatatatatgaattatcacttatcaataa

SEQ ID NO: 493 - DNA, 241 bp, Zea mays
  Clone ID: LIB143-062-Q1-E1-G11
gctcctcccacgtcccaatccccccctcgcgtgccccgcgggttccgtcccgccgtgtcaccccgctgtgtcggccgtcgcgggggaaggatgccaaacaggctcctaaggatttccttcatatcaatgattttgacaaggatacaataatgaatatccttaatcgagcgatcgaggttaaggcagcgataaagtctggagacaggagcttccaaccattcaatgggaaatcaatggcgat

SEQ ID NO: 494 - DNA, 117 bp, Zea mays
  Clone ID: LIB143-062-Q1-E1-G12
cctaatggtaatttttggagttggtggttgcaagccaacaatggaccgccggtgaaacctttaataaaggtaaccgcagttaataatgaattaaaaagaacgcatggctattgtatt

SEQ ID NO: 495 - DNA, 141 bp, Zea mays
  Clone ID: LIB143-062-Q1-E1-G2
cccaacccccaacaatgattcatagtattggccaaaaccaacaaaccgaaaaaccaaaaggccaccaagaattgcccgaaattaaaaaactggttaaaaaaaaggaaccaccaccaggacgccctacctaagcaaaccgat

SEQ ID NO: 496 - DNA, 277 bp, Zea mays
  Clone ID: LIB143-062-Q1-E1-G3
gtcgtagtagccgcttgatcaatctccctggtcgctagcacggccggacacagtacacgaaggtgcagggcagttgcagacatctgcaagaacacccaggtcgcggatctgcttcaccgtgtggacctcctagccctgccagtcgtacatctgtgccgcactcatctaggtacgatcatcaggaccatttcaactatgacgccgcgtgccacgagtacgatcagttctccacttccaactggatgtatagaaaccaaggcaagaccagtgtccgctc

SEQ ID NO: 497 - DNA, 380 bp, Zea mays
  Clone ID: LIB143-062-Q1-E1-G4
aacggaagccctaacgggttcgtcaagaactcctggggcacctcctggggcgagggtggctacatccggatgcagcgcggcgccggcaacggcggcctctgcggcatcgccatggaggcgtccttccccatcaagacctcgcccaaccctgcagacccgccgcgcaagccccgccgcgcgctcatcgccagggacacctcttcttcccagtgacacacacgaccacaactggcacgtaagtacacgttgccaggaatgacatgctatgctactagtgtttgcttgaactattatcgattgggtttgtactagtgatgacagtttcatcgattgcgcggtcgatctccatcagagacagagacgatataatcaggataaag

SEQ ID NO: 498 - DNA, 379 bp, Zea mays
  Clone ID: LIB143-062-Q1-E1-G5
actagttcctagatcgcgagcggcgcccttttttttttttttttttttttttttttttttttttttttttttttttttttttttttttggtccatcgaacaaccattcccacgctatagtttttgtacacaagcaggatcattttaaatcttgagaagatataggtcaacaacagccgctacattacgacagccaccaccatgagcaaccggtgctctggatcagaccaaaaccatgacaacgacagactagaactagagttcttcaatgtttcgacaggtctggcgaaccacaaacacaaggatgttttttcatggttccttattgtgccctttcgggcacgatgagcatcctcctgcactagtcggctgtccagctc

SEQ ID NO: 499 - DNA, 362 bp, Zea mays
  unsure at all n locations
  Clone ID: LIB143-062-Q1-E1-G7
gtgactcggtcgcatcttccccattctccatcgacccaccggcggcggcgcaagtgaagcgaagaggaaaggaagctacgagatgtcggcgaccactgcagcggtgcccttctggcgggcggcggggatgacctacatcggctactccaacatctgcgctgcgctggtccggaactgcctcaaggagcccttcaagtctgaggccgcgtcncgcgagaaggttcatttctccatttccaagtggacggatggcaagcaggagaagccaactgtccgcacagaatcggatgactaagggctggcgccatggcgacatagtccttcctacagatgatttgaagcgtcgttgcaagtttctggga

SEQ ID NO: 500 - DNA, 431 bp, Zea mays
  Clone ID: LIB143-062-Q1-E1-G9
gggcggcacggcacccggattgatcgggtggtggccggccaaggccgtcaccttcgtcgacaaccacgacactggctccacgcagcacatgtggccgttccccgccgacaaggtcatgcagggctacgcctacatcctcacgcaccccgggaacccatccatcttctacgatcacttcttcgactggggcctcaagaacgagatcgcgcacctggtgtccatcagggaccgccacgggatccaggcggacagtgagctgcgcatcatcgaggccgacgccgacctctacctcgctgagatcgacggcaaggtcatcgtgaagattggatcaagatacgactgcgggcacctcatcccagaaggcttccaggtcgtggcgcacggagatggctatgccgtctgggagaaaaactgagccaaatctgtgcctg

SEQ ID NO: 501 - DNA, 357 bp, Zea mays
  unsure at all n locations
  Clone ID: LIB143-062-Q1-E1-F2
ttatagtgttcctttaaccaactgggtaatacaagaaggcaacagcaaattctaggacctgtgcgttnagaggcccccatcattgtatacttgtgctggttgtggcttggaacctgagcaacaactttgggaaatgaacctcttggccgaaaacctgatacacagctctatgatgttgtattggcaatttgtgcttctcaaggggaagctgctgctgttcgacgcttgcttgcangagtcgagtcaaccagcgccggaagaaggaagaagtctatgtcatggctactgcgaggctatgtcaaaggtggcttcattctagacgcctcagaaacactcatacagatgctggacatgggc

SEQ ID NO: 502 - DNA, 385 bp, Zea mays
  Clone ID: LIB143-062-Q1-E1-H1
catccgtttcgtctctttgctcgcatctggcctcaagcccctcaggcctcagctcaccaccacgaaccaaccgacagaaagagggacgaatggcgagctctcagtgctgcgataacccgccggccctgaacccggcctgcggggagggcaaggtcgtcgacagcttcggcgggctcaaggcctacgtcgccggccccgaggactccaaggccgccgtcgtcctcgtcgccgacgtcttcggattcgaagcgccgattatgaggaagatagccgacaaggttgcttcgtcagggtactttgttgtggtaccagatttgtttcatggggattcttatgcacctgagaatgttgagaagcccttcctgtgtggataagtcacatactc

SEQ ID NO: 503 - DNA, 360 bp, Zea mays
  Clone ID: LIB143-062-Q1-E1-D6
aggagtttgttctgcaaggtttttatgcttttaatttctatttccttaacgaaacctcaggcaccttaaagacagcttggatgattggtttcatgaacagctagagaacttggatgatgattatcttgtgtttgattgccctaatatattctcaaatcatcttttcatgctttagttgtttcttaatagttgcacagtttcatctcactcatattcttgccacttacatgtatgtgacaaaacagacaatccgtcttttttattgcttatggcgttgtgcattatacatgtccaccaattatatacaaataccatttgtgggttacctctggtgtgtttacgtgcgagctgcaatcaaag

SEQ ID NO: 504 - DNA, 282 bp, Zea mays
  Clone ID: LIB143-062-Q1-E1-D8
agagaggatataacgaaggggatggattacatcggcccgtcacactcagtctttcatctgctgtgtcaccgggtatcaagagcatgttaggaacttgtcggtttttacgtcgcttagaacttctcgtcgacataaagcttttctaagcttttgagtagttgtgaacattttagacaatcgtgaacatatggtggttgatatgtgtccagtatggttttttaattgtcaacatgtagtggttgattagttatgaacactacgtagacactaaaaatcattaca

SEQ ID NO: 505 - DNA, 431 bp, Zea mays
  Clone ID: LIB143-062-Q1-E1-E10
cgggtccgaccaagccttcgaaagatgttggccccaacaataaccacctaatttgattgaggcatggtttgccaacggaaccccatttagttaatggccggaaccggtggttccccttcttcagggctcaaggtcaatcagttgtggtcacacttttccatttttacgttcagctaaactgaccccctgtctcatggtgtgccagcccccatgatcctcttctttgttttatccattgtttttgctttgatgagactattctggaataatatcatggaatgcactcttgttgcttcggtaggtgcaactgtgcaaggataggcaacaagtgttcaacaatatgtctgtggatcaattgacctgcatttcagcttttagttgaggatcaaaatctcgtgtcgttcaaggccctcggtagagagacattaatg

SEQ ID NO: 506 - DNA, 376 bp, Zea mays
  Clone ID: LIB143-062-Q1-E1-E11
aagcgacctagcttgattgatgcatggtttgtctactgaatctcaattagtttatgggctgaatctgttggtcctcctcctcaaggcgcaagggcaatcagttgtggtcacacttttccatttttacgttcaactaaactgaccccctgtctcatggtgtgccagcccccatgatcctcttcgttgttttatccattgtttttgctttgatgagactattctggaataatatcatggaatgcactcttgttgcttcggtaggtgcaactgtgcaaggataggcaacaagtgttcaacaatatgtctgtggatcaattgacctgcatttcagcttttagttgaggatcaaaatcccgtgtcgttcagggccctcggt

SEQ ID NO: 507 - DNA, 343 bp, Zea mays
  Clone ID: LIB143-062-Q1-E1-E12
taaaaggaggcacggaaatttcaagccattgttcaaaaaggctatggccaaacttgatgcggcacctttcaagaaatatgcatcgatgcttgatgattgggccctcaagaacagatacatcagccctggccccatccatttcattggccctggaagtaatgactcgaaccatactttgatgctggaactcggtgctgcgctatagagatgcgtcctttactttgttcttacagtttttgggagtggagactggccactggagcagcctgcaagtctccatattgtgtgtgaaattgtttaataagaggtttgatgggagttttttgcgtagccgactggatgt

SEQ ID NO: 508 - DNA, 365 bp, Zea mays
  Clone ID: LIB143-062-Q1-E1-E3
cggacgcttgggcagacccttggggccttcaactgaaaaaggtaaaccaacaattccgggtaaaccaaaaattaagtcaaaggacaaaaaaaaaaacataaaaggccaaaaacaagacaagaacataaaaacaacaacatcggcataaggatcggagtaaagacaaagataaagacaaagacaaggataagaaaaaagataaaagtggccatcatgaaaagaagaggaagcatgagggaacagaagattcagtagatgtgcataagcacaagaagagtaagcacaagagctccaaaaccgatgagatggggaatggagttagttaacacttcctagctctacctccaatccttgtaatttgctgt

SEQ ID NO: 509 - DNA, 370 bp, Zea mays
  Clone ID: LIB143-062-Q1-E1-E4
aacaccggccaattccaaatcccctcccgaagccaaaacccaaaaccaaaacctttaaccggcggcggcggcaacaacaagaatggcaatccggcaacaacggtcccaaagccccttccaagggccatcgacttcaccccggattgaaccaatgtcttcggacaatgaggtcagggaggaaaaggagctcgacctctcctccaacgacgttgtcaccaagtacaaggctgccgccgaaatcctcaacaacgctctgaagattgttgtgtctcagtgcaagccaaaagtcaagattgttgacctttgcgagaagggcgactctttcataagagagcaaactgggaatgtttacaagaacgcaaagaggaag

SEQ ID NO: 510 - DNA, 375 bp, Zea mays
  Clone ID: LIB143-062-Q1-E1-E5
taaaatgaatgatgaaaaagtcgtttctacaatactgtagctggcagtgatgaggaggccccatctcgttgcaccccggaagtagtgcacttcattgttcagcagcattttgatgctccatcaatgtgggcaatctttccacttcaggacctccttgcactgaaagacaagtacaccaaaagaccagcgccagaggaaacaatcaatgaccccactaacccaaagcactattggagattccgtgtccacgtgacattggagtccctgctgaacgacaaggacatccaggcaaccatcaaggacctggtcacaagcagcgggaggtccttccccggaaagaatgcggaaggtgccgacaagagcggcgagaagctg

SEQ ID NO: 511 - DNA, 407 bp, Zea mays
  Clone ID: LIB143-062-Q1-E1-E6
ctcgcgggtcgacacacgcctctagcgacagtcatagaaagaccgacgcgccggcagatcccaagctcaccggagagggggaagagggcgaccgaaggcggcgatgggtttcatcatggacttcgcggagaatctgatcctccgtctgatggaggacccggacaagcgcgaccaggttcggcgggagcatgtctacaagatgaaggagcggtgcgagcgcactaaggcggcgtggagcctccctctgcgcccctacggcttctggaccttcgaccgcttcaactcgcagctctcctgggatccccagatcagccaggccgccggccgtcgggacccctacgacgacctcatcgcccgccactctggctcgccgccgtcttcctgaacacccgttccgatccttgccc

SEQ ID NO: 512 - DNA, 342 bp, Zea mays
  unsure at all n locations
  Clone ID: LIB143-062-Q1-E1-E7
tcgcgggtcgacacaagcctctacagtcactcgtgcgatcccggaaagatcgacctttatgttggcaagaccgttgtgcagcgcgccatcgccatggaaggtgcaactgacgccttgatccagctgatcaaggaccatggccgatgggtggatcctcctgccgaggagtanggctgtaggctgtagccaagtctgtagtttatatattctgtaaagcgaaacacgcaatgcaggaactgagcatacaatgtacatcatccctacacattttgtacatttattgagatctgagaaataaattagaaaccttcggtgaaaaaaaaaaaaaaaaaacaaacaaaa

SEQ ID NO: 513 - DNA, 375 bp, Zea mays
  Clone ID: LIB143-062-Q1-E1-E8
ccctggcggcgtccgcggcaggatggcggaatctacggcgaggacggtgaaggatgtcaacccgcacgagttcgtcaaggcctactccgcccacctcaagcgctccggcaagatggagctccctgagtgggttgacattgtgaagactgcgaggttcaaggagcttcctccttatgatcctgactggtactacatcagggctgcatccattgcaaggaagatctacctaaggcaaggcatcggtgtgggtggctttcagaagatctacggtggccgccagaggaatggctcccgcccaccacacttctgcaagagcagtggtgctgttgcacgcaacatcctgcagcagctgcagattatgggcatcatcgatgt

SEQ ID NO: 514 - DNA, 417 bp, Zea mays
  Clone ID: LIB143-062-Q1-E1-E9
acccccaacaaatactcaaataacaagcggcgcccttttttttttttttttttttttttttttttttttttttttttttttttttttttttttttggcccatcgaaaaaccattcccacgcaaaagtttttgtacacaagcaggatcattttaaatcttgagaagatataggtcaacaacagccgctacattacgacagccaccaccatgagcaaccggtgctctggatcagaccaaaaccatgacaacgacagactagaactagagttcttcaatgtttcgacaggtctggcgaaccacaaacacaaggatgttttttcatggttccttattgtgccctttcgggcacgatgagcatcctcctgcactagtcggctgtccagctctgctccacaatctcgcggactttgcggttgt

SEQ ID NO: 515 - DNA, 357 bp, Zea mays
  unsure at all n locations
  Clone ID: LIB143-062-Q1-E1-F1
acatgctgttcacaacgacacacgacaagcagaccgaagccctaattgctgtgtatgaaggagaaggggaacgtgctgaagataaccatctgttanggtacttcaagattactggaattccggcagcccctaagggagcagttgatatcagtgtatgcatggatatcgatgctgccaatgtcctcagggtgttcgcangggtcgtcaagcctcaaggcccagccattccaccgttcatcgaggtgaggatgccaacgctggacgatggccatggttggtgtgggcaagctctagcaaagatgtatgggaggattctcgaccttgctgttcttccgaagaagctgcagccatgatatg

SEQ ID NO: 516 - DNA, 294 bp, Zea mays
  unsure at all n locations
  Clone ID: LIB143-062-Q1-E1-F10
ccaatccacanaggaggttctcaatgagagcatacatccattccccatcattggttcgaagattgttcggtctggcacccccccggttggtggggtggggtcaagtgatggatgttctgcatggtcatatggtggccggtggcgcaatcatcacctacttcggcgatgcgtcctcactggcagtcacactggttgagttcacggtcctcgcggaagtgtacatctggcgcgtgggaatgagtgggcgttttcctgacatctacagggtgcatgtggtagaggaccgggttgagg

SEQ ID NO: 517 - DNA, 380 bp, Zea mays
  Clone ID: LIB143-062-Q1-E1-F11
gtggccggcaaaacaaaggctgtaaccgccttcccaaaggcggtgctaaggtcaagggccggtcttggaaggccacaacagcccactggctcgttcctcttcctgggtccgactggcgtggggaaaactgagctggccaaggccctagccgaacagctgttcgacgacgagaaccttcttgtccgcatcgacatgtcggagtacatggagcagcactcggttgctcgcctcatcggagcaccacctggctacgtcggccatgaagagggtgggcagctgactgaacaagtgaggaggaggccgtacagcgtgatcctgttcgacgaagtcgagaaggcccatgtcgccgtgttcaacaccctgctccaggtcctcgacga

SEQ ID NO: 518 - DNA, 263 bp, Zea mays
  Clone ID: LIB143-062-Q1-E1-F12
gggggagggtgtgagagcagttttcggtagtcgttcttcagttcgaggcttgctcgtggactccccgcagcgtccagttgggggggagccgattcagtcatggtatgctttgtcggtattctgctgatgcgatggatcttctccaccgactctgctgcgcccacaactgtcgtcataggcatggaacttcgcatctacatgaggtatcacttcggttgtaggctgatgagaggatcatttggggagatctaccacgacaacgg

SEQ ID NO: 519 - DNA, 389 bp, Zea mays
  Clone ID: LIB143-062-Q1-E1-D5
ctcgcggttcgacccacgcctctacagtcactcgggacaaattagctagcttcttctagctctagctaggctcgtctgctgcaagaaggtaacagtaacagcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcgggatccagggcatcgcctggt

SEQ ID NO: 520 - DNA, 368 bp, Zea mays
  Clone ID: LIB143-062-Q1-E1-B7
actttgtacctgagggccagccgctggaaagcgagccaaatgagccactgcgagtgaatgtgctcttcaagcacgtccagaagatgttgactggtgatagcgcggtgattgctgagactggtgactcctggttcaactgccagaagcttaagctgccagaaggctgtgggtatgaattccaaatgcagtatggttcgattggatggtcagtgggtgcattgctcggatatgctcagggtgcgaaccacaagcgtgtgattgccttcattggtgatgggagcttccaggttacagcacaggatgtgtcaactatgctgcgatgtgagcagaacagcataatcttcctgatcaacaacggtgggtacacg

SEQ ID NO: 521 - DNA, 348 bp, Zea mays
  Clone ID: LIB143-062-Q1-E1-B8
acacatctgctaataaggatggctgccctaacacaaactacagatggtcctcgcctcggcgagcaggagatgaagaagatgtctccctccttccatccaactctgtggggagatttctttctttcttacgaggctccgaccgaggcacaggaagctcaaatgagagaaaatgctggagtgctaaaggaagaagtgagaaacatgattaaaggttcacatgatgtgcccgaaatagtggaccttattaacaccctgcagcgactaaatctggactaccactacgacgatgagataaccgaaaagttgactgttgtttacaactccaattatgatggtggtaatttggac

SEQ ID NO: 522 - DNA, 335 bp, Zea mays
  Clone ID: LIB143-062-Q1-E1-B9
tttttctccttttgaaccttgtccctcgtcgacatctgaccgacattgatcaagattttttttagtaccgagtgacgaagagttgatatggagctgacgatcatttgaattgatttcgttgtgcaagacttgtattacataaacatttaaatacatgtagctgaacatttcagtagaaatgctacggttgtggtctcccatcgttgactttcattagcgtggtggtaaacatcggttctgctcctgtcctgtattcatcggacgcaagtataacacaagcttggcttgggaggaggaagcacaaggagctattgccacctagcaaaaggataaaa

SEQ ID NO: 523 - DNA, 355 bp, Zea mays
  unsure at all n locations
  Clone ID: LIB143-062-Q1-E1-C1
tgctctccgaccccgagctccgaaggccgcagcatcaggcgcgccccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcanggcaagagaagtttggtggcctcagggatggatactatatccatggccagtgtgcgatcatcatgtttgatgtaacctc

SEQ ID NO: 524 - DNA, 420 bp, Zea mays
  Clone ID: LIB143-062-Q1-E1-C11
gggccgacccacgcgtctaggctgttccggacgacgacggcggagaaggcggcggaggcgctcggcgtcgtcgtccccgtggtggagacgctggagcaggcgttcagggagtgctccaaagggaaacccttcttcggcggcgacgccgtcgggctcgtggacatcgcgctcgggagcttcgtggtgtggatcagggtggtcgacgaggcggccggcgtaaagcttctggacgaggccaagttcccggccttgacggcgtgggcggagcgcttcttggcagtggacgccgtgaaggaggtgatgccggacgccggaaggctgttggagcactacaagggatttctggctaaacggtctccacctgctggttactgatcgctgtaactgtaagcctgtaacagcaagctcagtgttcgtgta

SEQ ID NO: 525 - DNA, 282 bp, Zea mays
  Clone ID: LIB143-062-Q1-E1-C12
ccggatggccccggatgcattcatgcactggtcggttctgaaaccctgctttggtaactgctccgtcgcggtcgctgtcatcaggctccaaagaatcctcctatgcatccgtatcggcgtaggtaccatcatcatcaatcttcgcgacgacgcacaattcacccctgtaatcggcatcatccgcttccctactcgcagttggtctgctgcaggaagtcatgcgccaatccagctcggcggcttcctacctcaatagatttctgcgccacatcgcgtcagatg

SEQ ID NO: 526 - DNA, 196 bp, Zea mays
  Clone ID: LIB143-062-Q1-E1-C2
cagttaatggttcaattggaagccacatttttccagcttgtcaagggtgaacgggccaatacagaggaatatttattttgccaagttcggacactttgacgacgaatgatgatgcacagggaatccgtcatatgatgcaataccggtgccattaaagtttcaggtttgcaacccttagccaatgcgctagcgtgtc

SEQ ID NO: 527 - DNA, 394 bp, Zea mays
  unsure at all n locations
  Clone ID: LIB143-062-Q1-E1-C4
agccttcaaggagttttgtaatttccggaaaacggcaatggggtgatcctaaagcccaataagggggaaccatttcccaagaaagttaattgcaaaatcctggttccaaataaaaggcctgaattaaccgttggaattgccaagaaaaaacaacaaaaaaaaattccctcccaacctaagttgggcaacaaaattgtccttgaacctaagaagccttgcaattaaaaattggggagttccctctcactttgggcattgacacantaagctcgacagactttttatgaaagggccagaaggacgtggagacgtggaagtagctgtctctggcattgcagatcaaagcagtgggaagtcgaagaaagatcaggagatagctttcgagtccttgttc

SEQ ID NO: 528 - DNA, 389 bp, Zea mays
  Clone ID: LIB143-062-Q1-E1-C5
aggaatgtgtctcaagaaaaggagttcatcaaagtattttatatactatattatatgatatggtgaattaagtctgatgtaataacagtgtgtaaattaatgtataacgagcgaataacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaagggggggccccccaaaaggttcaagccttacttacgctttaatgaaaggtaaaaccccttcaaaagggccaccaaattcaaattcacgggccttctttttaaaaagccggaacgggaaaaaccttgggtttaccaaacttaagccctttgaaaaaaaaccccctttc

SEQ ID NO: 529 - DNA, 378 bp, Zea mays
  Clone ID: LIB143-062-Q1-E1-C6
acacagcttcgaccgatcagaatctctatgctgaatcaaatacagggtcgtctcctgcatccactgaggacattgacataagtactctggctgtggaaagtgaagtggcggctgagaatgatggcccaattaacagtcaggtgcatgaaactgtagctctagaaaatgtggaaatgaaagatgatgtttcttctgctgaaaatgagcataacagatcgagcagccctgttattcatttagaggacccactagtgtctttgaaggatgttgagcagcatggtccaactcctactaaggactttgttgtacctaacacagaagaccaacaagaagccagagatatcagcttgcaggtacaagctgtggattccatgaaag

SEQ ID NO: 530 - DNA, 223 bp, Zea mays
  Clone ID: LIB143-062-Q1-E1-C7
tacaagactctagagtgagtcgtatgtatggccgcccctatgctgattctttagcatgcaccgcacatgcgtgccataacgaaatcgacaacttgacactggaggtcagcattgaagtggaagcagagaccaaaggcgactctggcagttcggagcaagaatatgtatctcgcatttatgtaggcatgcgacgagtagagccctccactcaaaccagccatag

SEQ ID NO: 531 - DNA, 392 bp, Zea mays
  Clone ID: LIB143-062-Q1-E1-C8
acccacgcgtccgaaaagagtaagattagatttgctggacatgatgaacaagatgatggtggtgacagggaagatgctataattgagcagatggcacaaaatctggtgattgatggcaatggtgatgccaagggagtagtgttggaaaaacctatcctgaggagtaaggatttcagatcagatttttctagagggcatcatgtatcaagtcagagaataagattccagaggagaaacaggccatgtcgatatgacatagatcgatttacacctaacttcttgtcaatttttgaatctttggtgccctctgaagaggaaattgcaaaccagaaacagttgttaacatctctaagcagactgataaacacagaatggcctaattcaaaactata

SEQ ID NO: 532 - DNA, 304 bp, Zea mays
  Clone ID: LIB143-062-Q1-E1-C9
gccagggtttgacagggaatgagttcctgataaagccccctcgcggaagcaacaagatttgttccagcttgagacaggagctgcggctgcggaggaattcagcaaaggcatggttctttccggaacgcagggcaacctgccgatggcaacaatgcacaccggcgggtctccgtacctgaggctgcacgacaggcacacacagcatcacagacatagcgctaacggccggtacatgtcgccactggatgtggtggctgcagaggtcaacaaccagcaactcacggtcgtgcccgtgggcacagga

SEQ ID NO: 533 - DNA, 152 bp, Zea mays
  Clone ID: LIB143-062-Q1-E1-D10
cactggaacagacacgaaaagatcagatatatattccccttgagggagtcgaacaagggaaggtggaggctactttcaagccaacatcagtagatgtaaagtttcatgatgtcaaaggcaagaattatcggtgtgccattacaaagctgaac

SEQ ID NO: 534 - DNA, 326 bp, Zea mays
  Clone ID: LIB143-062-Q1-E1-D11
cattttcgggatatacagcgacacatatctatcgatggccatgatgatgaagaagggcggcgccgcaacaccagcggtggcagcattggcgttggtcctgctggcggcggcggcggttagggcggacgtgaactgcgcggacgtggacgcaagcctgcgcccctgcgtcggcaacgtgacgggcacagatgcggccccggccgccgagtgctgcgccggcatgaagcggatcaaggccatgccgtccagcccggcggatcggcggcaggcgtgcgagtgcgtcaagcatgaggcggccaattaccagccgctcaacgccgacacca

SEQ ID NO: 535 - DNA, 393 bp, Zea mays
  Clone ID: LIB143-062-Q1-E1-D12
aaaactccttcccttcgctggtgataaggtctccttgctgcggcggcaattgcggttgcggctccagctgctcctgcggaaccggatgcaacggctgcggtatgtaccctgacgtggaaaccgccgccaccagcagcgtcaagaccacggtcctcgccgcgccgaccaccaaggccagcgccggcggcttcgaggcggccaccgagggcggcggctgcgactgcaacacctgcaagtgcggcaccagctgcggctgctcctgctgcagctgcaactgagctggcccggcccggcgatggcgcacgagagtcgagaggaggaggacgacgacgaagcgtataaatataatagcggcgtccagtaaataagatcctgtcaactgcacccgccatt

SEQ ID NO: 536 - DNA, 149 bp, Zea mays
  Clone ID: LIB143-062-Q1-E1-D2
atgagttgcaacattgcctcaataatttgcccgcgcaattcttgattttgatgcatgtaattctttgtcagttgcatgtgctgcagtccctgcgtgcagactcatttcgtgtctttcgttctgcccacaaaataaattctttctgcgtt

SEQ ID NO: 537 - DNA, 332 bp, Zea mays
  Clone ID: LIB143-062-Q1-E1-D3
aagccaaccagcacacaaaggtccacaaagctctctccctcccccctctctctctctctctcctgttccccgctagagtcgctcacggctgcggtcatgagaaccggcaacgcgtcacctctccaatggcatccccgtccctcctccgtgcaacctgtgcgcttctcgagtgctgaggctccctgtccctaagacaagcttgcgcgcgcgatggagggtttttcgagggacttgctgtgctggattggcaatggggacgcgccgccaccggagaacatgccggggcagctgcaggatgagatggaagacgtggatcttagcctctggctgtc

SEQ ID NO: 538 - DNA, 355 bp, Zea mays
  Clone ID: LIB143-062-Q1-E1-D4
atgcaaattttctcaactgtcttttgacattgtccagcgaggctgaagcaagaaactgtgaagtagtttggaaccgccagaacagctcctgtttttttcacagcacagtagatggtttgatgtgttttgtaacaaggattatttccccacattttggcagccgaataattatcttttaaacttttcggtgttcctcccgtctctatgcactgccgagcaacaattccaagccacgcgcgtcgttacccgtgctgcaaggaaaaacgcctgttgtactttttgcacatataaacattttgcacatataaacatttctcttaagcaaactcaaatttcaatttcccgcctgggggtt

SEQ ID NO: 539 - DNA, 264 bp, Zea mays
  Clone ID: LIB143-062-Q1-E1-B6
cacgcatctacgatgagtcggtcaacaacgacgagatcgccgctgacctcaaggagcacgtcatcaatcacgtgatgcctgataagtacctcgacgagaagaccatcttccacgtcaagcagtctgggcgctttgtcataggtcggccttacggtaactccggtctcagcggacgcgcgatcatcaatgacacttcccgccgcttgggaacccagagtggtggctccttctcacgctgtgacggcacattagtcgacggcagtg

SEQ ID NO: 540 - DNA, 406 bp, Zea mays
  Clone ID: LIB143-061-Q1-E1-H9
agcagccgcatccacaacctgcctctctcgtcccctggcggcgtccgcggcaggatggcggaatctacggcgaggacggtgaaggatgtcaacccgcacgagttcgtcaaggcctactccgcccacctcaagcgctccggcaagatggagctccctgagtgggttgacattgtgaagactgcgaggttcaaggagcttcctccttatgatcctgactggtactacatcagggctgcatccattgcaaggaagatctacctaaggcaaggcatcggtgtgggtggctttcagaagatctacggtggccgccagaggaatggctcccgcccaccacacttctgcaagagcagtggtgctgttgcacgcaacatcctgcagcagctgcagattatgggcatcatcgatg

SEQ ID NO: 541 - DNA, 377 bp, Zea mays
  Clone ID: LIB143-062-Q1-E1-A1
tagtgaaagtcctatcactattgatccactcagaaagaattacacgaggtaaaaaaaaatcatcacgaaacgccctagctagttagatctacgaaatttacgacgacgaggaggattacaatggcctcgaaccagaggcatcaagacctctgctctggctgttgttccagctggactggctgaaatccgtcgtgaaatcttggctgccgaacgccatccgctggaacagcctgatctcggccgtgctcgcgacgttgaacatctcgctcttgcctggctgcacgccgttagttagatcgacatcagcgagactgtcgagcacccgcacgacctggctcatcctcggtctcctggatgctgaatgccgaatgcaagct

SEQ ID NO: 542 - DNA, 405 bp, Zea mays
  Clone ID: LIB143-062-Q1-E1-A10
cggggccgaccaacgcgtcgacttacttgtcacctgaacctggacctgacaatggaataccacctcaccccttcacaacggttccttctcgcaaaattgcccgccgtcgccgtccctctccttcggctccggcttcaccaaggctcatcaattcgccgccgtcgtcgcagcagcagcagcagatcggccaagcagggaggacagctcctgccgccttcgcccccggcgctgcccatcatcggccaccttcacctcgtcagcgacctcccgcacgtctccctccgtgacctcgccgccaagcatggtggggacgacggcctgatgctgctccgtctcggcgctgttcccacctcgtcgtgtcatcgccgcgggccgcggaggcgatcacgcgcacgcacgaccacg

SEQ ID NO: 543 - DNA, 412 bp, Zea mays
  unsure at all n locations
  Clone ID: LIB143-062-Q1-E1-A12
caaaattatggcaagattcaaaccttccaaaggtgtcaagaatggctggggtgttccggtcctggtggttgtgcaacataaggaccctgatttcaagacccacccgatgaacttcctgaacgaaaggaccctgaaggggaccttctttggcaactataagccacgcactgatctgccaaatgtggtggagctgtacatgaaaaaggacctggaggtggagaagttcatcacgcacagcgtcccgttcgccgagatcaacaaggcgttcgacctgatggccaagggggaaggcatccgctgcatcatccgcatggagaactagatttcgctgtctagtttgtgatctggcctgngcttggggttaataaaagaagcaatgctagcctgccctttcgatgangaagtacataca

SEQ ID NO: 544 - DNA, 269 bp, Zea mays
  Clone ID: LIB143-062-Q1-E1-A2
cactcacatcgaattaccccaggtaagccaagatcgtcacgaaacgccctatctaattagatctacgaaatttaccacgaccagggggaggacaaaggactcgaatcagacgcatcaagacctctgctctggctgatgttctagcaggacgggccgaaatccgtcatgaaatcttggctgtcgaaagccatccgctggaacagcctgatctcgaccgtgctcgctacgttgaagatctcgctctttcctggctgcactccgttagttag

SEQ ID NO: 545 - DNA, 355 bp, Zea mays
  unsure at all n locations
  Clone ID: LIB143-062-Q1-E1-A3
cagcgagggaaagggatcgaaaccgcggcggaggcaatggcaaccggagggaagggactcaacccaactggggagttcttccggcggagggacaattggaggaggcaccctatggcggggaaccagctgcgcaacgccaaacccgggctcggcatcgccatcgtcgccttcgggatctacctcgtcggcgaagccgcctacaaccgcctctaccgcccctccggcgacaaccaacactagatcgccggcangatccgtgactcggtcaagaagctggagccaactttaccaagcactggtgctgttgatgtttttacagttttgagctcataaggtcagccatgaccatattgta

SEQ ID NO: 546 - DNA, 353 bp, Zea mays
  Clone ID: LIB143-062-Q1-E1-A4
cggccctttttttttgttgttgctattgtgatctgttggaatggactcattgctactggggagttcttccggcgtgaaggactagtggaggaggagcctatggctgggaagcagctgcgccacgccacacccgggctcggtatcgccatcgtctgcttcgggatctagctcgtcggctaggccgcctagaaacgccgtgtaccgcgcctccggcgacgtccaggcactagatcgccggcaggatccgtgactcggtcaagaatctggcgccaactttacgatgcactggtgctgttgatgtttttagagttttgagctcatatcgtcacccatgacgatattgtaatccgtga

SEQ ID NO: 547 - DNA, 354 bp, Zea mays
  Clone ID: LIB143-062-Q1-E1-A5
gcgaaggagaaagcagaccaacctagccacccagggagaaaggccaaaagggaggggagagtgtcgtcatggcttccattgtcgcttccaggagggccgttcctctagttcgcgctctggagaagctcatcgcagcgtcctccgcgcccgggactggatccgccctcaggccggtggcagtcgccggcgggctccgtggctacaacaccggcgctccgctccgaagctacgagggggcctagtcggaagactatatcgtccgctagtacgatgggcggcacggtagccgggactacgccgtgcccagcctgttcacagatattttccgtgatgcgcttagtgcgccgcatagca

SEQ ID NO: 548 - DNA, 371 bp, Zea mays
  Clone ID: LIB143-062-Q1-E1-A6
aggcgcccttggcagcaagtgcagacctcaaaacgcgacgtcgtcgaagctggacatctacatagaggacatccggagagggaagcacgggagcgactccggctcgtacgacgcccaaggaaggttcgttcccgagaagttcgaggagatattcgccaggcacgcgaggactgtccccgacgccctgacctcggacgagatcgaccagctgctccaagcgaacagagagcccggggactacagcggctgggctggcgcggaagcggagtggaagatcctgtacagtctcggcaaggacggggacggcctcctccgcaaggacgtcgcgaggagcgtctacgacgggacactgttccaccggctcgcgccca

SEQ ID NO: 549 - DNA, 277 bp, Zea mays
  Clone ID: LIB143-062-Q1-E1-A7
aagtccagcaccagctacgcctgtgcgcgcgcttgtgcagtacctacgttggtgggtgggtatgtagctagtgcggcggagcatcgatcgcgcggtactctcagtgccagccgtcgagagatcgaccggtcgtcgatcgatactgggggtcggggacgagcctcggaggccgggccgttgctgcgtaagataggggcagatgcagcatctggccgaggctgctgctacgtggacggatgactcgggtgcgccatgcgccggtacatcgtggcaaatc

SEQ ID NO: 550 - DNA, 383 bp, Zea mays
  Clone ID: LIB143-062-Q1-E1-A8
gacccacgcaaccagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggccccccaaaaggttcaaaccttacgtccccttaaatggaacttaaaaccccttcaaaagggccaccaaatttcaattaacgggccttcttttaaaaacttcggaacgggaaaaaccctgggtttaccaaattaaacccctttgaaaaaaatccccttttcccaagtggggtaaaaaccaaaaaggccccaaccattcccccttccaaaaattttccaaccctaaatggcaaatgg

SEQ ID NO: 551 - DNA, 350 bp, Zea mays
  Clone ID: LIB143-062-Q1-E1-A9
atcccaatccccaatactgattcgtattaccagcacagactgaattctctttagctagctaagacagggtaaccacaccaaaacaggatgcagtcagcgaaggtgaaggcaaatgacatggtgagctcggcaacggaaaaggtgaacgaggggtcggcaaaaatgcatggcaagacgggcgacgcgaccgcggccacgcacggcgagaacgaaattgccaatgatgctgcccgcgccaagaacgaccagttcaacgccgacatgcaccacgacaacgtcgaccaccgaacggtcaccgccattggccactacagcacgcgcgtgcccctcaatcgcccgcacgggcatca

SEQ ID NO: 552 - DNA, 407 bp, Zea mays
  Clone ID: LIB143-062-Q1-E1-B10
aactccctatatagagtcctactattgaaccctgtctctcgtcgacatctgaccgacattgatcaagattttttttagtaccgagtgacgaagagttgatatggagctgacgatggggggattgatttcgttgtgcaagacttgtaggtacataaacatttaaatacactgtagctgaacatgtcagtacaaatgctacggttgtggtctcccatcgttgactttcattagcgtggtggtaaacatcggttctgctcctgtcctgtattcatcggacgcaagtataacacaagcttggcttgggaggaggaagcacaatgagctattgccacctagcagaaggataaaagggaggatgactaattggcgatgtgtttgtgacacgctgccctcaagtgtggatgatg

SEQ ID NO: 553 - DNA, 386 bp, Zea mays
  Clone ID: LIB143-062-Q1-E1-B11
gatggagaggagaggaacagagccaagaaacaagcccggaagatggcaggcggcggattggtgaagcacatcctgctggcaagcttcaaggaggaggtgacgcaggagcgcctggacgagctcatccgaggatacgccgcgctcgtcggcgtggtcccctccatgaaggcgttccactggggaactgatgtgagcatagaaaacatgcatcaagggttcacgcacgtcttcgagtccacgtttgaaagcacggaaggaatcaaggagtacattgagcaccctgcacacgtcgaattcgcaagtgtgttcttgcctgtgctggagaaggtcctcataatcgactacaaaccgacgtcggccaattagcggtagaacatgctctgtac

SEQ ID NO: 554 - DNA, 399 bp, Zea mays
  unsure at all n locations
  Clone ID: LIB143-062-Q1-E1-B12
ggcccgggcccccggacccggaaaacaccaagggaatccaaccaaggaaaccttggattgtggactacaggggtaaagatcgattgagcatcgctgcaccatgcgcccttcaatctgctgtgcacctctttttcttctgctactattacatttggcatttgctagacctctctttcctctaccgagtaagacaaagaatgaagagaagaagcccatacagacgtttcggccatataacattgctcatcgtggatcaaatggggaaattcccgaggaaacagctgctgcatacatganggctattgaagaaggggcggattttatagagtctgacatccttgctagcaaagatggggccttgatttgttttcatgatgtaacacttgatgatacaaccga

SEQ ID NO: 555 - DNA, 268 bp, Zea mays
  Clone ID: LIB143-062-Q1-E1-B3
gccaagggcggcaaggccgagttcaacaagctcaacgacgtcacctccttcgacttcatcggcaaggcctacttcggcgtgcgcccctcggcaaccgacctcggcaagggcgggccgagcaaggcggccaattggctcatctggcagctccacccgctggtcacgctcggcctccccatggtcctgaaggagccgctgctcaacacgttcaacctcccgcctttcctcgtcaagggcgactacagggcgctgtacaagtacttctcca

SEQ ID NO: 556 - DNA, 386 bp, Zea mays
  Clone ID: LIB143-062-Q1-E1-B5
gacccacgcatcaacggacgcgtgggccgcgctacacgcccgcgctgtctcctcccgagcgttgtatcctcccgagcgccgcaagcccgcctgcgtcgagcgccgcccgagcgcctgcggtggacggaggagctgcaccggcagttcgtcgagtgcctcggtggccaggacggtgagtcagcccgcttctaatacttcccttcgtgtccgatccaaaaatatgattccatccggccatgtgggtcgctagggttccatccggccacaagagcctttttgctgcttctctgtcccttccgaccgctgtgaagcaaggcccgcctcgccgctcccgtccgggcgccgccgcagcatggctcggcaagaaagatgtccccagcagctcc

SEQ ID NO: 557 - DNA, 391 bp, Zea mays
  Clone ID: LIB143-061-Q1-E1-H8
gcacgacctgtgagggttcgaaggaagtagcagtgttttttgttcctagagggaggaagagatggcaaagggggaggggccggcgatcgggatcgacctgggaacgacgtactcgtgtgtcggcgtgtggcagcacgaccgcgtcgagatcatcgccaacgaccaggggaaccgcaccacgccgtcctacgtcgccttcaccgacaccgagcggctcatcggcgatgccgccaagaaccaggtcgccatgaaccccaccaacaccgtatttgacgcaaagcggttgattggtaggaggttctcggacccttccgttcagagtgatatgaagctatggccattcaaggtcgtggcgggccctggcgacaagccgatgatcgtggttagctac

SEQ ID NO: 558 - DNA, 284 bp, Zea mays
  Clone ID: LIB143-061-Q1-E1-G10
agagcagatccgcttcgcaagcaagaacatctcgaccgatcgacgacgactctaatcggatgccgattcgatcttcagctctcgggctatctacctagctagcaaagcatctcctctgatagtctgagcgcacctcgcaagcaagaacacctctgtcgatcgatacgtgtgcagtggggctgggcatggaggtggaggcggtcggctgcgagtgctgcggcctggaggaggagtgcacgggcgagtatatcggtggtgttgcggggtctaattcggagggaggt

SEQ ID NO: 559 - DNA, 388 bp, Zea mays
  unsure at all n locations
  Clone ID: LIB143-061-Q1-E1-G11
acggacgcgtgggttgcaaaagcgaagcaagcaatccgaattctctgcgatttctctagatctcgaccacccctactagttttggttcctcctttcgttcgagagagcgtttctagtggcaatggcgaagagcgagggtccggcgatcgggatcgacctcggcaccacctactcgtgcgtcggcgtgtggcagcacgaccgggtggagatcatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcangaggttctctgacncgtcagtgcagagtgacatg

SEQ ID NO: 560 - DNA, 357 bp, Zea mays
  Clone ID: LIB143-061-Q1-E1-G3
attcactcaaacctcttccccaaatcttcgattagattctcgttgacaagaagactagaaccgaacctgaccatgtcgctgatccgccgcagcaacgtgttcgatcccttctccctcgacctctgggacccctttgagggcttccccttcggctccggcagcagcagcagtctcttcccctcgttcccgcggaccagctcggagaccgcggccttcgctggcgcgcggatcgactggaaggagactccagaggcgcacgtgttcaaggcagacgtaccggggctgaagaaggaggaggtcaaggtggaggtcgaggacggcaacgtccttcagatcagcggcgagcgcaacaaggag

SEQ ID NO: 561 - DNA, 424 bp, Zea mays
  Clone ID: LIB143-061-Q1-E1-G5
cccagacccagacagcaaggaaccttggagcctgccggcaagtctaacgacgacgatggccgaaggggacggtccaactccagcccgcggcgctcgcgtcgtgctgttcccactgccgtcgcaaggccacctcagggcgatgctgcagctcgccagcgcgctccacgcgcgggggctcgcagtcagcgtcctccacacggcgtagaacgcgccggacgccgcgcacctacccggggctagccttcgtcgccgtgcccgacgtcatcccggaggccgtggccgcgacgacgaatgggatcgcgaagatgctcgcgctgagcgcggccatggaagcatcggggcacgtcggcggggcgctcgcgtcactcctcgcagatgaaggcggcggacagcggctggcgtgcctcatcttcgacgcgaccct

SEQ ID NO: 562 - DNA, 426 bp, Zea mays
  Clone ID: LIB143-061-Q1-E1-G6
acccacgcgtccgcaaggaccttcggcgcccgttcaggatccacatcttcccgagcgagttcttggttgacctcttcccccttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgttcacgtgcgcatccagcagcgtaatggtcgcaagagcctgactaccgtccagggattgaagaaggagttcagctacagcaagatcctcaaagatctcaagaaagagttctgctgcaatggtacagtggtccaggacccagaacttggacaggtcattcagctccagggtgatcagaggaagaacgtctcg

SEQ ID NO: 563 - DNA, 372 bp, Zea mays
  Clone ID: LIB143-061-Q1-E1-G7
gcccggacagttttgcgcacaagccccccattcccattctaccaccgacccgtcccgtcccactgcctgccagcgtctcccccgctccctctcctcgagagatctcgcgctccggcgatcgggcgcggcgggcggagggtcgcgaagtgccctgcccacccccgatgctcttcccgaagcgcatcaactacgtggccccgatgctcgcctccgccgccatcctgctcctcctcctctcgggctacttcgagctcccctccatctccaccccggcgccgctcctcgcgggcgcagcgcgcttccccaccgcgctcgactccgtcggatcgcgcgaccgcgaccccttcacctcgctcctcgaggccttcgcgt

SEQ ID NO: 564 - DNA, 428 bp, Zea mays
  unsure at all n locations
  Clone ID: LIB143-061-Q1-E1-G8
gggagggtgaagcaccgccgctgaccgctgtccccggctccccgccgccgcacaaagacgagaggaagaggttcccggcggcgccacgactatgtcgtcgatgatgaacgcgctggcgaactggctggcgaacccgcgccgcaacccgctggcgcgcctccacatgcacgccgtctcctcgcgcctcaggaaatacggactgaggtacgacgacctctacgacccctacttcgatctggacatcaaggaggcgctcggtaggctgcctanggaggtggtcgacgcccgcatccagcgcctcaagcgtgccatggacctctccatgaagcaccagtacctcncggaggacctccaggcacagcaggttccattcagaggatatttgagtgacatgttggcgttggtgaaaaaggaaagcgccgagcgtc

SEQ ID NO: 565 - DNA, 331 bp, Zea mays
  Clone ID: LIB143-061-Q1-E1-G9
cagaactggggagagggaggatacctcaggctcgagagaggcgcaaacgcctgtggtgtcgcccagcaagcctcctacccggtcgcatgatgaataaagcatatattctacatatacacgaaggcatgcataaaaatggctagtaaggaataaagcatgcaaacacattgacagtacatacatacatagcttaaaattgaatcacaattgtcatgtacaacactccagatatcatttatttctatttggccttcttttcaaagatcgatattctatatatacatatatgtaagggaacaagtttttatagcataataagtccttcgcacct

SEQ ID NO: 566 - DNA, 372 bp, Zea mays
  Clone ID: LIB143-061-Q1-E1-H1
atttaagtcacgtagagcttttatagatcataactccttaaccatgactccgattttagtggttctcgatcccacgatcttgtagcatcgcgtagaatattcttacactgtttgttctcatgtttggtgtactgttatttttatatgattcttgcctatttgtatgtattgctacgattagcggtgaggtcacgagaatctgaagagcaagttggtacctggaatctcaagtgccaggcaagttgtgcccttgatcacttctttttacctattcatgttctggttaatcataatgatctgcataggttaattttgatgggaaccaataggttacccgagtttgattatctttataccttgttaccactgaac

SEQ ID NO: 567 - DNA, 390 bp, Zea mays
  unsure at all n locations
  Clone ID: LIB143-061-Q1-E1-H10
gcggcgtcgcgcacgccgtgctgctgctcaacagcaatggcatggatgtgttctacaggggcacgtcgctgacctacaaggtcatcggaggtcttctcgacttctacttcttctcgggcccgacgccgttggccatagtggatcagtacacgtcgatgatcggccgtcccgcgcccatgccttactgggcattcgggttccaccaatgtangtgggggtacaagaacctttcagtggtagagggcgttgtggaaggttaccgtaatgcccagataccgctggacgtgatctggaacgatgacgaccacatggatgccgctaaggacttcacactcgatccggtcaactacccacgccccaaactgctggcgttccttgacaagatccatg

SEQ ID NO: 568 - DNA, 274 bp, Zea mays
  Clone ID: LIB143-061-Q1-E1-H11
agaatcctcccccccctgggtggcccggccaaaatggcttgcccccccgttacctccaaccccaacgcacaaggaggatccaagggcgacaacaaccggaagtttgccggccggaacaaaggacttcccgggaaacaaaaacaacttcacctccaaggaactcgcccgccttcccgtcgattaacacaacaagaagggcaatgctcttctggggttcgaaaaacttgtgaaaggcaagacacaagtggttgctggcacgatgtactatctcact

SEQ ID NO: 569 - DNA, 213 bp, Zea mays
  Clone ID: LIB143-061-Q1-E1-H12
tgtgacctccctgggaacggcagcgagcttcacctccaccaactctcccgcttcgccgtcgatgagcacaacattaacgccaatgctcttctggggttcgagaagcttgtcaaggccaacacacaagtggttgctggcacgatgtactatcgcactattgacgtgaacgatggcaaagtgaagaggctctacgaagctaaggtctgggagaag

SEQ ID NO: 570 - DNA, 351 bp, Zea mays
  Clone ID: LIB143-061-Q1-E1-H3
atgtgaatcacagcctcaggcttctgaaagttccagggatgtttgtaattcagatcaaagatgtgcaaatggtgggagaaatcaaactacttcctgtgctagtactcttatggtaaataaacaaaattgttactcagaaaatgatgaaggctccaggcatgatgtagagctgatgacgaactctgctagttctgatagcacctcgtcatgcatgagccagggagatagggaaagcagctccagcagtacaacctcttcgagcgctcaaaatccggaatcatcttctgaatctgaggaatcaccggagagaataaacagcacagtaggtacaccatcatcaagagctgcttc

SEQ ID NO: 571 - DNA, 324 bp, Zea mays
  Clone ID: LIB143-061-Q1-E1-H4
cacaatccccagcacgctgcgacactgtgccgtacgagtggcatgttcctcaagtgctgagcagtcaccggtggtgaccgacagtatcagcaatccaggaaacaagcagatcgacagctgcggtcgacgagcgctacactcaatcgcactcgctcatcacagtcctctactactgatttgccagacacaaactcatctggacatccatcacatgcccatcttcgccaaaatatgccataactacctacacaaagtcacagcgcctgtaactatctgaacacacagctttgactgtatctaatactcttgctatcgcaatttgtc

SEQ ID NO: 572 - DNA, 349 bp, Zea mays
  Clone ID: LIB143-061-Q1-E1-H5
cccaagcgtccgcaccgtctgtggagaagcgagaggaggaaggagacagggaaaggaatggaggggaatcttcgtaaagcacgaagcagcgacggagtcatcgcagcttcgtctccttccttctttcccctttcgctggccgctggtcgtcggcaccatcacctacggtcactggcgcagcgcggggccgctccgtaccgggtccgcgggcctctcgccagggggaccctataagcctccgctgctctgctcggctgctcttaccgtctctcccgtccacggtccacttagctagaaatacacaatacacacggagaaatcgcattgaggagcagcgcctgccgccgcg

SEQ ID NO: 573 - DNA, 434 bp, Zea mays
  unsure at all n locations
  Clone ID: LIB143-061-Q1-E1-H6
gcggcagcgatgatattttagtcgtactcgtacagaagccacagccctctgctagctagctagctcctgctagaatggaaagtgcaggaggggaagctcagccggtgctgccgcagccgccgccgccgccgccggtgcaagagctcgccggcgctgcaaacgacgtgccagctcggtacgtcgcgcgcgcaggcaacgagcccaaggtcacggtaaccgcgccggtccccgtcatcgacctcgcccgcctgtgcgagccgggcggcggcgccgacgaggcctcgaagctccggctggcgctcgagtcctgnggtctcttcctggtgaccaaccacggcatcgaggccactctcatggacgccatgatggacgcgtcgagggagttcttcaggcagccgctccaggagaagcagaagcacagcaacatgatcgac

SEQ ID NO: 574 - DNA, 215 bp, Zea mays
  Clone ID: LIB143-061-Q1-E1-H7
ctgccgcagagttgacaaggtccgaatgggagttagtctgtctgtctttgcagctctgtttcttctgcacttgggtaaaaacgctgtgaaccccaaaattaggaagattcagttcagaggtgaggattaagggtgggtgtccggtctgaaatagcagtggacctttgatgcctctgtttgtcttggtctggttccagtgatagctgtatcttgtg

SEQ ID NO: 575 - DNA, 390 bp, Zea mays
  Clone ID: LIB143-061-Q1-E1-G1
ttccatcatcccccttgcaagtatagtctcggcggctctagaagacgatgggcaaggacgacgtgatcgagagcggcgctggcggcggcgagttcgctgccaaggactacacggaccctcccccggcgccgctgatcgacgcggctgagctggggtcctggtcgctgtaccgcgccgtgatcgccgagttcatcgccacgctgctgttcctgtacatcacggtggccaccgtgatcgggtacaagcaccagacggacgcgtcggcgtcgggtgccgacgcggcgtgcggcggcgtgggggtgctgggcatcgcctgggccttcggcggcatgatcttcgtcctcgtctactgcaccgccggcatcctcgggggccacatcaaacccgccg

SEQ ID NO: 576 - DNA, 421 bp, Zea mays
  Clone ID: LIB143-061-Q1-E1-E2
gcaccccacgacttccgtccgagtctgagctcatctccacgcgccgccgccgccgctcgacgcccaccgcgcagccatggcggaacagactgagaaggctttcctcaagcagcctaaggtgttcctcagctcaaagaaatctggcaagggtaagaagccaggcaagggtggcaatcgattttggaagagcattggccttggtttcaagactcccagggaagcaattgaagggacctacattgacaagaaatgtccattcactggaaccgtttctatcagaggcagaattattgctggaacatgccacagtgctaagatgaacagaaccatcattgttcgcaggaactatctccactttgttaagaaataccagaggtatgaaaagaggcactccaacattccagctcacatctccccatgc

SEQ ID NO: 577 - DNA, 407 bp, Zea mays
  Clone ID: LIB143-061-Q1-E1-E3
gtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacgcctgcggctgcggtagcagctgcaagtgcgacccctgcaactgctgatcacatcgatcgacgaccatggatatgattattatctatctagcttgtggtggtggttgaacaataataagcgaggccgagctggctgccatacataggtattgtgtggtgtgtgagagagaga

SEQ ID NO: 578 - DNA, 380 bp, Zea mays
  Clone ID: LIB143-061-Q1-E1-E5
agctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttccc

SEQ ID NO: 579 - DNA, 377 bp, Zea mays
  unsure at all n locations
  Clone ID: LIB143-061-Q1-E1-E6
ctgctcccacctctatcccaacaggtgatgccgccaccgctgcactatccatagccaccgcaagatactgaaatggcgggttctgtcatcactcacaataccattgcacatctcaaccttttccagatgacattcaagagaaagccccctggcatcacacactatagggccaagataaggctgactagtcaacacacgttcatgtactctacacccatatagatatttgttgtgcgatttatcaccaacgacatcacatcacatatcatatctgctagtacagcangtgatatggttcttgcttctgcatactcgcatgagttgccacaatatggtctcgaatttggtctgaccaactatacagctgcctactgcac

SEQ ID NO: 580 - DNA, 349 bp, Zea mays
  Clone ID: LIB143-061-Q1-E1-E7
caccgaggtgcgcaagaacggcacctgcgcctggctgaggcccgacggcaagacccaggtgacggtggagtacgtgaacgagggcggcgccatggtgcccgtccgcgtgcacaccgtgctcatctccacccagcacgacgagaccgtcaccaacgacgagatcgccgccgacctcaaggagcacgtcatcaagcccgtgatccctgagaagtacctcgacgagaagaccatcttccacctcaacccgtccgggcgcttcgtcatcggcgggccccacggtgacgccggcctcaccggccgcaagatcatcatcgacacgtacggcggctggggagcccacggcggtggc

SEQ ID NO: 581 - DNA, 278 bp, Zea mays
  Clone ID: LIB143-061-Q1-E1-E9
cggtaataccgccgttgttgccgttggttaagccgccgccgccgccaccgccgccccagcttcttccacccctggtgccggttcttcctccgggggtgcctggcgtaccgcctgcctccgcttcaacgaatcgccgccccgtgaacgtgaatcatccctgagaaaaaaacttggagctgtactgtgttgtcttttacatttacacgcacgtacgtacgaactgccgtcagctgtaattttcttgttcgtcaatctgagctgtaattttctactctacc

SEQ ID NO: 582 - DNA, 122 bp, Zea mays
  Clone ID: LIB143-061-Q1-E1-F1
cccacgcgtccgcccacgcgtccgcccacgcgtccgcccacgcgtccggctatatgcaagtgttgtacggagtactaaactcatacgtggtaaaagatgaataaagacttaaacatttcttt

SEQ ID NO: 583 - DNA, 398 bp, Zea mays
  unsure at all n locations
  Clone ID: LIB143-061-Q1-E1-F10
ctcgactgcgccgctacagcctgacgcgatggcctcgtcggcgacgagagaggttctcatgcttgaggcgcctccgccgtccgaccccgctgcggggccctggcgcgcggtgccggacgcggaggccattgacgcgctgccctacatcgacggcgactacggcgatgcggcggtgaagcgggaggtcgatcgcctcgtcgaggaggagatgcgccgagggaagcgcaagcctgcagacttcctccgggacctgccccctgttcccaccgccggattcgagaatcatcctatgcttgctaaagaatatgaacgtgttanggctggcaaacctccttttatgctagatatgtctcgctatggtttggagccacctccaatgaacaagaggaatgatgttg

SEQ ID NO: 584 - DNA, 399 bp, Zea mays
  Clone ID: LIB143-061-Q1-E1-F11
ggaaggtctcgccatggtcaacggcacggccgtgggctctggccttgcgtccaccgtgctcttcgaggccaacgtgctcgccgtcctggccgaggtcatctccgcagtgttctgcgaggtcatgacgggcaagccggagttcaccgaccacctcacgcacaagctgaagcaccaccccggacagatcgaggccgccgcggtcatggagcacatcttggaaggcagctcctacatgaagctggcgaagaggctcggcgagctcgacccgctgatgaagccgaagcaggacaggtacgcgctccgcacctccccgcagtggctcggcccacagatcgaagtcatccgcttcgccaccaagtccatcgagcgcgagatcaactccgtcaacgacaacccgct

SEQ ID NO: 585 - DNA, 161 bp, Zea mays
  Clone ID: LIB143-061-Q1-E1-F12
ttaaccgggaaaaccttttgaaaattgaaggaataacaagttatccggaaaaggttcggaaggaaacaaaaggacctaaggcccttaaggatttcacaaaagaaaataacaaaaattggttaaacaatcaatggggtaatgggaaaaccaaaaaggttcaa

SEQ ID NO: 586 - DNA, 376 bp, Zea mays
  Clone ID: LIB143-061-Q1-E1-F2
cggacgcgtgggatcgataccatgaagaagtacaacgctggtacgaacaaggcggcatccagcggtacatccctcaacaccaagcgcctcgacgacgacaccgaaaacctcgcccatgagcgagttccaagtgatctgaagaagaatctcatgcaagcaaggctcgataagaagctgacacaggcacaacttgctcagatgataaatgagaagccacaggtgattcaggagtatgaatcaggcaaggcaatccccaaccagcagatcattagcaagctcgagagggccctgggaaccaagttgcgtggcaagaaatagctttcctacgagtttgtgtcccggagcatcataatagggggaaagacaagcaagctgt

SEQ ID NO: 587 - DNA, 381 bp, Zea mays
  Clone ID: LIB143-061-Q1-E1-F3
cgtcagcagaggaagttctatttcgacctctcctctatccgctctctttcccctcgatcgacgccgacgctgctgcctcccgcggcgcagcataaaaatggggagcggcggcatccgtaacgccaggccctcctcctggctcgccgccgtggccgccgctgccgcaccaccaatcgcccacgccgtcctcctcacctccggccacctctcctcccgtgcctccgccaactccctcctccgcgtcgccccctgctcctccgcctgcgcgctcatcctccgcctcctgctgctccaccgcctccgacccgaccacatctccctctccttctccctgcacgcctgcgcccgcgtcgtccccaccaacagcccgctaccgctcac

SEQ ID NO: 588 - DNA, 405 bp, Zea mays
  unsure at all n locations
  Clone ID: LIB143-061-Q1-E1-F4
agcgcttcgcaagcacaggcagtgatcggcaaccaaatccggacagtcttgagctctctcagtctcagcatttcagttcccagattcacatagccccagccccacaagtagcgaaatggcagctgctccgttcgcgattgccggccggctctcccccgttgcgcgcctcccggtccgcgcctggaggccggcgcacgggtttgcgtcgtccgggagagcccgctcgctcgccgtggcgtccgcggcgcaggagaacagggacaacagtgtcgacgtacaggttagccagaacggcggcaacaggcagcagggcaacgccgtgcagcgccgcccgcgccgcgcgacagcgctcgacatctcnccatccccgttcgggttagttgatccgatgtcgccgatgcggac

SEQ ID NO: 589 - DNA, 377 bp, Zea mays
  Clone ID: LIB143-061-Q1-E1-F5
agtcaacgttctcatggccgtgttgctgggccatgaccacgggcacggccacggccatggacatggacattcgcatgaccatggccacggccatggggattcggacgatggccattcccaccacgacgacgaggagcaagaacagggccgtgtccatcaccacgagcacggccatggaggcgctatcactgtcacaacccaccaccaccaccatcatcacgatcacgatgttgaggaggcgctgatcaagcatgagggtacccagtctgctggcagagctggtaagaagcctcggcggaacatcaacgtgcacagcgcatacctccacgtgctcggggactccgtccagagcgtcggggtcatggtgggcggggcga

SEQ ID NO: 590 - DNA, 395 bp, Zea mays
  Clone ID: LIB143-061-Q1-E1-F6
acaggtcaccaggctatggtgtatcgttagttgctgagaccactacgggatgcctgctctctgtagatgtcactgtgagttatcctagtgttgatgaaataaatgaagaatctgagaagcctgagctgacttctccggaggatcttggtgttcaagctgcatcaatgctactagaagaggtggctcaaggaggtgttgttgattctacacatcagggcctcctatttattctgtgtgctttatgcccaccggatgtatcaaaggttcgtgtgggacagttgactccatatggtatagagacacttcgaaacatcagagattttcttgacgtcaagttcatcatcaagcctgatcccaattcaaacacggttacttttaaatgtgttggcgcggga

SEQ ID NO: 591 - DNA, 409 bp, Zea mays
  Clone ID: LIB143-061-Q1-E1-F7
cccaccccgcagccgccctagcacccgcgacgagcaggatctgcccagttgctcttgcggtagttcccccaactgtcaccatgcagaacgaggagggtaagactgtggacctctatgtccccaggaagtgctcggccacaaacaggatcatcactgccaaggaccatgcctctgtccagatcaacattggccacttggatgcgaatggcctgtatgatggtcacttcacaacgtttgctctctctgggtttgtccgtgctcagggtgacgcagacagctccttggacaggctgtggcaaaagaagaaggctgatatcaagcagtagattttacatctagtttaccaagaattggacaccgccttagctatgttttgaattcatgtcactatatgcaatgttgtgatttc

SEQ ID NO: 592 - DNA, 222 bp, Zea mays
  Clone ID: LIB143-061-Q1-E1-F8
ctatgatctgccttatgaagggggacacacttttgtgggtgtaaatgtgttactccaagcaacaagtaacccaacgatcatgatgcttgttacggtttactagtaccttatccatgcctttgtgctcgcgtttacctgtggttgcatatcaagtattattagcacgtcatgtcgtctaactaggatagattgtcttaggggccttcggcttccgaaggtcct

SEQ ID NO: 593 - DNA, 404 bp, Zea mays
  Clone ID: LIB143-061-Q1-E1-F9
cccacgcgtccgcccacgcgtccgctttgaccgcagacaggactgtgacaagcttcaaaatagattcttatcacgcaatccagcaaaggttatcttgtcaagcatggaggttgttgcgcaatcaatgggatttaagacacacattcgcaattataagatgagggtggaaggtctaaatgccgacaagactagtcatctctcagttatggttgaagttttcgaagttgctccatcaatcttcatggtagaactacaaagagcagcaggagatacttcagagtataacacgttcgtaaataactactgcggcaaattagatgatatcatctggaaatttccaactgagaagggaaaatcaaggataccccggttatcaaagtctcattcataatctagtgctgtgt

SEQ ID NO: 594 - DNA, 73 bp, Zea mays
  Clone ID: LIB143-061-Q1-E1-E12
tcgtattagggcaagcaatgatccgaagctcaatcaagtcacgcaaacctcttccccaaatcttctatgagat

SEQ ID NO: 595 - DNA, 384 bp, Zea mays
  Clone ID: LIB143-061-Q1-E1-C6
acttggaacttcttgctgaccttccttggcaaaaggtcagtgaagaaagggagcttgaccttagagttgcgaaagagagccttgaccaggatcattatggactaacaaaagttaagcaaaggattattgagtatttggctgttcgtaagcttaaacctgatgccaggggtccagtgctgtgttttgttggaccacctggtgttgggaagacatctttggcctcctccatagcaaaggccctgaacagaaaattcataagaatctctcttggtggtgtaaaggatgaagctgatattaggggccaccgaaggacatacattggaagcatgccagggagacttattgatggactaaagagggtatctgtgagcaatccagtgatgc

SEQ ID NO: 596 - DNA, 419 bp, Zea mays
  Clone ID: LIB143-061-Q1-E1-C7
atcagcttgggctagatagatcaattgtttgtggtttgttggatgaacttgaacaacttcttaagggaattgctatgatgaaagagctgactcttaggacacgagattatctagtttcatttggtgaatgcatgtctacaagaatatttgctgcacttttaaacaaaattggagtaaaagctcggcagtatgatgcatttgatcttggctttataactaccgatgatttcacaaatgcggatattctggaagcaacttatcctgctgttgcaaggaggctacatgtggaatggattaatgatcctgctatacctatagtcactggctttcttggcaagggatggagatctggtgcaataactaccttgggcaggggtggtagtgacttgacagctacaaccattggcaaagccttggga

SEQ ID NO: 597 - DNA, 400 bp, Zea mays
  Clone ID: LIB143-061-Q1-E1-C9
aggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctg

SEQ ID NO: 598 - DNA, 372 bp, Zea mays
  Clone ID: LIB143-061-Q1-E1-D1
agcagaccaacctagccacccagggagaaaggccaaaagggaggggagagtgtcgtcatggcttccattgtcgcttccaggagggccgttcctctagttcgcgctctggagaagctcatcgcagcgtcctccgcgcccgggactggctccgccctcaggccggtggcagtcgccggcggcctccgtggctacaacaccggcgctccgctccgacgctacgagggggccgagtcggaagacgatagcgtccgcgagtacgatgggcggcacggcggccgggactacgccgtgcccagcctgttctcagatattttccgtgatccgcttagtgcgccgcacagcattggccgcctgctgaacctgatggacgac

SEQ ID NO: 599 - DNA, 386 bp, Zea mays
  unsure at all n locations
  Clone ID: LIB143-061-Q1-E1-D10
tgcacttcatgaaattacccctgcatttggtgcttccaccgatgatctcgaaagatgcagattgcgcggtattgttgattgtggcaaggcacataagcacatttatcaaagagctatgctcctcgtagagcaagttaaagttagcaaaggtagcccactcgtgacttgcctattggaaggtcctgctggaagtgggaaaacggctatggcagcaagtgttggcattgacagtgattttgcatatgtgaaaattatatcagcagaaacaatgattggtttcagtgaaagcagcaaatgcgcacagatttgcaaggtttttgaggacgcatacaagtctcagttcagcatgataattcttgatgatatcganaggttactggagtatg

SEQ ID NO: 600 - DNA, 403 bp, Zea mays
  Clone ID: LIB143-061-Q1-E1-D12
ggcaccacacctcttcttcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactgagccggtcaggcgatggcgcacgagagtcgagaggacgacgacgagtcgtataaatataatagcggcgtctaaataagatcctgtcaac

SEQ ID NO: 601 - DNA, 385 bp, Zea mays
  Clone ID: LIB143-061-Q1-E1-D2
ctcgtgccgcctccgtcgccggctcgcctccccatcgacgcgcaggcagccctgcgtttgctccccgtcggtcgggaaaggggcgcgccggcgctgcctccagcaatcaactcgccgcatccaatcacggcgcctccctcctcgattggctcctcggtggttggttgttataggcaggcgggaaggatgttctcgctgagccagatcgagcacgacctcccgatgccgccgcacctgctgagccgcccccttcccgacgccatcaaggccgagctcgagaggctcttcttggacaaggtaatcacaaaacttgggctgtgcgtgtctgtctatgatatccgatccattgaaggcggttccatccatccaagggaaggctgctcga

SEQ ID NO: 602 - DNA, 409 bp, Zea mays
  Clone ID: LIB143-061-Q1-E1-D3
accgttgcggcgcggcaccacctgaacccgatcaccacccacaccatgttgtcccgattgccggcgacggtgagccttcttcgccggtcgctccgagaaccgcgcggcttcagctcctctgtgctggcttcatctaaggaaacggccgacggaaagctggtggcgtcggtgcttttcgagcgtctccccgtcgtcatccccaagatccaccccgttgtctacgctttccaagaattctcatttcggtggaggcagcagtacagacggcaataccccgaggaggtcctcggcaaggccgacgcgaggggtaagggtgattatcatattgattatgtgcctgctccaagaattaccgaggccgacaaaacaaatgactggaagttcttacaacgagctcctgataataaac

SEQ ID NO: 603 - DNA, 385 bp, Zea mays
  Clone ID: LIB143-061-Q1-E1-D4
atttcaactcgcatctcccgcgccgcgccgccccagcccggcagcccaaatggacctgccagtggtagatctcacgccgtatctcggggccgcagccggcggcccggccgcgtcgggcgtggaggagctgcgcgcgctgtgcgccacagtgagcgctagtctgcgggacacgggggcgctgctggtgatggacccgcgctgctccgccgcggacaacgaccgcttcctcgacgtcgtcgagcgctacttcgcccgatccgccgacgcaaagcgcctccaggaacggccccacctccactaccaggttggtgtcacacccgaaggggtggaggtgcctcgcagtttggtcgacaagaacatgcaggagaagatcaggagcatgcct

SEQ ID NO: 604 - DNA, 417 bp, Zea mays
  Clone ID: LIB143-061-Q1-E1-D5
acgagcagcctgcaccagcccgcagtccttgtccctcctccagcacgttccctagccatccgtccagccgatggccatggctgaggccacccacctcgccagcttcatcatgtgttcgttccccgtggcgtgtccttatcactggtcgttggactcggcttagaccccatgctttgcgtcctttcgacgttgacgacgcttagctccctcctatagctctccgtgcggcaagcccagctttcatctccagctccagcagctgcccctcctggctccagtcctctgttcgtccctcgtcgtcgatctgtgcagccttgacgcgccatcggctccctgtccgacttcatcctcgtcgccgatctcatcccgttcaggctgtctgctcgagctccagccctcgctatcatgacttctcta

SEQ ID NO: 605 - DNA, 417 bp, Zea mays
  Clone ID: LIB143-061-Q1-E1-D6
agttttacgtcccggtagatttggaaagaaacattatgtacctttacctggtgcagacgagagagtttcaatattaaaggcacatgctcgtagcaagcccatctcgactgatgttgatttggatgcacttggtcgtcgtgctgagtgcaacaatctcactggtgccgacctagcatcactggtcaatgaagcagccatggcagcactggaagagagactggaattccgtgacaaggggacatcctcactgagttcgtctagcttgattgagatgccgcacttcgaacatgctctatcgaagatcaagccatcagtatctgaacagcaaatcaagaattatgaggcgttgtcaatgagatactcgtcaaactgattcatcaccagctgtccacatgttagtgtgtatacgaggacaac

SEQ ID NO: 606 - DNA, 420 bp, Zea mays
  unsure at all n locations
  Clone ID: LIB143-061-Q1-E1-D7
ggacaagtgcgagtgcaagaacacgctcatcgagggaggcggcatcggcgtcgccatcgaaacggcgacgtcgcacatcaaggtggagcccgcggccggcggcgggagcgtggtgaaggtcgaatccacttacaagctgctgccgggcgtggaggtgaaggacgagatcgccaaggccaaggagtccgtcaccgccatcttcaagggtgccgaggcctacctcgtcgccaaccccgacgcctacaactaaaccagtggactgggatgagcttcatttcccttgcggcttgtttggatatagaagggtattgtgtacggagattgggttttctttccccttctttttttttcatacanaataaaataaagctgctctaaagcagcgtgcggtttttggactcgagatggtatgagtatatg

SEQ ID NO: 607 - DNA, 428 bp, Zea mays
  Clone ID: LIB143-061-Q1-E1-D8
tgcaaatcctttgaacctttttcctcagggtgttccaagtggtgggtccaacccaggtgttgttccaggtgcaggatctggtgctcttgatgccttgcgacagcttccacagtttcaagcactccttcagttagtccaggctaatcctcaaatcttgcagccaatgcttcaagagctaggtaaacaaaacccacaaattctgcggttgattcaggaaaatcaagctgagtttctccgcttggtgaatgaatctcctgagggtggtcctggagggaacatactaggtcaactggcagctgctgtgccacaaacgctgacagttaccccagaggaacgggaggctatccagcggctcgagggaatggggttcaaccgtgagcttgtgctagaagttttctttgcatgcaacaaggacgaagagcttacag

SEQ ID NO: 608 - DNA, 403 bp, Zea mays
  Clone ID: LIB143-061-Q1-E1-D9
cccacgcgtccgcccacgcgtccgcccacgcgtccgcccacgcgtccgcaaacttggcattcttgcctgttcttaattattgccaggacaggagaaacaaagatgaggcctcagctgatactcgtcggcactctggctgttctcgccatcctcgcagctctcggcgaaggctcgtcgtcctggccctgctgcaacaactgcggtgcttgcaacaagaagcagccgccggagtgccagtgcaatgacgtgtcggtcaacgggtgccatccggagtgcatgaactgcgtcaaggtcggtgcaggaattcgtcccggcatgggccatggccccgtcgtcacctaccgctgtgacgacgttctcacaaacttctgccagagcagctgcccggaggcgccggcgccat

SEQ ID NO: 609 - DNA, 350 bp, Zea mays
  Clone ID: LIB143-061-Q1-E1-E1
aggctgctattgcaactgggcaaactctcgatgaagctgcaaagctaaagtaggtactatgcacaggacaagttcctgctgaatttgcaatggcaaagaccgatgcacacatggacgaagcttcagatggagccgatcagatggacacagatggtaagaaccaatatggcagtgaggctgatgggcattgacacggcgaaggaagcaccccaattcaggacgatcgaaagcatggagacataggctgggtcatccattgtctgagttatgtttgacagttttcgtgggggtgcatgaaagagctatagccttgatgccgcataactcggactctactgatcgcatgtgga

SEQ ID NO: 610 - DNA, 389 bp, Zea mays
  Clone ID: LIB143-061-Q1-E1-E11
cttcagtcttctttagattcatcagtgttgccttcttcaccgtagcagatctagtaacgctgacattgtggtcccagagtggtgccttggcagacctgaccagctagcaaataggcccagccaactccgatcgcaccagcacctgcaccactgcaccagccgcccgcaacccgcaaagctgcttcccggactagctagggtttcgtgtacgccgcttgatctagtcctctctcccggcacgcgaggtagggcgcagcgttgatggcggcggcaccggcggacgctaaggcggaggccgccaagatggacctcctcgaggacgatgacgagttcgaagagttcgagatcgaccaagaatgggatgaccaggaagaaggcaacgaagccgt

SEQ ID NO: 611 - DNA, 385 bp, Zea mays
  Clone ID: LIB143-061-Q1-E1-C5
attaaaaataccgtggccacgctgatggtgcgcctccaccacctgcccctgcccctgccccgcgccgcgcccgctcccacctaccgttgccgccgccacctcgccctcgcgccccctctccctcggctgcgggcatcggccgccgtcatgtcaacggcggcggaacagacgatcgccgaccagaagcgcacgctgcgcgccgaggtgcgcagggcgctgaaagccctctctaccgaccagcgcgccagcgaagatctggctattcaaactacaatactggattcctcttggttcaaagcaagcaaacggttgtgcgcttatataagctgtcagcagttgcgagaagttgacacatcagggatactagcagagtgtctaccgtcga

SEQ ID NO: 612 - DNA, 415 bp, Zea mays
  Clone ID: LIB143-061-Q1-E1-A9
acgaaaccaagcaacaattgagcgatcgatccatcgcctctctctctctcagcaatctatccgcgacaactaagcattcgattctccgacaacaacaagcagggcaatggcgtctgcggacgtgcacatggctggcggtgcggagacggagaccttcgcattccaggccgagatcaaccagctgctctccctcatcatcaacaccttctactcgaacaaggagatcttcctcagagagctcatctccaacgcatcggatgcgcttgacaagatccgcttcgagagcctgacggacaagtcgaagctggacgcgcagccggagctcttcatccggctcgtcccggacaaggccagcaagacgctgtccatcatcgactccggcgtgggcatgaccaagtccgaccttgtcaacaac

SEQ ID NO: 613 - DNA, 386 bp, Zea mays
  Clone ID: LIB143-061-Q1-E1-B1
atcagaaccagtgccaagctgcccaaattggtttcctccaaaggaataaacatcaccatctacggatgtacatacagtgtgccacagacccgcggcaacgtcttgcatcttggatcccaggatagaggatacacacgttggacttaaaacatcatctgtattcccttgtccgcactgtccatacagcccccacccaaatgtaagaagagctcctgaatctgttactgcagcactgtgacgacctccacaagcaatggccctcacacaatttcccaagactttactgacatgtccttcagcagccttgttacctttcatagctgatgggcgatccttgctgtatagtgctgattcaatgcacggtacaagatggggagaagaaacag

SEQ ID NO: 614 - DNA, 309 bp, Zea mays
  Clone ID: LIB143-061-Q1-E1-B10
cagcgatccgaagctcaatcaattcactcaaacctcttccccaaatcttcgattagattctcgttgacaagaagactagaaccgaacctgaccatgtcgctgatccgccgcagcaacgtgttcgatcccttctccctcgacctctgggacccctttgagggcttccccttcggctccggcagcagcagcagtcacttccccgcgttcccgcggaccagctcggagaccgcggccttcgctggcgcgccgatcgactggaaggagactccagaagcgcacgtgttcaaggccgacgtaacggggctgaag

SEQ ID NO: 615 - DNA, 373 bp, Zea mays
  Clone ID: LIB143-061-Q1-E1-B11
agggagaatcacctcgaggacgacagtgaggtggacgaagatgacgatgtcatctacaagatacatgttgccgccaacagatatgatttgcgatgttttgaatgactagcaagagctcttcgtgttttcactgggactgaaacaagccctgtattccaagtttcatcaatccctcggggttcaatgcttcagatgcatgttaaaccagagacttcaaaaattagaccgtacatagtttgtgctgtcctaagatgggtaacttttgatgacgcaagatacaacagcttcattgatcttcaagacaaactccaccagaatatctgccggtagaggacactcgttgctattggcatccatgatctggacactctgc

SEQ ID NO: 616 - DNA, 349 bp, Zea mays
  unsure at all n locations
  Clone ID: LIB143-061-Q1-E1-B12
agctggacatgctcaccgcgtggagcaacttcagccgccggggcaagcctgaagtggaccatcacgctcttctccctctccaccctgcccaacacgctcgtcatgggcatcccccggctcaagggcatgtacggcgacttctccggcagcctcatggtgcagatcgtcgtgctccagtgcatcatctggtacacgctcatgctcttcatgttcgagtancgcggcgcgcggatgctcatcaccgagcagttcccggacaacgccggggccatcgcctccatcgtcgtcgacccggacgtggtctccctcgancggcgcagggacgccatcgagacggaggccaaggtca

SEQ ID NO: 617 - DNA, 385 bp, Zea mays
  unsure at all n locations
  Clone ID: LIB143-061-Q1-E1-B2
ccccagaccacagcgcgacagtgagtacagcagcagcagctgagagcgtgagagcgtgcgaagcaggagggaggacaagaagaagccgatggcggttgtgagcggcagcggcgggaggctgaacccctgggcggagcccttcgtgccttccggggcgcggtaccgcggcctgcggaccgtggaggcgacgccggagcaggaggtggaggacttctcccccgagtggtggcgcctggtgtccgcctccccggccttccgcgaccgctggctgcgcgagtacggcgcgctcggcctactcgacgccgaggacgacctggacgacgacgtcgacagcttcctcnccgacgacttcttctcgcctccggccccgcgctacgagagcgag

SEQ ID NO: 618 - DNA, 366 bp, Zea mays
  unsure at all n locations
  Clone ID: LIB143-061-Q1-E1-B3
cgcgtctcgtccccgtccgcatccgcgtccgcgccgccttttcgtcnccgcgtcggcgtcgcggctccactgggcgtacgcgtcaccggcggaaggcgagggcaggcggtggtcgcgatggcgtccgccgacgcgcgcttggcggggattgcctcctccatccgcgtcatccccgacttccccaagccagggatcatgttccaggacatcacgacactgctgctcgaccccaaggcgttccgtgacaccatcgacgtcttcgttgagcggtacaaggaccaagggatcaccgtagttgctggtgtggaagctagagggttcatttttggtcctcctatcgctctagccatcagtgcgaaatttgta

SEQ ID NO: 619 - DNA, 368 bp, Zea mays
  unsure at all n locations
  Clone ID: LIB143-061-Q1-E1-B4
accgaacctcggcggcgtcggcgccacgcgagcaaaaaccctagtgcgagcaagcgagaggcagagacctcagtgcctcgagcaacgcgcgcccggcccgacggcatggagagcctcatcctcgcctcctcctgctccgcgtccccacggctcccgctactctcctccgccgcccgcttccgcgggctgcccgtttccgtgccgccgccgtcttcggcgtccatcagcggtgccgcgaggaaagggccgatgaggcccaggctcttcgttgccgcggcggcggctcctcgcggctccggaaacgttttcgagggattgagagcaaaaggctttgcaagcatgtcatcttcgactggcantgagaatat

SEQ ID NO: 620 - DNA, 421 bp, Zea mays
  Clone ID: LIB143-061-Q1-E1-B5
aaagcctccggttgcccgaagcagtcgcatctgctcttcgtggcaccgaactcttggagcaatcaacttttgaatcgtcgacaggacagccgcgcgcgtcgtggcgaaggctgcaggatggagcagcagacgaagacgacgacacagcaagagggcaaaggcctcgccaccatggagcggtcgatcgtggacaagccgccattcacgctagcggacctcaggaaggccatcccgccgcactgcttccagcgctcgctcatcaggtcctgctcctacctcgcccacgacctcgccatcgccgcggggctcctgtacttggctctggccgtcatccccgccctcccgggcgtcctcctccgcgccgccgcctggccgctctactgggcggcgcagggcagcatcatgttcggcgtgtgggtga

SEQ ID NO: 621 - DNA, 364 bp, Zea mays
  Clone ID: LIB143-061-Q1-E1-B6
gaaaaactagccgaagcaaacccattccacaagcacctggtgggatcatctcatcatcagaaacaaagagagagattccgtgcccacttgttgtagtagattgtgaggattgaggagtagcaaagagaagcagccatgaatccggacaacttcacccacaagacgaacgaggcgatcgtgggggcgcacgagattgcggtggaggccggccacgcgcagctcacgccgctgcacctggccgcagtgctggctgcggacaagggcggcatcctgcggcaggccatcacgggggcgtcggggggcgacggagcggccggggactcgttcgagcgcgtgctgaacaactcgctcaagaagctgccgt

SEQ ID NO: 622 - DNA, 213 bp, Zea mays
  Clone ID: LIB143-061-Q1-E1-B7
gtcggcgtcggcgtccgcgtctgagcggtgcttttcttcctcgcgtcggtgtggcggctccactgggcgtacgcgtcaccgcaggtaggcgacggcaggcggtggtctcgatggtgtccgccgacgcgcgcttggcggagattggctcttcgatccggcgtcgatcccaggacttccgcaggcccagggatcatgttccaggacagcaggaca

SEQ ID NO: 623 - DNA, 407 bp, Zea mays
  Clone ID: LIB143-061-Q1-E1-B8
acccacgcgtccgcaaggaccttcggcgcccgttcaggatccacatcttcccgagcgagttcttggttgacctcttcccccttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgttcacgtgcgcatccagcagcgtaatggtcgcaagagcctgactaccgtccagggattgaagaaggagttcagctacagcaagatcctcaaagatctcaagaaagagttctgctgcaatggtacagtggtccaggacgcagaacttggacaggtcattcagctccagggtga

SEQ ID NO: 624 - DNA, 417 bp, Zea mays
  Clone ID: LIB143-061-Q1-E1-C10
gggctcgagcacgcgtcaacgtcgacctcctttactcttttctcctcgtgtccgccgctacacgcgccgccggaaccctagcctccgccgccacaggcagccgggatggagaaaggagcctcggaggcgtcgcccccttgcgctcgctgcggcaagcccgctcagcttcaatgccccaagtgtgtcgaacttaagttaccgcgtgagaacgcagctttctgcacacaggattgttttagggcagcatggagctctcacaaatctgttcacccaaagcctggtgcaccggcatcccagcagtctccagaaggttggaaatattgtttgagaaaagggcgggaacgtgcattgcaacttcctcgttttgattggacaggtccattgagaccacatccaatatcaaagattcgtgtggtg

SEQ ID NO: 625 - DNA, 373 bp, Zea mays
  unsure at all n locations
  Clone ID: LIB143-061-Q1-E1-C12
gtcccaatcaaactgattgatccgtcgcccgcagggccacagcagccgcggcgaggtcgtccgtcggattcggaagctcagttattactgaaaagataatacagtacctatggcttctctggacgccgtgcgaggagacctcgccctgctgattctgtacctgaacaaggccgaggcgcgggacaagatctgccgagcgatccagtacgggtccaagttcatcagcaacggcgagccagggcctgcgcagaacgtcgacaagtccaccagcctggcccggaaagtgttccggctctgtaagttcgtcaacgatctgcacgctttgatcaagcctccntgcaaggggactcngctcccgctgattctactcggg

SEQ ID NO: 626 - DNA, 383 bp, Zea mays
  Clone ID: LIB143-061-Q1-E1-C3
gtcgccatggccgagatctgctcctccttcccgaccactggttctctgtatttctgggctgcacatttggcaggtccagtctggggtccgttggcgtcttggtgctgcgcttggctggaggccatcggcctcattgccgggattggcacacaggcatacgcaggatcccaggtactgcagagcatcatcctgctctgcaccggcaccaacatgggcggtggctacctggcccctcgctggctgttcctggtcatgtacatcgggctgacactgatctgggccgtgctcaacactttcgcgctcgaagtcatcgcgttcctcgacgtgatctccatgtggtggcaggtgatcggtggcaccgtcattgtggtgatgctcccgct

SEQ ID NO: 627 - DNA, 417 bp, Zea mays
  Clone ID: LIB143-061-Q1-E1-C4
actgggtggaggagaggtacacggacgacgagaagaacgccaagattctcgaagtggacaacggcaagccagggcggcacggttccaagaggcgcggcggcggctgcggcaaccatcaccagtcgccgtgctcgacgatgacctccgagcagaacagccggagctacgcgaccatgccggagtcgccgtccaaggactcgacgaccgcgcagcagtccgtgccgagcccatcgtccgtgggcatggcggccgaggccctgagcccgctgcgcgtgccggcggacatcgccgagctctgcgacagcccccagttcttctcggcgacgtcgcggcccggggagctccaggagggggggcgcgttcacgccggcggccaagagcgagtgctcgcgcagcctcttcggccgctactccgac

SEQ ID NO: 628 - DNA, 424 bp, Zea mays
  unsure at all n locations
  Clone ID: LIB143-061-Q1-E1-A8
ggagaagctcaaggagaagctgccgggccacaaggacggccaccacacggccgcaccgtccccggcgcccgcgcccgtggagacgcatgcccaccaccaggaggaagcgcacaggccgcacgtcgtcccgaccccggccccgccgcctccaccgcacgtccaccagcacgaccacggcgtcgtcgtccaggacgacgtgaagaccgggaccccgccgcatgcaccggaggaggagaagaaaggcctgctggacaagatcaaggagaagctccccggtggccacaacaagaagcctgaagccgctgccgctgccgcaccggctccgcccgtccacgcgccggcgccggcgccgcaggcggagaacgtgagcagcccggatggcaaggagaagaanggcttgctgggcaagatcatggcaagatac

SEQ ID NO: 629 - DNA, 341 bp, Zea mays
  Clone ID: LIB143-060-Q1-E1-H2
ggggttcaataaagctgtattttctgttttccaagacttggatttctcatttcttgagatgaacccattcaccttggtaaatggtgaaccgtatcctctggatatgagaggagaactacatgacacagctgctttcaaaaacttcaataagtggggcagtattgtgtttcccctaccatttggtagagttctcattacctccgaaagttttatccatcaactggttgataagacaagtgcttctctgaaattcatggtactgaacccaaaaggacgcatctggacaatggttgcatgtggtggtgctagtgtcatatacgcagacactgttggtaatttgg

SEQ ID NO: 630 - DNA, 343 bp, Zea mays
  Clone ID: LIB143-060-Q1-E1-H3
atcaccccacctcccctgagcttctcccgacctttggtcatgcaaaggatgcggccaacaaggacgagcgatggtgaccaacgtcatctgcttcctggtgctcgcatccgtgctcctcgccgtcgcttttcccgtgtctgctctgcggcagcaggtgaagaagggcggcggcggtgaaggctgaggcggaggcagtgttagcggaagcggaggcggcaacctgaatccctgggagtgctcgcccaagtgcgggtcgcggtgctccaagacgcagtacaggaaggcctgcctcaccttatgcaacaagtgctgcgccaagtgcctctgcgtgccaccggggttc

SEQ ID NO: 631 - DNA, 371 bp, Zea mays
  unsure at all n locations
  Clone ID: LIB143-060-Q1-E1-H4
acgttcaaccgctctgtcggcgctcacagccggccacgccaccatgctgccaccggccgcgcgccttgcggcccgccgcctcctcggcctcgcctccgcatctgcgtcggaagccgccggccgccgggtagcttcctctccgatcgcttccgcaggctactccgccgccgcgtccaggggctccgtctccagcaccaggcccttctccacggctcttaactaccaccttgattccccggagaacaagccggacatgaaatgggagttctcacaggcgaatatgaagaacgtcaatgagattctgtctcactatccaagcaactacaagcaatctggtattattccgctgcttgatcntgcacagcagcagc

SEQ ID NO: 632 - DNA, 359 bp, Zea mays
  Clone ID: LIB143-060-Q1-E1-H5
atccactaaaacccacaaagccctcctctgctctccatccctgtctctcgctttccctaacccacaccagaataccagatcgagcaccgatctagggttgcacctcttctgctagccggctggcgaggagccgttcggcatctggacgcggccaagggagatgaagctcgcggggctcaagtctgtggacggcgcccacgaggagtccatctgggcggcggcgtgggcgcccgccgctgaccaccgccccacggcggtgctcctcactggcgcgctcgacgagaccgtccgcgcttggctccccgacgacctcgctgccttggggtcccccacacggggccacgcgctcggagtcgtct

SEQ ID NO: 633 - DNA, 347 bp, Zea mays
  Clone ID: LIB143-060-Q1-E1-H6
agcggcgggtctgggaacgtgtaccgcgtgaagctcggcaacggcgcggtggtggccgtgaagcacgtcacgcggggggtggcgacgagcacggcgccgtccgccgccatgctgcggccggcggcgtcggtgcggtgccgcgagttcgactcggaggtggggacgctgagcgccatccggcacgtgaacgtggtgaagctgctgtgcagcatcaccagcgcggacggcgcggcgagcctgctggtgtacgagcacctccccaacggcagcctgtacgagcggctgcacggggcggcggggcggaagctgggcgcgctcgggtgggtggagcggcacgacgtggcggt

SEQ ID NO: 634 - DNA, 382 bp, Zea mays
  Clone ID: LIB143-060-Q1-E1-H7
actcatttctgcatccccctcccgccgcgccgcctcaccgccgccggagaagatgggtcgcgtgatccgcgcgcagcgtaagggtgcggggtccgtgttcaagtcccacacccaccaccgcaagggccccgcccgcttccgctccctcgacttcggcgagcgcaacgggtacctcaagggcgtcgtcaccgacgtcatccacgaccccggccgtggcgcgccgctcgccaaggtcactttccgccacccattcaggtacaagcaccagaaggagctctttgtcgcagccgagggcatgtacacgggccagttcgtctactgcggtcgccgcgccaacctctccatcggcaacgtgctgcccctccggcggatccccgagggt

SEQ ID NO: 635 - DNA, 341 bp, Zea mays
  Clone ID: LIB143-060-Q1-E1-H8
tgcaacagccaagtgcaagtgatcgagctcccccctcctcatcagtcgctaggcacagcgcacttgcaggatggcgcaggtctctaagacgcttctccttgtggccctggtgttcgtgtcgtcggcggcggtggagctgtgccgcgcgatcgacttcgacgagcgggacctggcgtcggacgaagcgctgtgggacctgtacgagcggtggcagacgcaccaccgggtgcaccggcaccacggcgagaagggccggcggttcgggacgttcaaggagaacgtgcgcttcatccacgcgcacaacaagcgcggcgaccgggcctaccgcctccgcctgaaac

SEQ ID NO: 636 - DNA, 402 bp, Zea mays
  Clone ID: LIB143-060-Q1-E1-H9
agagccggagctggaaaagaaggtgaaattcgtgtacactgacaatcctgagagccagaggataatggccgacatgtttgacatggagaagctggactccgcatttggtggccgcagcgcgtctggcatcgacgttgccaagtattccgagagaatgcgaacaggagatcagattaggggtcttcgctaacggcaaatggaatactgctatctcacagttcgtcaagaaactgttcagataacaagataattaaaatggatcactacggaattctagtggttacatcacaacagaccaggatgaattatgatgtctgctagatatattattagctctgaatgattgggataccaggtttttgatgatccgtgtaatgagatgacatgacaatataaaaaaca

SEQ ID NO: 637 - DNA, 393 bp, Zea mays
  Clone ID: LIB143-061-Q1-E1-A1
ggaaattttcacttcgccccaggcaaaggattttatgaatcaaacatagatgtgcctgagctgtcattacttgagggtggtttcaacattagccacaaaataaacaaactgtcctttgggacagaattccctggtgttgttaatccacttgatggtgctcagtggacacagccagcttcagatgggacataccagtatttcataaaagttgtccctacaatatacactgatattagaggacgcggtattcattcaaaccagttctcggtaacggaacattttagagatggaaatgttcgtccgaaatcccaacctggagtatttttcttctatgatttctcacctataaaggtgatattcacagaagaaaatagattcctactccactacctg

SEQ ID NO: 638 - DNA, 352 bp, Zea mays
  Clone ID: LIB143-061-Q1-E1-A10
agggggtacccgaccagacgtacgacatgtggtcggtctccggtgtcagcgcctacacgggcggggtctgggtggcggcgctgcaggcggcggcgggcatggcgcgcgtcgtcggggaccgccccgccgaggcctacttccgcgcgaggcgggacagggcggcgcgcgtgtacgacgccgagctctggaccggcgtctacttccgctactacaacagcggcggctgcggcgccagcgagtccatcatggcggaccagctggcggggcagtggtacgcgcgagcgtgcgggctggagccggtggtggaggacgccaaggcacggagcgcgctggcgaccgtgctggactacaa

SEQ ID NO: 639 - DNA, 347 bp, Zea mays
  Clone ID: LIB143-061-Q1-E1-A11
aggtgatttcaccgatgttcagatctagcgcgcgccaagcatctcttcacggcaggacgcgaatatcgcattcaagcactgacaagatggtgaagctctccttcggatgcgtcgggaactccttcagcgcgactaccatcacggcatacgtggccgagttcatcgcgagtctcatcttcatcttcgcaggcgtctgtacctccatcaccaaaggacaactgactaatgcgcgagcgactggatcagtgggggctgatctgggatcgccatggcacacgcgatggtgctgttcgtgagcgtgtctgtcacgacgaacatcacggggcggcacttgaaccgtgccgtga

SEQ ID NO: 640 - DNA, 395 bp, Zea mays
  Clone ID: LIB143-061-Q1-E1-A2
acggacgcgtgggcggacgcgtgggttccccgccccaccaggtacccacgcgttcctcagatcagatcggcaaggccaatccgaaatctcgagcgctcgcgccggcgaccacagcaaagaggaggccgcagcacgacagcgccccagggttcctactctcgtcgcagcggcagcactggtagcggcagcagtgaggggaagatgtcgtcggtgttcagcggcgatgagaccgcccccttcttcggcttccttggcgccgccgccgcgctcgtcttctcatgcatgggggcggcgtacgggacggccaagagtggcgtcggcgtggcgtccatgggtgtcatgcgcccagagctcgtcatgaagtccaccgtgcccgtggtcatggctggtgtgcc

SEQ ID NO: 641 - DNA, 359 bp, Zea mays
  Clone ID: LIB143-061-Q1-E1-A3
gcaaagcggccaagtggctcatctggcagctccacccgctggtcacgctcggcctccccatggtcctggaggagccgctgctccacacgttccacctcccgcctttcctcgtcaagggcgactacagggcgctgtacaagtacttctccacggtggcgaagcaggcgctggacaccgccgagggcctgggcctgtcgcgcgaggaggcctgccacaacctcctcttcgccaccaccttcaacagctacggcggcctcaaggtgctgttcccgggcctgctggccaacgtggccagcggcggcgagaagctccacgagcggctggtggccgagatccgcggcgccgtggccgacgccggc

SEQ ID NO: 642 - DNA, 385 bp, Zea mays
  Clone ID: LIB143-061-Q1-E1-A4
cttgacacgcatatatgcgcccatggctattatccgtggcctcaaggaatctggcgtctttaccaatgcagtaacatcagcgaaagcacagtcaaaaacgaagtcatcaaacatgggtctcggaaacaaggatcctatccagccaaacggaactgctggtcagtccacactggaaggcagtcatggaaagttgcaggcaaccgtgagaaagatcctggaaatggttgacacacaggaagaagcagcgatgccaccaatgtcgccccctggttttcttgagctgactgaaagtgtcactgccttttcatgacgctttggtttaaccatgcgtgatgcatgcagccttgagcatacgaatagcattggcttgtttggtggtcgtcgt

SEQ ID NO: 643 - DNA, 386 bp, Zea mays
  Clone ID: LIB143-061-Q1-E1-A5
cggacgcgtggcggacgcgtgggcggacgcgtgggtacacgaaggaggaggtccagaagatgaactcgaaatcatccgtgccgaggaaggaggaacccccagcagcaggcgaaggctgcgccgccgccgccgcaaacgagtaggatgtctgcctgcactgcagcaagcagttttagatgactaggtcgtgtggaggaagccgacgatgatgcatgcgtgatgaacccgttccttgtgcaggaggtggtgccagcccgggtcccagggaagtaaaaactcctgagatcttttgcttgtccgttgcagccccatcccccgtccgtttgggttttagttgggaacgtagaaactactgtctccgcctgcttctccgaagctcgctgttg

SEQ ID NO: 644 - DNA, 322 bp, Zea mays
  Clone ID: LIB143-061-Q1-E1-A6
aggaaattgtcagtgcattaggctggtgacacggtgaggagctagcatgagcctgtccctcgacctgatgagctttcacaactaactttcacgcatggtctccgtaggcgtatgcttggaatatcataccctgagttgacatagatgcaaatgcgggcaatttttgaagctgttagatcactgacaaagcataagcgctgagaacacctgaatacgctatttggacaagtgttcgcatcgataacggttcatcttgttgtgacatcacaagatctgcagcatcagttgacgcttagccaccaagatatcgagaaagtgttcg

SEQ ID NO: 645 - DNA, 239 bp, Zea mays
  Clone ID: LIB143-061-Q1-E1-A7
acagtgtcagtccatccggcatcgctacctgcaggagaatgaacatcaccatatagtgatgtataaagcttttaccacaaactttcaggaatgtcttgcatggtggatcgcatgatataggatacactcgttggacatatatcatcatccgtattaccttgtccgcactgtccatacagtccccacacaagtgtaagaatagctcctgaatctgttactgcagaactgtgacaacgtcc

SEQ ID NO: 646 - DNA, 407 bp, Zea mays
  Clone ID: LIB143-060-Q1-E1-H12
gacccacgacatccacgtgccgcgtagggcgggtagtaacagtcacatcctggccgggacgggatctcactgagggttgggaaatctttcacttgcatcgttcgctttgacactgaggtggagctggcgtacttcaaccatggaggcatcctcccttatgtcatccgcaacttggcagctgcgcataactgaggcaagatcacacaccgtttgacccacaatggcagtggcaggctccatgttcccagggctagcgacctggttctcaatgtagtgacatttgtgatggatctaggggtctctttgtcgattcagcccataaataaagtgtgaaataaaagccgcaggtggaggcaggaacctgctgattgagggaacagttttgcctgtgtttggttacatgaaaa

SEQ ID NO: 647 - DNA, 395 bp, Zea mays
  Clone ID: LIB143-060-Q1-E1-F4
accacgcgtccagtgaatgcactactagctctagcttcgcactactagctctagcttcgccattgcattcgcttactggagtacgtctggtacttgcacaactggctatcatggcgccccacattgtcgtcaacaaaaccgtgatcacattcacagcggtggccctgacgattcttgctgtgacaaccatgatggccgaggcccgagacctgtcatccacctccaccggtggctatggcgaggaagccatgaaagtgaggcatcagcagtggatggcggagcatggccgcacctacagggacgaggctgagaaggcgcaccggttccaggtattcaaggcgaacgccgattttgttgacgcgtccaatgccgcaagtgacgacaagaagagctat

SEQ ID NO: 648 - DNA, 394 bp, Zea mays
  Clone ID: LIB143-060-Q1-E1-F6
aggtgccggttgccattggaggccctggtcttcaccccggagtgaaattccggaacgacattcaaatccctgggctcgccaatgtagccgcaactgtgatgaacctccatggatttgaggcccctgctgactacgagcaaaccctaattgaagtggctgacaactaaatactggccagctatgtccaattttggttctatagttttgagaagggatatggccatgccattcaataatttctgtttgcaagcacggtgctcaaactcaccaaaacattgagaaacgccttttgacttgcatttagatgctctatttataccgttgacaatcgcctcttctggcttttagcagtttgatggctatctttacttagctatataatgtatctgagact

SEQ ID NO: 649 - DNA, 329 bp, Zea mays
  Clone ID: LIB143-060-Q1-E1-F7
aggttcctcaggtgctgagcagtcgccggcggcgaccgccggtgtcggagatgaaggagagaagcggctccagggcggcggtggacgagcgctacgcgcagtggaagtcgctcatccccgtcctctacgactggtttgccaaccacaacctcgtctggccatccctctcctgccggtgggggccacagtttgagaaagctacctacaagaatcgtcagcgcctgtacctatctgaacagacggatgggagtgtgcctaatactctggttatcgcaaattgtgaagttgtgaaacctaaggttgcaactgctgaacatatctcacagttc

SEQ ID NO: 650 - DNA, 378 bp, Zea mays
  Clone ID: LIB143-060-Q1-E1-F8
ggccgacccacgcatccaatcacaatacgaaacgaattaatccccaatcaacacagcaagtcagcaacaagcaaagcagcgacccgagagatggacgcgaggatgttcgggctggagaccccccgggtggcggcgctgcatcacctgctggacgtgcccgacggcgacaaggcgggcggcggcgccacgcgcacctacgtccgcgacgcgcgcgccatggcggccaccccggccgacgtcaaggagctcgcgggagcgtacgcgttcgtggtggacatgccggggctgagcacgggcgacatcagggtgcaggtggaggacgagcgggtgctggtgatcagcggcgagcggcgccgggaggagcgcgaggacgccaag

SEQ ID NO: 651 - DNA, 383 bp, Zea mays
  unsure at all n locations
  Clone ID: LIB143-060-Q1-E1-G1
agcactcgcatctctctcgccgcagcgctttctctcctcccgagatccctctcctcgtgctcgccgccacgcccgcgtgaacgccctcgctgccgcttcttgcactccccgcgcgccactcctcgctttcgcccaagccgcctcctctccctctccgtcgcccataatcaagcgagactgcgtgcaggggtgcatgctgcacgcggtggcgacgagctacggcacgaccgcgacgtcacgaatgactccgagttccgttcgtggggtgcaggctcaccggctccgcatgctgtaattgggcaaagcgtggggacgctacgctcgggtggtctacttcaatcttagcgcccagcgacatcgtcgtgcnacagggctggagcgac

SEQ ID NO: 652 - DNA, 402 bp, Zea mays
  Clone ID: LIB143-060-Q1-E1-G10
acacatccatccttattgagcttactgtttgatccatggactcggaaggagtaccagcaaatgtggcacatgagactactaatccggcaagccaagaagacggcgagagcaaggccgggatgactgatctgctgatgctgaccgacaagtcgcagctgcatgcgccagcaatattgctgcgtaacaacgaggagctcatgatgagccatgcgatcaagtcggagacggagcgcgttgagtacctcaagactgtgagcgactgctacacgcggacaatgaagctccttgactactccatggttgccaggatcacgtactagcgttcgggcggaacgacgagcctcgtcgcccgggatatggacgactacgtcttctacggcctcaacgcgtgcttgcagaacg

SEQ ID NO: 653 - DNA, 406 bp, Zea mays
  unsure at all n locations
  Clone ID: LIB143-060-Q1-E1-G11
agaagaagaagaaacaagccataccatagcacacaccaaaggttactcagtcacatggcaacatccagcacgggctgtctcgtcttgctctgccttgcgtctcccctcctcctccttcccagtgcggtggtccttggccacccatggggtggcggcggcggcttgtccccacagttctacgaccactcgtgccccatggcggagaagattgtgcagtccgttgtggcgcaggctgtggccaaggagaccaggatggcggcgtccttggtcaggctgcatttccatgactgctttgtcaagggctgcgacgcttcggtgctgctggacaacagcagcagcatcgttagtgagaaagggtccaacccgaacaggaactccatcanggggttcgaggtggtagaccaga

SEQ ID NO: 654 - DNA, 177 bp, Zea mays
  Clone ID: LIB143-060-Q1-E1-G12
atgcaagtgatactattcaaatatcaagggttacacactccaatggcacgattgagcactgcctgtcaagtgttgctgtgcagtacgtctctgctcggcgacgttatagctattgttattccttggccaaacatggtgtggaagggcgggagtgccacaagatttactgctaacatt

SEQ ID NO: 655 - DNA, 222 bp, Zea mays
  Clone ID: LIB143-060-Q1-E1-G2
agcaatcgcatctctctcgccgcagcgctttctctcctcccgagatccctctcctcgtgctcgccgccacgctcgcgtgaacgccctcgctgccgcttcctgcactcgcggggggcaactcctcgctttcgcccaagcggcttcttctccttctcggtcgcccataaccaggcgagacggcttgcaggggtgcatgctgcacgcggtggcaacaagctaggg

SEQ ID NO: 656 - DNA, 359 bp, Zea mays
  Clone ID: LIB143-060-Q1-E1-G4
catccttattgagcttagtgtttgttccatggactcggaaggagtagcagcaaaggtggcagatgagactactaaaccggcaagccaagaagacggcgagagcaaggccgggatgactgatctgctgatgctgaccgacaagtcgcagctgcaggcgctagcgatgctgctgcggaacaacgaggagctcatgatgagccaagcgatcaagtcggagacggagcgcgttgagtacctcaagacggtgagcgactgctacacgcggacaatgaagctccttgacgactccatggcggccaggatcacgtacgagcgttcgggcggaacgaagagcctcgtcgcccgggacatggacgact

SEQ ID NO: 657 - DNA, 363 bp, Zea mays
  Clone ID: LIB143-060-Q1-E1-G5
atccacaagacgtggcccgaggacgcgttcccgctgcagcccgtgggccgcctggtgctcaaccgcaacatcgacaacttcttcgcggagaacgagcagctggccttctgcccgggcctcatcgtccctggtatctactactccgacgacaagctgctgcagaccaggatcttctcctactccgacacgcagcgccaccgcctcggccccaactacctgctgctaccggccaacgcgcccaagtgcgcacaccacaacaaccactacgacggatccatgaacttcatgcaccgccacgaggaggtcgactacttcccctccaggtacgacgccgtcaggaacgcgccgaggtacccgattccg

SEQ ID NO: 658 - DNA, 393 bp, Zea mays
  Clone ID: LIB143-060-Q1-E1-G6
acgcgcccgctgcaatgaaccgcgcttcttggttgctccttgttctggtgcagctctcttgcttgcactgctactcagccacccaccatggcggcggccggaagcacggacgcccactactacccgcgcccgccaacgtcgtcgtcggctccgttgtcgtcgtccactccggcagctccgaggctaccaccaccgccgtttcttcaggcaccctggtcggggtccggtgccacgacgggaacggccggacggtgttccggaaggacggcgtcgtgacggaccgcagcggcaggttccgcgtgcacctcgcgcacgggccaagcagctcaagcagcagcagcagccaccagctccggtccgtcacgtcctgctcggtggccgttgcactcccgc

SEQ ID NO: 659 - DNA, 328 bp, Zea mays
  Clone ID: LIB143-060-Q1-E1-G7
aaaatggtcttcgtgggtgctccttgttctaatgcaggtctcttgcatgaactgcgactcatcttcacagaatggatgatgcgctaaggacgggcgtccaatagtagccgcgtccgccaagatcatcttcagtgccgttatcattctaatgacttgcagctcagaagctagatctacaaggatgagcatagtcagattactgctggtgctctcaaagccaaggaagaaactgacggtgtccctgcagtggcagtacatcaatagtctcactgtctagtttttgtgttatcgttttcagtgaactcatatttggttcagttatgattgc

SEQ ID NO: 660 - DNA, 409 bp, Zea mays
  Clone ID: LIB143-060-Q1-E1-G9
acaatcacaacgaacagaagctctcgatctcaccgacaccgaggaagaagagatcaatggcgtccgagcagggagtcgtgatcgcgtgccacagcaaggctgagttcgacgcccacatgaccaaggcccaggaagccggcaagctggtggtcatcgacttcactgccgcctggtgcggtccatgccgcgccatcgccccactgttcgtcgaacacgccaagaagttcactcaggtcgtcttcctgaaggtggacgtggacgaagtgaaggaagtcaccgcggcctacgaggtcgaggcgatgccgaccttccacttcgtcaagaacggcaagacggtcgcgaccatcgtgggtgccaggaaggacgagctcctggcccagatcgagaagcatgccgcgcctgcgcctgc

SEQ ID NO: 661 - DNA, 400 bp, Zea mays
  Clone ID: LIB143-060-Q1-E1-H1
agagacaggaagaggagggcgacgatggcgtccggctggggcatcaacgggaacaagggccgctgctacgacttctggctggagttcagcgagtgcatgagccgctgccgccagccctccgactgcggcctcctccgcgaggactacctcgagtgcctccaccactccaaggagttccagcgcaggaacaggatctacaaggaggagcaacgtcagatcagagctgctgctcgcaaggccaaggaggaagctgagggtgcccctgctgttgcagcacaccattagtctctctgtctattttttgtgttgttgttttctgttaactcatctttggttcagttatgatgctaagggcaaggcaataatctccagctgttggactacacagattttttccccc

SEQ ID NO: 662 - DNA, 411 bp, Zea mays
  Clone ID: LIB143-060-Q1-E1-H10
gacccacgcatccacccacgcgtccgggctgtgcaaggtcatcaaggaggttctgggtgacaaagttgagaaggtggtggtgtctgatcgcgttgtggactcaccgtgctgccttgtgactggcgagtatggctggaccgccaacatggagaggatcatgaaggcacaagccctgagggactcgagcatggcgggctacatgtcgagcaaaaagacaatggagatcaacccagagaaccctatcatggatgagctccgcaagcgtgccgaggctgacaagaatgacaagtcagtcaaggatctcgtgatgctgctgttcgagactgctctcctgacctccggcttcagcctggatgaccccaacaccttcggcaaccggattcaccgcatgctcaaactcggtctgagcat

SEQ ID NO: 663 - DNA, 352 bp, Zea mays
  Clone ID: LIB143-060-Q1-E1-F12
acccacgcgatcaaatatgatacaggaattattaccacaacaaactaagggggtgtttggttttagagacgactttttagtccctagtaaacaaactctacctattcatggaggctaactgactcatagacatagataggtacagctgcagcactactaatgaggttgtaaatgttatgcagcacattggggtagaacgttactgaggctgatcttcaggacatgatcaatcaggttgatgatgatggcaatggaatcatcgtctttcctgagtttctcaaacttatggtacgtaagatcaatgacaacgactctaaagatgagctcaaggaggccttccgtgtgttcgaca

SEQ ID NO: 664 - DNA, 384 bp, Zea mays
  Clone ID: LIB143-060-Q1-E1-D2
agtcaattcgcagtggatcgttcaccaagtggttccttctctggggaaccaggggcagtcagaaaacggaagggcgccatgggaaggggtgagggcgcggtgcaggaaggaatggggcatgttccagaccaggatggcggaggcggagaaggcgtattacaagatgatgggcatcacccctccaaactccacgcgtgtctagccgcgcctctcttcttggttttccatccccgccaccctgacctttgtggtggcgggtgagctgatgatactatactatagcactacttgattatagggagttagagatggtgggtgtagctgcttttgatggagaggtccttctgtaagtaaatgcgaggcgaaactgtgatgagaaaacat

SEQ ID NO: 665 - DNA, 370 bp, Zea mays
  Clone ID: LIB143-060-Q1-E1-D3
gaatcttccaaatgtgaccaatttacttgctactgtattggtcttcctcatagttatctatttccaaggtttccgtgttgtacttccagtgaggtcaaagaatgcccgtggtcaacaaggctcatacccaatcaagctgttttatacatccaacatgcctatcattctgcactctgcactaattaccaacctctatttcatatcccagcttctctacaggaaatacagtggaaatttccttgttaatcttcttgggaaatggaaggaatctgagtactctggccattctgttccggttggtggtcttgcttactatgtgactgcgccatcaagcttggctgatgttctggcaaatccagtccatgcattg

SEQ ID NO: 666 - DNA, 368 bp, Zea mays
  Clone ID: LIB143-060-Q1-E1-D5
atgggctacagcctacagacctacagcaagcgctggccatggcagagcattttgtgctgtgccccgtgatggcagtactattactatccatggacgtcctcggcgccgccgccggtgtcttcaagccgccgccggcgatgtacgtgttcggcgactcgacgctggacgtcggaaacaacaactacctgccgggagcgggcgtcaccagggccaacaggccctactacggcgtcgacattcccggcggcctttccaacggaaggttcagcaacggctacaacaccgccgatttcattgcaaagtgcatacggttcatgagcagccctccgccgtacctgtcgctgctgggagcagcatgctgcggccgc

SEQ ID NO: 667 - DNA, 317 bp, Zea mays
  Clone ID: LIB143-060-Q1-E1-D6
acgtcgccgtcctctcccgttcgcaacgccacgctccccaaccgcgaaaatgcccgaaacgagttgaaggcaccgtgccgcaagaaaaacgataagtgacgaaccctctgttcaaaaaaaggccgagccatttcggcatcggcggccctttgcccccaagaaagacctgcaccgattcctcaaattggccaatgtcgtgcgcatccagcgccagcgtcgcatcctcaagcagcgcctcaatgtgcctccggcgctcaaacagttcacccgcaccctcgacaagaacctcgctaccaacctgttcaagatgcttctta

SEQ ID NO: 668 - DNA, 352 bp, Zea mays
  Clone ID: LIB143-060-Q1-E1-D7
gacccacgcatcaagggagagagagagagagaagagagagagaagagagagagagagagaggagtgggagacccgcgagaggctgccgtgtatggaccgtagactcagcgactgcgaaggacggataaggggatggccggattcggaccgttcaggcaggactggaacccgttctttttccggaaaaaggaaccaacggccgccccaagaaagattaaaatggccttcacgccgccccccgcccccgttccgaaattcattccattaagaagtacaacgctggtacgaacaaggcggcatccagcggtacatccctcaacaccaagcgcctcgacgacgacaccgaaaacct

SEQ ID NO: 669 - DNA, 426 bp, Zea mays
  Clone ID: LIB143-060-Q1-E1-D9
ggccgacccacgcgaccagtccccactcgtcgcccatctgccgtgacgtcaccccattcttcatcggttcccttcctcgcctcggttcgcgggtacgccgagtcgcagacgcacctcaatcgcaaccttttggactcaaaggggggcaatagacagcagggaacagaactgagcgaggagattcccaaggatctcgtcggacgctagaggaagggacgggggacgggcgatggcgggggacgccggcagcggggtggactgggagagcctggcggaggccacctccggggcaatcggctcgctcgtcagcaccaccgtgctctacccgctagacatctgcaagaccaagttccaggccgagcttcagacgcaccaaggcgcgcagaagaaatataggaacctttcagatgtgttctgggaagcgat

SEQ ID NO: 670 - DNA, 358 bp, Zea mays
  Clone ID: LIB143-060-Q1-E1-E1
taaatgcgattgtacactcactcggatcctaatcgatggttcgcaattaacgttacatgtatgcacatgtgcgttgtctgaagacattgtgctatcgcagtcgatggagagagcactgactgtgacatgtgactctgtctgctcatctgcttgcacgataccactcaatagggggatcatcaaattcaggcagcaacagttatcgcgggttgagacaactacaggatgttgggtgcaacacatccggaaggtatcaaagggtcagtcatcattagaactcaatgttgaaaaacacgatgctgtaatcaatggtcatgcttggagaccaggaattggtgcctgcctacatgtagctaaa

SEQ ID NO: 671 - DNA, 411 bp, Zea mays
  Clone ID: LIB143-060-Q1-E1-E11
acttcatccctgatcggcgatcgcgtcgagcgagcagcgctataacgcacgatgaacttggcgtccgtcgttccctgcgcgcaggcattcctcgcgttaatgactcccgccgctggctcccaccgtcgggtccacacgcatgcggcggcctccaagagcggattggcctgccgcgtcgcgcgcagcgggggcacccggtggctgccggtctcctgtgcagccgggggcggtgcagttggtgacacttttgttactgaggacactacaaatgtgatgtttcctcgggaagtaacagttccaggctatacacacccattggttgcagttggcacaggttacagagaaaagttttttgtcaaagtatatgctgccgcgttctatgtagattactcacttcgccttgatactgag

SEQ ID NO: 672 - DNA, 413 bp, Zea mays
  Clone ID: LIB143-060-Q1-E1-E12
agcctcagttcgtatatcatccatactggtggctggtgccatttatttccattcaccaccaacctgacgagcactgttccgtctccctcgtctctgttctgttctgttgtgttctgtcccagttccagttccagacgagagaaacgcaggcggggcaggcacactgctaccgagcctggcgtcgtcgctggcagtggcatgcgctgaaagaccaccgaaaccacatgtggccagcaggcgcggaggacccgatgggcgtgggcgtggcgggcacggcgggcatgagccacggccccgcggcgccgtcgccgaggtcgtcgagcacgatgccggcggcggggcagtcgccggtgccgtacctcttcggcgcgctggcggccatgctggggctcatcgcgctgtcgctgctcgcc

SEQ ID NO: 673 - DNA, 374 bp, Zea mays
  unsure at all n locations
  Clone ID: LIB143-060-Q1-E1-E3
agttatactgctgggataccgcagggcaagagaagtttggtggcctcanggatggatactatatccatggccagtgtgcgatcatcatgtttgatgtaacttcaaggcttacttacaagaatgttcctacgtggcatanggacctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgagaaacctttcctgtaccttgcaaggaagctggctggtgatccgaaccttcactttgttgaagctgttgctcttaagcct

SEQ ID NO: 674 - DNA, 366 bp, Zea mays
  Clone ID: LIB143-060-Q1-E1-E6
acaaaaaccaaaataatcgccaccgctctccgcaccgaaccgaagcagcggcgatggcagcggagaagccggctcccgtgcgcgtgctctactgcggcgtctgcggcctcccggccgagtactgcgagttcggccccgacttcgagcgctgcaagccctggctgcgcgcgcacgcgcccggcgtctaccccgacgaccttgtcgccgcctcctcctcacccggaggcggcgacaaggacgtcgacaaggtcggggatcgcctccagggcgtcggaatctccgacggctccacaagcgccgcaggggatgcttccgcgtctaagccccaagaggcgaaacgcctgcctggtggtaagctcaagaaaa

SEQ ID NO: 675 - DNA, 395 bp, Zea mays
  Clone ID: LIB143-060-Q1-E1-E7
acttctcctttttgtttgggaggtcgccaaattccatcccatctctcagcgtcgtggtctccccgatatggatgggggaagagacaagctcgaacaaggaggctacgggcattgctttatgtttgtgacgctaaaggatctctatccatcattgtttccatattatcatggtattattgccttcaatattattctctatatcaactacagctaccgtggaggagttgatagtgaaggttgtccagttatttgtcgttgtcggtgctcactttcttcttcgctgcttgattcttgagttatttggtctatatgtagcaaatgtgattgaatcttaactgtcagtggacataattagacattttcaataagaagaatttcaattttagttgaatcct

SEQ ID NO: 676 - DNA, 382 bp, Zea mays
  Clone ID: LIB143-060-Q1-E1-E8
acccacgcgtccgctcctttttcattaatctaagttgatcactaatgtcagcggggtcttttataatctgatgatgccggtcttctgactgacggaacaaatggacagattatgtaggtagagagaggttgactactctgtgccgtatcattgtacatgcatgcagcagaaatttcggtctctgctttctcgcggtcaatagccagccctgagtctgcctcaattgtcataaaaagaaaagaaaagaaaagaaaagaaaaaaggttgctgcaacgagtttccaagtccagtcccacaagagacgttggacagacagggacagggacactacggcaggcactcggtagcaatcaagaagatggccggcgggcacaaggacaag

SEQ ID NO: 677 - DNA, 405 bp, Zea mays
  Clone ID: LIB143-060-Q1-E1-F10
aaaattaggagaccaacagcacgaagggggaaaaaaggagagcagaaatccccaatccctcctcacttcgacccttgctcggaatctccccgcagcgtccggctgaatccattcgattcactcatggtaggcttcgtcttcttctgctgattcgctggatcgtctccaccgacgcggctgcgcccacacctgccgtcacagccatggagccgcgcatcggcaacaggttccgcgtcggccgcaagctggggagcggctcctttggggagatctacctcggcaccaacgtgcagaccaacgaggaggtcgcaattaaactggaaaatgttaagacgaagcatcctcaattgctttatgagtcaaaattatacagaatacttcaaggaggaactgggattccaaatg

SEQ ID NO: 678 - DNA, 408 bp, Zea mays
  Clone ID: LIB143-060-Q1-E1-F11
atctctgccttcctgcctgcttccctccctccgtcagatccccgctcgggttgccatggcggaccagctcaccgacgaacagatcgccgagttcaaggaggccttcagcctcttcgacaaggacggcgacggctgcatcaccaccaaggaacttggcactgtgatgcgctcattggggcagaaccctactgaggctgagcttcaggacatgatcaatgaggttgatgctgatggcaatggaaccatcgactttcctgagtttctcaacctgatggcacgcaagatgaaggacaccgactctgaggaggagctcaaggaggccttccgtgtgttcgacaaggaccagaacggcttcatctccgctgctgagcttcgccatgtcatgaccaacctaggcgagaagctgac

SEQ ID NO: 679 - DNA, 392 bp, Zea mays
  Clone ID: LIB143-060-Q1-E1-D12
agacagcctgaaatacattggcattgagctgtggcaggttaaatcaggcactttgtttgacaacatcatcatcactgatgatcctgcgttggccaagacttttgcagaggagacatggggcaagcacaaggaggcagagaagactgctttcgatgaggctgagaaaaagaaggaagaagaggaagccgccaagggtggcgatgatgacgatgatgacctagaggatgaggcagacgatgacaaggcagacgatgacaaggccgactctgatgccgaggatgacaaggactctgaggagcacgacgagctctagatgatgagtatgatagaggtggccactgacattggtgccgttggcctggatttatcagctcttccattttgttctcctt

SEQ ID NO: 680 - DNA, 391 bp, Zea mays
  Clone ID: LIB143-060-Q1-E1-B7
gccgacccacgcatccacctcctcctcctcgctctcctcggcgttgcaggcagctcagtcgccgccgctgctcctgaggcggatgtcgtcgaccgcaacaccgagacggcggtacgacgcggccgtcgtcgtcactaccaccaccactgctagagctgctgcggctgctgtcacggttcccgccgccccgccgcaggcgccggtgccggcgccggtgccgccaaagcaagcggcggcacccgccgagaggaggagccgtccggtgtcggacaccatggcggcgctcatggccaagggcacgacggcgttcatcccgtacataaccgccggcgaccccgacctagcgacgacggtcgacgcgctgcggctgctggacggctgtggcgccgac

SEQ ID NO: 681 - DNA, 51 bp, Zea mays
  Clone ID: LIB143-060-Q1-E1-B8
acggcctcgtcagtgcggacggcgaatcatcgcgcccttccaccatcgatg

SEQ ID NO: 682 - DNA, 364 bp, Zea mays
  Clone ID: LIB143-060-Q1-E1-B9
aggaacagagccaagaaacaagcccggaagatggcaggcggcggagtggtgaagcacatcctgctggcaagcttcaaggaggaggtgacgcaggagcgcgtgggcgagctcatccgaggatacgccgcgctcgtcggcgtggtcccctccatgaaggcgttccactggggaactgatgtgagcatagaagacatgcatcaagggttcacgcacgtcttcgagtccacgtttgaaagcacggaaggaatcaaggagtacattgagcaccctgcacacgtcgaattcgcaagtgtgttcttgcctgtgctggagaaggtcctcataatcgactacaaaccgacgtcggccaattaacggtagaaca

SEQ ID NO: 683 - DNA, 373 bp, Zea mays
  Clone ID: LIB143-060-Q1-E1-C1
aatgatgcgcagcatcctcatttgagcattccagagactgaaactggaaaaccacgtcggcaatatcggcaacttctacaccgttcgccaatggatgtctctgttggagctgctgttgcagttgttggcttagctgcctatctggtttatgcagctcggaagaactcgtcctcttgaagcctcacgtactggacaattggggaaataaggcccttccatcctgcgacctcagctggatccatgctggttgaagttcgtcgcttgggtttttatcctgcatgaaaccaacgtttttgtacagacatgtcatcagctatcaattatccggtcaactggcgtttcagattcagacatcacctggctccgtaaaaat

SEQ ID NO: 684 - DNA, 384 bp, Zea mays
  Clone ID: LIB143-060-Q1-E1-C10
acgcatccagcgttgtctcacacgcccaagtcccaactcccaccgcccccgcctgccgttcaaatctccctaccctcccgaagtaggcaagtagccctccctgttcatcgagggggcagatcagtgagccgaacaacgaagcatgccgtccaagccgaacgccgcgtcacgcctcgtcttccgcgctttcctcctcgtcatcagcgccgccgcggacaacgataacaccgcggcacggctgacgatggagtagttcacccgcttctccgcctccgacgacagcgagggcccttccaacgacttccaggtcgagtcccaaggcctccagcgtcagatcgatgatcgggcctcgttcacgaagccgcccgcgacgtcggtgagccg

SEQ ID NO: 685 - DNA, 347 bp, Zea mays
  Clone ID: LIB143-060-Q1-E1-C12
acccacgcgtccgcccacgcgtccgcccacgcgtccgggagagagaaggaaccaaaaaaaaagctcggaatttgtagtctccaagccgtgcgacgaccggacgggaaggggaaaaaagggagggccgccgctgaattcgccgtcggtgaggagatcggttcctgcttgcagaggcggcaacaagcgctgcaaaggaaggaggaatttggaatggctgttgacaaccatgtggtggttgacttgaacggcttaccaaattccaaggataacgggggttccaagaacctgtctaaggatccaaatggttcggctccggctgctgcatctttgtcaacacctgttgactt

SEQ ID NO: 686 - DNA, 374 bp, Zea mays
  Clone ID: LIB143-060-Q1-E1-C2
acgcgtccaatgaagcgcagcatcctcatttgagcattccagagactgaaactggaaaagcacgtcggcaatatcggcaacttctaaaccgttcgctaatggttgtctctgttggagctgctgttgcagttgttggattagctgcttatcgggtttatgcagctcggaagaactcgtcctcttgaagcctcacctactggacaattggggaaataaggcccttccttcctgcgacctcagctggatccatgctggttgaagttcgtcgcttgggtttttacccggcatgaaaccaacgtttttgtacagacatgtcatcagctatgaattatccggtcaattggggtttcagattcagacatcacctggctccg

SEQ ID NO: 687 - DNA, 386 bp, Zea mays
  Clone ID: LIB143-060-Q1-E1-C3
aggaaacttccttcacaagatgcgttgaacaccctgggaatcacccacgccacccatctcaccactgcaccactgcgcgcttcatactgctggccgggctgctccagcaccaggaacgctcgctcctgctcgtcgacgttagattttcccagacgcgcgagctccccagcaactccaacacgttgctcgcctcgctcagtcttcaagccatcgtgccgctggttctagccaaagtggggcgcgttctttccttcgccaggcagcgcctccagtcgtcgtttcttttccacggctgcacgctcaccgactcaagcgcttggccatggagctcggtttcgtgtgtgcctgtgctgggtcaccaggtcacgtgctcgtccgttttgatg

SEQ ID NO: 688 - DNA, 370 bp, Zea mays
  Clone ID: LIB143-060-Q1-E1-C4
acaacacggcaccacacctcttcttcttcttcctcctcctcctagcacagctagcgcctgctccccttcgcctgtgatcatgtcttgcaccagcggcaagtgcgactgtggctccagctgctcctgcggcatctcatgcaactgcatgtccactaacgtagtcaccaccgccgccagcagcatcaacaccatcgtccactccgcaccgatcactaccgctagctccagccgctttgaggcgcgtaccgacggtcgccgctgcgactgtcaaatctgcaactgctgtacaaggttccgctgctcctgctgcagctgcaactgaaccggtcacgcgatcgtgctatacagtccagaggacgacgactagtcg

SEQ ID NO: 689 - DNA, 369 bp, Zea mays
  Clone ID: LIB143-060-Q1-E1-C5
acccacgcatcaagagcggtccaagaacatgaagggcaagtgtgcgatggcggcggcggagggcgtggcgaagcggctggtcggcaacgggctgaagaacaacgggctgctgttcacggggtaccccgtggtggggtaccacgggaagatgcatacgtcgggctcctgcgcgcgctcctcggctgcagatctgctcagcgcgtgcgggtgggattccaagttccacggcctcttcttctacgagagcacagggatcttctcgccggcccagttccgggacttcatcctctactttcagcgcctgcggcacctcgccggatcggacaggctctgcggcgtcgacgtgtataacggactcctggtccggtt

SEQ ID NO: 690 - DNA, 391 bp, Zea mays
  Clone ID: LIB143-060-Q1-E1-C6
atccacgctgtttcttttctttcttccttctctccacctcttcccccctccccaaattcgcgtcgaacgaattcgttaaataatctcagaaaacacacgattgactggatcgaagggattaaaacgagaacgttcagatcctgtgatcaggtctcggggctaatcgtgtgatacttcggcgtgctttggcttgtgattcagtgatatagggtttcggatctggagaattagttctcccgacttccgagtcagaccatgaatgagcagatgatgcgacctacggcgccgctgccgttccaccagatgtgggcggcggtgccggcgatggagcctccggtgggcgcgttcaagccggcgcggcaggcctggaagcgggcggcgcggacgccct

SEQ ID NO: 691 - DNA, 378 bp, Zea mays
  Clone ID: LIB143-060-Q1-E1-C7
agttcggaaccaacggcccgtccgcctccctctccgcctcccgtccccaacgccaatagttttcaagtggcaatggcggaccaggctaaccaacccactgtccttcataagctcggtggccagttccacctgcgctcgatcatctctgaaggtgtacgggcccgtaacatatgcccatctgtctcatcttatgaaaggagatttgccacatggaactacatgacccatagcctttggggcccctcactgtctgttagccgtggcatcaatgtcccaatgatgcagactccgctctgtgctaatgctcctgctgagaaaggaggcaagaacttcatgattgatttcatgatgggcggtgtttcagctgctgtttcaaag

SEQ ID NO: 692 - DNA, 373 bp, Zea mays
  Clone ID: LIB143-060-Q1-E1-C8
agttcggcatcgacggcgcgtccgcctccctctccgcctcccgtccccaaggccaatagttttcatgtggcaatggcagaccatgctaaccaacccactgtccttcataagctcggtggccagttcaacctgcgctcgatcatctctgaaggtgtaagggcccctaacatatgcccatctgtctcatcttatcataggagatttgccacatggaactacatgacccatagcctttggggcccctcaatgtctgttagcggtggcatcaatgtcccaatgatgcaaactacgctctgtgctaatgctcctgctgagaaaggaggcaagaacttcatgattgatttcatgatcggcggtatttcagctgctgttt

SEQ ID NO: 693 - DNA, 397 bp, Zea mays
  Clone ID: LIB143-060-Q1-E1-C9
accagcgttgtctcccactcccaagtcccaactcccacctcccccgcccgccgttcaaatctccctagcctcccgaagtaggcaagtagccctccctgttccatcgaacccagcagagcagccagccgaacaacgaagcatgccgtcgaagccgaacgccgcgtcgcgcctcgtcttcctcgctttcctcctcgtcatcagcgccgccgcggccaacgatgacgccgcggcgcggcggacgatggagcagttcgccggcttccccgcctccgacgacggcgagggcccttccagcgacttccacgtcgactccgagggcctccagcgtcagatcgatgaactggcctcgttctccgactcgcccgcgccgtccgtgacccgcgttctgtacaccgac

SEQ ID NO: 694 - DNA, 202 bp, Zea mays
  Clone ID: LIB143-060-Q1-E1-D1
agacagagcgggtgatctgaagaccacgaccccgatcggcgacaggtacggtgtgcgcggtcaccggccgtccagtccgggcagtcgtccccaaggcgaactacgacaaggggattcaatcctacaagaaagccgttaccaacggggggtctctggcggcgtctgcgaagctggtgcggggccttgtgaacgaactggtccc

SEQ ID NO: 695 - DNA, 415 bp, Zea mays
  Clone ID: LIB143-060-Q1-E1-D10
acgcgtacgtacgtcccaaaccaaaccatgtccgcgagagctcttctcctgacgaccgcgacgctgctcctgctcgtcgccgctgcgcgtgcggggcagccgctcgccggcgggtggagcccgatcaggaacgtcagcgacccgcacatccaggagctcggcggctgggcggtgacggagcacgtcaggcgggccaacgacgggctgcggttcggcgaggtgacgggcggcgaggagcaggtggtgtccgggatgaactacaagctcgtcctcgacgccacggacgccgacggcaaggtcgcggcgtacggggccttcgtgtacgagcagtcgtggaccaacacccgcgagctcgtgtccttcgcgccggccagctgaccaccagctggacgtaattaatcagcggcgccgcaat

SEQ ID NO: 696 - DNA, 406 bp, Zea mays
  unsure at all n locations
  Clone ID: LIB143-060-Q1-E1-D11
aattcctcccaacaccacctcgccgcgatctccgtagcctccgtcgcgtcgagcatcgatcatgtcggcctactgcggaaagtacaaggatgagctcatcaagaatgctgcctacattggcacccctggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctcnctggcatcaaggttgacaaggggcacattgaagttgttggcactgat

SEQ ID NO: 697 - DNA, 357 bp, Zea mays
  Clone ID: LIB143-060-Q1-E1-B6
aggaccctgggacatggaacctgacgccagtcagctaccaggatgattggcatgttggttttgtctacgaacgaaatggagttcctattggcgctcactcaaactcctactggctgtacattgtgccgtggggcatcaacaaggctgtcagctatgtcaaggaaacttacaaaaatcctacaatgatccttgctgaaaacggaatggaccaacctggtgatgtcagtattactcagggtgtgcatgacacagtaagaatccgttattacagagactacattactgagctcaagaaagcaatagatgatggtgccagagtcattgggtactttgcgtggtcgctgcttgacaacttcg

SEQ ID NO: 698 - DNA, 387 bp, Zea mays
  Clone ID: LIB143-059-Q1-E1-H9
acgaggctactcgtcatcctgttcgccggggcgaccctagtagtcgccaccaccgcgcacgagcaccatggtgaggcgcccacctgcgccggaggcagcgagcacgtgcttgcggagttccgccccggtgaggtgaccgtggacgggcacaacgaggactgggagagcgtggaggcctcggagttcgcgctgctgccggctctagatccagacgatgataaggcctactccggcggcaagatcgccgtaaaggctgtgcatgatggcgtcaacgtcttcttcttgcttcaggttgatggggcttacgcttacactaaaggggaaagtaacaaatgcccttctgttgctctgatgttccaagttggagagaaagccacattttacaat

SEQ ID NO: 699 - DNA, 305 bp, Zea mays
  Clone ID: LIB143-060-Q1-E1-A1
atgtagtgttataagccacaatacaagtcactacgatggtgtgaggaacagaaagtttacaatgtcgcggcattggccaattcttactctttttacatgaggaacatatgatgactattttgccgcaccacatgccaataccaatatccgttttgcgctggtcatcggcacctttgggatctatctatttcgccacgatgtcaagaaacaccgttactaccactctttggacctctaccagtttatgcccacatgatccgttcacggtcagaaactggaccaactttaccaagcactggtgctgt

SEQ ID NO: 700 - DNA, 393 bp, Zea mays
  Clone ID: LIB143-060-Q1-E1-A11
cgggccgacccacgcatcaaagaaaaagaagatcaaggaggtttctcacgagtggtcattgatcaacaagcagaagcccatctggatgaggaagccagaagagatcacaaaggaagaatatgctgccttctacaaaagcttgacaaatgactgggaggagcatctggctgtgaagcacttctctgtggagggtcagctggagttcaaggctgttctctttgttcctaagagggccccatttgatctcttcgacacaaggaagaagcagaacaacatcaagctctatgtgcgcaaggtgtttatcatggacaactgtgaggaactgatccctgagtggctgagttttgttaagggtactgttgactctgaagaacttcccctcaatatctcccg

SEQ ID NO: 701 - DNA, 339 bp, Zea mays
  Clone ID: LIB143-060-Q1-E1-A12
atgttgctccctctaatagaagtatctcaccacttcgtcacgctcacgtccgatccgtccacatgtgatacgccgatagatggaatcatccatgtccatgtcggcggccgccacagtcgtcttacagatatccgtgacgaccagcgtcatgttgcgcatctcactgtccttgatcaggtgcactttacggatgatcgcgctatgcctccgctggacgtacatcatcgctaccacagactcagcagtcatgtcaacaacgctctcgaactacgcacggtgcctatcagcggcagttatccagtactagagccggaattccagaatcgtgatcacgatagt

SEQ ID NO: 702 - DNA, 342 bp, Zea mays
  Clone ID: LIB143-060-Q1-E1-A2
gggatcgtcgcgtgcaggaagcggaccgacttcggatacgacacggatttcgaggtgcgctactcgcttgggaagctgctgggccaccgccagttcggctacacctttgccgccgtcgatcgcgcctccaccgagcgcgtcgccgtcaagcgcatcgaccagaataagatggtccttcctgttgctgttgacgacgtaaagagagaagtttgcatcttaaaggcattacaagggcacgaaaatgttgtacacttttacaatgcattcgaagatgacaactaggtgtatatactcatggaattatgtgagggtggcgagctacatgatccgatattagccaat

SEQ ID NO: 703 - DNA, 340 bp, Zea mays
  Clone ID: LIB143-060-Q1-E1-A3
cactagtctgttgaagctcaacctgggccaatcttacgtaagaatggaaccacccaaggaatgaagggaaaggagaaggatttcgccttgggcccaaaaagtttctcggagcccaacccaatcggaacggcggccaagggcacggccaacagggactacagggagcccccgcgggccccgctcttcaaccccggagagctcatgtcctgatctttctaccgccccggtatcgcagagttcgtcgccaccttcctcttcctctacatctccatcctcaccgtcatgggcgtctccaattccacctccatgtgcgccaccgtcggtatccagggcatcccct

SEQ ID NO: 704 - DNA, 300 bp, Zea mays
  Clone ID: LIB143-060-Q1-E1-A4
ccacgcgtccgataaattcttctagctctagctaggctcgtctgctgcaagaaggtaacagcgcaggcatggaggggaaggaggaggacgtccgcctgggcgccaacaagttctcggagcgccagcccatctgcaccgcggcgcatggcactgacgacaatgactacaaggagcccccgccggcgccgctcttcgagcccggggagctcaagtcctggtccttctaccgcgccggcatcgccgagttcgtcgccaccttcctcttcctctacatctccatcctcaccgtcatgggcgtct

SEQ ID NO: 705 - DNA, 327 bp, Zea mays
  Clone ID: LIB143-060-Q1-E1-A6
agtgcgtgcctggcaagtggcaaactcgagctgtctagtcctcggttcgcgaatcttccacagagaggcagacggcaggactcgcttcaagctcctcatctcgcgcaggggggtcgcctgagatcacagagacaatggtgaaggcagttgctgtcctcgccggcactgatgtcaagggcaccatcttcttttcacaggagggggatggtccgaccaccgtgactggaagtatctctggcctcaagccagggctccatgggttccatgtgcacgcgcttggcgacaccaccaacggctgcatgtcgactgggccacacttcaatcctg

SEQ ID NO: 706 - DNA, 341 bp, Zea mays
  Clone ID: LIB143-060-Q1-E1-A7
gcctggcatacgtggcagactccaactgtctactcctcggttcgcgaatcttccacagagagggaaactgtaggactcgcttcaagctcctcatctcgcgcaggggggtcgcctgatatcacacatacaatggcgaatgcagttgctgtactcgccggtactgatgtcaagggcatcatcatcttttcacaggacggggatggtccgaccaccgtaactggaagtatctctggactctgaccacagctccatgggttcaatgtgcacgcgcttggtgacactaccaacggctgcatgtctactgggtcacatttcagtcctgttcgcatagaccatgatgc

SEQ ID NO: 707 - DNA, 156 bp, Zea mays
  Clone ID: LIB143-060-Q1-E1-A8
acggacgcgtgggcggacgcgtgggcggacgcgtgggaaaaaaaaaaaaaaaaaaaaaaaaaaaaaaaaaaaaaaaaaaaaaaaaaaataaaaataaaaatataaaaaaggagaaataaaaaaaaatggcggcatataagggggttcgatgtttag

SEQ ID NO: 708 - DNA, 356 bp, Zea mays
  Clone ID: LIB143-060-Q1-E1-A9
cacgaaccaatttctcagcaaccagcagcacgacctgtgagggttcgaaggaagtagcagtgttttttgttcctagagggaggaagagatggcaaagggggaggggccggcgatcggtatcgacctgggaacgacgtactcgtgtgtcggcgtgtggcagcacgaccgcgtcgagatcatcgccaacgaccaggggaaccgcaccacgccgtcctacgtcgccttcaccgacaccgagcggctcatcggcgatgccgccaagaaccaggtcgccatgaaccccaccaacaccgtatttgacgcaaagcggttgattggtaggaggttctcggacccttccgttcagagtgatatga

SEQ ID NO: 709 - DNA, 399 bp, Zea mays
  Clone ID: LIB143-060-Q1-E1-B10
cgctgggctcgggcccgcggagccgggatatactccagggaagtcgagcaaggagagcgtggattgtggactacaggggtaaagatcgagtgagcatcgctggaggaggcgcccttctatctgctgtgcacctctttttcttctgctactattacatttggcatttgctagacctctctttcctctaccgagtaagacaaagaatgaagagaagaagcccatacagacgtttcggccatataacattgctcatcgtggatcaaatggggaaattcccgaggaaacagctgctgcatacatgagggctattgaagaaggggcggattttatagagtctgacatccttgctagcaaagatggggccttgatttgttttcatgatgtaacacttgatgatac

SEQ ID NO: 710 - DNA, 373 bp, Zea mays
  Clone ID: LIB143-060-Q1-E1-B11
aggagccaagactcttgtggttccaggaaacctcccaattggatgcatcccagactatctgatgatattcaagagcaataaggaagaggattatgaaccacagacaggttgtcttaggtggatgaacgagttctcacagtatcacaacaaggttcttgtggagcagctcaagaagcttcgcaagcttcatcctggagcaaccatcatctatgctgattactatggagctgctatggaaattttcctttcccctgaacaatatgggatcgaatatcccctagtggcttgctgtggtggagaaggaccctacggtgtgtccccatctacaggctgtggattcggagaatataagctgtgcgataatccagagaag

SEQ ID NO: 711 - DNA, 416 bp, Zea mays
  Clone ID: LIB143-060-Q1-E1-B12
acccacgcaaccaggagccatgactcttgtggttccaggaaacctcccaattggatgcatcccagactatctgatgatattcaagagcaataaggaagaggattatgaaccacagacaggttgtcttaggtggatgaacgagttctcacagtatcacaacaaggttcttgtggagcagctcaagaagcttcgcaagcttcatcctggagcaaccatcatctatgctgattactatggagctgctatggaaattttcctttcccctgaacaatatgggatcgaatatcccctagtggcttgctgtggtggagaaggaccctacggtgtgtccccatctacaggctgtggattcggagaatataagctgtgcgataatccagagaagtatggatcatgggatggcttccatccatcag

SEQ ID NO: 712 - DNA, 355 bp, Zea mays
  Clone ID: LIB143-060-Q1-E1-B2
acaacaaggcaccacacctcttcctcctcttcctcctcctagcacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcgaggcggccaccgagggcggcggctgcgactgcaacacctgcaactgcggcaccagctgcggctgctcctgctgcagctgcaactgagccggcccgcccggcccggcgatggcgcacgagagt

SEQ ID NO: 713 - DNA, 402 bp, Zea mays
  Clone ID: LIB143-060-Q1-E1-B3
acccacgcgttccacacactagctgtagcttgcaaagcgtcgtctgtaaatacttaccccttccacaagcaaggcaagggggaaaagcatcgtcagctagcaaagagagtgcgtagcaactagctagcaatggcggagaaccctgctccgagttccccgctagtgacttctcccgacgccgctgcgccgcctctgccagcggagttcaccaagctcaccttccgtagcctgtacatccgtcggacaggtccaggcagccgggagatgactgtggacgggaggccgtctgaccagctgggacgacggttcgtgagcgactttcccatatacgatggccgtggctccggcgcccgcctcgtcgctcgcttgcagggagtcactgtccaaatcggcagctcgcaa

SEQ ID NO: 714 - DNA, 375 bp, Zea mays
  Clone ID: LIB143-060-Q1-E1-B5
cggacgcgtgggcaaacattggtggacctcttcctattaccaaacctctggaccctccagacagacctgttgcttacatccctgagaacacatgcgatccacgtgcagctatctgtggtgtacatgacagccaagggaaatggttgggtggtatgtttgacaaagacagctttgtggagacatttgaaggatgggcaaaaacagtggttactggcatagcatagcttggaggaattcctgtgggcgtcatagctgtggagacacacaccatgatgcagatcatccctgctgatccaggtcagcgtgagtcccatgagcgatctgtcccgcgtgctggacaagtgtggttcccagattctgcaaccaagatcgcgc

SEQ ID NO: 715 - DNA, 377 bp, Zea mays
  Clone ID: LIB143-059-Q1-E1-H8
acccacgcgtccgggcacggtgagcgcgcagctcaggacgcacttcgccgagatcagggtggaggccgccggcgagggcgcctgcgtcgccaaggtcaaggtcgactacgagcgcctcgacggcgcgccgctcgcgcccgaggacgaggccaggctcgcgcaggggtacgtccgcctcgtcaggatggtggaggcatacctcgtcgcgcaccccgacgagttcgcctgagccgccacctttcctacgtacgtcagtacgtgtatgatcatgctatatggccgtgagtgttttggtttggaataacgggaggaaaggctcctctgtttggttgcttcaattcgcttcgaatcgagtatagacgtttgtgagtttgtgt

SEQ ID NO: 716 - DNA, 381 bp, Zea mays
  Clone ID: LIB143-059-Q1-E1-G1
atgctctcattgacaacagacaacaagcagtctggaaccttcaacctgtctggatccattagacggcaggttctgtctcccgctagttctcttcttagtccatgtagggggtgtttggtttgaggaatcactttatccaaaatgtagtggtgcatcatgggtccattcctcaaatttgttgggatgacctcattcctcatattagtactaactaaataactataaggaatgaggtgatgatggatcaactcaatccattacacaaaccaaacaaaaaattgaggagtgagaagacgatgacctagatcattcttcaaaccaaacagcctagtagtgttaaatgttttgcataccatgggcaccgttttgataaagttgtct

SEQ ID NO: 717 - DNA, 244 bp, Zea mays
  Clone ID: LIB143-059-Q1-E1-G10
cgacccacacgtcagtctagatcgcgagcggccccccttttttttttttttttttttttttttattatttttttattttttatttatttatatttttttttttttttttattttggtgggggtgtttctttttatattttttttttatagaaaaaacgcggagcttgagcatcaaagaagacgcgaacgaaagacggaggtgcaccaccaacggagatgtaaaggggagcaaaggggaaaaacc

SEQ ID NO: 718 - DNA, 386 bp, Zea mays
  Clone ID: LIB143-059-Q1-E1-G11
attattgcttgcagcaagggatgaagcactattgaagatcttgcggagaagtatcctgatatgattatcaaggttcctgttgatgtatttaaaggaataacagacgaggatgcagctaaagttgttgatggtctagctctaaagtcagcggataggcagtcttctatagaacagattaagaaactgtatgaacttttctgcaagtctgattgcacattgctggagataaatcctctggcggagacagctgacaacaagcttgttgctgctgatgcaaagttgaactttgatgataatgctgcatttagacagaaagaaatatttgcacttcgtgatacaactcaggaagaccccagggaggtcgctgctgccaaagcagatttgaa

SEQ ID NO: 719 - DNA, 377 bp, Zea mays
  Clone ID: LIB143-059-Q1-E1-G12
aacaatagttcgaggatcctgccgaaggtgaagaagctttggtcggcaaatttaagaaactgtatgatgacctcaccactggtttccgcaatctcgaagacgaggcacggtgaactagtgtagattctgtgtaaacaaggactgccaaatgttttataagatacataaattgtagattgagatcatctgtaagaattattcccaccgttgcaccatctcttcgccaccactgttttagtcatcggtgcctgatgggcaccctgtttatttcatgtatcatttattgctgtcattgtaataagcgatgggcatgattgtagttgaataagtacaatgtccatgtattcagacaccagtatcgtgcttatttgtttgtt

SEQ ID NO: 720 - DNA, 419 bp, Zea mays
  Clone ID: LIB143-059-Q1-E1-G2
gggccgagccacgcgtccactttcacccagatggtaaaacccttttctgtggattagaccaaagcttaaaggtattctcttgggaaccagtaaggtgccatgatgttgttgacatgggttggagtaatttggctgaccttagtatttatgaagggaaactcttgggatgctcctaccatgagtgccgtgttggtctatgggctgctgatatatcactcattggaccctatgctcttggtgtattgcccaaagcgaatttttttgctgagcttgtgcagtctatggaagataatcctgtgaaaccagttgatagcactgcaaattctcgtcctgcttcagcaatggcacattcaagaagttcatacaaaatcaaggagtctgggattgctcaaagcaaggttcgtggctcacatttgact

SEQ ID NO: 721 - DNA, 368 bp, Zea mays
  unsure at all n locations
  Clone ID: LIB143-059-Q1-E1-G3
actctaagaagactctcaggagctcagccgagaagtttgagttccaagctgaggtttccagactcatggacatcatcatcaactcactctacagcaacaaggatatcttcctgagggagctcatatctaatgcctctgatgctggataagattaggttcctttcccttactgataaggaagttctgggtgaaggggacactgcaaagcttgagattcagattaagttggacaaagagaagaaaatcctctccattcgggatacgggtattggtatgaccaaggaagatcttattaagaaccttggaacgattgctaaatctggcacttcangaacaggagctgctcgagtctcttgtcgaagctgata

SEQ ID NO: 722 - DNA, 390 bp, Zea mays
  Clone ID: LIB143-059-Q1-E1-G4
agccgacgtgcgctcgctacccctctccctcaaggcctttgccggcgaaaagcgcccattcgcccaccaggatgaagtttgttgctgcctatctgcttgctgtcctcgctgggaactccagcccctctgccgaggacttgacatccattctggagtcagttggctgtgaagttgacaatgaaaagatggaactccttctgtcccagctgagcggtaaggacattaccgagctcattgccgccggcagggagaagtttgcttcagtcccatgtggcggtggcggtgtggctgtcgcggcagctgcccctgctgctggcggcggcggcgctcctgcagctgaggcgaagaaagaagagaaggtggaggagaaggaagaaagtgatgacgaca

SEQ ID NO: 723 - DNA, 399 bp, Zea mays
  unsure at all n locations
  Clone ID: LIB143-059-Q1-E1-G5
aatgcagcatcggtggcttatgctcaggtctttgctcctcaccatggatgggcaataaggaaagcagtttctgctggaatgtacgcccttccctcaaagtcccagctgttgaagaaattgaatgaagatgaggaatcagcaaaggtccaaatgcagaactttgtcaggtcatcagctccagtaatctgctatgttgatgaccttttcacctcaaggaatttgggcatagattggtgaagaaaaatatggatacgtttgtttgatgtactaatccagtcagatggtgtgctgtgtgagctgggctcagaaaacctttttctggatccgtgtttccaagtcgtaaactaatataactacttaacgattcaaaanaaaaaaaaaaaaaaaccaaaagaaaaa

SEQ ID NO: 724 - DNA, 395 bp, Zea mays
  Clone ID: LIB143-059-Q1-E1-G6
tccattccttcatcccgtgtccgccgccggcgagtctacccagccgcggggctcggtgccccggccatccatcccctgcgaatctcgatccgccctcaaagggagtcaagcctcctccagcctttcctttcaaatcggatttgtttgctcaagttgcaagatggataagaggaccaaggttgcagtttgtgttgctgctgcacataacttactgtcaatgatggccgtgattattgcgtctagaaaaagaaaacgaaatgcaaggagcgcacagattacctatgcaccattgcatgtgagtggtacaggctgggatgaagataattttgttattactctggatgaagagcactataatggttatgttaaggatgacaaaagcgatgctgattgtt

SEQ ID NO: 725 - DNA, 400 bp, Zea mays
  Clone ID: LIB143-059-Q1-E1-G7
agagcgtttcagggctgaggatcaaagtcatcagaagaagcaaactgaacctggggaccagcaagaagccccagttactagttcagatagccaaccaacagtgggcacaccatcaacagattatgtggcaccctatgcccctcatgacatgagccatgcaatgggtcaatatgcctatccaaatatggatccatacaagggaatcctttagccgggggcttaggggggcaatccatgggggcacccaaaattagccggaatgcatccggcgggcttacctttgcctaccgatgcaattgaagagccagtgtatgtaaatgcaaagcaatacaatgccatattaagacggcgtcaatctcgggctaaagctgaatcagaacggaagcctgtcaagggccgc

SEQ ID NO: 726 - DNA, 396 bp, Zea mays
  Clone ID: LIB143-059-Q1-E1-G8
agaacgagcaaaggacaaatatcctcgctcgcagtcgcagctactacgccgccgcacctccgcccgccaccttcttcccggctccagcgatgtcgggggcgatcgggggcgccgaggtccacggcttccggggcgcagcggcgcagctcccgcggtcccgggtgctcgggaggccgatccgggtggcgccacccgccgcggcccggccgggcggtgcgtccgcgggtagcatacgcgccgtctccgcgcctgcgaagaaggacgcttctgaagttaagcgaagcaaggttgagataatcaaggaaaagagcaacttcctccggtaccctttgaacgaggagttggtctcagaggccccaaatatcaacgagagtgctgttcagctgatcaagtttc

SEQ ID NO: 727 - DNA, 387 bp, Zea mays
  Clone ID: LIB143-059-Q1-E1-H11
acagcagccaattcgctcgagttcagatcgagcgcgcgccaagcaagtcttccggccggccgcgaagagcgcaatcaagcaagacaagatggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgac

SEQ ID NO: 728 - DNA, 388 bp, Zea mays
  Clone ID: LIB143-059-Q1-E1-H2
gcgtccgactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtccgtgctgtgga

SEQ ID NO: 729 - DNA, 420 bp, Zea mays
  Clone ID: LIB143-059-Q1-E1-H4
tcccgggccgacgtccagcaccaggacaccatctacgtctccgggtggcagtgctcgtccacgcacacctccaccaacgagcccggcccggacctcgccgactacccctacgacaccgtgcccaacaaggtggagcacctcttcttcgcgcagatctaccacgaccgcaagcagcgggaggcgcgcatgtcgctgccccgcgccgagcgcgcgcgggcgccgtacgtcgacttcctcaagcccatcatcgccgacggcgacacgggcttcggcggcgccacggccaccgtcaagctctgcaagctcttcgtggagcgcggggcggccggggtccacctcgaggaccagtcctccgtcaccaagaagtgcggccacatggcgggcaaggtgctcgtcgccgtctccgagcacgtgaaccgc

SEQ ID NO: 730 - DNA, 398 bp, Zea mays
  unsure at all n locations
  Clone ID: LIB143-059-Q1-E1-H6
acaggaaggcactcacttctccaggagcccggagtcggcagcaagagagaatggccgccgacgccgccgccgccgccacccttcgtactgctctctcccaagcaacagggcaagagcagagagcttcactgctgtgcacaccgaagcaccgagttgctgccagcaggagaagcttgagattcaccactagggccagctcgaatgcgggcgccagtgtgagcatcccgaagcaatggtacaacctcatcgccgacctgccggtgaagccaccgccaccgctgcacccgcagacacaccagcctctgaatcccagcgacctctcncctctgttccccgacgagctgatcaggcangaggtcaccgacgagcggttcgtcgacatacccgaggaggtcatc

SEQ ID NO: 731 - DNA, 297 bp, Zea mays
  Clone ID: LIB143-059-Q1-E1-H7
caggaaggcactcacttctccatgagctttgagtcggcaacatgagctaatggtcgcgaacgcctcagtcgttgtcacccattcattctggccttgcccagacgagagggctagttcagccagcttcactgctgtggatcagtttctcatgaatttgttccaagatagtgtacctctaaacactgcactaactggactacatctttagggatcagtgttacctgcaacatccaatgttgcaatctcaattccaacatctgggtagagcagctatacccatctgaacacaagggatgt

SEQ ID NO: 732 - DNA, 391 bp, Zea mays
  Clone ID: LIB143-059-Q1-E1-F9
atgagcttctagcaacgtacagtgtatccgccatgagtcctttcggggcggtgatcacgccagaaaccctcaagtacatgtccaagtaccagggacgtgagatcacgcaggtggactgcgcacgggaggcgatgaggctgatccacgcggaagacaagaacctcaaggccgaggactcagcgtgggagctgaagaagaagttcggcaacggcgtgagcaccatggtcctcgtctacaacgccaccggggccagcctgagcctggtggacgacgggaaagactggatgggctccgtctacagctcgccgatcccggacaccttccacaacgggcagtggatcgccttcctccacgtcaagcccggctcgctggcgcaaggcagccaggccgc

SEQ ID NO: 733 - DNA, 194 bp, Zea mays
  Clone ID: LIB143-059-Q1-E1-E12
aaagggagatgaggctgtgcaggaggttgctgctgccgagtagtttgtttgctacttctatatctaggctgagtctggacatgaggttgcttatgacgtgaacttagagttgtctacttgttttcatccgcccctaagattttgtctggaaacaagtttaaaattaagattattctcaacaagtgtttaagatt

SEQ ID NO: 734 - DNA, 177 bp, Zea mays
  Clone ID: LIB143-059-Q1-E1-E2
tctcctcctcctcctcctcctgcagctgtgcaggtcggcttcagggacgatggcggccagggcggctgatgagaacagaaggccgggggtggggaggcccgcgccatgcgtagacatggggagccggcgcgcgctcacggacatcaagaacctcgtcggggttgccccgaacccctg

SEQ ID NO: 735 - DNA, 371 bp, Zea mays
  Clone ID: LIB143-059-Q1-E1-E3
acccacgcgtccgcggacgcgtgggggcgaggggagcagtcggcgggcaatggtcggcggcggcgcacatggcggaacaacctacaaaggctacaccatcccaaacaacaagcgcttggacaccgtccccggcaagggcctgtgcgctgtgatgtggttctgggtcttctacagggctaaccaggatggtgctacgctcttgggtttgcgtcatccttgggatgggcatgatgaccactctcatggtcatggacatggaaatgaggcatcgtgacattaatttgcctactctcggcggacggtgatttgatggcttgcatgtcacaacaacttaagattgagttaataaatttctacacccttcatggtac

SEQ ID NO: 736 - DNA, 362 bp, Zea mays
  unsure at all n locations
  Clone ID: LIB143-059-Q1-E1-E4
acctaaaaccatctgcttcaacccttaaccaaccccaaatttaatccggccgttcattaacggaattattaatggccccggcaaaaagcgggacccccaaaatgccttccccggtggccccgaaccgccggttcgcccccgccttaatgaatgggaaaacctgtgcgccaaaggtcgcttccaacttcgtcgcaagcgcgaaccccttgaagggcaacggcggctttggaaccttcaggcatttaaacttcacctcattcatgccgttcagcttcatgaaggagcgtctcaagttcctcgacgcggacaagtgcaagtgcaagaacacgctcatcgagggaagcggcatcngcgtcgccatc

SEQ ID NO: 737 - DNA, 367 bp, Zea mays
  Clone ID: LIB143-059-Q1-E1-E5
gtcaccggcacgcagacgctcagcaagagccaacaggacatcgtcgctcagcaagaaacaaggggggcaataatggcggagtaccagggcgagtatggacacccgtacccgcgcgtcgaccagtacgggaaccccgtgccgccggtggaccagtacggcaacccgctcccgagggagccggcgtccggtttcggcgccatcgctcccccctacagcgctggcgacagcgccgcggggcacgtggcggcgcctgtcgagtacggtgccgacgccaagtatccgcacgatggcacggggagcggtggcggcggcggcgtcaccgctccgaccggtgtggtggcgtactccagcggtggcgtcgcaccag

SEQ ID NO: 738 - DNA, 384 bp, Zea mays
  Clone ID: LIB143-059-Q1-E1-E6
gcattgacaagccagccggtggtttggttcgctttgctttgcttacgtgctgcgctgcgcgctccgaccaggcccgccccgaccggcgatgcagcggtggctcccggcgctcctccgccgcgcggcgcccggcggcggcgcggcgcggctcctcgccacgtcctccctcctcttcgacgacacgcaggagcagttcaaggagagcgtgcgcaagttcgcgcaggaggccatcgcgccgcgcgccgcggccatcgacgcctccaaccacttcccgcgggacgtggacctgtggaggctcatgggggacttcaacctccacggcctcaccgcgcccgaggagtacggcgggatggggctcgggtacatgtaccactgcatcgccat

SEQ ID NO: 739 - DNA, 378 bp, Zea mays
  Clone ID: LIB143-059-Q1-E1-E7
cccacgcgtccgccagcctccaactaaactaagagaaaagaagaaaaagaaatcacgcaagggatgttcgatggtgaacatcttatctggaagaaaaatgctatgcttcaagtcctgaatgatcgaagggggtcttacctgaactaataccatgagtgtgaccccaagttcgcgaagcttgaaatcttgatgcgctcgttgcgcatgtatatttgcacctttggttattaatcactagaggtagatgattgaaactaatctgcttaaccaatgtgcactgctgggcgctggcgtggttagctatatcagttaggcagttcgacagaggtcaaagagattgagattttgttctttcttggcaatgtcacagctttttgt

SEQ ID NO: 740 - DNA, 402 bp, Zea mays
  Clone ID: LIB143-059-Q1-E1-E8
cagctccgttgcgcaccgccaccgccggccggccagccgccggagcaccgaaagacccccgttctttcctgtaaaaaaaaacccgccgcctttagctagctaaccggtcgtcctcttcaccccctagctttgctagctctagctaggaacgaaagaaattaaaggataactgagattgctgattggtggtccgggtacggtgttcttgagtcgtgaagcgacagtacagtggctagggtcgtgccgcccctgcagtctccggggttgcgtgcaggatggtcgtcagggatcgggagtgaggaggcatcagctctcgcggtcgtggagcctaaatgtaccgcaacaacgactcggcactctcctgcttctacctcttcctcctctggttcttcttcttgaagt

SEQ ID NO: 741 - DNA, 389 bp, Zea mays
  Clone ID: LIB143-059-Q1-E1-E9
acttttacatggctgcaaactatgatgtccatgttcttggtattgatctttcggtgaacatggtttcatttgcaattgaacgtgccattggacgcaagtgctctgttgaattcgaagttgctgattgcaccacaaaggattacccagaaaatagttttgacgtcatctacagccgtgacaccatccttcacatacaagacaagcctgctctgttcagaagcttcttcaaatggctaaagcccggcggcaaagtcctaatcagcgactactgtaagaatcctggaaaaccatcagaagaatttgctgcgtacattaagcagagaggctatgaccttcacgacgtgaaggcttatggacagatgctgaaggatgctggttttcataatgtc

SEQ ID NO: 742 - DNA, 375 bp, Zea mays
  Clone ID: LIB143-059-Q1-E1-F10
gcccaatcgatcggcgctagccgctagcacgcctataaaatgccacttcattgaagtagatccatgcagcgccgagccatagccacagcccaccgcgcgagcaacgatgttcaggtgccccagcaatggctacggccaaccgcaccccaccgcgaactaccaccgcacccactccggcgaacacgtcaccaccaaggtcgcccagaaaccctgccatgccggcggcgccgtgcagcagcaccacgttgtccacaaggagtcgtcgttcaaggagctggacgggggtaaccgccgctgcttcgacaactatcccatgaacgctgctaacaacgcgaaccatcaccgctacgaggcctacgaggaaacctacgagga

SEQ ID NO: 743 - DNA, 389 bp, Zea mays
  Clone ID: LIB143-059-Q1-E1-F11
ggagcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaa

SEQ ID NO: 744 - DNA, 382 bp, Zea mays
  Clone ID: LIB143-059-Q1-E1-F12
aggtcgccctcaaattcgttccgtccaggcaaggaagaaatcgagcagccaaggagaggagaagatggctcgtacgaagcagaccgcccgcaagtccaccggaggcaaggccccgcgcaagcagctcgccaccaaggcggcgaggaagtctgcgccgacgaccggcggcgtgaagaagccccacaggtacaggcccgggacggtggctctgcgcgagatccgcaagtaccagaagagcacggagctgctgatccggaagttgcccttccagcgcctggtccgtgagatcgctcaggacttcaagacggatctgcggttccagagccacgccgtcctggccctccaggaaagccgccgaggcctacctcgtcggcctgttcga

SEQ ID NO: 745 - DNA, 352 bp, Zea mays
  Clone ID: LIB143-059-Q1-E1-F2
acggaagcgtggggcgagcgagcgaccaaagccatggctctccgcaccctggcatcgaagaaggtcctatccttcccgttcggcggcgcgggccggccgttggcggcggcggcgtctgcgaagggggtgacgacggtcacactccccgacctctcctacgacttcggcgcgctggaaccggccatctcgggggagatcatgcgcttgcaccaccaaaagcaccacgccacctacgtcgccaactacaacaaggcgctggagcagcttgacactgccgtctccaagggcgacgcctccgctgtcgtccagctgcagggcgccatcaagttcaacggcggcggtcatgtgaacc

SEQ ID NO: 746 - DNA, 310 bp, Zea mays
  Clone ID: LIB143-059-Q1-E1-F3
cggacgcgtgggcggacgcgtgggtgcaaatagcgtggcatatcctccaggatctcaataaaagatatagtgaaatatagcagaagctatttcatttagcattttttacagtttaaatggaatttcgctgccgattctgcatgagaacatgtaaataaggagatttcacgaacatgaacactcaaatacatgtagaggcctgtaaaagaagatgtctctagatccattactttaatattcgtggaatcataaccagaagtataagctagtgatgggaattgtagattaacgggaagatggtgatattctg

SEQ ID NO: 747 - DNA, 246 bp, Zea mays
  Clone ID: LIB143-059-Q1-E1-F4
agcttagctccactccaactcgaatcacagtcatgacaaaatcccgagaacaagctaaagggccttaaaaatcccgattaataggatccccctgggaacccaccagaaggtgtacgacacgggcgccctcaaggcggcgttcgctgagttcatctcgaccctcatcttcgtcttcgccggcctacgctccggcatggacttcagcaagctgaccagcagcagcccgacgaccccggcgggcctgat

SEQ ID NO: 748 - DNA, 349 bp, Zea mays
  Clone ID: LIB143-059-Q1-E1-F5
atctcactctcagctggtcgctcactcttgcagctccacccttcactcagtcttaggctcttagctctaggctctagctagccgcgccactccttcgtgtagccatcagccttctcatcgccaccaatggccactgccgaggtagtccagaccccgaccgtcgtggcggccgaggaagcgcccgtggtggagaccccgccgccggccgtcgtgcccgaggagtctgcccccgccgaggccgaggccgaggccgatgctgaggctgctgctcctgctgatctcgaggagcttcccgcggccgagcagcaggcagccgccgagcccgaggccgctgctcctgctggtgccg

SEQ ID NO: 749 - DNA, 395 bp, Zea mays
  Clone ID: LIB143-059-Q1-E1-F7
cactgacgcagaaggaaggctaacacttgctgatgctttggtctatgcttgcaaccaaggtgttgaaaagattattgatttggcaacgctgaccggcgcttgcgttgtcgcactcgggcctagcattgccgggattttcacgccgagcgacgagcttgccaaggaggttgccgctgcttccgaggtatccggcgagaagttctggagactgccgctggaagagagctactgggagtctatgaagtctggcgtggctgatatggtcaacactggcggcaggcagggaggttctattaccgccgcgctgttcctgaaacagttcgtcgacgacaaggtccagtggatgcacatcgacatggccgggccagtgtggagcgacaagaaacgggccgcca

SEQ ID NO: 750 - DNA, 293 bp, Zea mays
  Clone ID: LIB143-059-Q1-E1-F8
cccgtgggccgctcggcggaggtgaaggcggagccggtggacgcgcgtctcgaccatcagcacagcgcgacggagccgcagtcgtggcccatttaccggcccaggccagtgtaccacccgctccgggcctgcagcggcttggtcagcgctgggagcgaccacgactggtccaacaactcgaggtgacttttgcttgcaagcccaatcgtccacaggttacaggttaaacttagaatgagagatcaagtgtttatgtagcaataactttttgttaatttatctcatattaccgc

SEQ ID NO: 751 - DNA, 391 bp, Zea mays
  Clone ID: LIB143-059-Q1-E1-E11
acactcactcgaaccatcttccaaagcacccgaaccctagtgatctcggaaccctagccgcgcgcggatctcggcttttccccttcctccacgccagccatggacgaggacttcgagatgcctcccgccggcgccgatgagatgatgggcgacgacgagatgggcgacttcggcggcgacgagggcccggtgatgaaggtgggcgaggagaaggaggtcggcaaggaggggctcaagaagaagctgctcaaggagggcgagggctgggagactcccgaggtcggcgacgaggttgaagtgcattacacgggcacgctccttgatgggacaaaattcgactcaagccgtgatcgtggagaacccttcaagttcaagcttggacaaggtcaag

SEQ ID NO: 752 - DNA, 222 bp, Zea mays
  unsure at all n locations
  Clone ID: LIB143-059-Q1-E1-C12
aggctcctatctggtataggacggagctgagcttctagcaacgtacagtgtatccgccatgagtcctttcagggcggtgatcacgccagaaaccctcaagtacatgtccaagtaccaaggacgtgagatcacgcatgtggactgcgcacgggaagcgatgaggctgatccacgcggaagacaagaacctcaacgccgangactcagcgtgggagctgaagaa

SEQ ID NO: 753 - DNA, 395 bp, Zea mays
  unsure at all n locations
  Clone ID: LIB143-059-Q1-E1-C2
agccagacactgccatcgccgcgagagaagagccaacatcatagccgcttgcctacatagtcgcccggagcgcacggacaagcccgagagcttagctcttatggcgtggtcatcatcgctccaaagaaaacaacagagggggtcgaccaaggtactctgcggcgcggggttatggtcgcgactcgcacctcaccgtgggtgagagactttgtgccaccataacccgccagaattgctcaccggagctaactcggcgtcgtggatccgcaccaagcaatagtcaggcccgaaggcccttatgcacaccgatgagcaagtgaacgaggaacacgaagctcgcaggttgaagattctgagtaggagctcgttgaaggtgangagcaggtaccgccgga

SEQ ID NO: 754 - DNA, 369 bp, Zea mays
  unsure at all n locations
  Clone ID: LIB143-059-Q1-E1-C3
aggagaccggggccctcctcttccctgccattaacgtcaacaattccttcaccaaaagcacgtttgacaacctgtatggttgccgcaactcaatccctgatggtctgatgagggccaccgactttatgatcgccggtaaggttgccgtggtctgccgataccgtgatgttagcaagggttgtgccactgcactcaagcangctgatgcccgtgtcattgtgaccgagatcgatgccatctgcgccctccaggctctgatggatggtcttcaagtccttctcttggacgacgttgtctcggaagctgacatcttcgtgaccaccactggcaacaatgatatcatcatggttgaccacatgaggacgatga

SEQ ID NO: 755 - DNA, 398 bp, Zea mays
  unsure at all n locations
  Clone ID: LIB143-059-Q1-E1-C4
ctctaggaagactctcaggagctcagccgagaagtttgagttccaagctgaggtttccagactcatggacatcatcatcaactcactctacagcaacaaggatatcttcctgagggagctcatatctaatgcctctgatgctggataagattaggttcctttcccttactgataaggaagttctgggtgaaggggacactgcaaagcttgagattcagattaagttggacaaagagaagaaaatcctctccattcgggataggggtattggtatgaccaaggaagatcttattaagaaccttggaacgattgctaaatctggcacttcaggaacangagctgctcgagtctcttgtcgangctgatacgagaaagcaggaaagagctaaaaagatgga

SEQ ID NO: 756 - DNA, 397 bp, Zea mays
  Clone ID: LIB143-059-Q1-E1-C7
agcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgccttcgtgggcgggaacatcaacctgttccggggggctcctgtactgggtggc

SEQ ID NO: 757 - DNA, 357 bp, Zea mays
  Clone ID: LIB143-059-Q1-E1-C8
ggacaaaggagcggcggcgaggtctatggcgtcgacggcggggtacctggcgcggcgggcggcgcagaaggagcgggtgcgcctgctctaccgcagggcgctcaaggacacgctcaactgggccgtccaccgccacctcttctaccaggacgcgtcggatctccgggacaagttcgaggccaaccgacacgtggataacctggacgtggtcgataggctcatcgacgatgcggaggctcagtacaggaacttccagcaccccgatccctacattgttccatgggcaccaggcggcactaaattcacaagaaacccccctccacctcaagggatcgagatcatctacaattatggcaa

SEQ ID NO: 758 - DNA, 391 bp, Zea mays
  Clone ID: LIB143-059-Q1-E1-D11
ttttcttttccaggtagctgctctctattccgccagcgatcgagagaccaagaggagcaggagcgatggcgaggagctcgttcaagctggagcaccccttcgaaaggaggcaagctgaggctaaccgcatcagggagaagtaccccgatagaattcctgtcattgttgagaaggccgagaggagtgacatcccagacatcgacaagaaaaagtaccttgtccccgccgacctcacagtgggacagtttgtgtacgtggtgcggaagcgcatcaagctcagcgccgagaaggcgatcttcatcttcgtgaagaacaccctcccaccaacagctgccctgatgtctgccatctacgaggagaacaaggacgaggacgggttcctctacatgac

SEQ ID NO: 759 - DNA, 387 bp, Zea mays
  Clone ID: LIB143-059-Q1-E1-D12
cagccacccggttctccctcgctccagatctcccttcgcagccggccagggaccccttcacagcgcgggagatggctgatcaggaggccccagttgcagttgaggcaccaaccccagttcttggagagccaatggacttgatgactgcgctgcagctggtgatgaagaagtcaagtgctcatgatggacttgtgaagggtcttcgcgaggctgccaaggccattgagaagcatgctgctcagctttgcgttcttgctgaggactgtgaccagccagattatgtcaagctggtgaaggcgctctgtgctgaacacaatgttcaccttgtcactgttcctgctgctaagactcttggcgagtgggctgggctttgcaagattgactccg

SEQ ID NO: 760 - DNA, 370 bp, Zea mays
  Clone ID: LIB143-059-Q1-E1-D2
gcgaaggcgaccctccctccttcgctccttccgcgccgcctcccggccgtcgccgccatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaagctaagtcgcgccactccaatgggcagggccgctggcccgttaaatcagccaggttcatcctggatttgctgaagaatgctgagagtaacgctgatg

SEQ ID NO: 761 - DNA, 405 bp, Zea mays
  unsure at all n locations
  Clone ID: LIB143-059-Q1-E1-D4
aaaaggggagagagagagagagaagagagagagaagagagagagagagagaggagtgggagacccgcgagaggctgccgtgtanggaccgtagactcagcgactgcgaaggagggataaggggatggccgggatcggaccgatcaggcaggactgggagccggtcgttgtgcggaagaaggcacccaccgccgccgccaagaaggatgagaaggccgtcaacgccgcgcgccgcgccggtgcggagatcgataccatgaagaagtacaacgctggtacgaacaaggcggcatccagcggtacatccctcaacaccaagcgcctcgacgacgacaccgaaaacctcgcccatgagcgagttccaagtgatctgaagaagaatctcatgcaagcaaggctcgataag

SEQ ID NO: 762 - DNA, 378 bp, Zea mays
  Clone ID: LIB143-059-Q1-E1-D7
caagaaagcaacggcagcaagaaaccttgtaaacatcggagcatagatcgcggcggtgatggcggccaaggggaggacggagctggacgtgggcgccgacggcgtggccgtaatcaccatctacaatccgcccgtcaactcgctctccatcgacgtcttacatagcttaaaagaaagctatgaagaagcacttcggagaaacgatgttaaagctattgtcgttacagggaaaggagggaaattttctggaggatttgatattagttcctttggtggtgttcaaggaggccaaacaatgcaaccaaaggttggctacatagcaatagatattctcacagatactgtagaagctgcgacaaagccatcagtggcagcaat

SEQ ID NO: 763 - DNA, 389 bp, Zea mays
  Clone ID: LIB143-059-Q1-E1-D9
tacggtcgcttgggcgcaggtgacatacatacggtgcgagcgccggaagccggaagcaccggtgacgaagccttccgtgtcatcactcatcaggatctcagggttttgtttcgtttcgcgggcgttgggaatccatccatggcgaggaagatgctcatcgacggggaggtggcggccgtcgcggatggtgggcactatgactacgatctcttcgtcatcggggcgggcagcggcggcgttcgcggctctcgcaccgccgcctccttcggagctaaggttgcgatttgtgagctcccattccaccccatcagctcagagtggctaggaggacatggtgggacttgcgtgatacgtggttgcgtacctaaaaagatactcgtgtatggtgc

SEQ ID NO: 764 - DNA, 376 bp, Zea mays
  Clone ID: LIB143-059-Q1-E1-E1
aatccctaaccttcccccgcacgttcctctctctaccgtgttgcccgtcccgtgcccctgtcgcgatagatggctcgcggcccccaacgacgacgaccgcgccgccatgaccaccaccaccacgcccacggcggtggcggtcgtgaacgtggtcgcagttgcgcagctctacgtcgggcctccacctgcgcgcgtccctccacctcgcccgtggccacgaaatcctcttccatggaatcgtcgcgcatcctcctccacctcgaccgccgcggccgattcccaccgccaccacgccgcgcacgccccgtccctcggtcccccgtccgcctcttccctgcccctaccccccgcgtctaccgcgctcctcggccctcct

SEQ ID NO: 765 - DNA, 389 bp, Zea mays
  Clone ID: LIB143-059-Q1-E1-C11
ccgcccccctcctttcaactcgctcgctcgctcgccttccatctttctccctctgtcggcagtctgcagcagcccagcgccgtcgcgcatgcaggaggcgtcatcggcggcggcggcgggggccgagcccggccgtcgggcggcgcagcatcagttcgccggcgtggacctccggcggcccaaggggtacgcggcgccggcgccggcgccggcggtgggcgacggggacccgtgcccgcggtgtgcgtcgcgggacaccaagttctgctactacaacaactacaacacctcccagccgcgccacttctgcaagggctgccgccgctactggaccaacggtggcacgctgcgcaacgtccccgtcggcggcggcacccgcaagaagccct

SEQ ID NO: 766 - DNA, 388 bp, Zea mays
  Clone ID: LIB143-059-Q1-E1-E10
aggatccctcgacaatggcactccaggcagcctacgagtacctgcagcaggccgtcggccatggcgcgtggtcgtccacgcagacgctgacgctgctgctcatcgccgtacccaccgtactactgctgctagcgtccctcgccaagagcacgtcgtcgtccggtaggggcaagccgccgctccctccctcgccgccgggcaccctccccatcgtggggcacctacaccacatcgggccccagacccacatctcgctccaggagctggtggccaagtacgggcacaacgggttcctgttcctccgcgccggcgccgtgcccaccctgatcgtgtcgtcgcccagcgccgccgaggccgtgatgcgcacccacgaccacatcttcgcgtc

SEQ ID NO: 767 - DNA, 367 bp, Zea mays
  Clone ID: LIB143-059-Q1-E1-A4
attccagtgtccgccgtcgtgcgctcgctacccctctccctcgaggcctttgccggcgaagagcgcccagtcgcccaccaggatgaagtttgttgctgcctatctgcttgctgtcctcgctgggaactccagcccctctgccgaggacttgacatccattctggagtcagttggctgtgaagttgacaatgaaaagatggaactccttctgtcccagctgagcggtaaggacattaccgagctcattgccgccggcagggagaagtttgcttcagtcccatgtggcggtggcggtgtggctgtcgcggcagctgcccctgctgctggcggcggcggcgctcctgcagctgaggcgaagaaagaagag

SEQ ID NO: 768 - DNA, 143 bp, Zea mays
  Clone ID: LIB143-059-Q1-E1-A5
acacaaacgtctgacaaccttcctacgatataagacactttgcataaacgtgtcactggccaagattaagcggtggtaacaattagtcgctcgatccgccgagctcatgtgggtctcagaaagctcatcaggccaattgcaag

SEQ ID NO: 769 - DNA, 366 bp, Zea mays
  Clone ID: LIB143-059-Q1-E1-A6
acggacgcgtgggtgatcggccagggcaacgagaacgtgcaggacgtgctccttctggacgtcaccccgctgtccctgggcctggagactgccggcggcctaacgaccgtgcggctccctcgcaacaccacgataccaacgaacaaggatcatgtgttctccacctactccgacaaccagccgggggtgctgatccatgtgtaccacggagatcgcgccaggaccagggagaataacctccttggaaagttcgagctgtccagcatcccgcctgcgcctcacggcgtgccccagatcaccgtgtgcttcgacatcgacgccaacggcattctgaacgtatcaccggaggacaagactacaagacag

SEQ ID NO: 770 - DNA, 372 bp, Zea mays
  Clone ID: LIB143-059-Q1-E1-A7
cacgcgtccaagcaccaagaaaaagtaggggagaagtggagcacggttgcaaaactccaggaagagtgggtggaaaatgcagaccgctgggtggctggtttcttagagaagtttgaggaagggtgccactcaatggtcagttaccctctgaccacccttcgcagagagtccactgctttcgattaggagtccactgctcatttatgtattcttgtttccaaaacttcctcaggggacggccatcaaggagaggatccaggagaggctcatcaaggcacaatccagcgactttggcagcctcctatagtacgacagctacgattctgatgaagccaaagaaaacgacgaggacgaagacgaactctttgaaga

SEQ ID NO: 771 - DNA, 376 bp, Zea mays
  Clone ID: LIB143-059-Q1-E1-A8
acacagacacatccaacgagcccgaccgccagagctcgccgccgtcctccgcagacaatccaccatggcgatggtgctggggatggtgctggggaagatcccggtggagacgcccaagcacgaggtcctccacaccggcgccggctacgagatccgcaagtacccgcccagcatcgccgcggagttgacctacgatcccaaggagatgagaggagaccctgatggcgggttcaccgtcctcgccaactacatcggggtcctcggaaagccgcagaacaccaagcccgagaagatcgccatgacggctcccgtcatcaccaccgagcccatcgcgatgaccgcgccggtgattacggacgaccagcatgcgccgggc

SEQ ID NO: 772 - DNA, 404 bp, Zea mays
  Clone ID: LIB143-059-Q1-E1-A9
acaagactctagattgagtcgtattaaaacaacaacagagcgaggagctgaagcacacggcgaggctggtgtaccagacggccctgatggagagcgggttcaacctccccgaccccaaggagttcgcgtccagcatctacaagtcggtgcagaagggcctggacctgagccccgacgcgaccgtggaggaggagaacgaggccgaggagcagccggaggtggagaaggagccggagccggagccgtcgtcctacgacaaggacgagctttaggctttcggatttgttttcaagtctagctagctcccgctttagtaggaatgtgaatcagtgactgcctggtgtttagtcacgtgatggttctgagagacgcccatttttttttcccatgcaacgtgatagggg

SEQ ID NO: 773 - DNA, 364 bp, Zea mays
  Clone ID: LIB143-059-Q1-E1-B1
tcccgggccgacgtccgaccgaaaaaacccaaagtcacgtttcctcctcaacaaaaaccctcgcaaaaatctgggatctatctagaagcaccactcaacaaaccctaggttgcctgatcggctgatcgctccatggcgatcatctccgacttcaaggacgacgaggcaccggagcagcagctggcggccggccacggcgtcgaggaggccctcgtggcggcgttggagaggagcggcggcgcgctccccttcctacaggcggctatcgatgtcgcccaccgcaggtccggcctgttccgcgacccttcggcggtgagcaaggtcaccgcgatggcggcggcagccagggcgcagatcgaagccg

SEQ ID NO: 774 - DNA, 106 bp, Zea mays
  Clone ID: LIB143-059-Q1-E1-B10
atttctgctcaacgttgtgcgagggcaagatggggacggacctggtcgtgtgcaaggagtcgtgcgcgctctcccatcagtctatctctggtgctgtccggtagga

SEQ ID NO: 775 - DNA, 365 bp, Zea mays
  Clone ID: LIB143-059-Q1-E1-B11
acaagactctatagtgactcgtatgagaatccactggcaccattgataagctatcttgggctgaggttataccgcacaagcgatgataactcagttctgtatgatcatgatttagaaagctatgctctctttgataaggatggtaatcaggtcccaaaggagacagtcgataaagttggagaaacattcgagagaattcttgaagagacggtgaaagtgcgcgatgagcaggaacacgacatgccactgctacaggcaatttctattgtgtttgagaggcacccccatctaaagcttgaagggctagatgatcaggtcttacaatggtgtgtctgccggcttgaggcatggtttgctgcagatgc

SEQ ID NO: 776 - DNA, 401 bp, Zea mays
  unsure at all n locations
  Clone ID: LIB143-059-Q1-E1-B12
ctcgcagtccaatacaatactctaaacacattcgtaataagctctggagatgctgagaacgacacaagagatagaaaggcgtctagaagaggtttctttgcccttgatcattttgcacggtgaggctgatatggttactgacccggcggttagtaaggctctgtatgagaaagccaagagccaagacaagaagctgtgcctctacaaaagtgcgtatcacgctatcttggaaggtgaaccggaccagacaatattccaagttctcgatgatatcatatcctggctcgatcagcattccacanaagaacgtatatcgttgtgaatcaggcagcgctgttcgccaggattgggtgaattcctttggcaatgctgtatcgtttccggttggggatcccagattc

SEQ ID NO: 777 - DNA, 351 bp, Zea mays
  Clone ID: LIB143-059-Q1-E1-B2
gcacagacgacactcggacacacatcggctgtgcagccgtcaactcaccccaagtttatgtcggccaatggatcactgacgtaatgatgggatccgccagcatgtggaccctctagatcgcctcccccgtggcaccacatcgcatgttcggcaccaccgtgatagacgggcagtaactgacgctcacagtctcgtcgcaagtcgtcaccaactctgagtccgtttagggtgactgctgcatcggaaccgtcaggcagttcatcttcaccacagtcatccggttcaacatcacgaatgagcgtctcgactaccccgactcggacacgtgcgagtgccagaacacgctcatcg

SEQ ID NO: 778 - DNA, 366 bp, Zea mays
  Clone ID: LIB143-059-Q1-E1-B3
agccaaacaaaaaacgaggatcccaagttcccttcacaaactgcaggggaaggcaaacctcgtgcaccgcggccatggcaaaccagggggcgaagaagatgaaggacgagaacaagaaccgcttggacttactcctgcgcatcatcctcatatccaacgttatttacatagtggtgaggatggctataatgcattcatccttcacctggaagcattggattggccttatggtaacatcggccggatattttcttccatataagcaactcgccagtatggcaaagccagtttactctgataacggagaactactggatggtggcttcgatttgagcactggtggggtttgcgagtatttatatgatg

SEQ ID NO: 779 - DNA, 396 bp, Zea mays
  Clone ID: LIB143-059-Q1-E1-B4
acggacgcgtggggcgagcgagcgaccaaagccatggctctccgcaccctggcatcgaagaaggtcctatccttcccgttcggcggcgcgggccggccgttggcggcggcggcgtctgcgaggggggtgacgacggtcacactccccgacctctcctacgacttcggcgcgctggaaccggccatctcgggggagatcatgcgcttgcaccaccaaaagcaccacgccacctacgtcgccaactacaacaaggcgctggagcagcttgacactgccgtctccaagggcgacgcctccgctgtcgtccagctgcagggcgccatcaagttcaacggcggcggtcatgttgaacattcaatcttctggaagaacctcaagcccattagcgaaggtggc

SEQ ID NO: 780 - DNA, 371 bp, Zea mays
  Clone ID: LIB143-059-Q1-E1-B6
ctcgacgaaggaggaacgaacggacaggttgttgcacagaagcgacatggctttcgcgcccaaaacgtcctcctcctcctcgctctcctcggcgttgcaggcagctcagtcgccgccgctgctcctgaggcggatgtcgtcgaccgcaacaccgagacggaggtacgacgcggccgtcgtcgtcactaccaccaccactgctagagctgctgcggctgctgtcacggttcccgccgccccgccgcaggcgccggcgccggcgccggtgccgccaaagcaagcggcggcacccgccgagaggaggagccgtccggtgtcggacaccatggcggcgctcatggccaagggcaagacggcgttcatcccgtaca

SEQ ID NO: 781 - DNA, 330 bp, Zea mays
  Clone ID: LIB143-059-Q1-E1-B7
atgagcttctcgaagcatccactgtctccgccatgagtcctttcggggcggtgatgacgccaaacgctcgcaaggagctgtctaactctgaaggacgtcagctcacgcaggtagactgcggataggaggcgcagaggcagatacacgcagaagataccagtcactatgccgaaggctcagcggagtaacagcccaaacatgttcggcaacggcgtaagcagtatgggcctcgtcgacaatgcgacagttgctatacttagcccggtggcgcatcggacacactggctagactgcgatcataagccgccgataccggacactctcaacaac

SEQ ID NO: 782 - DNA, 334 bp, Zea mays
  unsure at all n locations
  Clone ID: LIB143-059-Q1-E1-B9
gacccacgagtcaatgttattggtgaaccgattgatgagaagggtgacataaagacaaaccacttcctccctattcatcgtgaagcccctgcctttgttgagcaggccactgagcagcaaattcttgttactggaatcaaggtcgtggatcttcttgcaccctaccaaaggggtggaaagattggcctcttcggtggtgcaggagtgggtaaaactgtgctcatcatggagttgatcaacaatgttgctaaggcccatggtggtttctctgtgtttgctggtgttggagaacgttaccgtgaaggtaatgatctgtacanggaaatgattgaaa

SEQ ID NO: 783 - DNA, 353 bp, Zea mays
  Clone ID: LIB143-059-Q1-E1-C1
agcggaagatctacgacccgctggaggaggaccccttcggccccatctggaacaataacaacgggccaaatttccggctcaagctctcggtcaccaaggccctcgccctcctcaaaatcttcgccgacaaggacaacgcctgatccccatcggttctgtcgtcgggccactcgaagctcggatgcacgaatgaatgaacaaacaataataacgaatggatggagcatgtatatcgtcatgcgcatgtcccacgacgagacgggagtataccacggtggagtagtatattaataattaatatagtatgtccacctttgtttgatactactaagggctatgtattgaggcacgcg

SEQ ID NO: 784 - DNA, 383 bp, Zea mays
  Clone ID: LIB143-059-Q1-E1-C10
acatttccccttccccgcaccgcaccgcaccgcacccaacccccgtcggagagagagatggcatcggtggcggagatgcagcccctcgcgccggcggggtaccgccgcgcgccggagatgaaggagaaggtggaggcgtcggtggtggacctggaggccgggaccggggagacgctgtacccggggatctcgcgcggggagagcgccctccgatggggcttcgtccgcaaggtctacggcatcctcgctgcgcagctgctcctcaccaccgccgtctccgccctcaccgttctccaccccaccctcaacgccacgctctccgactccccgggcctcgcgctcgtgctcgccgtcctgcccttcatcctgatgatcccattgta

SEQ ID NO: 785 - DNA, 388 bp, Zea mays
  Clone ID: LIB143-059-Q1-E1-A2
cagatcacttgttcttggaaaggacaatcaaaatgacttcactgcctttgagtactctatttgggctgaccttggggaggacttcatctttgtcccccatgattctagcattggaaggaacaaagtcctattttatccagcaagacagcagtattcagtttctatgaatggatgccaagatactgttcctctaatcactgcaagaactggtctatatcttgaaggatcagtgttacctgcaacttctgatgttgacatcaagattctagcagctggaaagagcaactatgcccatctgaacaaaggggatgtagcaacagaggcaaagacagattctgaaggatcattttttgcaggtcctttgtatgatgacatagtatataaagtt

SEQ ID NO: 786 - DNA, 386 bp, Zea mays
  Clone ID: LIB143-058-Q1-E1-G5
acgcgcgggccgatacaacaccctacagtgactcgcaatagatccccctgtagtccccggccccgtctttccgccgcctcctgcaaccgcttcacgtgcccctcgcaggtcccctttccgaccccaagtggggccgaagaagtcctccgcccagcgccagccccacgccatggagcccaacaagtcctctctatgcggcgccaccgctcctgccgccaccgccgaagccgagtccccgttgtgcagcttgttctacccgccggcgccggcgccggcgccgaccgcggcaaatgggaaagattcggacttgtacagcattctttacaaagggcagagcgggagcgcacaagctggcgtcacaagtaatgggaaaccgcaatgggctc

SEQ ID NO: 787 - DNA, 394 bp, Zea mays
  Clone ID: LIB143-058-Q1-E1-G6
cgggccgacccacgactcaacatcgcccctgcaaatatagtctcggcggctctagaagacgatgggcaaggacgacgtgatcgagagcggcgctggcggcggcgagttcgctgccaaggactacacggaccctcccccggcgccgctgatcgacgcggctgagctggggtcctggtcgctgtaccgcgccgtgatcgccgagttcatcgccacgctgctgttcctgtacatcacggtggccaccgtgatcgggtacaagcaccagacggacgcgtcggcgtcgggtgccgacgcggcgtgcggcggcgtgggggtgctgggcatcgcctgggccttcggcggcatgatcttcgtcctcgtctactgcaccgccggcatctcggggggccacatc

SEQ ID NO: 788 - DNA, 406 bp, Zea mays
  Clone ID: LIB143-058-Q1-E1-G8
tttctttcaactggatgaagaagatgtaatcaagactttttttaccattagaaaccgcaggccaaagaaaaacaagtaatcttctagtacatactcccatgagtaagtgaaatttatgtatatgttgaactgaattaatatattatcatgattataaaaatattatattggaaccaattatatatatttgtaactatttagttaggcaaattttattatttctatatggtgccaccaaattattggttcggcatacccagagataaattcctagattcgccactggtgaaagatacaaattcctgctactatagctatttgaagtattgttgcccgatgtgctgactgctgaggtagtaagtagtatggatctcgttggttaataccttgcattttgtttcttcat

SEQ ID NO: 789 - DNA, 391 bp, Zea mays
  Clone ID: LIB143-058-Q1-E1-G9
cgggccgatacaaaaccctacacagattaccatgagctttgacatcgacgccaacggcatcctgaacgtgtctgccgaggacaagacaacggggcagaagaacaagatcacaatcaccaacgacaagggccgtctctccaaggaggagatcgagaagatggttcaggacgctgagaagtacaagtctgaggatgaggagcacaagaagaaggtggaggccaagaactcgctggagaactactcctacaacatgcgcaacacgatcaaggacgagaagattgcgtccaagctgccggccgatgacaagaagaagatcgaggacgccatcgacgcggccatcagctggctggacgccaaccatctcgccgaggcggacgaattcgacgacaag

SEQ ID NO: 790 - DNA, 406 bp, Zea mays
  Clone ID: LIB143-058-Q1-E1-H1
accatcaccagctcttctccatcaagagtaacaggccatcgccttaccagttctgatcccaaatcatttacggcgtaggtgcctcttgctcaaaacccagccccacagcaatggagtgcgagaacggccgcgttgctgcaaccaacagcgattccctgtgcatggcgacgccccgcgccgacccgcttaattgggggaaggcggcggaggagctgatgggcagccacctggacgaggtcaagcggatggtggccgagtaccgccaacccttggtgaagatcgagggcgcaagcctcagcatcgcgcaggtggccgctgtggccaccggcgctggcgaggcccgggtcgagctggacgagtcggcccgtagccgggtcaaggcaagcagcgactgggtcatgagcag

SEQ ID NO: 791 - DNA, 370 bp, Zea mays
  Clone ID: LIB143-058-Q1-E1-H10
aacggcggcgtaggtaacggcggtctcaaccccaggcgagctcggctccggtcacccgtcgatccacgcaaccatgtcgaggaggaagaccagggagcccaaggaggagaacgttacccttggacccactgtccgtgaaggagagtttgtctttggtgttgctcacatctttgcatccttcaatgacaccttcattcatgtcactgatttgtctgggagggaaactttggttcggatcactggtggcatgaaggttaaggctgatcgtgatgagtcgtctccttatgctgctatgcttgctgctcaagatgttgcacagcgttgcaaggagctcggtatcaccgcgctgcacattaagcttcgtgcaact

SEQ ID NO: 792 - DNA, 380 bp, Zea mays
  Clone ID: LIB143-058-Q1-E1-H12
gacccaaacgtccaaggcaccacacctcttcctcctcttcctcctcctagcacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcgaggcggccaccgagggcggcggctgcgactgcaacacctgcaactgcggcaccagctgcggctgctcctgctgcagctgcaactgagccggcccgcccggcccggcgatggcgcacgagagtcgagaggacgacgacga

SEQ ID NO: 793 - DNA, 286 bp, Zea mays
  Clone ID: LIB143-058-Q1-E1-H2
tcgtattactggatcatcaatagtcgtcatccattttttaatctcctacttcaaggatgacgacacccctcaaaacttctcggcggtcagcccctgagtcggggagattctagtataagtgctatagaggaacgacagtacaatccctattcacaatacagccatccatctctctcatcgcatgtctgacatgttccttaagccttctttattatttcaatttactgccactacattattggttcgggataacctgagatctattcatatgtcagccacagatgtc

SEQ ID NO: 794 - DNA, 404 bp, Zea mays
  unsure at all n locations
  Clone ID: LIB143-058-Q1-E1-H3
agtgatgcctaatcggatcagcatgcggccaaagtagtacccatttggcacctgctgtaaataatcattaggttcgagcaggctgttgctcgaagcttcctcatctcgtttgccgtcacccgggtggaatctanagacagtgaacgcaggttgtgcangtcattcaggtgtttgaggccagcattggacacccgtgagtttgacacgttcaagttgatcaaagcagtcaggccagagatcagctccaaggttttgtctgtcagattagcattttgagaaagattcagcaacgtcagggccttcagatccttgatgttcttcactccagcatcagtaacgaacccaccacagacttcaagagaaacaagattcttaaaatatctgaagcaatttgtgccattgtc

SEQ ID NO: 795 - DNA, 332 bp, Zea mays
  Clone ID: LIB143-058-Q1-E1-H5
aaataaacaaataaaaaaaaagaaaaaaaaaaaaaaaaataaaaaaaatgaaataaaataatcattaaattcaaaaaaagatatatcacaaaaacttcgtcatctcggggggaggtctctcaggtggtttctagagatagtgatctcaagttttgcacgtcattcatgtgtttggggccagcattgcatacccgtgactttgtcacgttcagcttgatcagggcattctggccagatatcagctctaaggttttgtctgtcagattatcattttgataaagattcagcaacgtcagggccttcagatccttgagtttcttcactccagcatc

SEQ ID NO: 796 - DNA, 406 bp, Zea mays
  Clone ID: LIB143-058-Q1-E1-H6
acacgaaattctgagatccatccagaaacgtcgctccatggcgattatctccgacttcaaggaggacgagaccccgcagcagtcggcggcggtcggccccggcgtcgaggagaccctggtggcagcgctagagaggaccggcggtgcactcccctttctccaggcggccatcgatgtcgctcaccgcaggtctggcctgttccgcgacccttcggcggtgagcaaggttaccgcgatggcggcggccgtcagggcgcaggtggagaccgaggagagggcagccagagaggtcaagaggaaggcggaggaggccgagaggaaggctgcggtcgaggcgcagaaggctgacatggaggcggcgacggcgacggcggaagagaagctggagaaaggacgtatggatgcg

SEQ ID NO: 797 - DNA, 401 bp, Zea mays
  Clone ID: LIB143-058-Q1-E1-H7
gcctcctctacctgtccggctgtcccggctccagcatttccaccctcgcgcggcggtcgccggagcgagcagagctgccggaaggcccgtcggatccgccgccgccaagatgaatgacgccgatgtagccaagcagatccagcagatggtgcggttcatccgccaggaggccgacgagaaggccaacgagatctccgtctccgccgaggaggaattcaacattgagaagctgcagcttgttgaagctgagaaaaagaagattagacaagagtatgaacgcaaagagaagcaggttgaagtacggaagaaaattgagtactctatgcagttgaatgcttctcgcatcaaagttcttcaagctcaggatgatctagtaaacaaaatgaaagacgatgcgatga

SEQ ID NO: 798 - DNA, 412 bp, Zea mays
  unsure at all n locations
  Clone ID: LIB143-058-Q1-E1-H8
ccacgcgtcgactgatgctgttgctactgtctaccgctgtgggaanaaggacagggccatgagcccatgagatccgaaatctccacgcctcctgcctgccataggaataatttcctcgactgaaccacgcaataattcagctgcccctatcgtggttgtggtggaccaatggaccatgcttgcagctctctcttttcatttaggggtaggttggttggagcagcgtatgtgattggctgcttgcaaggccgtgagggtgccatccattatggctcattggcgattggacgtgtatgaacaagtttgtaatgactagaaataatcattgtaccatgttttttctatgctggcgcgtttatagcaccatgctttgtgtatgtcacttgtgtacgcatactanagagaaagcatg

SEQ ID NO: 799 - DNA, 426 bp, Zea mays
  unsure at all n locations
  Clone ID: LIB143-058-Q1-E1-G3
gggccgacccacgcgtctactaacttacctgcagacctaactaaactgccaagaatttggccaaagcaagatctcacaatcccatataacagatcggagcccgcccatgtatgtgtagatagacagagatatagatatatggcggataaccaggagatgatccacccaccagcggctgctgccaccacgggcagcacgacgactcacggcgattggtggaccacggcggtgtcgtggtcgccggaccagcagctacctgctgggttcggcggctgggcgtcgtctgccgcggcaacagctggaggcaacaggtcgaggtccggcaacaacgcggctgcctcctcggagtcncccgggtccaagtccaaccactcgctcaccaccgaccaaggcgtggtctccgtgccgccgcacccgccgccagcg

SEQ ID NO: 800 - DNA, 287 bp, Zea mays
  unsure at all n locations
  Clone ID: LIB143-059-Q1-E1-A1
aaattcactcaaactccttcccaaaatcttcgattagattcccgttgacaagaagactagaaccgaacctgaccatgtcgctgatccgccgcagcaacgtgttcgatcccttctccctcgacctctgggacccctttgagggcttccccttcggctccggcagcagcagcagtctcttcccctcgttcccgcggaccagctcggagaccgcggccttcgctggcgcgcggatcgactggaaggagactccagaggcgcacgtgttcaaggcanacgtaccggggctg

SEQ ID NO: 801 - DNA, 381 bp, Zea mays
  Clone ID: LIB143-059-Q1-E1-A10
acaacactctagattaattcatattaaaacaacaacagagcgaggagctgaagcacacggcgaggctggtgtaccagacggccctgatggagagcgggttcaacctccccgaggccaaggagttcgcgtccagcatctacaagtcggtgcagaacggcctggacctgagccccgacgcgaccgtggaggaggagaacgaggccgaggagcagccggaggtggagaaggagccggagccggagccgtcgtcctacgacaaggacgagctttaggctttcggatttgttttcaggtcgagctagctcccgctttagtaggaatgtgaatcagtgactgcctgggtgtttagtcacgtgatggttctgagagacgcccattttt

SEQ ID NO: 802 - DNA, 392 bp, Zea mays
  Clone ID: LIB143-058-Q1-E1-E7
agcaaggttagcattgtgatggaacaaatgattaggttgcttcatgattgtggattgccagcagaggatatggatttcataaattctgatggtgccgtaatgaacaagcttctgttagaggctaatccgaaaatgacccttttcactgggagttcacgggtagcagagaaattggctgctgatttgaaaggccgagttaaattggaggatgctggttttgattggaaaattcttggtccagatgttcaagaggttgattatgttgcatgggtttgcgatcaggatgcttatgcttgtagcggtcagaaatgctctgctcagtctgttctattcatgcacaagaattggtcttctagtggtctgcttgagaaaatgaagaaactttctgaaag

SEQ ID NO: 803 - DNA, 406 bp, Zea mays
  Clone ID: LIB143-058-Q1-E1-F1
gctacctactactcaagtatccatccttattgagtacagtgttgatccatggactcggaaggagttgtagcagcaaaggtggcagatgagactactaaaccggcaatccaagaagacggcgccgagagcaaggccgggatgactgatctgctgatgctgaccgacaagtcgcagctgcaggcgctggcgatgctgctgcggaacaacgaggagctcatgatgagccaggcgatcaagtcggagacggagcgcattgagtacctcaagacggtgagcgactgctacacgcggacgatgaagctcctcgacgattccatggcggccaggaccacgtacgagcgttcgggcggaatgaggagcctcgtcgcccgggacatggacgactacgtcgtctacggcctcaacg

SEQ ID NO: 804 - DNA, 390 bp, Zea mays
  Clone ID: LIB143-058-Q1-E1-F11
agtacattcctgatcatggcactagtgtgcatctccaaattcaacactagtgccaagatcacgaatgtacagagagaaaagggtagaaagtgcatcttgcattttgtcttgattttcatccaatgccgcagccagagcctcagcagatgcagcacgaacattgtaatttttatgggaaagtgcattgaaaataccagagtaatcagtgatggcatcaaaaccaaagcggtcccataattcctctgctaattcagcaaccaccttctccggatcatgagcggcaatccagaggcttgttgacacctgcaaatctcgttgcacagagtgcacaggaacacattttatagcagttaagcaggcaagcctaacatgcagttcttttgcatatac

SEQ ID NO: 805 - DNA, 215 bp, Zea mays
  Clone ID: LIB143-058-Q1-E1-F4
ccaagcgtccggtaagcccatcagactagatatacaaattaatataataagagccgattatcgggagaaagacgcatgtcaagcaatgtcccgtttttcaagcaacgagcgagagctgcatgcgctggttagatttaagggcctagatttaatatggatattgcccatacgttatgtaattaaatcaaataaatgttaagttcatattgaatgtg

SEQ ID NO: 806 - DNA, 381 bp, Zea mays
  Clone ID: LIB143-058-Q1-E1-F6
aatcaaatttcaactgcataaagaggggtgtcatggcgtcctcgaggatctcggatttcatgaggaagacactgcagaaggaggcttccagggatgcctgacctgagtagcaaatgtattagcacgactgagaagctgcctgcctgtgataggcgatggcgatggcaatggtgtgtagacagcagctgggtctctagttttgacggcatgtagtcgtgttagaatgaaggaggcaagggtgcgatggagtggaggtcaatcggcgtgtgatgccacgtcactagcttagctgcggatggtttggtggacttttgaggaacagataatgagattgtatgcacggcacgctgaaattttacttgaacgccgcccgattaaaac

SEQ ID NO: 807 - DNA, 402 bp, Zea mays
  Clone ID: LIB143-058-Q1-E1-F7
aggcggcaagaccaacaaccaagccggcgcgggccaatactgaccgacgatcaagtgacgatcgacaccaatatgctcaagcaagaagccagcggcaaatcaattatgtcgccgctgggttttatgtattttgtgattctatatgcacgctagctgcttgtccgtcccggccaatggaaaaaaaagggggaagaaaaaatgtctgtcggtatatgtgttctcgccgaataactctcgcgcatagctagctggtggggctgagtcactgccttcgctatatgtatacgtgcaaaaattagaggtggagggttgttttagctaatcccaccttaattccaaggcacagtgacctttttttttcaaaaaaaaaaaaaataaaaataaaaaaaaaaaaaaaagaaa

SEQ ID NO: 808 - DNA, 408 bp, Zea mays
  Clone ID: LIB143-058-Q1-E1-F8
aacagccggtgtcttctgcatcagcagagaaaagtaaggcaattcctcgtggtgattcggttggtgatactttggcaaggcaactgggagtccagattgcatcttctgatgaacaggcaaaagctgccgaggacttcaagaagactttatatggtgttgttgatgatggaagtagtgatgaagacgagtcaacctcaaagactaaaaagatacatataaggatacgtgataaaccggctgcacctactgtagatgtcaacaaattgaaagaagccactaaacagctaggcttgggtcctccgctgagtaggacaaggtcattatcagggacacctcaagacttcaatcaggctcctacacaaccaggaggtccagccgcagctgtttccccagcaatgccaaattctg

SEQ ID NO: 809 - DNA, 406 bp, Zea mays
  Clone ID: LIB143-058-Q1-E1-F9
acaaaactctacagtgagtcatataattgctcgagacagcaactgtatgacatttggatgttagcctggacgtcttctgccgaccatacaaggttttccccctgggggcttgttgttcatcttgttaggctcaccttaccttggttattgtacgttacccatcaagtatagatttggaaaaaaagagaggataattttaattttcatctctcttgtattattattgatttatttttgtgggtaccaaacttggatttgtttcatctgatcgagttcacaaaaatactgccattactgggtgatggttctgaactgcaggttgaaacaattgtgccctttactgtaaatgtcttcttcttgtatccaggcaaaagaaaggaaacctaccaagacctattaagacctc

SEQ ID NO: 810 - DNA, 403 bp, Zea mays
  Clone ID: LIB143-058-Q1-E1-G1
ggacaagttctcccttacaaatttcacgacatggagaaacatacgaaagtacatcactgcgaggattatatccaactggggaaggtgctggctatgctgggggcatcttaagtgctgctgtggatggtatgtattgtggttttgctttagctaaacaactttctttattccatggcgatatagagccatttctaggcaaaacacaaaaacaaacaggttttataaagtattgaatggactagtgcttggtattttgttgttccaattttttgggggaaaagatcgatgtcattatagctttaaccataggatatttttgtcatgtttagagcagctgtgattgccttactaaattcatcagctaatttgtgcacggttgatgtagaagggtagagcaaggcat

SEQ ID NO: 811 - DNA, 190 bp, Zea mays
  Clone ID: LIB143-058-Q1-E1-G10
cccgggccgacccaaacgtcaagtttaacacgtattatgtttttctgtaaagcttagaaatacttattttgttaatgcatagaaaatcaatgaaaaaaatgtagagcttttatgaaagtcaaaatggacatcaacgatttacgctaaaacttgtacccatttacgctgttttagttcacattttatgttg

SEQ ID NO: 812 - DNA, 391 bp, Zea mays
  Clone ID: LIB143-058-Q1-E1-G11
acggaatgacatcaacagagcgcttcacttgttccgtgagatcgcaatggggcatgatctgaagaagtttttgggtgtgatcgtggggctgtgggttctctccggagttggaagcagctgtgacttcctcacgttgacatacattgccgtcctgatgctccacacggtgccaatcttgtacgacaagtaccaggacaaggtggaccatttcgctggaagggcacacaccgaggccctcaagcagtacaaggtgctggatgccaaggtcctgagcaaaatccccaggggtgcggtcaaatccaagaagcagaactagttaggataagccgcagattgtgaatgcccgtatcctgagtatcgggcttgtggttttgcatggcatatgtcaatc

SEQ ID NO: 813 - DNA, 404 bp, Zea mays
  unsure at all n locations
  Clone ID: LIB143-058-Q1-E1-E6
ctcctgtttcccaaccgagttatagaagaagccggcagtgtgaaaatcggtcagccacttcgcaaagtgttcagtccccggcttgttgagcagctgagggcgactttcccaggcgagaaatttctgctcagccagaaaagcaacaggacgtacatggttctggagcgaagcgcgagcggagaggacgcgctgagggggtggctggtcgccgcgttcgcttcggagatggagaggtcaggcgccggctcacgcgatgacgcggttctgagcgaggcctacgagaagatggagcgggtcttccccaccttcgtgtcagaagttaggagtanggggtggtacaccgatcagtttttggacgggaactgtagtcgagtctcgtttgccaagtttcggtagtcgcagag

SEQ ID NO: 814 - DNA, 376 bp, Zea mays
  Clone ID: LIB143-058-Q1-E1-G12
agccgaccactccgatctagatcagatcgctggtcctgcctgtgcacttggttcattgatgtgatccctagactcttgacggcgactggttcctatgcgacgcggacaggacagggttcgagaggctgggtccaggcggtgtggggtagatctacttcatgctgccctccgtcacggcctgcggcacgaggactcatctctcttgtcgtcagggtccgccactctctcctcccagcactcctgagttatgcttgttccattccctccagggacgcataagcgggggctgtagaggaggcggatgcgccagcgaccgtgtcgcattggtccgcgatgtggctccggggacactgtcatcctgctccatgtgcgcccc

SEQ ID NO: 815 - DNA, 425 bp, Zea mays
  Clone ID: LIB143-058-Q1-E1-G2
gggccgagccacgcctctacgacacatcatgacagaaacagtactgctgccagtagagctctcagaactcgggaaaaaaaatgtcagaggccgccgtgcgtgtgatcggcctatggccgagcccgttcgggatccgcgtcctgatcgccctgaagctgaagggcgtcgagttcgagttcgtggaggaggtggtgggcatgaagagcgagctgctgctgaggtcgaacccggtgcacaagaagatccccgtcctgctccaccacggcaagcccatctccgagtctctgatcatcgtccagtacatcgactaggtctggtcctccggcgcgccggccttcctcaccgccgacgctcacgcccgcgccctccagcggttctgggcgcagtacgtcgacgacaaactgccttgggcgatccgcatactg

SEQ ID NO: 816 - DNA, 349 bp, Zea mays
  Clone ID: LIB143-058-Q1-E1-D1
gagtcatattacaacaccaacaacggcggagctgccaaagaaagcaaaccagaggagagaagagaggaggggttggctggctggccctggccgtcgtccgccggtagctcgtggtcgctcgctcgctccatcattcctccctctccgccggcgtgcccgcccgcccacatgacggagtcagagggcgagacggaggctgcgcgcgcggccgtgctgacgccgccgctgtcgctggggggcggcgggctctcgggggagctccgcccggccaacctcggccaacgggtgctcagcctcttcctcaacgtccgcccgggctccgacctctcccacttccagctgccgggga

SEQ ID NO: 817 - DNA, 378 bp, Zea mays
  Clone ID: LIB143-058-Q1-E1-D11
agcacaagttgtctaatcgaaatatgcaggcacagaattgaaattcaatgacgccgaccatctcattttgaaagaagatgacataattggtattcttgacagtgatgatgtgaaggatatgaaaccactgaatgatcgcattctgattaaggttgctgaagctgaagaacgaactgctggtggtttgctattgacgcaggcaactaaggagaaaccttctgttggatcagtggtagccgttggcccagggccgttgggcgaggacggcagcaggaatcccctgtcgatcactcctggaagcaacgtgatgtattccaagtatgcggggagtgagttcaagggcgaagacggtgagtacatcgtgctcaaggcgtctga

SEQ ID NO: 818 - DNA, 376 bp, Zea mays
  Clone ID: LIB143-058-Q1-E1-D12
tctgatgtcaattaatggcagcagagttcaataatgtctggtctctgaagcacatactcagttttctgtcggctgtgttgcagacgaatgacttattgccacagagctaaggatgacagtgtgagtatttttgctgttcaatgtaactcagttctgttatttttttgactgttgttgatgcatttctgtctagactggactgcagagagaaagttggggcagatttccggcttcaatttatgtccttatcatcactacaacagcaacgacgagcacagtagcaaatcagtccgagccttgtggaggagagcctccacaagaagtgcctcgacgggttcgctaactccgccgccggtaccgtgtcaatgatgggcca

SEQ ID NO: 819 - DNA, 404 bp, Zea mays
  Clone ID: LIB143-058-Q1-E1-D2
acggaagcttgggcttcgaggcaattgtcttcttgttcgtgatgcatccctttgatgtcggtgaccgctgcgaaattgaaggtgttcagttggttgttgaggaaatgaatctcatgacaacggtgtttctccgatctgataacatgaagatatattatccgaacagtgtactcgcaacaaaaccaattatgaatttctacagaagtcctgatatgggagaagcaattgacttctccattcatgttgcaactcctgccgagaaactggccctgatgaaggaacggatactgcgctacattgacaacaagaaggaacattggtacccgggcgcgatggttgtactccgggacgtcgatgataccaacaaactgaaagtatcaatatggctgcgacacacactcaac

SEQ ID NO: 820 - DNA, 423 bp, Zea mays
  Clone ID: LIB143-058-Q1-E1-D3
gggccgacccacgcgtctagtttgtctcatcatcaccgctcaccgcggtttggctttctcccctcttctgcaccacttctcgctccggattccggattccctctgctctttccctaacgaaggtagccatggcggggagaggtaaggcgatcggctcaggcgccgccaagaaggccacgtccaggagctccaaggctggcctccagttccccgtgggaaggatcgccaggttcctcaaggccggcaagtatgccgagagagtcggcgccggcgcccctgtctacctcgctgccgtgctcgagtatcttgctgctgaggttcttgagctggccggcaatgcggcacgtgacaacaagaagacccgcatcgtaccgcgccacatccagctcgccgtccgcaacgacgaagagctctcccgcttgc

SEQ ID NO: 821 - DNA, 407 bp, Zea mays
  Clone ID: LIB143-058-Q1-E1-D4
agcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatattaaagctctgcacaagaacctagctgccagagaattgctataccaacaccagcataacaaaaggatgagctgccctgccatggcacagctcctctccaataccctgtactacaagcgcttcttcccatattacgccttcaatgtgctcggtgggcttgacagcgaggggaaagggtgtgttttcacctatgat

SEQ ID NO: 822 - DNA, 430 bp, Zea mays
  unsure at all n locations
  Clone ID: LIB143-058-Q1-E1-D6
tcccgggccgacacacgcctctagcatcttcacatgcgaatcatcgttttccatcgctcctactcctatcatccagaaaatctgagcggtattgatggcgcccaaggcggagaagaagccggcggcgaagaaggtggcggaggaggagccctcggagaaggcggctccggcggagaaggcccccgcggggaagaagcccaaggcggagaagcggctacctgcgggcaagtccgccggcaaggagggcggcgacaagaagggtangaagaaggcgaagaagagcgtggagacctacaagatctacatcttcaaggtcctgaagcaggtgcaccccgacatcggcatctcctccaaggccatgtccatcatgaactccttcatcaacgacatcttcgagaagctcgccgcggaggccgccaagctcgcccgg

SEQ ID NO: 823 - DNA, 391 bp, Zea mays
  Clone ID: LIB143-058-Q1-E1-D8
acgcgcgggccgatacaacaccctatactgacgtcgtgagtacaaacatacagctagatagcctctgcatgcctacgtacagcatggccaaggccgagctgctcctcgccctcgtggcttcgctcgtcgtgcggccattctcctccctcgccgtgtaccaggacttctgcatcgccgacctatccgccgccgccacgccgggcggctacccgtgcaagcccccgaaggacttgaccgccgactacttccactacggtagcctcgccacacctggtatggcgctgaaacccttcaagatcgctctgcgctcgggcgtcggcacaactttccccggactgaatgggctgggcatctctgctgcgagagttggtgattgaccctggccgggtcg

SEQ ID NO: 824 - DNA, 408 bp, Zea mays
  Clone ID: LIB143-058-Q1-E1-E1
agcgcgagatcgccgccttcttcgcgcacgtcacgcacgagaccggacatttctgctacatcagcgagatcaacaagagcaacgcctactgcgacgcgagcaacaggcagtggccgtgcgcggcggggcagaagtactacgggcgcggcccgctgcagatctcgtggaactacaactacgggcccgccgggagggacatcggcttcaacgggctcgccgaccccaacagggtggcgcaggacgccgtgatcgcgttcaagacggcgctctggttctggatgaacaacgtgcaccgtgtgatgccgcacggcttcggcgccaccatcagggccatcaacggcgccctcgagtgcaacgggaacaaccccgcccagatgaacgcgcgcgtcggctactacaagcagtact

SEQ ID NO: 825 - DNA, 399 bp, Zea mays
  Clone ID: LIB143-058-Q1-E1-E11
aaattagcaccatgttggactgagctgatcagagcaattacttgcgaactgaaaacactggagtgtagcctgtgctcagctgccacaagatagcctgaagcaaactgctgtacaataagcaagtgattgttctgccatcaacggtggcatatcactgtacaaatgagcaccattgactaacgcacataagtcgccttgtctgaaactggtcattttctttgaaattcaccctccagttcatgtgctttggtggcagacgtcgtggcatggtatatggtacctgagaacattctttgggtggcaactggttttggctacttagtcttctgttgcctgtaatatgagatgtgatgttatttctagtctagctattgttgtaatttttttggactctacatg

SEQ ID NO: 826 - DNA, 422 bp, Zea mays
  Clone ID: LIB143-058-Q1-E1-E2
gggccggcccacgcgtccaaagcgaatcagagcaatcggaattctctgcgatttctctagatctcgactaccccccactagttttggttcctcctttcgttcgagagagcgattctggtggcaatggcgaacagcgagggtccggcgatcgggatcgacctcggcaccacctactcgtgcgtcggcgtgtggcagcacgaccgggtggagatcatcgccaacgaccaggggaaccgcaccacgccgtcctatgtcggcttcaccgacaccgagcggctcatcggcgacgctgccaagaaccaggtcgccatgaaccccaccaacaccgtcttcgatgccaatcggttgatcggcatgaggttctctgacccgtcagtgcagagtgacatgaagctatggccgttcaaggtcatcccagggcc

SEQ ID NO: 827 - DNA, 393 bp, Zea mays
  Clone ID: LIB143-058-Q1-E1-E4
tgggtaagatcgttttgcagcttgacaagataaaccctcaagtgggctcccgcatgggttcaacattttccccgtggaaggggtacgacaagaccagacaagctcctgccaaaggccaactggagaagatcgtgtcggccaatgggctctccgaaaacgtgttcgagattgcttcaaaaagcttggcggattagcttgggcagttccgaggaattgcgagtgggagtgcttaactgaatctctcttttgttggtaaaatgacaagtagagataataaacaggcgggccgaatttgcatgaactgataaaatataagtgtgatgatgcccgctttgtggggggctttggagcatgcatgcgcgctcgtctgttggaatggaactgctgtttttt

SEQ ID NO: 828 - DNA, 405 bp, Zea mays
  Clone ID: LIB143-058-Q1-E1-E5
ctctccgcacataccctccctacctcgccgtcgccgtcgcatctgccatgggggcgtacaagtacgtctcggagttatggagaaggaagcaatccgacgtgatgcggttcgttcaacgcgtgcgctgttgggagtacaggcagcagccggccatcgtccgcctcacaaggcccacccgccccgacaaggcccgccgcctcggcttcaaggccaagcaggggtatgttgtttaccgcgtccgtgtgaggcgtggtggcaggaagaggcctgtgccgaagggtattgtctatggcaagcccaagcaccagggtatcacccagctcaagttccagaggaacaagagatctgttgctgaggaacgggctggacgaaagcttggtggactcagggttctcaactcctact

SEQ ID NO: 829 - DNA, 407 bp, Zea mays
  unsure at all n locations
  Clone ID: LIB143-058-Q1-E1-B11
ctcgcgggccgatacaagcctctaaactaagtcggcataccgaattctctgcgatttctctagatctcgaccacccctactagttttggttcctcctttcgttcgagagagcgtttctagtggcaatggcgaagagcgagggtccggcgatcgggatcgacctcggcaccacctactcgtgcgtcggcgtgtggcagcacgaccgggtggagatcatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcangaggttctctgacccgtcagtgcanagtgacatgaagctatggccgttc

SEQ ID NO: 830 - DNA, 311 bp, Zea mays
  Clone ID: LIB143-058-Q1-E1-B12
ccacgcgtccgcggacgcgtgggcggacgcgtgggcggacgcgtgggcactctctctaatcacagtttcgacactgatcggtactctctagtgtccgactcgtcacagttttagcgagagagacagagagcgagcgagggagaggaggatgggttccacttccacgggaccggtgagcgggttcgcggcgccggagcgggacatcgacgatctgccgcggaacgacgccaactacacggcgctcactccgctctggttcctcgagcgcgcggcgctggcgcatcggggcagggcctccgtcgtgcacggcc

SEQ ID NO: 831 - DNA, 405 bp, Zea mays
  Clone ID: LIB143-058-Q1-E1-B2
acatgattcaggcttatcctactacataatattgctcgcctctcctgtctcctctcctcgtcgagcggttgtgggtggtcgatccataaggccggaatggcaaaccaccaggagaagcccaccacgtccccaccgccccagccggcggagggcagcgtcgctcgcccccgcttgcccggcgtcggcaacgcacacccgggcagtgccggatacccaaacccgccagatgccgcgatccccgatgcggcgactcttcgggaccagtggcggtttgccgtgcggcagtacagccgctggtactcccacgcctggggcaccgccatccttgccggcgccgccttcttcgcgcttgggtggcttgtcaaggggtcaaacccgctcacgtcccgggccgagccacaacac

SEQ ID NO: 832 - DNA, 409 bp, Zea mays
  Clone ID: LIB143-058-Q1-E1-B3
gcccgggcagaactctacactaagtcgtagttatggcgttcgagagctacggctacctcaccaagagcggcgtcatgtcgtcgtccccgaccagcacgctggtctcgcccccgaggtcgccgccgtcggagtccccgccaatgtcgccggacgccgccgccgcagcgctccgccgcggcgcgtggccgggtgtcggcggctcgcccgtcaacgaggtcctcgcctcgctgcgccagctccgcctcagcggcggcggcggcggcggctcgccgaggtcggcgccttccggcgggtcgttcttgtgaggcggctacccgttcgggtccccgaagtctccggacggtctgtacagtctcccgtccacaccatcaaccaggccgtgcccggtgatggtgaccaccgcctccgg

SEQ ID NO: 833 - DNA, 279 bp, Zea mays
  Clone ID: LIB143-058-Q1-E1-B4
tcccccggtgggtggcaagcgtcggacgacgccgaaccgttgtaccagagtggcgcgccggtgggagacggctgcgtgcgacgccgcctgcgtcggaggccgttcctgttctcgccgaaaggcgtttcggactcgcggagctcgcagacgtgccttgatcgggacgccagcacgagtgtgcttgggatcatccttgcagggggtgctgggacaaggctgtatccactgacgatgaagaggggcaaacaagcagtgccgttgggcgccagctacaagctc

SEQ ID NO: 834 - DNA, 410 bp, Zea mays
  Clone ID: LIB143-058-Q1-E1-C1
agtatgcatcattctcaggaaccctagcgccgccgcacccgcaggaatgggtatcgacctcgtcgccggtgggaggaataagaagaccaagcgcactgcgcccaagtctgacgatgtctacctcaagctcctcgtcaagctctaccgtttcttggtcaggaggaccaagagcaatttcaacgctgtcattctcaagaggcttttcatgagtaaaaccaaccgaccaccaatctccatgcgccgccttgtcaagtttatggaaggaaaggagaagaacattgctgtcattgttggcacagtcacagatgacaaaaggatccaggaggttccagcaatgaaggttactgccctgaggttcacggagacagcaagggccaggattgtcaatgctggtggcgagtgcctcacat

SEQ ID NO: 835 - DNA, 413 bp, Zea mays
  Clone ID: LIB143-058-Q1-E1-C11
ctcgcgggccgatacaagcctctagcatgcctcgtcctctttcagcaaacacagctagctagcagcacctgctcccttcgcctgtaatcatggcgtattgctgcgacgacggctgcaactgcccccctgactgcgggtgcccatgcgactgctgcaatttgtaccctgaagtggagaccgccgccgccagcggcatcctcgctgcgccgaccaccaaggccagcgccggcggctgcaacacctgcaagtgcggcggcaccagctgcaactgcaactgcagctgagccggcccaatggtggcgcacgagaggacgacgacgacgaggcgtagtatatatgtatgtagcagcgtctaaataagatcctgtcaagagtcaactgcacccgccattgtatggtcgcctgcctcgcct

SEQ ID NO: 836 - DNA, 276 bp, Zea mays
  Clone ID: LIB143-058-Q1-E1-C12
gggtcgatacaagactctaaagtgagtcatctgatggggacccaattaactagcctttcgtatcttagctggtctttggccttcttcagcgaccgcgagctcgcgagctgattagtgtaaatatacgacgatgatcggatgatgatgatgatgaaaagttctgccagaaaaaaaaagaagaaaaaagaaaaaaacaaagaacaaaaaaaaaaagaaaaaaaaaagaagatgaaaaaaaagaaaatgaaagaaaaaaaaaaggggggggcgcccgaa

SEQ ID NO: 837 - DNA, 77 bp, Zea mays
  Clone ID: LIB143-058-Q1-E1-C2
gcactgtcacacaagagtttttgatccaagaggttccagcaatgaaggttactgccctgacgttcacggagacagca

SEQ ID NO: 838 - DNA, 411 bp, Zea mays
  Clone ID: LIB143-058-Q1-E1-C3
tctacactgagtcgtattaatgacagaaggacagaagctgaaacaaattcagggaacgctagcaagtctgctgataaaaagcctgcacctaaagagccaccaaaagactacatccatgtgagggctagaagaggtcaagcaacggacagccatagcctcgcagaaagagcacgacgagagaagataagtgaacggatgaaagttcttcaagatattgtccctggatgcaacaaggttatcgggaaagcatcagtccttgatgagataataaattacatccagtctttacagcgtcaagtagagtttttgtccatgaaacttgaagcgattaatgctcatgtgagcaatgcaactgtagcttttccaaccaaagattttggtgttgcgccatataatactgctcctagcctg

SEQ ID NO: 839 - DNA, 428 bp, Zea mays
  Clone ID: LIB143-058-Q1-E1-C8
ctcgcgggtcgacacacgcctctacgttctggctcaatacttcattgaaagtgtgattaagaagaaccaaagcataaatgggcatcacaagaacataaccttcaggtgtgccgatgtgacatctaacgacttgaagattgaagataactctgttgatctgatattttcaaactggctattaatgtatctttcagatgaggaggtccaaaagcttgtggggaaaatggtaaaatggttaaaggtcggaggccatattttctttagagaatcatgttttcaccaatctggagattccaaaaggaaggtgaacccaacacactatcgagaaccaaggttttataccaaggtatttaaagagggccattcatttgatcaagatggaggttcgtttgaactttctctagtgacctgtaaatgcattggggctt

SEQ ID NO: 840 - DNA, 414 bp, Zea mays
  Clone ID: LIB143-058-Q1-E1-B1
acgcgtccgcggccgttgccgcgagctcgctccgacccaccgccgatggcgacggcgatgggcgcgatggccgccacctgcatggcctcgatcccggccgccgctacgttccccggtgatctcggcgtcggacgacgccgagcggttgtaccagggtggcgcgccggtgggagacggctgcgtgcgacgccgcctgcccggaggccgttcctgttctcgccgaagggcgtttcggactcgcggagctcgcaaacgtgccttgatccggacgccagcacgagtgttcttgggatcatccttggagggggtgctgggacaaggctgtatccactgacgaagaagagggcgaaaccagcagtgccgttgggcgccaactacaggctcatagatatccctgtcagcaactgtctcaac

SEQ ID NO: 841 - DNA, 259 bp, Zea mays
  Clone ID: LIB143-057-Q1-E1-H12
aacctcttccgccgcttcaacgcaggcgagctcggctccggtcacccgtcgatccacgcaaccatgtctgcagcagcggcaagtgaaaccgcgggggaagacgttccccctggacccaatgtccgtggaggagagtttgtccttggtgttgctcacatctttgcatccttcaatgacaccttcattcatgtcactgatttgtctgggagggaaactttgggtcggatcactggtggcatgaaggttaaggctgatcgtg

SEQ ID NO: 842 - DNA, 438 bp, Zea mays
  unsure at all n locations
  Clone ID: LIB143-057-Q1-E1-H2
cccgggccgacccccaccacgagtccggactgattgaccgcaccgattccgcgatacgttcccgaatccaacccatcttcgtccgctccggccactcgtttcgccgccgtcggtcgccacccgcaaggtttggagggatagattcgggagggatggcttccggtgggcagccgcagttccggtacacgcagccgccgtcgaaggtgctccacctgcggaatctgccgtgggactgcactccagaggagctggtcgagctggggacccccttcggcaaggtcgtcaacaccaagtgcggcgtcngcgcaancgcaatcaggcattcatcgaattcggcgaacaaaatcaagctattgccatgatatcatattacgcatcgtcaacagagccagcacaggtaananggaaaaatgtgtaccttcagtactcaaatagaca

SEQ ID NO: 843 - DNA, 440 bp, Zea mays
  Clone ID: LIB143-057-Q1-E1-H3
gggtcgatacaagcgtctacagtgcatgtctcatcatcttcatcgtcctagcacagctagcgcttgctcaccttcgtctgtgatcatgtcttgcagcaacggcatgtgcaactgtcgctcgagctgctcctgctgcagctcatgcaactgcatatcgactgacgtggataccgccgccgccagcagcatcaagaccatggtcttcgctgtgctgaacatgaaggccagcgcctgcggcttcgatgcagccaacgagggcggcggctgcgactgcaatacctgcgactgcggcaccagctgcggctgctcctgctgcagctgcaactgatccagcccgctcggccaggcgatggcgcacgatagtctagatgacgacgacgacgacgcgtataaatatactaacatcgtctagataagatcctgtcaactgctaccgccat

SEQ ID NO: 844 - DNA, 337 bp, Zea mays
  Clone ID: LIB143-057-Q1-E1-H4
cgtaacaccctatagtgattagcagcgccgcagcattctgccgcgcagtcgcgggcgccggttcccagcatgccatgtcgaattggatgcctccgtcggagatctctcccttcagccggatagtgaagctgaagcccacgctcttggaatccgcgaacgtccttcaggcagccctgctccgcgtgcaaccgctgtccaatgccaacctgcctaacgtccgcactcgctgtgagctcgacctcacgcgtgctggaatggagattgggcattgtcgggacccacccggcgtcgtggagctccgactcctcctggagctcctcgccatgcgcgactgtcg

SEQ ID NO: 845 - DNA, 371 bp, Zea mays
  Clone ID: LIB143-057-Q1-E1-H5
acggacgcgtgggtgcggatcctcgtggcggacgcggacgcgtacgtggccgtcgtcgacgagaaggtcatggtgaagatcgggacaaggtacgacgtgagcagcgtggtcccgtcggatttccacccggcggcgcacggcaaggactactgcgtctgggagaaagcgagcctccgcgtcccagcggggcgccacctctagcagctcagactgctcagtcttgtgctgcattgcaaacacagcagcacgacactgcataacgtcttttccttagtttcctaaattttaccttttcctagttcaatttcatatatgtatttctacatgtacacactatcacaatcagataaataaacaagcttagtcacctg

SEQ ID NO: 846 - DNA, 275 bp, Zea mays
  Clone ID: LIB143-057-Q1-E1-H6
gcgtcaacatccatctccgtctctctcactcccgcaaccaagcagttcaactcacacccgaagcggcgccgctagggtttgctccgacagccgcgaaacctagtccttactgcgccctcccacagaggccgtcattcactaatctacctgctacgcttcgcttcccgctccgatttggagctagggtttagcttatctccgagctcagcttcgggtcgcggcacgcggcatggcggggtacggtgaagagaaccagaacgccatgaacgggtacg

SEQ ID NO: 847 - DNA, 428 bp, Zea mays
  Clone ID: LIB143-057-Q1-E1-H7
cacgactctacactcacgtcctactaacgcgtccggtgctcatctggaccttggtcacatttcctttgcttgttttgggaggtattgctggcaaaaacagcacaagtgaattccaagctccttgccgtaccacaaaataccccagggagattcctccacttccgtggtaccggagaactattccacagatggctatggccgggtttttgcctttcagtgccatatacatcgagctgtactacatctttgctaatgtttggggccacaggatttacacaatctacaagcattctgtttattgtctttatcatcctccttattgtcactgcattcatcacagttgcactgacatacttccagcttgctgctgaagaccatgagtggtggtggaggtcattcctatgcggacgatcaactggatttttcgt

SEQ ID NO: 848 - DNA, 216 bp, Zea mays
  Clone ID: LIB143-057-Q1-E1-H9
gcccttcgacgcccatcccggctggtcgatcgcgatgagccatcgcgggactgcccggcgaacgatcccaccgactgctccatgggtcttcctctacttcctctgcgccatgaacatccgaaccaatctccagaaactgctcggcttcaccccgctgcacgcggttactacggccggcaggggtctcttcattatgtccgatccgaacgttaactg

SEQ ID NO: 849 - DNA, 366 bp, Zea mays
  Clone ID: LIB143-058-Q1-E1-A10
cttagccctgcgatgccgctcacctgggctcatcttccagtcgccctctccgcccagcagcagagcacaccatcctctccactcggatccccaagccctcgcctctagctcttgccacggcatccatcccctgctcggacctccacccggccgcgtcctcgccggtggccagcgccgctgcatcgcccttcctagcgtcggccttggcaccgcttccccgagcgccccagtcgagctcgcccatcctctgctctagccctttctccacgccgtcgctgagctcgcccctcccctcagccatggacacgacgacctgcagcccttcttggtggccaagcccatcttcctactcgcgccccctctttt

SEQ ID NO: 850 - DNA, 406 bp, Zea mays
  Clone ID: LIB143-058-Q1-E1-A11
cgcgggccgacacaagcgtcaagaggaactcgcgggatcgaggagatcgggacgatgatgggagggcgcgctctgctgctgctcctggtctcggcgctgctcgttcagatccgcgcctctgacccgctgctgtacgaaccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcaatttgaagtgagacttcagaatggccttgaatgtggaggtgcctacattaagtacatccggcctcaggatgctggat

SEQ ID NO: 851 - DNA, 360 bp, Zea mays
  Clone ID: LIB143-058-Q1-E1-A12
agccacggtcacgggcgcgtcgacgggctcggcggcggcggcggagcgccggtggagatcgtggagagcccccgcgagtacgccttcgtgctcgacgtgccaggcctctccaagtccgacatccaggtaccgcacctgcggcgcgcggtccctttactccgttggatccagggcgcgagcaactgaccccaatcgcatccgcttgtgtttcaagtgacgctggaggaggaccgggtgctggtgatgaagggcggcagcgggaagcggtagcgcgatgaggaggaggacatgaacggcgaagggtgccgatacatccggttggagcgcggcgcggcgccgcggtcgttcgtgcgcaagttc

SEQ ID NO: 852 - DNA, 381 bp, Zea mays
  Clone ID: LIB143-058-Q1-E1-A2
cgggacgctgctcatcactacatgctgtcctctgatccaggggctggcggacctggaggcggcggtgtgcctctgcaccgtcctcagggccaacgtcctgggcatcaacctcaacctgcccatcaacctcagcctcctcgtcaactactgcggcaggcgcgtcccctcgggcttccagtgcttctgatcacgcccatcgatccatctgcaggctaaataatttgtccaagctagtatatatacgtacgtacgttgatatatatgatgtagtattatatatatgtccatgcatgcaatgcatctcgtcgtccatcgcatgttgttgtcgttgttgtgtgtgttttcgatgatcctgtctctgttataaatatcattattatt

SEQ ID NO: 853 - DNA, 317 bp, Zea mays
  Clone ID: LIB143-058-Q1-E1-A3
gtgtggctctggatcgtcctcagggccaacgtcctgggcatcaacctcaacctgcccatcaaggtggggctcctcgtcaactattgctggaagcgggtcccctctggcttccaatgcttctgatcatgcccatcgattcatctgcatgctacatagtttgttcaagctagtatatatacctacgtacgttgagtatatatgatgtagtactatatatagtgtccatgcatccaatgcatctcgtcctccatcgcatgttgttgtcgttgtggtgtgtggttttcgatcatcctgtcgctgtgttacatatcattagt

SEQ ID NO: 854 - DNA, 383 bp, Zea mays
  Clone ID: LIB143-058-Q1-E1-A4
cctccaaccgttcccatggggaacaagcaactcctcctcgccgcatgcctcctcctcctggccaacggctccgtcgccaacgacgtggactactgcaattagaaaggacaaccggttaaagttagcggggtgcagatcgtgcccgatccggtcgaacccggcaagcccgccactttcaagatctccgcttctactgataaaaccatcgagaaggggaagctggttatcgacgtcaagtatttcttcttctacgtgcactcggagacccgcgacatctgcggagagacttcctgcccagcgaccggcgacttcgtgctgtcccaccagcagacgctgccaggcttcactccgccgggctcctacacgatctacatgaagattgt

SEQ ID NO: 855 - DNA, 425 bp, Zea mays
  Clone ID: LIB143-057-Q1-E1-H11
gggcctcgacatatcggtagccaccttcacctcaaccgccccggcgcacgtgcgcgtctccatcgtcgccgcctctcctccttcggacacgactgaccttccactggcgccgacgaagaagacacataggaagaagctcaccgccaaacctcatccagatccagtcgctaccctccgaaagccgcatacggaacgtctcgtctcttcctttggatccggcagccggtgctcctcctccggatccggtggtcaactccatcacccccagctccacctcccttagtccccctccatccgccctcacccaccgcttctatatcgccacctctctcgttgtagaagacactgaggatctggccatcatcatccgtcgcccctcactcgatttcccatctgccgctccctcctggtctctgagccgctga

SEQ ID NO: 856 - DNA, 303 bp, Zea mays
  unsure at all n locations
  Clone ID: LIB143-057-Q1-E1-F2
aaattaactcatagacatggcgcgccaccaccagcagcgggcgctgctcctgttcccactcgtcttcctcctcctctccttgcccgctctcgcggcgcgtgcgaaacganggccatatcatggtctgcagaattccccacaaatacctgtcggtgaaggaagcngctgcggtgatagcgttgctgccggagtcggctgacggggagctgtcggcggtgtactcgtgggcggaccaggtgcgctggcactaccactgggccaacgctctccactacgccatacacccccaagtctgcaacttca

SEQ ID NO: 857 - DNA, 424 bp, Zea mays
  unsure at all n locations
  Clone ID: LIB143-057-Q1-E1-F3
aagcctctagagcaactcgcagtagccgtgcgcggcggggcagaagtactacgggcgcggcccgctgcagatctcgtggaactacaactacgggcccgccgggagggacatcggcttcaacgggctcgccgaccccaacagggtggcgcaggacgccgtgatcgcgttcaagacggcgctctggttctggatgaacaacgtgcaccgtgtgatgccgcatggcttcggcgccaccatcagggccatcaacggcgccctcgagtgcaacgggaacaaccccgcccagatgaacgcgcgcgtcggctactacaagcagtactgccagcagctccgcgtcgacccaaggcccaacctcacttgctangcgacngcgtccacgttgtacccatggctcctgctagtgctagctcgtccacaataaatg

SEQ ID NO: 858 - DNA, 260 bp, Zea mays
  Clone ID: LIB143-057-Q1-E1-F4
actccctatagtatgtcgtattacagtgcgcatctggataaccggtcaaagcccaccctcttctccaaggtaagactccacagggtgaagaacataaccgggctggtcgaaacttttgcgaagtgcgctaagctgatggagctggtaaaccttgtcatcgttgccgggtagaatgatgtcaacatgtccaatgacagggaagagatctctgagatagagaagatcatgaactcatcaatacccacgacttgctccggcaa

SEQ ID NO: 859 - DNA, 186 bp, Zea mays
  Clone ID: LIB143-057-Q1-E1-F5
acaagactctagattgagtcgtattacagcatgatgtgggatacccagacagccgtgatgaactagtgcatcagcggttgcagtcggcatatctaccatactggtctgcatgatgggatgctgaagtctaggatgtggaccactacgtgtctatgtagatgcacgcactgatgtatgtgggacact

SEQ ID NO: 860 - DNA, 418 bp, Zea mays
  Clone ID: LIB143-057-Q1-E1-F7
acgcagactgacatgatcgcgctctcaggtgggcacacgatcggggtgacgcactgcgacaagttcgtgcggcggctgtacccgttcaagggcgccgccgccggcccgccgatgaacctctacttcctgcggcagatgcggcggacgtgcccgctgaactacagcccgtcggcgttcgcgatgctggacgccgtgacgccccgcgcgttcgacaacggctactaccggacgctgcagcagatgaagggcctgctggcctccgaccaggtgctcttcgccgaccgccgctcccgcgccaccgtcaaccgcttcgccgccaaccagaccgccttcttggacgccttcgccaacgccatggccaagctcggccgcgtcggcgtcaagaccgccgccgcggacggccaagtccgccgggtat

SEQ ID NO: 861 - DNA, 401 bp, Zea mays
  unsure at all n locations
  Clone ID: LIB143-057-Q1-E1-F9
gacacacgcgtctacaatcagtctcactcccccaagatcctcaacccgatcccaaacaaaccagcaaatccatccatcgcacatggacgcgttcttctcggcctcctccgcgtcggcgccctacggctacggcgccggcngatggagctacgactcgctcaagaacttccgccagatcacccctgccgtccagacncgcgcaattagcatttcgtatttttttaaaaatatatatcagtcgctggtttcgtgcgttccagaaattctcctgcgggttgcgtgtagctgatgcgtaattccctgacgtaatctatgattcgcgcgcgtcgtgttccttgcatttagaactgcaactgtgcggatgccaccgattcgattgattcgtcactttaagaacatga

SEQ ID NO: 862 - DNA, 190 bp, Zea mays
  Clone ID: LIB143-057-Q1-E1-G10
ctctagactgagtcctagtaatgcttgatgaacgaatgaagaatgccgatacatggcaccataatgctgccaaccgtgtggcataacccaaaccaccgggtcctatcacttgtgcagcatttgctcaagatgtcattgaaggtacagcacgcgtttcacaagctcacgagcacaatcaccagcccctgat

SEQ ID NO: 863 - DNA, 333 bp, Zea mays
  Clone ID: LIB143-057-Q1-E1-G12
gtactatgattcttgaagagatcgagcttcttttgcaccacaatgtctaggatgtcttgcacctgcggataaatctgcggctgcggctcaagctgcaagtgcggcaagaagtaccctgacctggaggagacgagcaccgccgcgcaggccaccgtcgtcctctgcgtggccccggacaagaaggccgcgcccgagttcgtcgaggccgcagcagaatccggcgaggccgcacaaggctgcaactgccgtggcaactgcaagtgcgacccctgcaactgcggatcacatcgatcgacgaccatggatatgattactatctatctaacttgtggt

SEQ ID NO: 864 - DNA, 363 bp, Zea mays
  Clone ID: LIB143-057-Q1-E1-G2
gggtcgagacacgcgtctagaggaagtcgaaccaagagatcaagaaccacccatggttcttgaagaacctgcccaacgaagatgaccgacgagtaccagatgaacctacagctagtcgacatgaatgtcacgtcgcaaagcctggaggagattatgtccatcatactggaagcccggaagcccggcgacaggctgaagcatgcgggacagctccccggccttgggagcatggagctggatgacattgatgttgacgacatagacgttgacgacagtggcgactttgtacgtgccttgtgacgcggttcaggctgtccggcaccgttgctgcggtggactctcacccactctcctgggtcttgt

SEQ ID NO: 865 - DNA, 413 bp, Zea mays
  unsure at all n locations
  Clone ID: LIB143-057-Q1-E1-G3
aggcaaacctcagcaacccgtacatcgtcgagtacaaggacggatgggtggacgaggggacctccgtctgcatcgtcacaagctactgcgaaggangggacatggccgagaggatcaagaaggcaaggggcatcctattctcagaagagagggtgtgtcagtggttcacgcaattgctcctcgccctcgactacctgcactgcaaccgtgtgctccaccgtgatctcaagtgttccaacattttattgacaagggataacaatatcagactcgctgactttgggctggcaaaactgctcatggaggaccttgcctcatcggttgtaggaaccccaaactatatgtgcccagaaatactagcagacataccttatggatacaaatccgatatatggtcacttggttgctgtatg

SEQ ID NO: 866 - DNA, 413 bp, Zea mays
  unsure at all n locations
  Clone ID: LIB143-057-Q1-E1-G4
catgaatgttattcttcaatgaaacaccccatgaaactggaggccggggaaggaagcagctggatggcggcggcggcggcagcgcggccggtgcccggcgtgcatcagctaccgatgttcgcgctgtggaacgactgttgattgtggcaatggcaacctggttggtagagtacgtagtagttagtgaagaaatgcatgtcattgcacctgcatgcgcatgcgcgagcacgaggtgtaatgactttcggcagtagaagtggcggtgaagaagtggacgacacggcctgnggaaggacatgcatggcgtactgcctcnctgcaagcgagatgcatgcatgttgcacacgctcgccgtttcttcgcaagatggcgacaattttgccgcaatatgtaatgtaatggttccacatgca

SEQ ID NO: 867 - DNA, 417 bp, Zea mays
  Clone ID: LIB143-057-Q1-E1-G5
acggacgcgtgggtcatatttaatctgcagtgatagaagacaccgggcatgtttgggatgtgggagatttaagcagatacgggtagaactacagtactacagtctacaactttcatttaatcgaacttgtttctgcttcgactgaagctttaattcttgtgctgttggaatttctgttctgcagatcatttagctcaaataattggtagtccaacggtcacgatacttgttttggtttgggatttctgtgcttttgtctactttatctatgttgttgtggttggctggttgcctttacatgtggttgtttggtaagtttggcaatttggaatccctgtagcgaaaactgatatttaaaactgggccctggtcagaagtcattctggttgtgttggtttcatcacttgcttccagtga

SEQ ID NO: 868 - DNA, 444 bp, Zea mays
  unsure at all n locations
  Clone ID: LIB143-057-Q1-E1-G6
cgcccgggccgacacacgactctagagtcaggcgcacgactcccgcgcggcgcttgcgcgcaaacacgccgcgcggaggcgggacgacggagcccgtcgagccgcgcaaggacggccgccgtccgcgggccattaagccgaagaagccgggctggcgcccgaagagctggaggtgctggaagaggcggccatcatgggggaggacgaggggcgccggcccaccgactacgaccgccgcgcgcacatcttcgaggagagctcgcgggtcttccgtgatctcaagcagcgaagcgacggcgacggtggcggcggaagcgagagccagagcggccgtggtggtggcgtgactactggtcncgcggcggaaacagctaacaaggacgtgtaaagataacgagccgcagctgtagcagctttgttggataaaatgtcgtactgtgtaat

SEQ ID NO: 869 - DNA, 295 bp, Zea mays
  Clone ID: LIB143-057-Q1-E1-F12
ttaatcaattcactcaaacctcctccccaaatcctccattagattcccgttgacaagaagactagaaccgaacctgaccatgtcgctgattcgccgcaacaacgtgttcgattccttctccctcgaactccgggaaccctttgagggcttccccttcggctccggcagcagcagcagtctcctcccctcgttcccgcggaccagctcggagaccggggccttcgctggcgcgcggatcgactggaaggagactccagaggcgcacgtgttcaaggcagacgtaccggggctgaag

SEQ ID NO: 870 - DNA, 443 bp, Zea mays
  Clone ID: LIB143-057-Q1-E1-G8
cccgggccgatgcacgcctctacactgagtcgtattatctcgtcgagagtagctagccgcccttgtgcagacatgccaccgctccgagctcgacgtgccgcccacgcacgagagccccgcactgcaagctcgctccgccgcgccgttcttgctcgaggttcgccatcgcggaacgaatccctgcaccagccgagctcgatccgacgtaaaaccgttggtcgttccttcattttctctccgctgttccctcctctctgttgcctgctcatcgatgagggatatacgtgtacatctgggccaacacgctggcccgaagcacgatcatacacagcctaggtgttggtggccttcatcttcgccgaaggtcttctaagcacagacactttccgcaggactatctgcaggcttacatcacgtgaacgtataggccgaatctacaattc

SEQ ID NO: 871 - DNA, 357 bp, Zea mays
  Clone ID: LIB143-057-Q1-E1-H1
ctcgcgtgtcgatacaagcctctacagtgacgtcgtgtcaaagtgagcattccgaattcgctgcgatttctcgagatcacgacaacatcgactactcttggtaccccctttcgtgccatagatcgtttctagtgacgttgggaagatgcgatgctccagggatggggatcggtgtcgggacgaactacccgtgcgtcagcctgtggtcaaacgagcgcgatcgacatgaatcggcagtaggactgcgaaccaaacgagctgtcctatgtcgggatcaccttcagcgaggtgctcatcggcaactccggcatcagcgacgtccgcattcacgcaatcatcaacgtcttcgatcacaat

SEQ ID NO: 872 - DNA, 389 bp, Zea mays
  Clone ID: LIB143-057-Q1-E1-D12
aaccctctagactgagtcctattaaaatcctccggatttccttaatttggtttgtgtgaaatacacagttttgggggaaaattttttgaagctgaaaaaatggtgctgaaaacggaactcggccgcttcattggccacaagatctaccctgggaaaggcatccggtttattcgtgctgattctcaggttttcctttttgccaactctaaatgcaagcgctacttccacaaccgcctgaagcctgcaaagcttacctggacagcaatgtacaggaagcagcacatgacggacatccatgctgaagctgtcaagaagatgcgccgtgccaccatgaagccatactcgaggtccattgtgggtgcttccttggaagtgatccacaagaagag

SEQ ID NO: 873 - DNA, 427 bp, Zea mays
  Clone ID: LIB143-057-Q1-E1-D2
gggtcgagacacgcgtccaacgaaacgtacgtcacacagtccattattgccgtctcccttttgcgtgagcaaagaaagagagcgagaagcagtcgccatgtctgggatcatccacaagatcgacgataagctccacatggggggcgaccacaagaataatgatgacgagcaccacaagaaggccgatgagcaccacaagaatgatgagggggagcaccacaagaaggacggcggggagcacaatgaatgcatcgtggagaagatcaaggacaacatcaccggcgagcacggcgacaagtccggcgaccacaacgagaagaatgacaagaataacaatgataagaagaagcacggcgagggccacgaccacgactgcggccacagtatcagcagcagcgacagcgactgagatctggtgtcgcagcac

SEQ ID NO: 874 - DNA, 386 bp, Zea mays
  Clone ID: LIB143-057-Q1-E1-D3
acaagaacacgtatgctggatgcaatgttaggaagcacattgataggtgttcatcagaccctaacgctgtcataacaacctatcaaggaaaacataaccattaatcaccggttggtcagggcggcaaccacaacgcatgaatgtcatcacaacacaaagggcagaacaacgtatccagcaatcagacttcattctcgacaccagactacgctaaccagatgccaagtgggatcttacagttcaatagcgagcaatattaccatgtatttggatgacgttcttttggcaaataccggatgcctgcaattcgtacaaccatatggcatcatcagtttcataaagcctgacactttcaaatgacttcagtattttcacgtacatacaca

SEQ ID NO: 875 - DNA, 417 bp, Zea mays
  Clone ID: LIB143-057-Q1-E1-D5
agccgcggtccgtggactggcggcagaagggcgcggtgacggccgtcaagaaccagggccgctgcggcagctgctgggccttctccacagtggtggccgtggagggcatcaacgccatacggacggggagcctggtgtcgctgtcggagcaggagctgatcgactgcgacacggacgagaacgggtgccagggcgggctcatggagaacgccttcgagttcatcaagtcccacggcggcatcaccaccgagtccgcgtacccgtaccacgcctccaacggcacctgcgacggcgcgcgggcccggcgcgggcgggtcgtggcgatcgacggccaccaggctgtgccggccggcagcgaggacgcgctggccaaggcggtggcgcaccaaccggtgtccgtggccatcgacgcggggg

SEQ ID NO: 876 - DNA, 408 bp, Zea mays
  Clone ID: LIB143-057-Q1-E1-D7
acccacgcgtccgaaacacacagaagcgaggagcactacttgttggttggattctcttcagtctagcagctagtccagttaagtttcagacacacatggggagcattggcagaggcacggccaactgcgccaccgtgccgcagccgccgccgtcgacagggaagctcatcacgatcctgagcatcgatggcggcggcatccgcggccttatcccggcgaccatcattgcgtacctcgaggccaagctccaggagctggacggcccggacgctcggatcgccgactacttcgatgtgattgccgggacgagcaccggcgccctgctcgcgtcgatgctggcggcgccggacgagaacaatcggccgctgttcgccgccaaggacctcaccacgttctacctcgagaacg

SEQ ID NO: 877 - DNA, 373 bp, Zea mays
  Clone ID: LIB143-057-Q1-E1-D9
acaagcctctagactgactcatctaatcaacccaatccccctcaaccccaacaaccccgagttccccaacccgaatggccccaaaggccgaaaaaaagcaagcggagaaaaaacccggcggccgaggagaaagcggagaagacgaccgcaggcaagaagcccaagtccgagaagcgcctgcccgcctcgaagtcctccggcaaggaaggcggcgagaagaaggggaagaagaaggccaagaagagcgtggagacctacaaaatctacatcttcaaggtcctaaagcaggtgcaccccgacatcggcatctcctccaaggccatgtccatcatgaactccttcatcaacgacatcttcgagaagctcgccggcg

SEQ ID NO: 878 - DNA, 423 bp, Zea mays
  Clone ID: LIB143-057-Q1-E1-E1
acccacgcgtccgcgtcggcgaaggcaaggccgtgcgccgccgccgcgcccgtgaatctccccagggcctcctccgccaccagctcgacatgtgctcccgcaacgccgacctcaccaccgcgctccgcctctacgacgacgccctctccccggacaaccccatcccgctctccctccaccactacaactgcctgctctacctctgctccaacgccgccgctaccgactctgacagccatatctccgccaccgccgctcagcgcggcttcgacatcttcgccaggatggaggccgacggcgtccagcccaacgaggccaccctcaccagcgtcgcgcgcctcgccgccgccacccgcgaccctgccatggccttctccgtcgtccgccgcatggccgctgcgggcaccccgccgcgcctccgca

SEQ ID NO: 879 - DNA, 322 bp, Zea mays
  Clone ID: LIB143-057-Q1-E1-E10
attcaaccccgccgcccaatccccaatggctcaaccaaccacgaaaaccgccaagccgccggcatccttccgcttccgatggggaatgccgcctgcggccccccctccggatttcctccggggggccgctgccgccgccggcgcggcctgatggttgttcagcacgtcatcctcgacgtccatggggaattgttctctggcggggtcagcggctgcggcgttccgccggcgtcgaaggccgcgatcgccgcgctgaaggaggtgaaggccggggagggcgacggcgatggcgacgacgcgctgggcgagtgcgccatctgcc

SEQ ID NO: 880 - DNA, 155 bp, Zea mays
  Clone ID: LIB143-057-Q1-E1-E11
cttccagggggcactttcataatcattcaatctggaaaacccctgcgttactcacagacgtcgcccgagggaaaattgcccctttgaagaatcggttttttttaagaagggtctggctcgttggcatccctcaaattttggcccccactatgggg

SEQ ID NO: 881 - DNA, 161 bp, Zea mays
  Clone ID: LIB143-057-Q1-E1-E2
cgggtcgagacacgcgtctaaaataaatcatgttatcttttgttttttcctctccatgaactgttttatttattgtactaatatagctgattattcagttggacattcatttttttgtcaaacagtttaacaatattttttttcctgtgtggtctacaatt

SEQ ID NO: 882 - DNA, 419 bp, Zea mays
  Clone ID: LIB143-057-Q1-E1-E4
agatcttttctggaagcagcttgatgtgacatacccaggcatgccggatgcaatggtccatcaggggttttattctgcatattataatacaactctgcgatatgagatcctgaagtctattaaatgggcaagaaaaacatatggaaatctacccataaatgttgtgggacactccatgggaagggctttagcttcgttttgtgcccttgatctatctgttaaatttggatcgcaagaggttgaactcatgacctttggacagcctcggataggcaatcctgcatttgctgtatactttggtgaacaagtcccaagaacaatccgtgtgacccatcagaatgatattgtgccgcatttaccaccgtattattattacctaagtgaatggacataccaccacttcgctagagaagtttggc

SEQ ID NO: 883 - DNA, 391 bp, Zea mays
  Clone ID: LIB143-057-Q1-E1-E5
acggaaggtcaaagaatagcagcagcaggcggcgccgagtagcggctccccacctcgagcttgccaccatggctagaggattgaagaagcatttgaagaggctcaatgcgcccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgattgcaaggtcaggacagacaagacctaccctgctgggttcatggatgtcatttccatccccaagaccaatgagaactacaggctgctgtacgataccaaaggccg

SEQ ID NO: 884 - DNA, 412 bp, Zea mays
  Clone ID: LIB143-057-Q1-E1-E8
cttcccggctccagcgatgtcgggggcgatcgggggcgccgaggtccacggcttccggggcgcagcggcgcagctcccgcggtcgcgggtgctcgggaggccgatccgggtggcgccacccgccgcggcccggccgggcggcgcgtccgcgggtagcatacgcgccgtctccgcgcctgcgaagaaggatgcttctgaagttaagcgaagcaaggttgagataatcaaggaaaagagcaacttcctccggtaccctttgaacgaggagttggtctcagaggccccaaatatcaacgagagtgctgttcagctgatcaagtttcatggaagctaccagcaaactgaccgagatgtccgtgggcagaagaattactcgtttatgctccggacaaagaacccttgtgggaaagtt

SEQ ID NO: 885 - DNA, 386 bp, Zea mays
  Clone ID: LIB143-057-Q1-E1-E9
gggccgacgcacgcgtccacccagacgtccgatcaaatcaccctgccgatcgccatggacaaacaacaggcggaggagggcgaaagcccccgcgtcaagaggaccccggaggaggggtcgtccccgctgtccgctctggcggatgacgtgctgctagagatcctgggacggctcgaggcggacccgcgggactgggcgcgggcctcctgcgcgtcgccgctcctcgccgctctgctccgggcggcctgcctctcgccgcgactgtcacgggcgctctccgccgagctcctccccgcgccgtcaccggacggggcgcccgcggcctgggcggcgctccacaagctctccgtctgttgcccggggctcctccgcgccggggtgctcct

SEQ ID NO: 886 - DNA, 425 bp, Zea mays
  Clone ID: LIB143-057-Q1-E1-F1
agacagactcatcatatgcccacaaggccagaaccagaaccaagcagctcgttgcaacctcatatcatcccctgccacgcacctccgtccgccgcgccatggaatcgaggaggagggccgtgcccaccgtgacggcggttgcggtggcgacgctgctgctgacgatgatgacgtcgtcgggcgtgggcggcgacttcgcggcggaccgggcggagtgctcggagcagttggcggggctggcgacgtgcctgacgtacgtgcaggagcatgcgacggcgacggcgccgacgcccgactgctgcgcgggcctcaacgcggtgctgcagagcagccgcaagtgcctgtgcgtgctggtcaacgaccgggacgaccccaatctaggcctcaagctcaacgtcgacaaggcgctcggcctccccgccgtc

SEQ ID NO: 887 - DNA, 362 bp, Zea mays
  unsure at all n locations
  Clone ID: LIB143-057-Q1-E1-F11
caagcctctaatctgagtcgcattaacgtgaggaaaatgtgtacatggtgaagctcgctgaccangccgcgaggtacgatgagatggttgagttcatggacaatgtacccaaaactgttgactcggaggagctcactgtgcatgagcgaaacctcttgtctgttgcatacaggaacgtcattggagcccgccgcacctcatggcacatcatctcctccatcgagcagaaggaggatggccgaagcaattaggaccgagtaacactcatcaaggattaacgtggcaagattgagactgagctgaccaagatctgtgatggcatcctcaggctgcttgagagccatcttgtgccgtcttctact

SEQ ID NO: 888 - DNA, 397 bp, Zea mays
  Clone ID: LIB143-057-Q1-E1-D11
aggagacgtttcaaggactgcgagcgataggatgtggactcactgtatcattcgcgttctccatactgatcaacctcttcctcagttatcccactcagccgggatggttaccttctcctttgctgtccatccgtatagacaacatccacaagggtaagcacgggagtgattctgaaacttacgacactgaagggaggtttgatccatcaaagttcgatgctatattcagtaagtacggtcgaacccatcctaatgctctaacaaaagacgagttgagctcaatgcttcaaggaaaccgcaatacgtacgatttccttggctggttggccgctgccggtgaatggctcttactctacagcttggcgaaagacaaggatgggctcttgcagcgcgaaac

SEQ ID NO: 889 - DNA, 196 bp, Zea mays
  Clone ID: LIB143-057-Q1-E1-B4
acattcattcgtactcactcagatgacgtctcaatcactctggataccgttgtacaatcaactgcttcgtcaaacggaccattgacaatgggatcaacgaggttgcagttgaagtcgcttgagggaccatcttctgtcatcataccgattaagtcaactacgctcttgatgtacctgtgaggaagccgaagaactt

SEQ ID NO: 890 - DNA, 402 bp, Zea mays
  Clone ID: LIB143-057-Q1-E1-B5
acggtcgcgtgggcggacgcgtgggccggtggctccaccactagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatattaaagctctgcacaagaacctagctgccagagaattgctataccaacaccagcataacaaaaggatgagctgccctgccatggcacagctcctctccaataccctgtactacaagcgcttcttcccatat

SEQ ID NO: 891 - DNA, 419 bp, Zea mays
  Clone ID: LIB143-057-Q1-E1-B6
agcgtcacacgcggaaaggtatcaccggatcaggtagaacgctgcacaatctccttcgccgccgccaagatggtgaacgttcctaagaccaagaagacgtactgcaagaacaaagagtgcaagaggcacacactccacaaggtgactcagtataagaagggcaaggatagcctgtctgcccagcgaaagcgccgttatgaccgcaagcagtcaggatatggtggtcagaccaagcctgtcttccacaagaaggtcaggaccaccaggaagattgttctgaagctgcagtgccagagctgcaagcactactcacagcacgccatcatgagatgcaagcattttgagattggtggagacaataacggcaagggcacatctcgtatctaagcttctcgtccacctgtcaggttgttgagttg

SEQ ID NO: 892 - DNA, 416 bp, Zea mays
  Clone ID: LIB143-057-Q1-E1-B7
acagagacagagacgatataatcagaataaagtatagcagcgcgtgtgcgcaacagggtaagattaggcgtgtgatttgatttcaaagctgtgcttgtaacgtaatgtaatacggtgtggcatatgcaccgggatatggtatgtgtattgggaaaaaaaaaaaaatcaaacataaacacaaaaacaaaaataaaaataaataaaaacaaacaacaaaaaagaaaacaaaaaaataaataaaaaacaaaaaaagggggggccccccaaagggtctaaattttacttacccttgctagaaacataaatattcttcgaagtcgtccccaaatttcaatcaagatggcggtctttttaaaagtctataacgggaaaaacctcggctgtacccaatttaaccccctggacaaaaagccccc

SEQ ID NO: 893 - DNA, 417 bp, Zea mays
  unsure at all n locations
  Clone ID: LIB143-057-Q1-E1-B8
acccacgcgtccgcccacgcgtccggaaattgcaaacctgtcactagcgaagcatacttcgtcgagcacactcttgcaattaatccaccgagttcggtttagtagcatagcatcgacaataaatgtcgctcgtgagtcggcgcagcagcaacgtgttcgaccccttctccctcgacctctgggaccccttcgacatgttccgctccatcgtcccgtcggcggcctcctccggcggcggttccgagaccgccgccttcgccaacgcccgcgtggactggaaggagacgcccgaggcgcacgtgttcaaggccgacctccccggcatcaagaaggatgaggtcaaggtcgaggtggangacggcaacgtgctcgtcatcagcggcaagcgcagcagggaagaggaggacaagaacgaca

SEQ ID NO: 894 - DNA, 391 bp, Zea mays
  unsure at all n locations
  Clone ID: LIB143-057-Q1-E1-B9
gcgggccgcctctagactaagtcgcactacacggcgcctccccctcaacatggcctgggctcgccttgcctcccgctcccgtctgcgccccgcggcctccgccgccggccgatcccgacacgcctcaacaccggctccgcctccgcctccgtccccacctaccacacgcacggtacctgctgccacctccgcgccaccgctccggcgtctcctcctgcttccgcggcaccggtttgctgacgccacgccctcagcatcgaccgcgtggctgctcggtgcccgctggcgccaggggcacggcangaggtgctttgcgagcgccgcctacccggcgcaggcgacgccgggggaagcgtctgagctggtggatgtgccactggcgcagactggg

SEQ ID NO: 895 - DNA, 373 bp, Zea mays
  unsure at all n locations
  Clone ID: LIB143-057-Q1-E1-C1
agcctctagagtaattcctattactctccctcgatgcctttgccggcgatgagcgcccattcgcccatcaaactgattagatggaactctctctgtctcaactgagctgtaaggacattancgagctcattgctgctggcaaggataattttgcatcagtctcatgtagcggtggcggtgtggctgttccagcagctgtccctgctgctggcagcgctcctgcagctgaggcgaagattgaagataatgtggacgacaaggaataaagtgatgacgacatgggctgtcagcctcttcgactaagcctgtgcaatattcaggagtattgtttttgagtcacggaagcaaatcgactacaagtcctagtcatgtt

SEQ ID NO: 896 - DNA, 393 bp, Zea mays
  Clone ID: LIB143-057-Q1-E1-C10
tctactacacctcgagtaaccacagcgagaaccaatcgccaagcaaaaagcccgagaaagaaagaacacacaggagacacacatggcggctgcagcgaaggcgtcgtggatggtggcgatgagcgtcggggccgtggaggcgctcaaggaccacgcgggcctgtgccgctggaactacgcgctgcgctccgtccaccgcgccgccaaggccaacgctcccagcttcgcgcaggccacgaagctggcgccgcccgccgcggacaaagccgccgcggaggatgggatgaggaccgtcatgtacctcagctgctggggccctaactagctagggcctctgctagtttcggcttcctgcaaccgtaccgagctcggcttcaaatctgattcatgact

SEQ ID NO: 897 - DNA, 317 bp, Zea mays
  Clone ID: LIB143-057-Q1-E1-C11
tctcactaccccctccggtccgggtccgggtccgtaaggtcctccggggttcggtttcctgggtaaccggatcaaaatggcggcttcggatgttgattaccgcggcttcatcggcggcctcccctgggccacggacgaccactccctcaacaacgccttcagcacctacggcaaggtcctcgagtccaagatcatcctcaatcgggagacgcagaggtcccacggcttcagcttcgtcaccttctccacggaagaggcgatgcggaacgccatcgacggcatgaacggcaatgagctggacggacgcaacatcaccg

SEQ ID NO: 898 - DNA, 240 bp, Zea mays
  Clone ID: LIB143-057-Q1-E1-C12
cccttcctctcctccaaggtccaatcctcgcccaaccgcaacctccccaaccaaccaaggttttccaaaataacaacgccggaccccccaacttggcccctggccaagggcggcaccaacaaggggggaacccactccttcggcccctccaacaatttctcctcccacgacctcgcagtccaaaacttccctcaagccaaggtactctctcgctctctctcctacgtctctctacgatct

SEQ ID NO: 899 - DNA, 422 bp, Zea mays
  Clone ID: LIB143-057-Q1-E1-C2
aggcaaacaacgatgaaggcatgcccatgtatcagaggcccttcatgaagggcaagctgtacatccacttctcggtggagttctcggactcgttgagcccggagcagtgcaaggccttggaggctgttctcccgcccaagccagtatcacagtacactgacatggagctggacgagtgcgaggagacaatgtcgtacgacgtgaacatcgaagaggagatgcggaggcggcaacagcagcaccaggaggcctacgacgaagatgatgatgtgccaggcggtgggcagagggtgcagtgcgcccagcagtaggcagcttgcggtaagtctacccgcttgtattggcctgatgatacttcggttacacgagtgcagttatcggtctgttagttcaagttctgcgtttggggtgttagatccacc

SEQ ID NO: 900 - DNA, 418 bp, Zea mays
  Clone ID: LIB143-057-Q1-E1-C4
aaagcaagcagcctaaaaaaaccgtatcgtctcgcctgttcagtttccttctcttcccgcagcccggtttgccgaccaggttccaccgttccagagtagccaagcgaatcccgtgtctggttcgcgcgatggcggaggagcagtccaacccccagcaccagcaagcggaggagagggaggttatggtggagcagcagcagccgaggagggccccgaagctgaggtacctggacttcgtccaggtggcggctgcccatgccgcggtgtgcctcgctgggctctacggactcgccaaggaccacgccgggccgctccgccccagcgttgacgccgtcgagtctgccgtgaagggcgtcgttagccccgtctacgaccgcttcggcggcctgccgctcgacgtcctcgccttcgtcgaccg

SEQ ID NO: 901 - DNA, 355 bp, Zea mays
  unsure at all n locations
  Clone ID: LIB143-057-Q1-E1-C5
acccacgcgtccgcccacgcgtccgggtgcgcgcacctgaggaagcaaccactgttccagggttcctgcgagaccgcctttgagaagtgccggggtcctgaaacgtctgagatctccagggcacagctagctgatctcttgcggttaagcatggtgccaccttctgatgataagatgctggagctgttcaagacgttcgatgtagatggcgacgagaagatcagcagggacgacttcatggcgtgtcttgggaggttcccgttcctgatcgcgttctttgctgccctgatcaatggggaagtgtacatcgagatagtctgaatgaatgcctgangganagcgatgccgcgtaaaa

SEQ ID NO: 902 - DNA, 154 bp, Zea mays
  Clone ID: LIB143-057-Q1-E1-C6
acaacactctatagtgacgtcgtattacgcgtccgggtgcgcgcacctgaggaagcaaccactgttccaaggttcctgcgagaccgcctttgagaagtgccggggtcctgaaacggtctgagatcgccagggcacaggtaaccgatctcttgcg

SEQ ID NO: 903 - DNA, 409 bp, Zea mays
  Clone ID: LIB143-057-Q1-E1-C7
agggttttgctgctcaccgaccccgagctccgaaggccgcagcatcaggcgcggccccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcatagggacctg

SEQ ID NO: 904 - DNA, 355 bp, Zea mays
  Clone ID: LIB143-057-Q1-E1-C9
accttcagtgaaaccgttcttgataagtcctgccgcactgtcataagcaagtcacctaacaagcagaacggtctgtacatggaagcgcgccccctgaaggagggtcttgctgaggcaattgatgatggccgcattggcccacgtgatgatcctaaagtgcgctcccagatcctctctcaagagtttgggtgggacaaggatcttgccaagaagatttggtgcttcggacctgataccaccggcccaaacatggttgttgatatgtgcaagggagtgcagtatctcaatgaaatcaaagattctgttgtggctggtttccagtgggcatcgaatgaaggtgcactggctgaagaga

SEQ ID NO: 905 - DNA, 121 bp, Zea mays
  Clone ID: LIB143-057-Q1-E1-D1
gttccaactttatctgtttttatgcatatacaggttgtatcaattcctgaataatgtttgttgaagacctttattatcatgtaaagagattctatctaggaagccttttttggattcgagt

SEQ ID NO: 906 - DNA, 419 bp, Zea mays
  unsure at all n locations
  Clone ID: LIB143-057-Q1-E1-B2
acccacacttccgagctaagctaagccgagctaagaagcacagcaagtctcaccagactagcggctancgcgagaatggccaacgacatcgaggccgcngcggtgcacgaaggcaacgactactctgacacgctcccggcgccgctggtggacgcggacgagctgaccaagtggtcgctgtaccgcgcggtgatcgccgagttcgtggccacgctgctcttcctctacatcacggtggccacggtgatcgggtacaagcaccatacggacacggcggcctcgggccccgacgcggtgttccgcggcatcggcgtgctcggcatcacctgggccttcggcggcatgatcgtcatcctcgtctactgcaccgccgaggtgtcgggtgggcacatcaacccggtcgtcaccttcggcctctt

SEQ ID NO: 907 - DNA, 153 bp, Zea mays
  Clone ID: LIB143-056-Q1-E1-H3
gtattaaactgccatggaagctagctaatggatggaggcagaggccagaacgatgaaggggggaagctatacatatatgtgtgtaatatagatatatggggtttgtgttaaaaaaataacctacaaaaaactgggggtaaaaattcaaaatca

SEQ ID NO: 908 - DNA, 380 bp, Zea mays
  Clone ID: LIB143-056-Q1-E1-H7
agcacacccaagctcgcgcccaccttccacgtcgaggtccgagtcctgctttgatggcgaccgacgtggctgagactcccgcgccgttggtggatgcggccccagaggcgcccgccgacgccccggcggcgcctgctgccgacgcgaagccggccaaggccaagaaggccaccgcgccgaagaagcgcgccagcccgactcacccgccgtacgccgaggtaattggtgccctccctttgatccttctgccgtgccgtgctgtgcgtgcgtctccgccgcgtcgggatcgtactgagtagtggatggtcggtgcgcaggatggtctcggaggcgattacgtcgctcaaggagaggacggggtccagcaggcggtgccagtg

SEQ ID NO: 909 - DNA, 413 bp, Zea mays
  Clone ID: LIB143-056-Q1-E1-H8
gtagttccacaagcttttggaaatgttatgatgccagtgatgtaccagcagatgttccaggtgcctccgaagccaaatgagaccgtgcaggatacttcagccaatggaaaaagtaagcgacctcgcggtcagaagctcacagagacatcccaacaggcaaatggaaccccagcatctgcatctggctagggtggactactaacattttgaacaggatttctgtacatacgttgacttcgttgacttcatgccgtgagaaattttacatatggacgctggcactaacaattacctcaatgttgtccaaggtatctggcccaggactggaaattgtctctcgcacactttctttttgtgtgtggctgatttctgcaagacaggtttcacctaatgtacaagtcccctatcccttt

SEQ ID NO: 910 - DNA, 384 bp, Zea mays
  Clone ID: LIB143-056-Q1-E1-H9
cacacgcctctaaacacatcactcatcaaggcatccctttgaaatgtgtgatatctgttgaggaatctgaggtgaatagaaaaattctaagaaggtggtggttgaaaactgaacaaactggagtactaaggcaacatgcaggaatttggaagctcaaaacacatgtgattgaagacttggtgaaagagtttggtggttttgatctgattatcggtgggaattatacttcttgcaaaggtggtactacagtaaatacgacaatgggcatggattcgaaccgcttctatgagtataaccgtgtagtcaaaagggtaaggactgcagttggactcagttgatgagtccatctttaatgaagattgcagtcttcataaaactagcctg

SEQ ID NO: 911 - DNA, 446 bp, Zea mays
  Clone ID: LIB143-057-Q1-E1-A1
cgggtcgagcccgcgtccacaacccaccatgccaagccagcgaaccaccccgcccgcagccgcaagcaagcagccaagcagtgtgaactgaccgtccgttccgtccagcccaccatggaggcgccgccggtaccggagctcatggatctggacgcgccccctcccgccggttccccccgccgtcagcgacaagaagaaggaaggggaagggggagacactgttacgggtcacatcatctccaccaccatcggtgggaagaacggcgagccgaagcggaccatcagttacatggcagaacgtgtcgtgggtacgggctcatttgggatcgtcttccaggctaagtgtttggagactggagagaccttcgccattaagaaggtgctgcaggatcggcgttacaagaaccgggagctgcaacttatgcgtgccatggagcaccccaacg

SEQ ID NO: 912 - DNA, 369 bp, Zea mays
  Clone ID: LIB143-057-Q1-E1-A10
aaggcggccattaattcatcgaagggttaagggcccccttaaccaccgggaccctcaaattccctcgcccggtgggacggaacctctggtgcaccgcggcgttgaaggactggcaaaccctgccgcccaaagtcgcctcccagctcatcgccagcgcgcagcacgtggagggcgaccgcggactgggcagcgtcaggcagttcaagttcacctcactcatgccgttcagcttgatgaaggagcgtcacgagttcctgcacgcggacaagtgcgagtgcaagaacaggctcatcgagggcggcggcatccgcgtcgccatcgaaacggcgacgtcgcacatcaaagtggagcccgcggccggcggcggga

SEQ ID NO: 913 - DNA, 70 bp, Zea mays
  Clone ID: LIB143-057-Q1-E1-A12
gttcgaggcctacttagcggttaaggggttttcgtactccttcaacattgggacccacattgtgtcaacc

SEQ ID NO: 914 - DNA, 381 bp, Zea mays
  Clone ID: LIB143-057-Q1-E1-A5
agggtcgtgcagccctactacgccctggtagtatcggcggagggcggcagcagccggccgcggaccatcccggcgcgcaacgccggcgtgtgcagcggccacacgctggggcagtactaacggcctggggtccgaaacccggggcacggcaacttgggtgcccgacccgtacggcatcgagatcggcgacccggccgcggcgcccgccagcgagggctacgagcagcgctggctgctcaacgtgcacgccatcgacacgcgcggcgccgccgaccggacgatggcgtgcaccgagtgccgctgcgacgtgtacaacgtgacggcggactggcgcgggcacgccatcgagcccgggtacgccggcggcctgcgctgctgcta

SEQ ID NO: 915 - DNA, 391 bp, Zea mays
  Clone ID: LIB143-057-Q1-E1-A6
aacttactgttgtaatttctttttcttccaaatttctttgattttcttcttatttgtatttatacgtcagcctgttttatgattgtaggtcgtgtcaggcatatgttaacaatttgagaccagcaaaattctgcctgctatgtcatgtcacatgtatttgtgttcttctataggcaatatatgagagctaagatccatagagcgacagccatggtatatcctcgtctgtctttggtaaacgtttatatgataatcaattatccagttagatgagagctaagatccatatagcgacagccatggtatatcctcttctgtctttggtaaacatttgtatcataatcagttgtccagttagatgggagttaagatccatagagtgacagcctct

SEQ ID NO: 916 - DNA, 400 bp, Zea mays
  Clone ID: LIB143-057-Q1-E1-A7
accattttgaagccccatgatggtcaagctgtttactcagttgcttttcttacagcacctgaacgatcaaatcatataaatcaaagtacatcgggtcttctgaatcgagaagttaaaatttgggcttctactaatgaggatggctggttgttgccaagtgattctgagacttggaagtgtactcagacgttggaacttgttagttctctggaacctagagtcgaacaggcatttttcaaccatgttgcggtgctgccccaagcgagcctgattttgcttgcaattgctaaaacgaacgctatttatgccgtgcatgttgagtagggcccaaatcgtgcttcaactcgcttagactacatagcagatttcacattttgaatggccaaaattaagccttaaa

SEQ ID NO: 917 - DNA, 159 bp, Zea mays
  Clone ID: LIB143-057-Q1-E1-A8
aaaataagtcgtactaatcatcgtcatgctgtgtacttaggtggtcttcttagatgagcaagaagaatgaacgcagagctatcagaagtacgtcgtgtcaactgaagctaaacatgttgatatgagcatctgttatcgtagaatgacatgtggcaagaa

SEQ ID NO: 918 - DNA, 412 bp, Zea mays
  unsure at all n locations
  Clone ID: LIB143-057-Q1-E1-B1
tacaatcctctacagtaagtcatactacgcggcgatggggatcggtgagcacttcgagggcgtcaagcagcactgggcgagcaacttcgccttcctcaactacttcaagaaggtctacagccgcgccgagcccctcccaaagtggtccgaccccgacgtcgacgagttcatcgcatccgacccggtctacgggccccagctcaaggccctgcgggagtcgaggaagttcgcgctcgccggggccctcgtcggcgccgcccacctcggcggcgtcncgctcaagtactccaaggcgccgcacggcgtcctgctggcgaccggcttcggcgcgatcaccggcgccgtgctgggatccgaggtggcggaccactggtaccagctctacgagatggacaagcanggggccaacctc

SEQ ID NO: 919 - DNA, 319 bp, Zea mays
  Clone ID: LIB143-057-Q1-E1-B10
taagttggacggcttccccttccccgcctaacaattcctcccccggttaagggttcctaaggttttgttgaagggccaatgccgatggcgatgttgaataacgttgcctccgccggggggcttcctggggcaacaacaaccaattcccgggaaaatgcctccgcgccatacggcgagatcctcgactccaatgtcatcaacgaccgtgatacagtgacgtctcgcagcttcagcatcgttaccttcgcctctcacaactccatgctcgacgctatctagaacatgaacagcacggagctcgacggccgtaacatcaccg

SEQ ID NO: 920 - DNA, 325 bp, Zea mays
  Clone ID: LIB143-057-Q1-E1-B11
cgcacgcgtctacacacattcatattaggcacaccagcacagatgaagaagataaaaggcactgagctgagatggcgaagcacttggctgccatgtgcacgtgcagcctcctagttctggtactgctctgcttgggctcccagctggcccaatcgcatgtcctcttccacgggttcaactgggagtcgtggcagaagcaaggtgggtggtacaactacctcctgcggcgggtggacgacatctccgcgacggtggccactcacatctggctctcgccgacgtcgcactcggtggcgccgcaagggtacatgcccggccggctcta

SEQ ID NO: 921 - DNA, 321 bp, Zea mays
  Clone ID: LIB143-057-Q1-E1-B12
caccagcacagcagaagaagaataaacaggcactgagctgtgatggcgaagcactttgctgccatgtgcacgtgcatcctcctagttctggtactgctctgcttgggctcccagctggcccaatcccatgtcctcttccaggggttcaactgggagtcgtgggacaaccaaagtgtgtggtacaactacctcctggggcgggtggacgacatctccgcgacgggggccatgcacgtctggctcccgccgccgtcccactcggtggcgccacatgtgtacatgcgcggccggctctacgacctggacacgtccatgtacggc

SEQ ID NO: 922 - DNA, 344 bp, Zea mays
  Clone ID: LIB143-056-Q1-E1-E7
atccagagacaaccgctgcgtaaacgaatccatcgccatggcgtctcgtctcgttgcggcggcggcctcctcctcctccctctcctcagcgtcccccctcgctcgcctaatctctcgccgcggccttgccggtgccgcagacggccatgggtctgcgaaggtgcccttgtggaaagatccgttgagcccgagcaagtggaaggaagagcactttgttctagcaagcctctcaatgtggggggttattttttatggtggttacaagctttttagtggaaagaaggaagccaagactgaagcggcatcaccacaggcataggtggccgagatggagttatacccgt

SEQ ID NO: 923 - DNA, 389 bp, Zea mays
  Clone ID: LIB143-056-Q1-E1-E9
acgttgtgctctctctcttcattcgttcccggcctcaccccgagccagtcgtctcgctagggtttcgccgccgccgccatgcctcgccgcagctcaggaaggtctgccccacgcccagctccccgtgctgcttcactgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgactctgtattaggtccccggaccatccagcatgagactcttgccacagaagctcctgctgctgcccctgctgctccagcgatgaatgctgatgcttgcagcttcca

SEQ ID NO: 924 - DNA, 59 bp, Zea mays
  Clone ID: LIB143-056-Q1-E1-F11
acaatactcaatattgagtcgtattatccagattgcatatgttaataatttcagttgtt

SEQ ID NO: 925 - DNA, 404 bp, Zea mays
  Clone ID: LIB143-056-Q1-E1-F2
tacacctacctctctacgaactacctgccgccggaaaaccctagagcgctcgaccatggatccgcagcagccggagcctgtcagttacctctgcggagattgcggagctgagaacaccctgaagcccggagatgtcatccagtgccgtgaatgtggctaccgcatcctctacaagaagcggacccgccggattgtccaatatgaagcgcgctgaagagtgaagacaagggaaaacactgaagatggttgatctattactcgccacattacctatgtaaacagtcttctgggggaaatgaagatgtcagacttaacgtttgtatgtcgtgtgcctcctttgaacctgagctgtataatttgtaacgcttgaactggggactgatttgagaactgagacactgcag

SEQ ID NO: 926 - DNA, 306 bp, Zea mays
  Clone ID: LIB143-056-Q1-E1-F3
acgcgtccgaatcacgttcccgccccgcgcctcgcctcgccttgagatctgtggcgtcgtcggcaccagtccgtccgtccgtccttccgtcgtcggcgccggagaacgagtagagatggaggagacggcggcggtagccgcggcggctgagaaggcgtcgtcgtacaggtactgggtgcgggaggccaccggcgacgccgcgccgctccccgtttcgcgcaagctcgacaccgctgccaacgggaacgggaacccgccgcccgttcgctccgtctggaatcaggctggaacatgggaagaaaagaa

SEQ ID NO: 927 - DNA, 112 bp, Zea mays
  Clone ID: LIB143-056-Q1-E1-F6
gagtcgtattagtctgggtgtcatgtgggtcggctttgttctcgggtttcatgaccaactcactttatgctggaccttctatctatgctttcattcagttcctcgtgggtta

SEQ ID NO: 928 - DNA, 205 bp, Zea mays
  Clone ID: LIB143-056-Q1-E1-F7
acacgcatctgagttgtatcatctaagagagttattacagcgagcagaaataattggtactccaaaaaaaaaaaaaaaaaaaaaaaaaaaaaaaaaaaaaaaaaggaagaaaatctagaggaataaaacttaattaaacgtgaatgcaaacatcatatatcttctatactgtaacgtaacattaaattcactggcggtggtgttt

SEQ ID NO: 929 - DNA, 95 bp, Zea mays
  Clone ID: LIB143-056-Q1-E1-F8
tgagtcgtattagggagttccggcagccaggagagagatctcgaaggattgggatcaggatggaattctcagccagccactgtcaagatagggac

SEQ ID NO: 930 - DNA, 438 bp, Zea mays
  Clone ID: LIB143-056-Q1-E1-G2
cgcgtccgactgaggccccgacaccaagcagccgcactggcgccaccccgagctccgccgggcgctcgcctccaacgaccagaccgacgagctcaggcggatccgcgccagcgtccaggactccgcggtcaaggccaaggagaaggtcaggtcgctgcacgaggccatccagaagctcgacaagtacaagaacattgtcacacgcaagcgccagcgcgccaccgaggcgtcgtcctcgcccgacaagctcggggctgccggtgcctgctcctcgtccacaggcgcgctcaggatgggggcgcagaacaactctgccgtcttgagcaagcgcgtgcgctcctccctcgctgatgcccggtggaaggacgtggtagtgttcctacaaggcaaggcccctttggttagtaatgagaaaaattcacctgtggagaaggaaaa

SEQ ID NO: 931 - DNA, 226 bp, Zea mays
  Clone ID: LIB143-056-Q1-E1-G4
cgtattaagtagtagatggctaacggaaccctttgttttttttttttaacaatatcaacggtcatttttttcaagcagagatataaatcgtttctcttgcgagagtatttaccatgcataagcaacgctttagtgagtcttgcttattcaatataggttctacaaaagtggatttggataaggaactagtgcaatgtcgagaaactagactaagggcgtgtttgga

SEQ ID NO: 932 - DNA, 442 bp, Zea mays
  Clone ID: LIB143-056-Q1-E1-G5
cgccggtcgacacacgcatccaaacgcatgtcgctgccccgcgccgagcgcgcgcgggcgccgtacgtcgacttcctcaagcccatcatcgccgacggcgacacgggcttcggcggcgccacggccaccgtcaagctctgcaagctcttcgtggagcgcggggcggccggggtccacctcgaggaccagtcctccgtcaccaagaagtgcggccacatggcgggcaaggtgctcgtcgccgtctccgagcacgtgaaccgcctcgtcgccgcgcggctccagttcgacgttcatgggcgtcgagaccgtcctcgtcgcgcgcaccgacgccgtcgccgccacgctcatccagaccaacgtcgacgcgcgcgaccaccagttcatagtcggcgccaccaacccgggcctcaggggccagagcctcgcggcgcggctcaagacc

SEQ ID NO: 933 - DNA, 273 bp, Zea mays
  Clone ID: LIB143-056-Q1-E1-G6
acacacgcatccaaacacacgtccggttctagatcgcaaccggcgccctttctttttttttattacgaatatcaaaggtcatttttttcaagcatagatataaatcgcgttcacgtgacattgtatttagcacgcataatcaacgcttgaataactcctgcaaattcaacacaggttcaactaaacttgccttggctatggaaccacagcaatgtcaagaaactacactaagtggcctatttggattactggcgcaaacaacacgccgctcca

SEQ ID NO: 934 - DNA, 270 bp, Zea mays
  Clone ID: LIB143-056-Q1-E1-G7
tgagtcgtattacccgcgccgagcgcgcgcgggcgccgtacgtcgacttcctcaagcccatcatcgccgacggcgacacgggcttcggcggcaccacggccaccgtcaagctctgcaagctcttcgtggagcgcgggggggccggggtccacctcgaggacgagtcctccgtcagcaggaactgcggccacatgtcggtcaacgtgcgcgtcgccgtctccaagcacgtgaaccgcctcgtcgccgcgcggctccagttcgacgtcatgg

SEQ ID NO: 935 - DNA, 415 bp, Zea mays
  Clone ID: LIB143-056-Q1-E1-G8
ggtcgacgcacgcgatccaggccattcctctcgccttactccctcacagaacccagtaaaatattgccagtcccgccgtcgagatggccccacgccgcctgctcgtcctcgccgtcgtcgccctcgcggccaccgccgccgcggccaactccggcttcgcggactcgaacccgatccgccccgtcaccgaccgcgcggcctccgcgctcgagtccacggtcttcgccgcgctcggccgcacccgcgacgcgctccgcttcgcacgcttcgctgtgaggtacggcaagagctacgagagcgcggcggaggtccacaagcggttcaggatcttctccgagagtctccagctcgtccgctccaccaatcggaaaggcctctcctaccgcctcggcatcaaccgcttcgcggacatgag

SEQ ID NO: 936 - DNA, 371 bp, Zea mays
  Clone ID: LIB143-056-Q1-E1-G9
agccaaccgcatcgtcaagggtccctggatcgtccgcgccaccgtcggcaactacgcggcctgcctgctcggccgcgcgctcacgtgccgctaccacaagggcgacgactacctcgagatcgacgtcgacatcggcagctcagcgatcgccagcgccatcctgcatctcgcgctcggcgccgtcacgtcggtgaccatcgacatggggttcctcgtcgagtcccagtccgaggaggagctgcccgagaggctattcggcgccgtgcgcatcgcgcagatggagatgagcgcggccaagtacgtggagctgccccctgatgaggccatgcctgagacggccggcagggccggggccgggttcagggtaagct

SEQ ID NO: 937 - DNA, 424 bp, Zea mays
  Clone ID: LIB143-056-Q1-E1-C4
aacaccctaaactaagtcgtattaacacgaggaatgatgttggcgcttggaggcaggctctacggaatgctcagagccagttgcagcatcaaattataaggatagagaatctcgagcttatgctgaaatatggcgtacatgtttggaagctccagaacagacaaatggaatcagttctgtctaggatgcaaaagatggctgtagaatacaatgaaaggatagaaaatgtcaatcgcgagaggaagttccacgagcaaaatactggaggacagctgcatgccctgaaaatggaatggcaggagctgtgtcaaaagaaatatagctattcaggctgcttgtgttgacctgcaaaatcatattgaccagcttaaacgttaagcagaagaactgggaatgcccatggacgacaactcaggaacccgac

SEQ ID NO: 938 - DNA, 445 bp, Zea mays
  Clone ID: LIB143-056-Q1-E1-C6
cgccggtcgacacacgcgaccagtggaaatcctactcgtccccttccgcagccggtactcaaccccaaccctatcctgtccgccgccgtcgcccggcgcctcctcccccacctagaaacccagaggctctaatcctagttctttctgtgcagtcgccgcccaattcccccacccaattcccactctccgctcgacagatccatacatgatgggagaggccaaggagaacgacgtttatgaggaggagctcctggactacgaggaggacgacgacaagacggtcgatggctccgctgctaagcccaccggagaggtcgcaaagaacggctacgtcgggatccacagttccggtttcagagacttcctgctcaagccagagctgctccgtgctactcaggattgtggttttgagcatccttcgaggtgcaacacgagtgtatccctc

SEQ ID NO: 939 - DNA, 405 bp, Zea mays
  Clone ID: LIB143-056-Q1-E1-C7
cacctctagcccgacaggtgaagccgccgccgctgcagtgtccatagccaccgcaggagactgagatggggggttttgtcaagacccacaagagcaatgcatacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatatctgctagtatagcaggtgatatggttcttgcttctgcttactcgcatgagttgccacgatatggtctcgaagttggtctgaccaactatgcagctgcctactgcactggccttctgttggctcgccgtgtgctcaagaccc

SEQ ID NO: 940 - DNA, 323 bp, Zea mays
  Clone ID: LIB143-056-Q1-E1-C9
ctcaaaagtgagtcgtgttacagcacaagcaagaaccacacctcctcccttcgcctgtgatcatgtcgtcttgctgcggcggcaagtgcgggtgcggctccagctgcgcctgcggcagcggatgcaacggctgcggtaggtaccctgacctggagaccgccgccacgagcagcgtcaagaccacggtcctcgccgcgccgaccatcaatgcgagcgccggccgcttcgaggcggtcaccgagggcggtggctgcgactgcaacacctgcaagtgctgcaccagctgcgggtgctcctgctgcattctgcaaatgagctggccc

SEQ ID NO: 941 - DNA, 407 bp, Zea mays
  Clone ID: LIB143-056-Q1-E1-D10
gggccgacccacaagtctatatggagcccgcttagggtgcgagaggtcgcgagttcgtttctcgcaacaccccccaccccagtccccagacaagtcgctcgcgcgccagaagttcgtcgatgactgcgaggccgccctcaacgagcagatcaacgtggagtacaacgcctcgtatgcataccactccctcttcgcctatttcgaccgcgacaacgtggctctcaaaggatttgccaagttcttcaaggaatccagcgacgaggagagggagcacgctgaaaagctcatggagtaccagaacaaacgtggaggcagggtgaggctccaatcgattgtgacgcctttaaccgagtttgaccacgctgagaaaggagatgctctgtacgctagggagctggctctggccc

SEQ ID NO: 942 - DNA, 380 bp, Zea mays
  Clone ID: LIB143-056-Q1-E1-D11
gtgagtcgtagtagttatgaaggctagtgtcatgcttgagagaaagaaagaatatgcaactatcttggcctttgatgtcaaagtgatgcctgatgcccgcgatctcgcagaagagtccggtgtgaggatctttgtggcagatataatataccatctgtttgatcaatttacagcatacattaagaacctcaaggaagagaagaagaaagaaagcgctgaagaagctgtgttcccttgtgttcttaagattatgccaaactgtgtcttcaacaggaaggacccaatcgttttgggtgttgatgtccttgaaggaatagccaaggtgggaactcctctctgcatacccagtaaagaatttagtgatattgggaagattgcct

SEQ ID NO: 943 - DNA, 384 bp, Zea mays
  Clone ID: LIB143-056-Q1-E1-D4
gtccgaccgaatccaaccgcgaatcgcccgccgtgccttcacccgccgctcctccatctcctcctcctcgtcgtcgctgccgccgcgctgcggggggcgccgttggcggacgccggcgcggacacctgcaaggcgtggttggtgcagtccatccccacggacatgccgcacctgagccgcatccccggggtcctatccacgggagatgtgctccagtggctctcggggaatgcaacgaagagtctggacatccttgcgcagtactggcagttcttgccccagccgaacaatccgaaatcgggggactacgggttctccaagagtgacatgaggagattcggggccgacgaaggccgccgggtttacaaggcactggaaaatgct

SEQ ID NO: 944 - DNA, 417 bp, Zea mays
  Clone ID: LIB143-056-Q1-E1-D5
atccaggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcagcggcggctatggtggccggcgccgtgacggccgttatggc

SEQ ID NO: 945 - DNA, 325 bp, Zea mays
  Clone ID: LIB143-056-Q1-E1-D6
atggcggctggtcccaagctcggggcgggcgcgacgcgcgagcaccgcaccgatgccgatgctcctcccaccccctcccctcctcctcatcacccaactactacctcccatcccatccgcgccctccttcggtcctctcccatccgctccgctcgcagcccctccccttgcccccgcgatgtcgtcgtcgtcaccgccgccgcgggccgacgacgacgacggtgcgcaggaggtgggcgccggcgatgggaggtcgctgggctacggcgaggcggactactgggacgcgcggtacgtggaggacggcggcgcaccgtacgaaggg

SEQ ID NO: 946 - DNA, 400 bp, Zea mays
  Clone ID: LIB143-056-Q1-E1-D8
atccgaaaataaataggttgattatgttgcatgggtttgcgatcaggatgcttatgcttgtagcggtcagaaatgctctgctcagtctgttctattcatgcacaaggtaaagactgtcaaatgtgtgttactttgctaattatctaggattgttattgtggactgttcatcgctgatgaagcatataatgttcctggttggttgatctatgacttgtgatcggtcctttggtgttttattttctagtaagttggtcaatctcctagggttgttacctctctaatcatattgatctaaaagttttggatcattatatatctgctcaagaggattagaaaagaaaagaaaaaggcatcgatcgctggtactgggagcgggtgacagttattgtgaatgcatg

SEQ ID NO: 947 - DNA, 397 bp, Zea mays
  Clone ID: LIB143-056-Q1-E1-D9
agcaacagccaagtgcaagtgatcgagctcccccctcctcatcagtcgctaggcacagcgcacttgcaggatggcgcaggtctctaagacgcttctccttgtggccctggtgttcgtgtcgtcggcggcggtggagctgtgccgcgcgatcgacttcgacgagcgggacctggcgtcggacgaggcgctgtgggacctgtacgagcggtggcagacgcaccaccgggtgcaccggcaccacggcgagaagggccggcggttcgggacgttcaaggagaacgtgcgcttcatccacgcgcacaacaagcgcggcgaccggccctaccgcctccgcctgaaccggttcggcgacatggggcgggaggagttccggtccacgttcgccgactcccgcatc

SEQ ID NO: 948 - DNA, 371 bp, Zea mays
  Clone ID: LIB143-056-Q1-E1-E10
aaacaatcaaccagcaacactcttctcgtataacataatacagcgaaggtaactcacatggcaacttccatgggttgtctcgtcttgctctgccttgtttcgtctctccttcccagtgccgtccttggccacccatggggtggcttgttcccacagttctatgaccattcgtgccccaaggcgaaggagattgtgcagtccattgtggcacaggctgtggccaaggagaccaggatggcggcatctttggtcagactgcatttccatgactgctttgtcaagggctgcgatgcttcggtgctgttggacaacagcagcagcatagttagtgagaaagggtccaacccgaacaggaactccctcacggggtt

SEQ ID NO: 949 - DNA, 432 bp, Zea mays
  Clone ID: LIB143-056-Q1-E1-C3
acgcgtccgggaaaaatggaacgagctggttttcttgaggcctggaaatctttgcctgatgacaatgaatttacaaaagaattcccgggctctgtcatcagcagcatagatgctactgttgagcgctttgcagcttcaaatgtgttctttatagccaagcggaaaaatgccaacatggatgttctgtatctctccgcgaagatgccccgtggaaatcccttccttatagagggtacagccgtggttggtgttcctggccttaaaatgtgcaatcaaaacaccaaatacggagatggttcatctcttccttgaagccatggaggctcccaccaagtgacgacaaacttaatggatctggatcggtggttctaaaaaaaaacattcagtccactagctgctataagtgtttggacatggcacttttatttttca

SEQ ID NO: 950 - DNA, 409 bp, Zea mays
  Clone ID: LIB143-056-Q1-E1-A3
ctactatgcttttctttgttaccgtcggcgtcgggaactccgcttccgcacaaatattgcgtttgctgtcagcttgctcaacggttctgtttgtttggtgagatgtgttttcctctttctccttcgttgtgagtttccatttggtggacatccttttccagatcccttcgtggattagatccacgctcctctagtcgagatcgtcttgcatttttctgagatggagattgggaccgaaaaggcaagtatttttctttggtagttttggcatgtgcagacaaatgaggaagtgcttctacagttgtacctcatttaactctattttggagattgagactgaaaaggcaagtatttctttttggtaaagtctttcgcaagtggacatctgattccaatttttttaaaggga

SEQ ID NO: 951 - DNA, 335 bp, Zea mays
  Clone ID: LIB143-056-Q1-E1-A4
ataacgtggagaccgccgccgccagcagcatcaagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactgagccggtcaggcgatggcgcacgagagtcgagaggacgacgacgagtcgtataaatataatagcggcgtctaaataagatcctgtcaactgcacccgccattatcgaatcatggtccctcctggggttcatgttcatctgtaacgtgctcgcggtcatgtccgtct

SEQ ID NO: 952 - DNA, 189 bp, Zea mays
  Clone ID: LIB143-056-Q1-E1-A5
gtgggccggcgccgggcgccgcgcagcagaacaggcgctggcgcgcgaacggatctcgtgttttccgacgccatcgcgcgagcaggccgtcgcgagcacgtcgggcttcttcgactggatgttcgtgggagagcgcgtctaccgcgcgctcgcggatgcctatccgttgctgaccgatgcgcgatatgc

SEQ ID NO: 953 - DNA, 400 bp, Zea mays
  Clone ID: LIB143-056-Q1-E1-A6
ggctcctatctggtataggacggagctgagcttctagcaacgtacagtgtatccgccatgagtcctttcggggcggtgatcacgccagaaaccctcaagtacatgtccaagtaccagggacgtgagatcacgcaggtggactgcgcacgggaggcgatgaggctgatccacgcggaagacaagaacctcaaggccgaggactcagcgtgggagctgaagaagaagttcggcaacggcgtgagcaccatggtcctcgtctacaacgccaccggggccagcctgagcctggtggacgacgggaaagactggatgggctccgtctacagctcgccgatcccggacaccttccacaacgggcagtggatcgccttcctccacgtcaagcccggctcgctggcgc

SEQ ID NO: 954 - DNA, 428 bp, Zea mays
  Clone ID: LIB143-056-Q1-E1-B2
ttccaactccctgatgtgagtcgtattacaagccgtctcgcgcagccacagcctccatttctcctccgacggcggtgcggctagctcaaccatggcggactccaaggccacctcggcggtcaccctccgcactcgcaagttcatgaccaaccgcctgctggcccgcaaacaatttgtgcttgaggttatccaccccggccgcgccaacgtctccaacgcggagttgaaggagaggcttgccaagatgtacgaggtgaaggaccccaacaccatcttcgtcttcaagttccgcacccacttcggtggaggcaagtccactggcttcggcctcatctacgataacctctagtctgccaagaagttcgagcccaaataccgcctcatcaggaatggtcttgctactaaagttgagaaatcccgcaagcaaa

SEQ ID NO: 955 - DNA, 355 bp, Zea mays
  Clone ID: LIB143-056-Q1-E1-B4
gcaaatcgcttcacaagcacagtgatcggtaaccaaatccggacagtcttgagctctctcagtctcagcatttcagttcccagattcacagagccccagccccacaagtagcgaaatggcagctgctccgttcgcgattgccggccggctctcccccgttgcgcgcctcccggtccgcgcctggaggccggcgcacgggtttgcgtcgtccgggagagcccgctcgctcgccgtggcatccgcggcgcaggagaacagggacaacagtgtcgacgtacaggttagccagaacggcggcaacaggcagcagggcaacgccgtgcagcgccgcgcgcgccgcgcgacagcgctcgac

SEQ ID NO: 956 - DNA, 406 bp, Zea mays
  Clone ID: LIB143-056-Q1-E1-B6
gcttcctccgcgaggagggcagcaagctgctgcagtacgtgtactggtccaacggccgtgagaccgagaaccccagcgtcgacaacaagcagtgccccgggaagaacttcgtggtgctggtcggcaggctcctcctcgtcgagctcttcctccgctacgacacattcaccgccgaggtcggcaaggagctgctcggcaccagcgtcatcttcaccggtgtcacgaaagctacctccggtccgggcagcgagtaaaccgcccggccggcgcgcgtcgttggatatatgatgagtggacgtgacagagtgtcgcattatttcttaatttcgtcattttcctccttccttctaataagacttctctctcacgctcggccaccaccttcacgtgtgattggaggtgtttg

SEQ ID NO: 957 - DNA, 382 bp, Zea mays
  Clone ID: LIB143-056-Q1-E1-B7
acggacgcgtggggcgcaccatggaggcggcggcggagaataaggaggccgagcaggaggagcagcagctaccgcacgcgcagaaggataacgcgcccgccgccgccgaggaagacgaagcggattcggaggagaccgagcgccgcaaccgcgacctcaagtccggccttcacccccttaggcacaaactcgtgctctggtacactcgccggacgcctggagcgaggtcgcagtcgtacgaggacaacatcaagaagatcatcgatttcagcacagtccaatcgttctgggtttgctactgccaccttgcgcgcccttcttccctgccgagccccagtgaccttcatctcttcagtgatggcatccgtcgcctctgggaaga

SEQ ID NO: 958 - DNA, 394 bp, Zea mays
  Clone ID: LIB143-056-Q1-E1-B9
cccacacgtcaaaaagcagcaatgcaacagcacaagcaagaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgaggcggccaccgagggcggcggctgcgactgcaacacctgcaagtgcggcaccagctgccgctgctcctgctgcagctgcaactgagctgggccggcccggcgatggcgcacgagagtcgagaggaggaggacgacgacgaggcgtataaatataatag

SEQ ID NO: 959 - DNA, 362 bp, Zea mays
  Clone ID: LIB143-056-Q1-E1-C1
aagcctctaaactaagtcgcaggatctcggcctctcctcggtctctcctcccagatcgggccatccaggtgctaccgctcttcgccccctccacttcaccgccgccgcgtagatccgtctccgcctcctggaagcgctaccagtggaccaacgccgagccggcggacttagcggcgttagggttgcggttgggaattgattgcgggggacgcagcggtggcgcctggcatggcgggggcgcccggggtccggccgggtgcggggggtgggggccgcgccgctgcggggctcaagacttacttcaagaggccccaagggaggtacaagctgcagtaccagaaggcgcactccgcggtgctgca

SEQ ID NO: 960 - DNA, 411 bp, Zea mays
  Clone ID: LIB143-056-Q1-E1-C10
acacgactctacacacacgtcctactaacgcgtggggttggaccacatacgattgttgattgttgatggtaaagaagttgtgaactttgcatcagcatgaggtctggagtctagacacagcattgcaaactgaggtttaatcatcttagcaactacggtacgtgaccctgagcgcgtgattgttgcgaaacaacgaccacctcggtctacaccttaaaggtttgcgcgacatggcttttcatagtgctcaattggatctatcccctgagcataggagaaaagtatcaatctgtacagtggattcaagtattctataaagcatgtatcctccaatttcccacaagcgagaatggcatgatatgatggatgaaatggctgttgcggtcaattgtctttcaaggatcaattgtc

SEQ ID NO: 961 - DNA, 343 bp, Zea mays
  Clone ID: LIB143-056-Q1-E1-A11
cttagcaagtcctcctcgggttagggttccttagggttttgtggaggggcgatggcggcggctgatgtggagtaccgttgcttcgtcggcggacttgcctgcgccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggcggcggcggccgccgcggccgtggct

SEQ ID NO: 962 - DNA, 210 bp, Zea mays
  Clone ID: LIB143-056-Q1-E1-C2
acagccgcttcatgcacgagaagtttgcgacgagtgactctcctgaagctccgctcgttgtcgctaggccaatgaaagtcagctccttcagtatagcaaatcgacgctgactccgaagctcttttccccaattgtgcagaaataatctgagaagttgtagggttttggtcaatttgttcccttttccgcttttagaaggtttgggtagtt

SEQ ID NO: 963 - DNA, 379 bp, Zea mays
  Clone ID: LIB143-055-Q1-E1-G10
ggtcgacgcacgcctctacagcgatgtgccatcaactgacctgtgacctccgcatttccaaacagcccgagcgagctagagctagcagagcggcaggcacctccctcctcaaggaacatggcccgcacgcagcagttggcagtagtggcgaccgccgtggtggccttggtgctgctggcggcggcggcgacctcggaggcggccatcagctgcgggcaggtggcgtcggccatcgcgccctgcatctcctacgcgcgcggccagggctcggggccctccgccggctgctgcagcggcgtcaggagcctcaacaacgccgcccgcaccaccgccgaccgccgcgccgcctgcaactgcctcaagaacgccgccgccggcg

SEQ ID NO: 964 - DNA, 382 bp, Zea mays
  Clone ID: LIB143-055-Q1-E1-G11
tgcaagcctctacactgagtcgtattaaacaaagaggaagccgcggtagcactggtagcggcagcagtcagggggagatgtcgtcggcgttcagcggcgatgagacggcccctttcttcggcttccttggcgcctccgctgcgctcgtcgtcgcatgcatgggggcggcgtacgggacagccaacagtggcgtcggcatcgcgtccatgggtgtcatgcgcgcagagctcgtcatgaactccatcgtgcgcgtggtcatggctggtgtgctccgtatctacggcctcatcatcggcgtcatcatcagcactgggatcaaacccaaggccaagccatagtatgtctttgacggatatgcccagctgtcgtccggccttgcctg

SEQ ID NO: 965 - DNA, 436 bp, Zea mays
  Clone ID: LIB143-055-Q1-E1-G2
caagactctagactgagtcgtactacctcctcttcctcctcctagcacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcgaggcggccaccgagggcggcggctgcgactgcaacacctgcaactgcggcaccagctgcggctgctcctgctgcagctgcaactgagccggcccgcccggcccggcgatggcgcacgagagtcgataggacgacgacgaccaggcgtataaatataatagcagcgtctaaataagatcctgtcaactgcacccgccatta

SEQ ID NO: 966 - DNA, 355 bp, Zea mays
  Clone ID: LIB143-055-Q1-E1-G5
ctctaaaatgggacatagaaagagagaagagagagagaagagagagagagagagaggagtgggagacccgcgagaggctgccgtgtagggaccgtacactcagcgactgcgaaggagggataaggggatggccgggatcggaccgatcaggcaggactgggagccggtcgttgtgcggaagaaggcacccaccgccgccgccaagaaggatgagaaggccgtcaacgccgcgcgccgcgccggtgcggagacgataccatgaagaagtacaacgctggtacgaacaaggcggcatccagcggtacatccctcaacaccaagcgcctcgacgacgacaccgaaaacctcccccatg

SEQ ID NO: 967 - DNA, 426 bp, Zea mays
  unsure at all n locations
  Clone ID: LIB143-055-Q1-E1-G6
taccccgttgcaagtaaagtctctctgctaagcgaagcgaagcttcaagctagtctcggcggctctagaagacgatgggcaaggacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgacgcggcgtgcggcggcgtgggcgtgctgggcatcgcctgngccttcggcggcatgatcttcgtcctcgtccactgcaccgccggcatctcggggggccacatcaaccccgccgtcaccttcg

SEQ ID NO: 968 - DNA, 431 bp, Zea mays
  Clone ID: LIB143-055-Q1-E1-G7
gggtcgatacacgagtctaaagcctttcgtccgacgaatttgagcaactgcacccagagcgcgatccattgccggggaagaagcaacttgttgcgagcctcctctatggcgagctccgaccatggttccaccaccgcccccaaggacgtgccgggcagctacggcctgccgctggtgggcgccgtgcgcgaccgcctcgacttctactacttccaggggcatgacaagtacttcgagtcccgcgtggagcgctacggctccaccgtggtgcgcatgaacgtgccgccgggccccttcatggcgcgcgacccgcgggtggtggcggtcctggacgccaatagcttccccgtgctcttccacatggaccaagtggataaaaaggacctgttcacgggcacctacatgccgttcacgtccctcacggggggcta

SEQ ID NO: 969 - DNA, 410 bp, Zea mays
  Clone ID: LIB143-055-Q1-E1-G8
tacaagactctagaatgatgtcatcattattctccgcctcaggggtggtatgcagatctttgtgaagaccctgactggaaaaaccataaccctggaggttgagagctcggacaccatcgacaatgtgaaggcgaagatccaggacaaggagggcatccccccggaccagcagcgtctgatcttcgccggcaaacagctggaggatggccgcaccctagcagactacaacatccaaaaggagagcaccctccaccttgtgctccgtctccgtggtggtcagtaagtcatgggtcgtttaagctgccgatgtgcctgcgtcgtctggtgccctctccatatggaggttgtcgaagtatctgctgttcgtgtcagtgttggtttaataatggacccgttgtgttgtgtgtgcg

SEQ ID NO: 970 - DNA, 139 bp, Zea mays
  unsure at all n locations
  Clone ID: LIB143-055-Q1-E1-G9
tcatatggctgnngcctgngggcnnggtccttntcantgnctactgcnngnntcctgggaaaccatcanaggaatttgcancgtacattaaccagagaggttatgacctacatgctgtggaggcttatggacagtgggg

SEQ ID NO: 971 - DNA, 374 bp, Zea mays
  Clone ID: LIB143-055-Q1-E1-H4
tggcccgcgacgagctgcggcggctcctcgccgccaccctcagccccgacaaggcgtcggtggacgccgctgctgcggggctcgacgcgctctcttcggagccacgcttcggcctcgcaatcctcgccgtcgctgcaggggatggtgaccagcggatgagagtcgctgtagcgacatacttaaaaaattttacccgccgaaatttggaaaggcgtctgtgttcatctgaggtttacaacgagttccgtgaccaacgtgcccatgctttgcttctagtggagcatgcaattcctcaagtgctgattgaacttttccgccaagttgtttaaaaagattttgtcaaggataacttgtggcctgagcttatccctcag

SEQ ID NO: 972 - DNA, 362 bp, Zea mays
  Clone ID: LIB143-055-Q1-E1-H6
agtgccggttaagacacagattaggctggacgagaacaccgccaacaatgaggctgctggggctgcagcggagccggtgtttgttgttggtgaggctgtcaatgacagcttgccagtggttgcttctgagtctgatttcagccgtggtaagtaccttatttacattggtggtggcgagaggtgcaagagcatgaaccatttcatttgggggttcttgtgtgcccttggtgaggcacaattcttgaaccggactcttgtcatggacttgaatgtctgcctcaatgcacggtatacttcgagtggcaaggatgaagaaagagatttcaggctctactttgattttgagcatttgaagcaatctg

SEQ ID NO: 973 - DNA, 132 bp, Zea mays
  Clone ID: LIB143-055-Q1-E1-H9
aagtggtgcgtagagtacatacgacaaagggcatgggttcgaaccgcttctaggagtataaccgtgtagtcaaaagggtaaggactgcagttggactcagttgaagagtccatctttaatgaaagatgcagt

SEQ ID NO: 974 - DNA, 397 bp, Zea mays
  Clone ID: LIB143-056-Q1-E1-A10
aaccaggaccaggtccaggagggcgcgccgcgcagccatggcgaagaaccggaacaagaagaacagggccaagagcggcggcctcgccgccatggacaccactgagggcggccccgccacatccactgccgcggacgtcccacaaccaatggacacgtccgagggaaagcagccatcgtcggccacagcggcgctcggttcgatcaacaagaaaataaagaagggggtgcatatgaaaaggtcacagaatgctaggaaaatgaaagcaattgctacggctgtatcgaagaatgagaagtccgaggagaagatccagaaagcaaaaggcaagaagacaagaatccagtcggccaagtccttgtacgactgaatatttagcactgagcagaattttgtg

SEQ ID NO: 975 - DNA, 449 bp, Zea mays
  unsure at all n locations
  Clone ID: LIB143-055-Q1-E1-G1
actcgtgggtcgttgcaagcctctatagtgacgtcgtattaacgcgtggcggacgcgtggggcctgccctgtcctgccttgttaagcaacacagcgagacatcacgagagctagagagagatggcggccacggtttcctccttcccggtggtgaacatggagaagctggagacagaggagagggccacggccatggaggtcatccgcgacggctgcgagaactggggcttcttcgagctgctgaaccacggcatctcgcacgagctgatggacgaggtggagcggctgaccaaggcgcactacgccaccttccgggaggccaagttccaggagttcgcggcccggacgctggaggccggcgagaagggcgccgacgtcaaggacgtggactgggagagcancttcttcgtccgccacctcccggcctccaacttcgcgacctccccgag

SEQ ID NO: 976 - DNA, 424 bp, Zea mays
  Clone ID: LIB143-055-Q1-E1-E2
acttcatgtggatgtagaattgaagaaatcccaattattcttgaggaagataaaatccagttccgtcatctactgtgtggagattggagaaatagcacatggatcaaagccatcaagttttttggcagcattgtttgcttacttcatggaggatgccactgttcctaaattgtcctcaaaactttcaccatctagaaatcttcttgggactaatgctggcagccatatctcaacacttgatagattgtatttctgggagagcaagctttatgatgaagccaaggccagcagtgccatctgcaggaagtacggtgggaaatgtaagaagctaagacttcatgaatcaagaggggtgaatcaaattgataacgattttacccgtgcggcaagggaaagatgtcagtatcactgcatcctccaagat

SEQ ID NO: 977 - DNA, 423 bp, Zea mays
  Clone ID: LIB143-055-Q1-E1-E4
acatgattctgggtaaaagattctttgtgacaccatcggactctgttgccattatagcggccaatgctgttcaatcaattccttactttgcttctggcctgaagggagttgccaggagcatgccaacatcagctgcccttgatgttgttgcaaagaatttgaatctcaagttctttgaggtgcctactgggtggaaattttttgggaatttgatggatgctggaatgtgctcaatctgtggtgaagaaagctttggcactgggtctgaccacattcgtgagaaagatggcatctgggctgtgcttgcatggctttctattattgctttcaagaataaggacaaccttggaggagataagcttgtcactgttgaagatattgtccgtcagcattgggccacatatggtcgccattattacacac

SEQ ID NO: 978 - DNA, 353 bp, Zea mays
  Clone ID: LIB143-055-Q1-E1-E7
acacagcatcagctcaaaaacctaacacacctcaacaagcagagcaaagacccgggattcgccggcgcggtagcgagagcgagagatggacgggaggatgttcggtctcgagacccccctgatggtggcgctgcagcaccttctggacgtgcccgacggcgacgccggcgcgggcggcgacaaggcgagtggtgccgcggcgggcggcgggcccacgcgcacctacgtccgcgacgcgcgcgccatggcggccaccccggccgacgtcaaggagctcccgggcgcgtacgcgttcgtggtggacatgccggggctgggcacgggcgacatcaaggtgcaggtggaggacgagc

SEQ ID NO: 979 - DNA, 420 bp, Zea mays
  unsure at all n locations
  Clone ID: LIB143-055-Q1-E1-E8
acgaatcttgggatgtaccctgtggaccatttctgtgcaatcattaaccctccacagtctggcattctcgcagtgggtagaggaaacaaggttgttgaacctgttgtggacagcgatggaaccgagaaggctgctgcagttacaaagatgagcctgacactatctgctgaccatcgtgtatttgatgggcaagtaggaggcaagtttttcacggagctggcgctgaatttcagcgacatcaggaggctgctattgtaaatgaaaggaggcaattaccgtgttttgacgtattctttgggagcgaaaaccgctcaggaaaagagaacatttggatgcaacccgtggtctgctgcttgatcngcatcccgtacaacagtaacaattttgtaataaatttataataagaatgcactggcacct

SEQ ID NO: 980 - DNA, 420 bp, Zea mays
  Clone ID: LIB143-055-Q1-E1-E9
gggccgaggcacgcgtccatgataaacgccctccccatcggcgtatggccattgaccacatcgtccgcgccgccctccgccaccgaggaaaccgcaagcagtcatcagcaatgccgccgtacgcaccgagagagcagcggcacgacgggccgccaggggaagtcccgccgatgagcgccaaggacgtgaccgccatcgaagccctcctcggatactgcttcatcgacaaatctcttgtcgagctggcgctgacgcatggctccttctactggcccaaccgccccggggatacctacgagcgcctcgagtacctcggcgacggcgtcctcacctgcctcatgtcgcgcgaggtcttccgcacctaccgcacgctccagcccggcccgctcacaaggctccgcgccgctaacgtcgacactg

SEQ ID NO: 981 - DNA, 399 bp, Zea mays
  Clone ID: LIB143-055-Q1-E1-F1
gcgggccgacccaagcctctacggaaacttgggatatcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgatgagcccgtcgcggccgaaccg

SEQ ID NO: 982 - DNA, 387 bp, Zea mays
  Clone ID: LIB143-055-Q1-E1-F10
cgcgtccacaccaatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacaccttctcgtactatgaccaggtccttgacaccactgccatgctcggcgctgtccccgaacgctactcatggactggaggagagattgggtttgacacctacttctccatggccaggggcaacgccactgtccctgctatggagatgac

SEQ ID NO: 983 - DNA, 390 bp, Zea mays
  Clone ID: LIB143-055-Q1-E1-F11
gcgtccagctagatctagatcgcgatctagaactagtcccgacatcgtcccttcgtccccacgagcaaccgataatccgccggcgttgagatgttggtttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgttaatgtggttgatattgttgacacattccgtctacaagagcaacctccttttgacaagaaatcatttgtgtcttacatcaaaaaatacatcaagaatctcactgctgtg

SEQ ID NO: 984 - DNA, 397 bp, Zea mays
  unsure at all n locations
  Clone ID: LIB143-055-Q1-E1-F12
ctctacagtgattcgtattagacatagctgcatcaacaggcattgtccttgatccagtctacagtgggaaggcggtttatggattgctaaaagacatggctggcaatccagccaaatggaaaggtcgaaaagttctgtttatccacacaggtggtcttcttgggttgtatgataaggctgaccagttgtcatctttggctgggagctggcgcagaatggatcttgaagattctgttccacgcaaagatggcactggtaagatgttctgatcagtatggtccatgtgattccatgatggctcattcttgcaaacattgtatccattacagagttgttactcttacatttgtgcaagaaaatgcaaaatagatggttcacattgtatanagcactgatg

SEQ ID NO: 985 - DNA, 432 bp, Zea mays
  Clone ID: LIB143-055-Q1-E1-F2
cgggtcgagacacgcgtctacactgcgccattcgacagcgacgagcacccaacaggctcagaaacatcgctgacatccacatgcaccacagtagttcagtagagtagctgttggaacccacacaccggcgatggcaactgctcctgtgacatcctccatggctacgaactccacctgtgtgcggctgcctagcatgcccctgaggcgtgcacccgccatcgtctcctttgcctctcgtccatggtcaaccgcaatgacctcatgtactggattgtcgcggcactctgatgtggttgccgccgcggggcaccagaagttgatggggtctttgaacaacaacgagggactcatgtttggggtggttgtggcacggttcaacgaggtcgtgacaaatttgttactacagggtgcccttgaaactttcgagcgata

SEQ ID NO: 986 - DNA, 371 bp, Zea mays
  Clone ID: LIB143-055-Q1-E1-F3
acccttacgaatgaagaggcagccttctcaccgtcgcacccggcgatgcagcggcacgtcgcctccggccggccgtcgggcacggacggctccgacttttcttaccgcatggtcgtcgaatcccggtaccagagggtcgccgagggcagatcccgcctcgcgcgcctcatcctcgtgcaggcgctgcacctagtggccggaggcttgcttctattgctgtcgttgtccaagggggcggcggtgaacaagttcgccgtgctgtccatggccgcgggattcctggctatagtggtgggggaattagggcgaatgcggaccatgtcagtgctgcttcggctctacacaagcttgtcatcaattgcggttgcatt

SEQ ID NO: 987 - DNA, 423 bp, Zea mays
  Clone ID: LIB143-055-Q1-E1-F4
agggaagtcgacgagacagagagagaaggccaagaggcttcctctccccattcctcccttccgtgccctagccgagccagccgcgaggaatgaggcatcccgccgtctcgcctggcgcccgcccgtcggccgaccttctgccgcagcttccaattgtaaaaagatcatagatttttgtgcaagagcgagtggatatggaaccatcccctcagcctatgggtgtcgctgccggtgggtcacaagtgtatcctgcctctgcctatccgcctgcagcaacagtagctcctgcttctgttgtatctgctggtttacagtcagggcagccattcccagccaatcctggtcatatgagtgctcagcaccagattgtctaccaacaagctcaacaattccaccaacagctccagcagcagcaacaacagc

SEQ ID NO: 988 - DNA, 420 bp, Zea mays
  Clone ID: LIB143-055-Q1-E1-F6
aaaaccagcacaaaaaggagcacaaagctctctctccctcccccctctctctctctctctcctgttccccgcgagagtcgctcaaggccgcggcgaggagaagcagcagcgcgtcacctctccaatggcatccccgtccttcctccgtgcaacctgtgcgcttctcgagtgctgaggctccctgtccctaagacaagcttgcgcacgcgatggagggtttttcgagggacttgctgtgcgggattggcaagggggacgcgccgccaccggagaagaggccggggcagctgcgggaggaggtggaggaggtggagcttagcctcgggctgtcgcttggcggccgattcgggctcgacaggaaggggagcaggtcccccggtcgtcctccgtgggggcatgctgacaacgccggtggaggtg

SEQ ID NO: 989 - DNA, 358 bp, Zea mays
  Clone ID: LIB143-055-Q1-E1-F7
agaagcctacagcagccaagaaaagcacatacccgagtcgccgaaacaacaacaatcccaatcccccctcgtcactcaaaactcgaccaacaatgtcgctgattcgccgtggaagcgcattcgaccccttctcccttgacctctgggaccccttccagggctttcccttcggctctggaagcagcagcagcagcagcctgttcccctcgttcggaggcaccaccagctctgagacggccgccttcgccggcgctcgcgtcgactggaaggagacgccggaggcgcacgtgttcaagaccgacgtgccggggctgaagaaggatgaggtgaaggttgagctggaggacgggaacgtgct

SEQ ID NO: 990 - DNA, 396 bp, Zea mays
  Clone ID: LIB143-055-Q1-E1-F8
tacacggactagacgcacaagtcgatcgccatggcgatgaagccggcggcggcggctccccctaccccggccgcggcgcacagcgtgttcgtctacggcagcctgatggcggacgaggtggtccgcaccatcctcaagcgcgtcgcgcccgccgccccggccctcctcccaaactaccaccggttcaacatcaagggccgcatttacccggcgatcctgcccgttgagagcaagagagttgctgggagggttatcatgggtgttactgatgaagagctccagcttcttgacgcgtttgaagacgtggagtacacgaggacaagagttgagatagcactggctgactcttccgagaacatgctggctgacacttacgtgtggagtgatgcagaggat

SEQ ID NO: 991 - DNA, 349 bp, Zea mays
  Clone ID: LIB143-055-Q1-E1-C10
caagcctctacagtaagtcgctatataatccccaatcaacacagcaagtcagcaacaagcaaagcagcgatccgagagatggacgcgaggatgttcgggctggagaaccccctggtggcggcgctgcatcacctgctggacgtgcccgatggcgacgccggagcgggcggcgacaaggcgggcggcggcgccacgcgcacctacgtccgcgacgcgcgcgccatggcggccaccccggccgacgtcaaggagctcgcgggagcgtacgcgttcgtggtggacatgccggggctgagcacgggcgacatcagggtgcaagtggaggacgaacgggttcttgtgatcagcg

SEQ ID NO: 992 - DNA, 398 bp, Zea mays
  Clone ID: LIB143-055-Q1-E1-C11
tagagtgagtcatattaatggcgatggcgactgcgaaatgatgctgcaggaacagatggactcgctggtggccgacgacgtcagcatcggaggagggtcgcctgaagaaggggccatggacgtccgcggaggacgccatcctggtggactacgttaagaagaacggcgagggcaactggaacgcggtgcagaagaacaccgggctgttccgctgcggcaagagctgccgcctccggtgggcgaaccacctcaggcccaacctcaagaagggggccttcacccccgatgaggagcccctcatcatccagctccacgccaagatggggaacaagtgggcgaggatggctggtcacttgccaaggggtactgaccatgagatcaagaactactggaacact

SEQ ID NO: 993 - DNA, 58 bp, Zea mays
  Clone ID: LIB143-055-Q1-E1-C3
gcgtccacgttactctagccgtctcgcgcagccacagcctccatttctcctccgacgg

SEQ ID NO: 994 - DNA, 345 bp, Zea mays
  Clone ID: LIB143-055-Q1-E1-C7
aagccggtagaaggaatcttagtggtcctgtgaaccagactgacagttatgcacaacgaccgcgtgagaccgtatctatgtcattaaaggaaattatgcatagcactgaccggtctggggaaaggaccatggagagaccacgtacatcctcgcgcacaggcagtgcatcccgtagagctgttgcatcaagcagcaggcaggcctcatctgtggaaccaagtgagcagcagtatagccgggcaagcagattgttctctagcaacagtggcagtcgcccatctagcacccagagggtgaacccatcgccaggcgacgcaagggctacctccctctcacgggcggcag

SEQ ID NO: 995 - DNA, 383 bp, Zea mays
  Clone ID: LIB143-055-Q1-E1-C9
gggccgacgcacgcgtccagggcaatcatcagtgatacatgtccgcatgaaacgtcatgcaatgagtgagatgccaaaatcagatgaggatgtttcaaaatggtgtaaagacatttttgtggcaaaggatgccttactggacaagcatttggcaacaggcactttcgatgaggagattagacctattggccgtccagtgaaatcattgatggtgaccctgttctggtcgtgcctcctgctgtttggcgccatcgagttcttcaagtggacacagcttctgtcgacgtggaggggtgtggcgttcactgccgcagggatggcacttgtgacgggggtcatgcatgtcttcatcatgttctcccaggctgagcggtcgagctcag

SEQ ID NO: 996 - DNA, 407 bp, Zea mays
  Clone ID: LIB143-055-Q1-E1-D10
agcggacgtcctttttttttttttttttttttttttttcgcgaacaaatcaacctggacagcaaagattctccgcaacacaaggcgagcagagtttcagcatgcgccgagacaactcaacttggcctcaaagttcgggtatgtttgtacacatcagggctcagagcctagcctgatacacttctcacaaggcaaacagaagcatggcattgcagactgcagtgcccgagattctgtaggtttttcgataggaatctgcctgtaacacaatttgggagggtgtttggctgtagcatccataggacgacgagggagggagggggggccaaccaattggcagccttattatttcgaacagataaaaatcacgccagggcgatggatactcaactcaatcacggaattcat

SEQ ID NO: 997 - DNA, 390 bp, Zea mays
  Clone ID: LIB143-055-Q1-E1-D11
agtcaaaaactcctgaggcacctcctggggcgagggtggctacatccggatgcagcgcggcgccggcaacggcggcctctgcggcatcgccatggaggcgtccttccccatcaagacctcgcccaaccctgcagacccgccgcgcaagccccgccgcgcgctcatcgccagggacacctcttcttcccagtgacacacacgaccacaactggcacgtaagtacacgttgccaggaatgacatgctatgctactagtgtttgcttgaactattatcgattgggtttgtactagtgatgacagtttcatcgattgcgcggtcgatctccatcagagacagagacgatataatcagaatgaagtatagcagcgcgtgtgcgcaacagggtaag

SEQ ID NO: 998 - DNA, 405 bp, Zea mays
  Clone ID: LIB143-055-Q1-E1-D2
acgaaaggtggttttgccacgaaggtaaatgtgattgatgatgatgatctacttgagagagagctagaacaaggtgttgagttggctgttgagtttgagaagattaatcaagataagaagcagaactcgtccgatggtagcatgcatccaccagaccttgaaaacgctgacgaattaatggagaatggccaccatgtcaagcagagtctaccaacgacagctgaagacatgggctgtccgatggacagtaaagaacgacatcctccagcacttcataagcaaaatgatgtttctgagcacaagtcacagcagcttgatgacacattgaaacaccaaaagagctgtgatcatcctcaacctgtaggaagccctgagcaggatggaaaagactacaagaggcctaag

SEQ ID NO: 999 - DNA, 370 bp, Zea mays
  Clone ID: LIB143-055-Q1-E1-D3
acgccactgtctctcggcctggagactgcaggtggcgtcatgacggtgctgatcccgaggaacaccaccatcccgaccaagaaggagcaggtcttctccacgtactccgacaaccagccgggcgtcctgatccaggtgtacgagggtgagcgcgcgaggaccaaggacaacaacctcctcggcaagttcgaactctccggcatccctcctgctccccgcggcgtgccccagatcacggttaccttcgacatcgatgccaacggcatcctcaacgtctctgccgaggacaagaccaccggccagaagaacaagatcacgatcaccaacgacaagggccggcttagcaaggaagagatcgagaagatggtgc

SEQ ID NO: 1000 - DNA, 427 bp, Zea mays
  Clone ID: LIB143-055-Q1-E1-D4
ctactaggacacgtaggacgatccaagcctctagagagagtcattatagcagcagcagctgagagcgtgagagcgtgcgaagcaggagggaggacaagaagaagccgatggcggttgtgagcggcagcggcgggaggctgaacccctgggcggagcccttcgtgccttccggggcgcggtaccgcggcctgcggaccgtggaggcgacgccggagcaggaggtggaggacttctcccccgagtggtggcgcctggtgtccgcctccccggccttccgcgaccgctggctgcgcgagtacggcgcgctcggcctactcgacgccgaggaccacctggacgacgacgtcgacagcttcctccccgacgacttcttctcgcctccggccccgcgctacgagagcgagcgggaggacgccgcgggcaggag

SEQ ID NO: 1001 - DNA, 370 bp, Zea mays
  Clone ID: LIB143-055-Q1-E1-D5
acatctgacaatctgctcatcgcctacaagccccgccgggggaagttcgcggtgtacgacggcgatgtgacactggcagaagctgagaggttcgtgggatccgttttgaacggagacgttcaactgtcgccgacgaaacaaaagcctgtccttcggtagacgattactgcaagttgcaaaggttttagatctaacacttattatcttaattaaggacctgtacatacatggacgatgagagtacaatcgtagagcgtttgctggacagttttgtcgttcggtaaaccacagttactaactacatctcgccctcaaccgtgccaatgtaaattacgcaaattctgcagtcctgtcgagatatccagtatgc

SEQ ID NO: 1002 - DNA, 349 bp, Zea mays
  Clone ID: LIB143-055-Q1-E1-D7
tactctctctctattcattccccgcctcaccccgagccagccgtctcgctagggtttctccgccgccgccgccgccgccatgcctcgccgcagctcaggaaggtctgccccacgcccagctccccgtgctgctccagtgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgatgctgtattaggtccccggaccattcagcatgagacggttgcctcagaagctgctggtgctgcc

SEQ ID NO: 1003 - DNA, 355 bp, Zea mays
  Clone ID: LIB143-055-Q1-E1-D8
agtccctcaccgcaatggccactgccttgcagggccagccgccgaggttcactgcgtgcatctacacaacaaacccgcaagaacatgtggctgcctgcccagatgatgatcgtcgttgccaccaccagaaacgacctcgagcggtgaccaccgctagccgcaacaccacccttcttctgaattgctgatgccacgatgcgctgccactcgcccgcccggcaagcctgcccggcggcccggcacatcgccgccgcaggacacacagccgccaccacagcaaacacctccaagccgccaccaagccaggccaccgccgtaggcgtgcagcagcccaatatcttagtgccccacaacg

SEQ ID NO: 1004 - DNA, 128 bp, Zea mays
  Clone ID: LIB143-055-Q1-E1-E10
agcgaagcgcacagagggggggaacgaaggatacaccacccagatagagttaccctctgcgaagatgaaggacaagaggctgatacgatcgaacaccatagcaccacgagccgcagacaatgtccaca

SEQ ID NO: 1005 - DNA, 383 bp, Zea mays
  Clone ID: LIB143-055-Q1-E1-E11
gcgtccagaaccactccgcctccacccgcaccacaccaccggcgatgtccacagcggcggcgcagggcggcagcgacaagccggcgctccggaggcccgtcttcaccaacgtcgaccagctcaggccgggcaccaacgggcacaccctcaccgtcaaggtcgtcagcgccacccccgtgcctgggcgcgcgcgcccaggcgcacccgccgccgccccatcccgcgcgccgcgcatcgccgagtgcctcgtcggggacgagaccggcgccatcgtcttcaccgcccgcaacgaccaagttgacttgcctgaacccaatgcgacagtgatcttgcgcaatgccaaaatagacatgttcaaacggataatgaggcttgcagtggac

SEQ ID NO: 1006 - DNA, 307 bp, Zea mays
  Clone ID: LIB143-055-Q1-E1-C1
cgtgggctagcatggatagatgatagcacagttttacaaacatcaaatatcccttgcattgcttgggcaagtgtcatttttaggctctccaagtcagttaatctgcttcgcaggatgaacattcgcagccctacttcaagcctccccatcttgacaaccccatttgcactcttctgctgtctgaaaccacgatggcatttggcaggtcacttgtcactgacagcaacggtaactacaaaggacctctcacactttcactaaagcaagggtaagcgtaacaattgcgttaattaattgatcatactac

SEQ ID NO: 1007 - DNA, 390 bp, Zea mays
  Clone ID: LIB143-054-Q1-E1-H9
accgcatcccgttcgcgagcgcgacacacgctgacagctcacggctgaccttcccgagtcccgacggcctccagctccatcttgattcttgaggcgaagccccggtgcgtaagagtctgccatggccagcgagaataaggtctttgggttcgaggaagtcgccaagcacaacgtcaccaaggactgctggatcatcatcgccggcaaggtgtatgacgtcactccgtttatggatgagcatcctggtggagacgaggttttgctagctgtaactgggaaagatgctacagctgatttcgaagatattggccacagtgattccgcaagggacatgatggagaagtaccacatcgggcagatagatgcttcaacaatcccagcaaagcgtgc

SEQ ID NO: 1008 - DNA, 407 bp, Zea mays
  unsure at all n locations
  Clone ID: LIB143-055-Q1-E1-A10
tgcaactctctacactgagtcgtattacatcgccgctgcctaatccccatggcctcagcgaacaacgacaaccgcgaggcggcgggcatcctgcggctgctgatggggatggcggcggcggcgcccgcctcggcattgcctcgggggggcggcggcggcggcggcggcggcctgatggtggtgcagcacgtcatcctcgacgtcgacggggaattgttctcgggcggggtcggcggcggcggcgtgccgccggcgtcgaaggccgcgatcgccgcgctgaaggaggtgaaggccggggagggcgagggcganggcgaggacgcgctgggcgagtgcgccatctgcctggacgcggtggagggcacccgcaaggagatgccgtgcgggcaccgcttccacgggcgctg

SEQ ID NO: 1009 - DNA, 388 bp, Zea mays
  Clone ID: LIB143-055-Q1-E1-A4
aaccaagcgtccgtctatcctaactaaaccaaaagtatgagagggttttgcaaacccagagccttcccgggaagccttccatccaaagaattgtcaataagcaggcatcagctttcgcaacaccaatcttctaatttaccataggtgttgcgccctgttttacagaagagagcatctgaaggaacttccatggctcatctagacgccacttactgtacacggatttacaattcacgggtggtgaccgatatcttgatgcaacaaaagaatctttaagcgagggcaaactcctcgtcttggaaggaaagatggggctcttcttggtacgggtgaactactttgttgatctcatctgcagtaagcgtttcacgctccagcagcgcatttg

SEQ ID NO: 1010 - DNA, 387 bp, Zea mays
  Clone ID: LIB143-055-Q1-E1-A8
gacacacgaatctacggtcacttgggcgaccccacatctatcgacccgaattctccactcaatggacccacccaagccgccgtcctcggtcgcctcgtcgtcggggccggagacgccgaacccgcacgccttcacctgcgagctcccgcactcgatctacgcgctcgccgtctcccccgtcgcgcccgtcgtcgcctccggcagcttcctcgaggacctccacaaccgcgtctccctgctctccttcgaccccgtccgcccctccgccgcctccttccgcgccctcccggcgctctccttcgaccacccttagccacccaccaagctccagttcaacccccgcgccgccgcggccgtccctcctcgcctcctccgccgacacgctcc

SEQ ID NO: 1011 - DNA, 386 bp, Zea mays
  Clone ID: LIB143-055-Q1-E1-B10
tctagagtgagtcatgataccggcggtgtagggctgtaggcgacccatggctccacagacgaggagagacaggttggcgggggaagcgcggccgagctcgtcggggctaacaccggcgaagccgggggcggtcgaggtgcagcgccgacgggcgggcagcggttggacgagccgtcggatctccatctacgcctcccgagtctacttcctcctcatcatgctccagatcccgctcttcagggtcccttgtagagctggcacatgcacaactcctattcaagtaacatcatctcagttggtctcaaatgatatattcccagcagctgttgtgaaggccatgctctaccctggagctaccgtgagcagcctaactaaagcaagacatt

SEQ ID NO: 1012 - DNA, 410 bp, Zea mays
  Clone ID: LIB143-055-Q1-E1-B11
ctctaaattaagatcatggattggcttgggcagtcacagtatgctacccaaacagtctactggtcatctttatcgtcagcaatctcagaggtagtattctcaaagaacgcgaccgtgaggctactcgtcgcctactgggcgcatctcatcccaaacaccgagaaatacctgaagagcctactgtactccaacgttctctgcgcgtcttcggcgtacaaccactgcagcggcaaggtcgagatcaagtactacgtggttcctgggcacaacgagaccgggcctgcgctgtcccagggcggcgccgcgacggggagccgttaccctggcttcaccagggtgaaccacggcaagtacgccgtcagcgacgtgagggcgaacgtcggcaccagcaacctcatctgggactactt

SEQ ID NO: 1013 - DNA, 306 bp, Zea mays
  Clone ID: LIB143-055-Q1-E1-B2
aagactctagattgagtcgtattagcagcagcagcatgaagctgagcttgcagctgccgctgcgcagcccctccccgatgacgatgatgacctgatcgaatagatatgttatacatggcccttgttgatgactcttgttaaaaatctgtggtggttcaatccttgttagtgttaggcggtacctgaatgttctcttgatgtatccgaagagttgagaaggaagttaatgactcagtatcctgttggcttgttgacttggttttttggtgaacctgtccttgagggaatacagaggtattgtcaggc

SEQ ID NO: 1014 - DNA, 375 bp, Zea mays
  Clone ID: LIB143-055-Q1-E1-B5
cacgactctacactgagtccctataaaaagcatacttcccgaagcactcttgcaatccactgagttctgtttgttgagacgcatagagctagctgctagcgtcgacaatgtcgctcgtgaggcgcagcaacgtgttcgaccccttctcgatggacctctgggaccccttccacaccatgttccgctccatcgtcccgtcggcgacctccaccaactctgagactgccgccttcgccagcgcccgcatcgactggaaggagacgcccgaggcgcatgtgttcaaggccgacctccccggcgtcaagaaggacgaggtcaaggtcgaggtcgaagacggcaacgtgctggtcatcagcggccagcgcagcaaggaga

SEQ ID NO: 1015 - DNA, 415 bp, Zea mays
  Clone ID: LIB143-055-Q1-E1-B7
aggaagctattgttctttttcgttggcatttcaaaatgatgatcaaaagtcagaaggcagcatggaattgctgaattcagtgaaagctatttcgatccatcctctttccaataacaagtttttggtactggattcatctggagtgttgcatgtcttcattttttcaacaacacaaatggtctcaagaggtgccatcaagcaatattctgaaaatatccatacatatcgcttgcattatcccatgaaagtgcaattatctgctgtcttttcagttacctctataaagacacaatttttttgggtttcagatggtggacatactgtacatgttatgtccgcagttgagactgaatcgcctaacggtggatatggagaacttactggagaaagagagttagcgcctatcaagctttca

SEQ ID NO: 1016 - DNA, 391 bp, Zea mays
  Clone ID: LIB143-055-Q1-E1-B9
gcaagcctctacaatgagtctgcttaacccctgccaagatccatctttccggttccgccgcctgatcgaagtgaacaagcaaggaagagccatggcgagcgagcacgcggcggggggcgatgctaagcatcaccagaagcagagcctgatggacaaggcgaaggggttcgtcgcggagaagatcgcgcacatccccaagcccgaggccacgctggacggcgtgacgttcaagggcctgagccgggagtgcatcacgctgcacagcagcgtgaacgtgtccaacccctacgaccaccgcctccccatctgcgaggtgacctacacgctccggtgcgccggcaaggaggtggcgtccggcaccatgccggaccccggctggattgccgccagc

SEQ ID NO: 1017 - DNA, 388 bp, Zea mays
  Clone ID: LIB143-054-Q1-E1-H8
cgtcaaagccgcagcaagtgcccagaaggccagaaccagaaccaagcagctcgttgcaacctcatatcatcccctgccacgcacctccgtccgccgcgccatggaatcgaggaggagggccgtgcccaccgtgaggatcgacgtcggcaccacctactcgtgcgtcggcgtgtggcagcacgaccgggtggagatcatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcacgaggttctctgactcgtcagtgcagagtgacatgaagctatggccgttc

SEQ ID NO: 1018 - DNA, 376 bp, Zea mays
  unsure at all n locations
  Clone ID: LIB143-054-Q1-E1-G12
ccacgcgtccaagccacatctctccactgctccgtccagcgcgtccacctcccaaacccctactcccccaggaagcaatggcttcccccacccagggccaggtcatcacctgcaaagcggcggtggcgtacgagccgaacaagccgctcgtgatcgaggacgtgcaggtggcgccgccgcaggccggcgaggtccgcgtcaagatcctcttcaccgcgctctgccacaccgaccactacacctggagcggcaaggatcctganggtctttttccttgcattcttggccacgaagctgccggaattgtgggaagtgtcggtgaaggagtaactgatgtgcagcctggggatcatgtcattccttgctaccaagcaga

SEQ ID NO: 1019 - DNA, 422 bp, Zea mays
  Clone ID: LIB143-054-Q1-E1-G2
acctaaagcccatacaccagaagcgcaccaactccccaaccaccggagaccgcaccccagcacaggatggcatctgactccacggccgccgtgacggtggacggcagcgcgcttgcggggcgcgcgctggccgcggcgggcacgcggcacatgttcggggtggtgggcatccccgtcacctccctcgcgtcccgtgccgccgcggccggggtccgcttcctcgctttccgcaacgagcagtccgcggggtacgccgccgccgcctacggcttcctcacgggctccccgggcgctctactcaccgtctccggcccaggatgcgtccacgggctcgcgggcctctcccacgccaccgccaacgcctggccgctcctcatgattcccggattctgcgatcaggctgacgccggcaggggcgactt

SEQ ID NO: 1020 - DNA, 397 bp, Zea mays
  Clone ID: LIB143-054-Q1-E1-G4
gcgtccacggacgcgtgggggagagtatccacaagtccaaggctgagaaggccagagagaagacactttctgatcagtttgaggccaagcgtgcaaagagcaaggcaagccgtgagaggaagattgctaggagggaggagaggctggcccagggcccaagagaaccaacagcacctgtcgcagccccagctccatctactggggtgccaaagaaagcaaagaagtgaagtatggaaacaaagctgtagctttttggtactatataagcatgactttggagcacctgaagtattttgctgttatatagttcgtgtctcaatattctgagtcttgtatctctaccgttctgttggataatgcatgccgtaagagttgtttatggagcttttgttgttac

SEQ ID NO: 1021 - DNA, 421 bp, Zea mays
  unsure at all n locations
  Clone ID: LIB143-054-Q1-E1-G6
gacccacgcgtcagaggagggcgctcacgaggccaccggcgctgatctcaagcaaccactagtcctcgccgtagcggttggcgaatacaggcaggcgcgagccaggcacagcggcacgacgacggactaggagcacagctgcacacgggcacgacggctcctggggccaaggcacggtggcggttcgggcgacgatggggccaaggcatggcggaggggcagccggccgggcaaggtgctgcactgagggggtcgccggtgagaccacggacggagggacgcgtgggacgatgcggcatgatgagatgtgagagagaagcccgtgagaataaaaaatataacttcctatattaaaaccgtaggaagttacttaacttcctaaatgttgtacatgtactctagaaagttanggcctgtttgt

SEQ ID NO: 1022 - DNA, 406 bp, Zea mays
  Clone ID: LIB143-054-Q1-E1-G7
ggcttcaagacgcacggcgtgaacgacatcaccgtggtgggcggctatcgcgccgacgcgatcgacacgtcgggcatcaagctcgtggtcaacgaacgccatgcgcagacgggcgaactcgcgtcgctcgcctgtgcggccgaacgcctgaccggcgacaccgtgatttcgtacggtgacctgctgttccgcagctacatcgtgcgcgacctcgcggagagcgaggccgagttcagcgtggtggtcgattcgtcgctcaccgaaaccaaccagagcgtgcgcgatttcgcactgtgctcggcggcggacgatcgcggcctgttcggccagaagacctacctgcaacgcgtgtcgagcgacgtcgccgccggcacgccgcacggccgctggatcggcctgctgaacg

SEQ ID NO: 1023 - DNA, 437 bp, Zea mays
  unsure at all n locations
  Clone ID: LIB143-054-Q1-E1-G8
gggtcggcccaacccacacgtcaagttggacatgcttcgcctatatgcacctgtgcttgccgtccttcgggtcggtgctctttggttaatgttcaaccacctcactatggtgaatggcaacgatggtaggccgacgatatacatacactacaatacaatacgatgatcctagatggatcagggatacacacgacgaccaacaacaaatccaagggaacaatggcgcccaggaacgactttcttgagacgccagtcgggtggacgagcaggaaagcgttcgtcagcccatcgcgtacttctgcgtccagctgcgggccgtcgactcgtacttcggccggtccgtcttgtacatgtgggcaatctccgggacaagaaggtcgtccgggttggggtcggtcagcanggagcagatggagagcaggaccttagaaattgtc

SEQ ID NO: 1024 - DNA, 391 bp, Zea mays
  Clone ID: LIB143-054-Q1-E1-G9
gaccgtgaggcgacacgacgccgagagatcacccgccccccgcatcgtgtccgccccgcttgggattgtgaggtaaagcgtgatggcagcgccgccggcgagggctcgagccgactacgactacctaatcaaactgctcctcatcggagacagcggcgttggaaaaagttgcctcctgttacggttttcagatggatcattcaccactagcttcattaccactattggcattgacttcaagataagaactgttgagttggatggcaaaaggattaagttgcagatctgggatactgcaggccaagaacgtttccgcacaattaccactgcctactacaggggagcaatgggcatcttacttgtgtatgatgtcacagacgagtcatctttc

SEQ ID NO: 1025 - DNA, 389 bp, Zea mays
  Clone ID: LIB143-054-Q1-E1-H1
cccacgcgtccgcggacgcgtggggagagcagctgactgcgtgctcctgccttcggtgggcgacggcaggcgatcccagtccagcaccccccctccctccctatctctctgatctctccctcgctctcgcagccgccactgtagaagcttcgaggctgctgctgcgcccatggccgcggaagccaagacgccgtccctcgctgaggaatattcacttccaccacaggaagttccagtggaaaaggcagctgaggagaagccctctagtggtactgagactgaatctgctccttcaaccaatgatgagactccttcatctgtagaagataagaatgaaacgtctgaagtacaagatgctgctgaaaagtcagacgcagaagaaactaaca

SEQ ID NO: 1026 - DNA, 286 bp, Zea mays
  Clone ID: LIB143-054-Q1-E1-H10
cacgcgtccagacaaatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaagacgatgaacgcatgccggcgttcgcgctcgtcaacaaggccacggggctcgccatcaagcactccctcg

SEQ ID NO: 1027 - DNA, 398 bp, Zea mays
  unsure at all n locations
  Clone ID: LIB143-054-Q1-E1-H11
atgaagttatccaccccggccgcgccaacgtctccaaggcggatttaaaggaaaggcttgccaaaatgtacgaagtgaaggacccaaacaacatcttcgtcttcaagttccgcacccactttcngtgggnggcaagtccactggctttcggctcatctacgataaccctcagtccgccaagaagttccacccaaatacgccccatcaagaatggtcttgccactaaggtttaaaagtcccgcaagcacaattaaagaagcggaaaaacagggccaagaaagattcgtggtgtcaagaaagaccaaaggctggtgaccccaagaagaagtaaacagtcatttatatttctgtattactgtcctgaactctgggtggtcgtctagttgcaatgtcataat

SEQ ID NO: 1028 - DNA, 195 bp, Zea mays
  Clone ID: LIB143-054-Q1-E1-H12
tcagagtagcccacggtactgaagctcttggctcaccttctggtgttcctcttcccaaaagtcttgaggagcttgagcaggttctaatgcttggcatagaaaagcgacttccaatggtggtagctaatccagattatgtcactgtcgaagctcgagatctccgtgtcatgcctggcactctggcagctaaatatg

SEQ ID NO: 1029 - DNA, 276 bp, Zea mays
  Clone ID: LIB143-054-Q1-E1-H2
gagtaaggttgcagaaaatattgaaaatttcttgcatgagtgtcagtcgcaaagggctgataagataatcgattcgttcatagttccacgttcagtgacgttgggatacaacttgctcttcactgaacgtgtggtcattcgtcctctatatatcaaggatccgctggtcaactgttttgggagattcaccatgggcggtggggccattatcgactatctccaggtggccagctagccgctgcgcccgattaagtgggatggggaaagagatgagga

SEQ ID NO: 1030 - DNA, 425 bp, Zea mays
  Clone ID: LIB143-054-Q1-E1-H3
agatttttatttttattttgctagttcttgaaatttcttgcacgagtgtcagtagccaactgctgataacaacatcctatcgttcctgtagcccctttccgtgaccttgccaaagaatttgctcttctctgtgcgtgtgcaatttcttccgctacagctcaaggatccgctactctgctgttttgggagattcgccatgggcggcggggccgttaacgaccacttcccgggggccagcgacccgctgctccccacgaagcgggatggggacggggacgaggacgacgcaggtgcctccgcgttccacgagttcgacggcgcctccttcgccggcgcggtgttcaacctctccaccaccatcgtcggcgcgggcatcatggcgctaccggccaacatgaaagtgctcggtctcgtccctgggctcg

SEQ ID NO: 1031 - DNA, 363 bp, Zea mays
  Clone ID: LIB143-054-Q1-E1-H4
gggcacgcgtccggcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagatcatcgccaacgaccaggggaaccgcaccacgccgtcctatgtcggcttcagcgatactgaccatcgcaatcgcgcacgcgctggcactgttcgtgggcgtgtccgtcgcggcgaatatctcgggcggccacctgaatccggccgtgacgttcgggctgg

SEQ ID NO: 1032 - DNA, 207 bp, Zea mays
  Clone ID: LIB143-054-Q1-E1-H5
aggtgctgatgcatgactaaaacggaggttcgaactttgaaggacagtgatatctgctatccttgcttatgttaagttttccttgtcttggaactaaatgtgtctgttgtgctccaaataagttttggtttttgactgcatatttgcaattggtagggttaatgcgacattgtgttaagcctgcatagtgcattctaattttccctt

SEQ ID NO: 1033 - DNA, 386 bp, Zea mays
  Clone ID: LIB143-054-Q1-E1-H6
gcgaagcatcgagttggaattcagcgcgatttctctagatctcgagtacgcccgcaaagagtttggttcctccttacaagatggtgaagctcttctggtggcaatgtcgagaatccatgatcgcgacctccggatcggcctacgtagccgatactcgtgcgtcggtgttcttcatcatcgccggcgtcgagatcagccatcgcctacaggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaacatcctgacgggcgt

SEQ ID NO: 1034 - DNA, 396 bp, Zea mays
  Clone ID: LIB143-054-Q1-E1-H7
tccatcgacccacccaacccccccctccgccccgcgcttcgcctgggtaccggcgtccgccgcgccccgtcccgtccaggaacaggaagagcagtaacccatccatcggggatcaccaggggagcaagatgtcgactgccgccgccccaagattgcccgctcccagatccggggcaagctatcactatcagacgaccgcggctccggtggccaacaccctctccttcgccggccacgcgaggcaagcggcccgcgcgtccgggccacagctgtccagcaggttcgtggcgtccgcggcggccgtgctgcacaaggtgaagctggtcggcccggacgggacggagcacgagttcgaggcccccgacgacacctacatcctcgaggcggccgagaccg

SEQ ID NO: 1035 - DNA, 393 bp, Zea mays
  Clone ID: LIB143-054-Q1-E1-G11
acggacgcgtgggcggacgcgtgggcggttgcgattttgacaccatagaaccttcagtatctacatatttgtaaggtgagtaacaatcattcttattgcaaggcacattcttcttgattcttattcctaatataatatttggcaaaacaataaaatacaatggtgcttgtaccagaagtagaataaatatttgtgcttgcctacgtatcattgctttgagaagaaagaggtggggaaaagaaaccccccaagttacagaccaccaatacaaacaaacaaagagcagtgacccactaaaatcagccctaacagaattcatagtattccatacaaattcaacacttattaatctaggtttatgcttttgattccatgttttataaacacagttca

SEQ ID NO: 1036 - DNA, 384 bp, Zea mays
  Clone ID: LIB143-054-Q1-E1-E6
agtccgagcacgccgaacgctgtcggaaggcacaaagcggcgagcggcgccgggcttcccctctctttctcgcccccgatctgcgccgatcggggcgaccgctctctggggacgccgatcgaaggtcgggcggcgatgcttccgatatacggaagcagtttctagttttcttcagttggtcgccacagtttccagcgctttcagccagttgtctaataacttgttgttgttgttgtacttaagattgacacgcttcgtgttgtaaagcattgccatgtttggggcatgacttgtttttgttgaaatcaattgacttccaaggggtacactaaatccttgatgcaacataataggatcaccgtactgtcttcctcagagaccttc

SEQ ID NO: 1037 - DNA, 398 bp, Zea mays
  Clone ID: LIB143-054-Q1-E1-E7
acaaagcataaatgggcatcacaagaacataaccttcaggtgtgctgatgtgacatctaacgacttgaagattgaagataactctgttgatctgatattttcaaactggctattaatgtacctttcagatgaggaggtccaaaagcttgtggggaaaatggtaaaatggctaaaggtcggaggccatattttctttagagaatcatgttttcaccaatctggagattccaaaaggaaggtgaacccaacacactatcgagaaccaaggttttataccaaggtatttaaagagggccattcatttgatcaagatggaggttcgtttgaactttctctagtgacctgtaaatgtattggggcttatgtcaaaaacaagaagaatcaaaaccagatatgct

SEQ ID NO: 1038 - DNA, 220 bp, Zea mays
  Clone ID: LIB143-054-Q1-E1-E8
agcgtggtttgaggaacggcagttcgcctcggtcgttctgtgaaataaaattgggttacaagaattatggcgtttgtcaatatggtcgtaatgtcgtaggatggtggaatgtggtcacaaactttgcgtatgttgggtctacttgtggtgtctgaatctatgtatggatgtcatgagtttgtctactagagttctagttcctgtggtgttcgtatgatgt

SEQ ID NO: 1039 - DNA, 395 bp, Zea mays
  Clone ID: LIB143-054-Q1-E1-E9
gcccactcctccggctcttcttctccaccggcaccagtccaccacctcctgccaccgcgcggccccaaccaaccacaccgcagcgcagcaatggcgggcaacggcgccatcgtggagagcgacccgctgaactggggcgcggcggcggcggagctggccgggagccacctggacgaggtgaagcgcatggtggcgcaggcccggcagcccgtggtgaagatcgagggctccaccctccgcgtcggccaggtggccgccgtcgcctccgccaaggacgcgtccggcgtcgccgtcgagctcgacgaggaggcccgcccccgcgtcaaggccagcagcgagtggatcctcgactgcatcgcccacggcggcgacatctacggcgtcaccaccggctt

SEQ ID NO: 1040 - DNA, 239 bp, Zea mays
  Clone ID: LIB143-054-Q1-E1-F10
cacgctctgctcctccttttccactgctctgcgtctgcgtctgcgtctgcgtctgcactgcttctcgtctccctccccccgcctccgccatcggccccgggggggggcataacacggccatcgaaggctacggccgcgagttctaccacttcaacgaccagctgcgcctggagacggccgccttctcgggcctctccctcagcgactccatctggtcgcccgccggctggcgcagcaac

SEQ ID NO: 1041 - DNA, 394 bp, Zea mays
  Clone ID: LIB143-054-Q1-E1-F11
acgactctcctctctcgcatccgcagcctctcgagctctactccatcccctcgatctcgaagcgcagcagcagcagtcaggcggccatggacgcgagcgcagccggagccggcgggaaggcgaagaagggcgcggccgggcgcaaggccggcgggccgaggaagaagtcggtgacgaggtccgtcaaggccgggctgcagtttcccgtcggccgcatcgggcggtacctgaagaagggccggtacgcgcagcgcgtcggcacgggcgcccccgtctacctggccgccgtcctcgagtacctggccgccgaggtgctggagctggccggcaacgctgccaaggacaacaagaagacccgcatcatcccgcgccacgtgctccttgccatccgcaa

SEQ ID NO: 1042 - DNA, 208 bp, Zea mays
  Clone ID: LIB143-054-Q1-E1-F2
tcggcatcatgagatcgatctggctgcaggacttctcataaatgtcttgggtttctgctcctgggactttgtcagccatagacagaagtgatgaggaatggccattcagtccgatgaatgtcaccatgttggcatatgtgaacatgtagtagcggcaatccgacactatgtgtggatcgatagtatatatacatcatcaacgacggga

SEQ ID NO: 1043 - DNA, 293 bp, Zea mays
  Clone ID: LIB143-054-Q1-E1-F3
cgcgtccagttaattatttttagtgcgcgagatcttgaaatttcgtgcacgattgtcagtagccaactgctgataacatcatcgtatcgttcctgtaacccctttccgtgacgatgcgatagaatttgctcttctctgtgcgtgtgcaatttcatcagctacagctcaacgatcagctactctgctgttttgggatatacgccatgggtggcggggccgttaaggatgacttcccgggggcgaacaacccgctgctccccatgacgcaggatggagacagggacgaggacgac

SEQ ID NO: 1044 - DNA, 427 bp, Zea mays
  unsure at all n locations
  Clone ID: LIB143-054-Q1-E1-F4
aacaaggcaccacacctcttcttcttcttcctcctcctcctaacaaaactaacgcctggtccccttcccctggtattaagttctgcaacaaccggaaattccaacggttggtccaactgctcctggcggaactcaagcaaatgcattttccctaacgttggaaacgccgccgccaacagcatcaagaccacggtcctcgccgcgccgaccaccaaggccaacgccggcggcttcgaggcggccaccganggcggcggctgcgactgcaacacctgcaactgcggcaccagctgcggctgctcctgctgcagctgcaactgagccggtcaggcgatggcgcacgagagtcgagaggacgacgacgagtcgtataaatataatagcggcgtctaaataagatcctgtcaactgcacccgccattatcga

SEQ ID NO: 1045 - DNA, 385 bp, Zea mays
  Clone ID: LIB143-054-Q1-E1-F5
aggaaacgagagggccggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccagctgctgctgcaggtgctccacctgctgagaaaccacctgctgcaaagcctgatggcaccagtcagattgctgctggggttaccagccaaaccaataactaccacatggccgacggtcagaacaccggaaacttccttacggaccgtccttcgaacaatgtctacgctgctcctggcg

SEQ ID NO: 1046 - DNA, 338 bp, Zea mays
  Clone ID: LIB143-054-Q1-E1-F7
accgcaaccgcaagcaagcgaagcgcagagcctgcctgaccagagctagctgagctacagccaacagcagctggtctgactgacatggcgaaggacatcgaggcatcggggcccgaggcgggcgagttctcggccaaggactacaccgaccctccgccggcgccgctggtcgacgcggaggagctcacccagtggtccctgtaccgcgcggtcatcgccgagttcatcgccacgctgctcttcctctacatcaccgtggccaccgtgatcgggtacaagcaccagacggacgcgtcggcgtcgggccccgacgcggcgtgcggcggcgtcggcatcct

SEQ ID NO: 1047 - DNA, 410 bp, Zea mays
  unsure at all n locations
  Clone ID: LIB143-054-Q1-E1-F8
agcctcctgcccccgccgtcgtcgggggtgccggaggtcatctggctgccgacgagcgggggagcggggcccttgtcctgcgcgccgccggaccccgccgtgtatgaccgccccgtcatcggcatcgtctcgcacccaggggacggtgcgggcggcaggatcagcaacaccaccgcgacctcctacatcggcgcctcctacgtcaagttcgtcgaggccgccggcgcgcgcgtcatcccactcgtctacaacgagcccgaagaccgcctcctcgagaaattgagtttgttgaatggagtgctgttcactggtgggtcagagaacgaacgtgtatattttgacacgataaaaagagtatttcagtatgttttggacaagaatgatgcaggtganacatttcctttgtttgc

SEQ ID NO: 1048 - DNA, 402 bp, Zea mays
  unsure at all n locations
  Clone ID: LIB143-054-Q1-E1-F9
acgcgtccagcacctcaagctctgctcctccttttccactgctctgcgtctgcgtctgcgtctgcgtctgcactgcttcgcgtctcnctcnccccgcctccgcctccgccccggcaaaaagcaaaacacggccatggaaggctacgaccgcgagttctaccagttcagcgaccagctgcgcctgcagacggccgccttctcgggcctctccctcggcgactccatctggtcccccgccggccggcgcaacaacagcaacgacgtcctcttcgccgcctccgcgtcgcccgccgacgccgccaagagcaacgccgtcgtcgggctcaagctcaacgacggagggcccggcctcattggctccgggaagctggccttcggcggcgccggcaccggcggcaccaa

SEQ ID NO: 1049 - DNA, 379 bp, Zea mays
  Clone ID: LIB143-054-Q1-E1-G1
tccaagactctacactgagtcgtattacgagcgcgcgccaagcaagtcttccggccggccgcgaagagcgcaatcaagcaagacaagatggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctgggcgtgggcggtcacatcacca

SEQ ID NO: 1050 - DNA, 364 bp, Zea mays
  Clone ID: LIB143-054-Q1-E1-G10
gaggcgacacgacgccgagagatcacccgccccccgcatcgtgtccgccccgcttgggattgtgaggtaaagcgtgatggcagcgccgccggcgagggctcgaggggactacgactacctaatcaaactgctccgcatcggagacagcggcgttggaaaaagttgcctcctgttacggttttcagatggatcattcaccactagcttcattaccactattgggattgacttcaagataagaactgttgagttgggtggcaaaaggattaagttgcagatctgggatactgcatgccaagaacgtttcggcacaattacaactgcctacttcatggggagcaatgggcatcatacttgtgtatga

SEQ ID NO: 1051 - DNA, 414 bp, Zea mays
  Clone ID: LIB143-054-Q1-E1-C7
caacttcactggtgctggaggagttgccttgtctatgtacaacaccgacgagtcaatccgagcttttgctgaggcttctatgacaactgcttatgagaagaaatggccactctaccttagcaccaaaaacacaatcctgaaaaaatatgatggcaggtttaaggacattttccaggaggtctatgaagctgactggaagtccaaatttgaggctgctggaatatggtatgagcatcgtcttattgatgacatggttgcgtacgcgcttaagagcgaaggaggctatgtgtgggcttgcaagaactacgatggagatgtgcagagtgatttcttagctcaaggttttggatctttgggtttgatgacatcagtgttggtgtgccctgatggaaaaaccatcgaagctgaagctgc

SEQ ID NO: 1052 - DNA, 387 bp, Zea mays
  Clone ID: LIB143-054-Q1-E1-C8
agggacttttcttccttcgcctctacaggtttggaatcggcgctgtccgtcttcgctcttctcgccagggcaaattaaagctacaatgcaggctgcctactatgcaaaggatcctttggtttgaagtccagttgaccgaagttggaaaatacttctgagacttacagatttcacaaaggtcttgtttattttctacgattttccttcaagcacgtggaataatacgtttgacaaacaatttgctgacgaagttttcgaacacggctgaacacacgcacaaggcgtgcacagtacacgcgcgcagggggaggaggagaacacgaggatggtgaatgcaacgcccaagccaactccggtcaatgcagccccagaagtgatcttccaccc

SEQ ID NO: 1053 - DNA, 405 bp, Zea mays
  Clone ID: LIB143-054-Q1-E1-C9
cacgcgtccacgaaggaggaacgaacggacaggttgttgcacagaagcgacatggctttcgcgcccaaaacgtcctcctcctcctcgctctcctcggcgttgcaggcagctcagtcgccgccgctgctcctgaggcggatgtcgtcgaccgcaacaccgagacggaggtacgacgcggccgtcgtcgtcactaccaccaccactgctagagctgctgcggctgctgtcacggttcccgccgccccgccgcaggcgccggcgccggcgccggtgccgccaaagcaagcggcggcacccgccgagaggaggagccgtccggtgtcggacaccatggcggcgctcatggccaagggcaagacggcgttcatcccgtacatcaccgcgggcgaccccgacctagcgacg

SEQ ID NO: 1054 - DNA, 264 bp, Zea mays
  Clone ID: LIB143-054-Q1-E1-D1
actccctaatagtagagtcgtattaagaggaaacatagctactcctactacgcaaatccatccttattcaacttagtgtttgatccatggactcggaaggagtaccaacaacagtgggaggtgagactaccataccggcaagccaagaagactgcgagagcatggccggaagtactgatctgctgacactgacgtataagtcgcagctgcaagcgctagcgatgctgctgctgaacaacgatgagatcatcatcagccaggcga

SEQ ID NO: 1055 - DNA, 427 bp, Zea mays
  Clone ID: LIB143-054-Q1-E1-D2
acaggtatttggcgaccaacatggaaatgcgatatacctttatgagagagactgcagtctacagagaaggcatcagaagatcagcgaggaagctccagctccaaatgtgccagctgagtttcggtctcatattggtggagctgctgtatctgcagcaaagggtcatttattggattgtttgtgttgaaggcagttggttactacaatgctggaacagtggagtttattgtggacactctttctggagagttctacttcatggagatgaatactcgactccaggttgaacacccagtgacagagatgattgttggtcaagatcttgtggagtggcaaatacgtgttgcgaatggagaacgactaccattatctcaggagcaggttccaataaaatggacatgcatttgaaccacggatatatgctgaa

SEQ ID NO: 1056 - DNA, 357 bp, Zea mays
  Clone ID: LIB143-054-Q1-E1-D3
aagcagatcaaggccgagggagaaaatagtgttggcctgctggggaatctggtagtgagaaatgagatgaaatgacagatgccagagttctcgttaccaatatatatatatgttacggcgttacacactgaatctgtattagtgctagtgttggatctgtaagtttttgttcgtgaataatcagtgggtgcacagactattaagtggactatgttttgaggcgctgcttgaatgatctgtactgtacgtaggggagtgtacggtgttagcaatatccctggctgcgcttcattgctctctcgtggcacgagcacgacatgtttgtaataaagttaccaggtagtggggctgtcgggc

SEQ ID NO: 1057 - DNA, 165 bp, Zea mays
  Clone ID: LIB143-054-Q1-E1-D4
cgcactcgaccgcgctcctctcgaacgttaggtatgctcgtccaccgtctcctcctcgtcgtcgccgtctccgcagcgagctgcaccgccatcggggaggcggtggtttacgaacccctctctgacgagcacttccctccggggatcctccccaatgacgtggtc

SEQ ID NO: 1058 - DNA, 409 bp, Zea mays
  Clone ID: LIB143-054-Q1-E1-D5
ctgctgccttatacgaaacatagctactcctactactcaaatccatccttattgagcttagtgtttgatccatggactcggaaggagtagcagcaaaggtggcagatgagactactaaaccggcaagccaagaagacggcgagagcaaggccgggatgactgatctgctgatgctgaccgacaagtcgcagctgcaggcgctagcgatgctgctgcggaacaacgaggagctcatgatgagccaagcgatcaagtcggagacggagcgcgttgagtacctcaagacggtgagcgactgctacacgcggacaatgaagctccttgacgactccatggcggccaggatcacgtacgagcgttcgggcggaacgaagagcctcgtcgcccgggacatggacgactacgtcgt

SEQ ID NO: 1059 - DNA, 352 bp, Zea mays
  Clone ID: LIB143-054-Q1-E1-D6
cccacgcatcaactgctgccttatacgaggcatagctactcctactacacaaatccaaccgtattcagcttagtgtgtgctacatggactcggaaagactaccaccccaagtggtgagatctgactttcagtctcacaatccatgaagcaggtgaaactacagcagggagtcctgatctgcagagtctgagtgacaagtcgtaggtgcatgcactaccgatgcagttgcgtttaatgtaggaactcattctggacagtcgatcatcatggagatggatactctactctaccttgagaacgcaatgaaatacatgattcgtgggtcacgatcttgttgagtagcccatacgtg

SEQ ID NO: 1060 - DNA, 396 bp, Zea mays
  Clone ID: LIB143-054-Q1-E1-D7
caactatcatctctgcatttctgttagcaaatgtaatgggccgtttccaatggttgacatgcccaagaaaggatctgtcaactgggtggctttattgtgatcctggtccaatgtttaagccagagcattactcattgggagagtcggtgccacattggttcccatggaaagatctagccattatgcctgtgcagtggcatgctttagccctaggtttatttgcgtcaataatagcaccatttggaggattttttgcgagtggcttcaagagggctttcaaaataaaggattttggtgacagcatacctgggcatggtggaattactgatagaatggattgccaaatggttatggcagtgtttgcatacatataccaccagtcattcattgcacctc

SEQ ID NO: 1061 - DNA, 414 bp, Zea mays
  Clone ID: LIB143-054-Q1-E1-D8
ccgaagccgcactctaccgcgctcctcccgaaccacagctatgctcgcccaccgcctcctcctcctcctcgccgtcgccgcggcgagcggcaccgccttcgctaagccgacggcgtacgaagccctcgctgactacgacttcccgccggggatcctccccaagggcgtggtcgcctacacgctcgacaacgccacgggcgccttcacggccacgctcgacgcctccgcgtccggcagcgggtcctccgtctgcgagttctccatccagggctcctactcgctccgctaccagaccaagatcaccggaaagatcgcccccgaccacctcaacgacctcgagggcgtctccgtcaaggtcctcttcttctggctcaacatcgtcgaggtcacccggcgcggcgacaacctcgagtt

SEQ ID NO: 1062 - DNA, 334 bp, Zea mays
  Clone ID: LIB143-054-Q1-E1-E1
aagcaagcctccaatccattcggcgggcacgtggctggcgaagtcttggtgcgtgcccacggtgccatttcctgcatcctcatcgtacaacaggaatcgctagctgagaacggagagatgtctggcacgtcggcatcatcgacttgcttcacgaacgacacagacgtgcagtctccacgatccacgcgcgtcttcgtgctgaaggatcacagccaactcggtaatgcacatctggggttagtcaaccttgtgaaagacacaacacagtttgtagctcgcactatgtacgatcttattattgatctgaacgatggcgtacttaatacactttaag

SEQ ID NO: 1063 - DNA, 176 bp, Zea mays
  Clone ID: LIB143-054-Q1-E1-E10
agtcaaatccgacagctcatccgctctatcggtacgattcgaataactcgtgcgaccgtgcggtctaaaccatggataacgttggtcaacaatcgcgggcaactgtcaccattgtgaagcatcacttcctcaatatgaggccaggcgtagcagaactcgacgagagccatctggac

SEQ ID NO: 1064 - DNA, 396 bp, Zea mays
  Clone ID: LIB143-054-Q1-E1-E11
aatcctcactcgccgccgccgccgctcgtccctcgccccatcgcgatggcccggatcaaggtgcacgagctgcgggggaagagcaaggcggatctgcaagcgcagcttaaggagtttaagtcggagctctccctgctacgcgtagccaaggtcaccggcggggctcccaacaagctctccaagatcaaggttgtgcgcacctccatcgcgcgcgtgctgaccgtcatctcgcagaagcagaagtcggcgctgcgtgaggcgtacaagaagaagaagctgctcccgctcgacctccgccccaagaagacccgcgccatccgcaggcgcctcaccaagcaccagctctccttgaagaccgagagggaaaagaagcgtgagaagtatttccccatgagg

SEQ ID NO: 1065 - DNA, 407 bp, Zea mays
  unsure at all n locations
  Clone ID: LIB143-054-Q1-E1-E12
ccggcccacgcgtccaaccatcttcccgcgccagtacgcgttcgagatgtcctccgtcatctacaaggactggaacttcacagagcaggctctccctgacgacctaatcaagagaggcatggcggtcgcagacccgtcgagcccgtacaaggtacggctgctggtggaggactacccgtacgcgtcggacgggctggccatctggcacgccatcgagcagtgggtgacggagtacctcgccgtctactaccccaacgacggcgtgctgcgggcggacgtggagctgcaggcgtggtggaaggaagcgccccaggtccggcacgccgacctcaaggacgcgccctggtggcccaagatgcagacggtggccgagctggtcaaggcctgcnacaccatcatctggattg

SEQ ID NO: 1066 - DNA, 412 bp, Zea mays
  Clone ID: LIB143-054-Q1-E1-E2
agcgaatccccaatccgttcggcggcgagccgaccggcgatgcgtccgccggcgccgaaggtcccatccgccgcttcctcgtcctcccacagccagcgcgagccccgcccggagaaccctctcctcctcctcccctcctctcgcttcaccaagctctcactcggctgtcccctcctcgaccgcctcctctgcggcggcctccccgccgcctccgttaccgagatagccggcgagtctgcctctggaaagactcagctctgtcttcagctcgccctcctggcgcccctgtccccgctctccgcctcctccctcttcctccactccgacctcccattcccccttcaccgcctccgccgcctagcccccaaatcccgccccgatatcctccgacaagtcctcgtggcggccgcgc

SEQ ID NO: 1067 - DNA, 368 bp, Zea mays
  Clone ID: LIB143-054-Q1-E1-E3
aggacctaccgtcgtttgagtcaccataaaaaagcaatgtttagtattcaaattcaacgcgcgctggcgcgcgccattgactagtatttatatagtgggctctccgtaagtttctttgagccgggtagctacacagtacgcacacctatcccggctgcagcgcggttccagccactggtgccacgtggtttgtgctcttgtgggcacactggcctccacccatctctctcacgtctccccatccgcagcaaaggcacacagtacagattcggcccatcgttttatagccacaccatggctaggaagtgctcacactgtggcaactgcggccacaactccaggacctgcgggagagaaaccatgctctg

SEQ ID NO: 1068 - DNA, 213 bp, Zea mays
  Clone ID: LIB143-054-Q1-E1-E4
ctaacacatcgcgaatccttgcacaggatggtcatagtcttagactgcaactcacagctgcagttactatgtcttcagatacgaccatcagtagtccagctgatgatcctgcatctaatcatgattacatgactgatatgtcagtataagcggctagcattgcatctcaatggatggaattactgcatcatgacataacgggacgtcatgctg

SEQ ID NO: 1069 - DNA, 381 bp, Zea mays
  Clone ID: LIB143-054-Q1-E1-C6
acccacgcatcaacgatcgctcatcaatcgccagaggagttgttgatggaggtgagtgaggttgacaagcacaccatcgtcatggacggcagatactacggcggtcgctatcagcgctgcagcggcggctacgacggcggcggtggcatcacaacgccggggtacactccggcggtcgcgtacgggatgtcgcatgtgaacatcgatggcaacgggtgcgggcggtcgctgccgcctcagccgacaatgactgtgtactgccgcaccgatcctaactacgccatgatcgtccccaacgggaatgtggtcctggtgccagcgaataccaacgacgagtactaacactcaatcaaagacatccggtggaacacgagcatcaat

SEQ ID NO: 1070 - DNA, 400 bp, Zea mays
  Clone ID: LIB143-054-Q1-E1-A9
aattggatcctttctccttttgttgtgctcatctcatgtggttctgtgactgctgagagataggtgggcgaggcagccatggagttgatggtcggaggcagatctgcttggatgcaagtggagagggggctggcgcgccgcacgcggcacctacctccagcagcggcgccagcgccggcggcttcttgtagatctggaagcgccaatattttcttctctagccgtttagcaatcatcatatataggaatgtggacgtgctccatgtacctcttcccctactaatcaagcaaggtagcaagaatatgtactgcttgggaccatgagatgctagagcctgacatgctagagccctcatcctccatgtttgatgtggttatcatctgattcaagtaaccttgt

SEQ ID NO: 1071 - DNA, 267 bp, Zea mays
  Clone ID: LIB143-054-Q1-E1-B1
ctcaatcgaacgtgtggaggcgtaccggaaggtcctcaagacatggtctagatcggtacaggcgcacgtagattccaagagaacaacggtcttattcatgagcgtgtcaccagtacatatgcagatcgaacgttggggcagccccaacgccgtaaaatgcttctccgagacacagccggcgatcaactacaataagaaactggacgtgggcacggactgggaactcttcgcgaccgcccagcgcgtaacgacgtcgatgaagaaggt

SEQ ID NO: 1072 - DNA, 388 bp, Zea mays
  Clone ID: LIB143-054-Q1-E1-B10
aaggatctggtaagcaactaagcaagtgtactgaggacggaggcatcgatccagcgttccagctagcacgcacgcagccagcacccagcacccagcagtagaatctatatatcgtacgcaagtagtggatcgaggcatctatctgcagtccctttcttcttcttcctcttgattgataggtgcgccgaagcttgttttgttgggtggcctttgtctctgtcgtctcgtctcgtctcgtcttccgcccggccgccaccacctgcaggctatactagctagctattaagtccggccaaccaagcagctcgatcaggtcggtcgacggcggggacagttcggagggaggaggcggccggagaccgaaggacgcctaccatcaactcgcggt

SEQ ID NO: 1073 - DNA, 402 bp, Zea mays
  unsure at all n locations
  Clone ID: LIB143-054-Q1-E1-B11
cacgcgtccagtcaagttgtccaatcacaactaaagccaaaacaacaaccaaccaacttattctgattaacaatccttttcccaaaacaaaaagggaacaagaatcccctccaaccgacgaagaaaggcaatgcccccgcttgcgcaggccgtccacctcctcgtcgccttcgccctcgcgcttggctgcctgncgggcggcgccaccgcgacggtggtgacgacgtgcagggcggccgcggacagcgacgcgcgcgtggactacgcgttctgcttcgccgagctgggcatgcaccgcgagagccccgacgccgacacctggggcctcgccaaggtggccgcgctgacgggcgtcaacaacgccgacaacgccgtgtacgacatcaaggccctgctcgccaa

SEQ ID NO: 1074 - DNA, 374 bp, Zea mays
  Clone ID: LIB143-054-Q1-E1-B3
acactaccgaagcccttgtacccctcaccgccgccgctgctgctacggagcttccacccgcgcgcgcgccgcggtgaagacggagccagtggtggatgggctcgacgacgacgtggtgcacacgatcaccaatcaggtggaatactattttagtgacatcaaccttgctactacagaacatctgatgagattcattaccaaggattctgagggatatgtgccaatatcagtaaatgctggctttaagaaggtcaaaacttctgtgcgcaataatgtgatgcttgctgctgctctccgaacctcatcaaaacttgttgtaagcgatgacggtacgagagtcaatacgcagcaaccatttacagaatctgatttgc

SEQ ID NO: 1075 - DNA, 379 bp, Zea mays
  Clone ID: LIB143-054-Q1-E1-B4
ccacgcgtccgcgtgcaactaggaaaaggcacaaggttccgtcccactgcatgcgtcaagagactgtctggttttcttgttctgatttgtcatttgctggtgctcaaagccggcttggtttcctcgaaggatcagcatctactcttgattgtggactttgtcgcatctgatatcaacttcataaatctttatccaagatggcgctgcaaaacattggtgcttcaaacagggatgatgccttctacaggtacaagatgcccagaatgattaccaagatagaaggccgtggtaatggtatcaagacaaatgttgtgaacatggttgacatagcaaaagcacttgccaggccagcttcctacacaaccaagtactttggatg

SEQ ID NO: 1076 - DNA, 425 bp, Zea mays
  Clone ID: LIB143-054-Q1-E1-B5
acgaaatcgaacgtgtggaggcgtaccggaaggtcctcaagacatggtctagatgggtagaggcgcacgtagatcccaagagaacaacggtcttattcatgagcgtgtcaccagtacatatgcagagcgaaggttggggcagccccaacgccgtaaaatgcttctccgagacacagccggcgatcagctacaataagaaactggaggtgggcacggactgggacctcttcgcgaccgcccagcgcgtgacgaggtcgatgaagaaggtacccgtgcacttcgtcaacataactgcgctgtcggagatccgcaaggacgcgcacacctccgtgcacacgctgcggcaggggaagctcctgacgccggagcagaaggcgaacccgaggaagttcgcggactgcatccactggttgctccccggtgtg

SEQ ID NO: 1077 - DNA, 397 bp, Zea mays
  unsure at all n locations
  Clone ID: LIB143-054-Q1-E1-B6
aattcncgggccactgcagcgatagagaaagagaaaaaggaaaggaaaggacaaaggagcggcggcgaggtctatggcgtcgactgcggggtacctggcgcggcgggcggcgcagaatgagcgggtgcgcctgctctaccgcagggcgctcaaggacacgctcaactgggccgtccaccgccacctcttctaccaggacgcgtcggatctccgggacaagttcgaggccaaccgacacgtggataacctggacgtggtcgataggctcatcgacgatgcggaggctcagtacaggaacttccagcaccccgatccctacattgttccatgggcaccacgcggcactaaattcacaagaaacccccctccacctcaagggatcgagatcatctacaat

SEQ ID NO: 1078 - DNA, 406 bp, Zea mays
  unsure at all n locations
  Clone ID: LIB143-054-Q1-E1-B7
gctgcaagactgccaggcttccacacgtgtgtgggcagcggtggagagagactacttcctgaatggtactctgagaaaggcattgaactgatcctgagtactgagattgtgaaggccgaccttgcttcaaagactctgaccagtgcagctgcggaaaccttcacatatgagaccttgctcattgctacgggctcctcggtcataaagctcactgattttggtgttcaaggagcagaatccaacaacatattgtatctaagggacattgcggatgccgacaagttggttgcagctatgcaggcaaagaagggtggaaaggctgtgattgttggaggtggttacatanggcttgagcttagcgctgccttganaatcaacaacttcgatgtgaccatggtgtaccctg

SEQ ID NO: 1079 - DNA, 131 bp, Zea mays
  Clone ID: LIB143-054-Q1-E1-B8
agtcaacctccaataatggtatctgtcgagcacccgaggcattgaatttgagtaatggaattcaccataattgttcaacctccaataaagtctgtaactccaattcttcaaagcatgttttttagttcgac

SEQ ID NO: 1080 - DNA, 359 bp, Zea mays
  Clone ID: LIB143-054-Q1-E1-C1
gtcgtatcatcagtcgccagaggacttgttgatcgacgtgagtgaggttgaaaagcacaccatcgtcatggacggcggatactacggcggtcgcgatcagggcgacagcggcgggtactacggcggcagtggcatcgcaacgccggggtacgctccggcggtcccgtacgggatgtcgcaggtgaacatcgacggcaacgggtgcgggcgggcgctgccgccgcaaccgaccgtgaacgtgtactgccgcgccaaccccaactacgccatgagcgtccgcgactggaaggtggtgctggcgccggcgaaccccaaagacgagtaccagcactggattaaggacatgcggctggagcacg

SEQ ID NO: 1081 - DNA, 388 bp, Zea mays
  Clone ID: LIB143-054-Q1-E1-C11
accgggaatggcaacgctcaaggtcccagccactgttcctcccgtcgccgatgactgcgaccagctgcgcaaagcattccaagggtggggcacgaacgaggcgctcatcatctccatcctcggccaccgcgacgccgcgcagcgccgcgccatccgccgcgcttacgccgaggcctacggcgaggagctcctccgctccatcacggacgagatctccggcgacttcgagagggccgtgatcctgtggacgctggacccagcggagcgcgacgcggtgctggccaacgaggcggcgcggaagtggaagcccgggaaccgtgtgctcgtcgagatcgcctgcacgcgcacctccgcgcagatcttcgcgaccaggcaggcttatcacgag

SEQ ID NO: 1082 - DNA, 389 bp, Zea mays
  Clone ID: LIB143-054-Q1-E1-C12
cccacgcgtccggcacaaggtgcctttgggaagctctacaggggaacatacaatgggatggatgttgctattaagcttttggagcgacctgaggctgaccctgagaaagctcaactgttagagcagcagtttgtccaagaagttatgatgcttgcaacactgaggcacccgaatattgtcaagttcattggtgcgtgcaggaagccattggtttggtgtattgtgacggagtatgcgaagggtggatctctcaagaatttcttgagcaagaggcagaacaggtctgtcccgctgaagttggcagtcaagcaggcattggatgttgcacgtggcatggcctatgtccatggccttgggttcattcatagagatcttaagtcggacaacct

SEQ ID NO: 1083 - DNA, 376 bp, Zea mays
  Clone ID: LIB143-054-Q1-E1-C2
acggacgcgtgggtggcaaagggggaggggccggcgatcgggatcgacctgggaacgacgtactcgtgtgtcggcgtgtggcagcacgaccgcgtcgagatcatcgccaacgaccaggggaaccgcaccacgccgtcctacgtcgccttcaccgacaccgagcggctcatcggcgatgccgccaagaaccaggtcgccatgaaccccaccaacaccgtatttgacgcaaagcggttgattggtaggaggttctcggacccttccgttcagagtgatatgaagctatggccattcaaggtcgtggcgggccctggcgacaagccgatgatcgtggttagctacaagggtgaggataagcagttctctgccgaggaga

SEQ ID NO: 1084 - DNA, 374 bp, Zea mays
  Clone ID: LIB143-054-Q1-E1-C3
acaaatgcgtgcgccggccgccccctatcccgccggccctgtgtgtgttccccgctaccagccatggcgtcgccgttctccgtgccttcgctgatcatggaggacgaagggcggttcgaggcggacgtggcggaggtggagtcgtggtggggcacggagcggttccggctcaccaagcgcccctacaccgcccgcgacgtggtcctcctccggggcacgctccggcagagctacgcgtcgggggagatggccaagaagctgtggcgcacgctcaaggcgcaccaggccggcggcaccgcctcccgcaccttcggcgcgctcgaccccgtccaggtcaccatgatggccaagcacctggacaccatctacgtctc

SEQ ID NO: 1085 - DNA, 354 bp, Zea mays
  Clone ID: LIB143-054-Q1-E1-C4
agatatttttgttacagatgaatctgggactaagaaaaggatactgctataggacaacattgtgcggtggagaaccactacgaatgcagatggcactatatcttgtgaaagcaatgcaagcattgtgaaatggaaggatggaagtatgcagcttctgattggcaatgatgttctagatataactgtacatgaggcgcatcatgatcaatcccatctgtttttgaggaatgggaatggaagtctacaatcacaacgaacgctattgcacaaaatgcgatttataccatcctccttgttttcgaagtcacatcgcttatgaacagccctggttgattctcagaataagaaaactgt

SEQ ID NO: 1086 - DNA, 367 bp, Zea mays
  Clone ID: LIB143-054-Q1-E1-C5
agcgatcgctcatcaatcgccagaggagttgttgatcgaggtgagtgaggttgaaaagcacaccatcgtcatggacggcggatactacggcggtcgcgatcagcgctacagcggcgggtactacggcggcggtggcatcgcaacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgacgggaaggtggtgctggcgccggcgaaccccaaggacgagtaccagcactggatcaaggacatgcggtggagcacgagcatc

SEQ ID NO: 1087 - DNA, 272 bp, Zea mays
  Clone ID: LIB143-054-Q1-E1-A8
aaataaatcatataaaaaaaaataaaaaaaaaaaaaaaaaaaaaaaataaaaaaaaaaaaaaaaaaaaaaaaaaaaaaaaaaaaaaaataaaggaaaagaaaaaaattgggtttaaatcacattaaagtgggagaaggggcaaaaatttaactcctaggggggggcgtcccaggggtttctgctcctgtttggcgttctggtaaattttcatctttctcttctgtttgatccgttttcctctccggcgttctattttactgcctatttgcgg

SEQ ID NO: 1088 - DNA, 419 bp, Zea mays
  Clone ID: LIB143-053-Q1-E1-H2
atgattcacaaagttttcacaagtccaagtctgttccaaacattccgaaggaccatgtatgcactgttgatgagctgtcagttaatcggggtgactggtactaccttgatggcactgggcatgatcaaggcccattttcttattccgaattgcaagaattagttaaaaaggacactatcattgaacaaagtagcgtgttccgtaagatcgataacacatggtttccagttcttaaggatttaaaacctggaagctctgttcccagtgcagcaccaagctcaaacttaattgctgcttttacgcacccagaccaatataattttggtgtgaaccaaggatcaagtagcttccatgagttacacccccagttcgcgggttatacacgtggcaaattacatgaactagtcatgaaatatttc

SEQ ID NO: 1089 - DNA, 440 bp, Zea mays
  unsure at all n locations
  Clone ID: LIB143-053-Q1-E1-H3
ggtcgatgcaagcgtctacagtgacgtcgtgttaatccccattcgttccccttctcgcctccacgagccttcacaaattgccctctcagctcttctcctaatctcactctagccctagccaaatcccagacccatcccagccctagcgacaccaaccagctcgccagcgaccatggggaacccggagaagctgatgaatcagatcttcgacctcaagttcacctccaagtcgctgcagcggcaggcgcgcaagtgcgagaaggaggagaaggagcagaagctcaaggtcaagaaggcgatcgagaagggcaacatggacggcgcccgcatctacgccgagaacgccatccgcaagcgcaccgagcacatgaactacctccgcctcgcctctcgcctcgacgccgtcgtggcccgcntcgacacgcaggccaagatgcagg

SEQ ID NO: 1090 - DNA, 418 bp, Zea mays
  Clone ID: LIB143-053-Q1-E1-H4
gtattatcggcatcttgaagatattttcaacagatataaagaacctgatgctgatatgataatggtggaaggaatatctcaattttgcaatgatctgcaggttgatcctcaggatattgtcatgcttgtcatatcatggcacatgaaagccgccacaatgtgtgaatttactcgtcaggaattcattggtggactgcagtcaattggggtagattcaatcgagaagtttcgtggaaaattaccatcattacgagctgagctaaaagatgacaataaattccgtgatatatacaactttgcattcacttgggcaagggaaaagggtcaaaagtctctctcactggagacttctattggaatgtggcagttgctatttgctgaaaggaactggcctcttccggatcattggtgtcagttt

SEQ ID NO: 1091 - DNA, 396 bp, Zea mays
  Clone ID: LIB143-054-Q1-E1-A1
gcgctgcccatggaagtggaggccgcgcgcgcggccgtggagaacggcagccctctggtccccaacaggatcaaggagtgccggtcctacccgctgtaccggttcgtgcgcgaggaggtcggcaccgagtacctgaccggcgagaagacgaggtcgcccggcgaggagctgaacaaggtgctcgtggccatcaaccagcgcaagcacatcgacccgctgctcgagtgcctcaaggagtggaacggcgagcccctgccgctctgctgagctgcaccagcagagaaagacaatgtatacagaaggaaaacaagtagtatagcagcacaggacagagcgtttcaaggtcgttgtgaagtgctttaccatcagaccagcacgagaacccctatcttaccg

SEQ ID NO: 1092 - DNA, 389 bp, Zea mays
  unsure at all n locations
  Clone ID: LIB143-054-Q1-E1-A10
acccacgcgtccggcacgtatggtgcttcaacactgcgtgaacaatgcggatgattgtttcatgtgagcaaccagtatttcatcttggcaaccaaagtttatggaaccatattcagatcaggaaagaggaaaccagtgtgcttcagatctaatatattccctgaacagtggaacatgagcacctgcaggaagctttggctggtctctacaggtcttcaagagcacattttcgcaccatgataacctgacaaccggtatctgttgtgcatgttgtccattaccttgttgcgaccgtgctgtctggagaacttgagctgcctgctcgcccactgaaaggctctgggcgctagatccagaaatcncatttttcacagtgcctgccgaacctg

SEQ ID NO: 1093 - DNA, 288 bp, Zea mays
  Clone ID: LIB143-054-Q1-E1-A11
cttctttttgtgcgcacatgggtttactaccttgagagaccgttcattgtcatactcaatcgagtccttcaccaaacaatggtgcagccctcctcttcttctagatgagttttctcacgttaaggagtccgtatacggcgatgagaatttctcggttagcgtcaacaggtcggctttcgagatcgttgctacatacaataaggaggagacaggaatcgaccttgtcatacgcctcccgagctgttaccctctgcgccacgttgatgtcgaatgcacgagaagtttggg

SEQ ID NO: 1094 - DNA, 392 bp, Zea mays
  Clone ID: LIB143-054-Q1-E1-A12
gagttgtacaggagctgcactgcacgctcctcaaattcccacgccgcatcgccacccagtgccctgctcaccgccgaacggtttcaatggccgcaagcacagcggcgccatgctacgacgcgccggagggcgtggacgtccgcgggcggtacgaccgggagttcgcgggcatcctcacccgcgacgcgctggacttcgtggccggcctgcagcgcgagttccgcggcgccgtccgctacgccatggagcagcggcgggaggcccagcgccggtacgacgccggcgagctgccgcggttcgacccggccacgacgctcgtgcgcgagggggactggacgtgcgcgcccgtgccgccggccgtggccgaccgcaccgtggagatcacgggcccc

SEQ ID NO: 1095 - DNA, 303 bp, Zea mays
  Clone ID: LIB143-054-Q1-E1-A2
cgtccagcgatactcatagaagtggaggccgcgcgtgcggccgtcgatacgcgtaggtatctgggcccgacgagcatcatcgcattcacggtcgaagacgcgtattcacccacgtatgggagatcgtcagcggagcataatgtagactgccacagaccaagtattgcccgctccgacatccgcagcgtgctagcactaacaaaccaccgcagctccagtggccaacagcctcaccttcgccgggcatgcaaggcaggccgcccgcgcctccgcgccactgctgtccaacaggttcatggcgtc

SEQ ID NO: 1096 - DNA, 384 bp, Zea mays
  Clone ID: LIB143-054-Q1-E1-A3
acccacgcgtcaggtccttcctccgtcttcctcctctgccgactggacatgctgggcgtcgcgcggaggcggctcggatccggatgcgtgctcgcccagctggcgcaggccctccgcgccgccgccgctcccgccaggacctactccgccgcggccaaggagataactgtacgggaagcattgaatactgcattagatgaagaaatgtcagcagacccttctgttttcttgatgggagaagaggttggcgagtaccaaggtgcatacaagatatccaagggtttgcttgacaagtatggcccggatagggttctcgatactccgatcactgaggcgggcttcactggcattggtgttggtgccgcttaccatggtcttcgacct

SEQ ID NO: 1097 - DNA, 389 bp, Zea mays
  Clone ID: LIB143-054-Q1-E1-A4
acgacaagtgcgggtgcgccgtgccgtgccccggcggcaaagactgcaggtgcacgtcggggagcggcgggcagcgggagcacacgacttgcggctgcggggagcactgcgagtgcagcccgtgcacgtgtggccgggccacgatgccgtccggccgcgagaacaggagggctaactgctcctgcggggcgtcctgcaactgcgcatcctgcgcctcggcctgatccgtgcgcctcgccctcgtgctaccgcgctgcctagtggagggagttgtctagtgaggctggagacgaagcaactagcactacttctaataaagggcttgtgtcatgctcgccagacgcatcacgcgctgcatctgcatcgtggtatcgtgtagtaagtttgtg

SEQ ID NO: 1098 - DNA, 398 bp, Zea mays
  unsure at all n locations
  Clone ID: LIB143-054-Q1-E1-A5
aggtccttcctccgtcttcctcctctgccgactgccctcatccactccactcccaagtccccaccacccccaaccccgtctctccactgcggcgcaggcttcgcttcggctccgctcggctcgagcagaagaaaatgcaacgggcagtgcagaccgtcaggtcacacggcaatgttcttaaatatgctgttctacaacacatcagcgctcccaagccagcaatgcttcctgctgccttttctcgtttcatgtcagtttcatctgctcgcctagaggatcgtggatttgaaactgccactgtagcagatgtcttgaagtctaaagggaagagtgctgatggatcttggctctggtgcnacacagaggatagcgtctatgacgctgtcaaatctatgact

SEQ ID NO: 1099 - DNA, 316 bp, Zea mays
  Clone ID: LIB143-054-Q1-E1-A6
aggtccttcgtccgtcttcctcctctgccgactgccctcatcgactccactcccaagtcgacacgacggcacaaggagtctctcaactgcggctcaggcgacgattcggatcggctcggctccagcagtagaaagtgcaacaggcagtgcagaccgtcaagtcagacggcaatgtgctcaagtagggtgttctacaacagatcatcgcgcgcaaccgagcaatgcttcctgctgccttttctcgtatcacgtcacttacatctgcgagtctacaagataggcgagttaaaactgacacagtaccacatctcatgaa

SEQ ID NO: 1100 - DNA, 80 bp, Zea mays
  Clone ID: LIB143-054-Q1-E1-A7
acccacgcgtcagatgatattgatatattgttggacaacaatagatgcatattgttcccctgtcaaatcgacacgggaat

SEQ ID NO: 1101 - DNA, 420 bp, Zea mays
  Clone ID: LIB143-053-Q1-E1-H11
tagtctcagtctcacgagttcttgttcgtctccgcctcaggcaaactccacacggacacggtcacacctcgctcgctctcgctcccgtatcgcggtttccttttcgaagccttgctaggtttagctggggcctccgtctatcctgtcaatggccccttaggcggctgtacttcagacttcagaggtgacgtgaggcgtggggacgcgcgtagctgattggttcgaggaggcggggatggacccggacttctcgccggcgagtgggggcccgagctttgagttcgccttcaactcggtcaacttctctgaccgggtgttgcggatcgagatcgtcgctggggatgacgccctcggggccaagggcgccaccggcgaagggtgctcatctcttgccgactgggcgtgccaccgcaagcgacg

SEQ ID NO: 1102 - DNA, 125 bp, Zea mays
  Clone ID: LIB143-053-Q1-E1-F2
gcgtctgactcaaacgccgctcccgccacctctctgcgaccgtcgccatggggaccaaggcctgcgagatgcaatcgccaaatcacgactacgccatacccgaattccaggtatcgccgtggtgt

SEQ ID NO: 1103 - DNA, 404 bp, Zea mays
  Clone ID: LIB143-053-Q1-E1-F5
ttttcctactcaggggtggcatgagaagtgtagaattcaaagtcatagagactgatcctgcagagtattgtatcgttgcaccagatacagaaatattttgtgagggtgagcctattaagagggaggacgaggaaagactcgatgaggttggctatgacgatgttggtggagttagaaagcagatggcccaaatcagggaactggttgaacttccattgcgtcatccccagcttttcaagtctattggtgtgaaaccaccaaagggcatattgctgtttgggcctcctggctccggcaagacccttattgctagagctgtagctaatgagacaggtgcattcttctttttgatcaatggaccagaaatcatgtcaaagctagcaggagaaagtgaaagcaatctc

SEQ ID NO: 1104 - DNA, 392 bp, Zea mays
  Clone ID: LIB143-053-Q1-E1-F7
aaaaaggcactggagaactcccccttccttgagaagctgaagaagaggggctatgaggttctgtacatggttgatgccattgacgagtatgctgttggtcagctcaaggagtttgagggcaagaagcttgtctctgccaccaaggagggtctgaagcttgatgagactgaggacgagaagaagaggaaggaggagctgaaggagaagtttgaggggctgtgcaaggtcatcaaggaggttctgggtgacaaagttgagaaggtggtggtgtctgatcgcgttgtggactcaccgtgctgccttgtgactggcgagtatggctggaccgccaacatggagaggatcatgaaggcacaagcccttagggactcgaacatggcgggctacatgtc

SEQ ID NO: 1105 - DNA, 443 bp, Zea mays
  Clone ID: LIB143-053-Q1-E1-F9
cgcgcgggtcgatacaagactctacagtggatcatgatatcaagaagaaggtggacgccaagaacgcgctcgagaattatgcctacaacatgaggaacaccatcaaggacgacaagatcgcctccaagctccccgctgaggacaagaagaagatcgaagatgccgttgacggcgccatcagctggctggacagcaaccagctggctgaggtggaggagttcgaagacaagatgaaggagcttgaggggatctgcaaccccatcatcgcgaagatgtaccagggcgagggcgcgggcatgggcgctgctgctggcatggatgaggatgccccgtctggtgggagcggtgctggtcccaagatcgaggaggtggattaagttggttagtgttcgaggtttggtttggtgaggtgtgaagtgcctgaactctgatggttgtttgtg

SEQ ID NO: 1106 - DNA, 435 bp, Zea mays
  Clone ID: LIB143-053-Q1-E1-G2
tagtttggatcatctcaccggctcgaggagatcgtgacattgagaggacgatgggagggcgcgcgctcctcctcctcctcctggtctcggcgttggtctttcagatccacgcctccgacccgctgctgtacgagccgttcgatgaggactttgaggggagatgggtcgtctccaagaaggatgaataccaaggtgtgtggaggcatgccaagagtgatggtcatgaggactatggcctccttgttagtgagaaggcaaggaaatacgccataatcaaggagcttgatgagccagttaccttgaaggatgggacagtggtcctgcagtttgaagtgagacttcagaatggccttgaatgcggaggtgcctacattaagtacatccgccctcaggatgctggatgggatgccaaggagtttgataatgagactccat

SEQ ID NO: 1107 - DNA, 450 bp, Zea mays
  unsure at all n locations
  Clone ID: LIB143-053-Q1-E1-G4
tcatgggtcgatgcacgcctctacactgatgctcctcatataaccgccctggctccctctatcgccacacgaacgccgccaacccgaacccacctctcggtgcgctccgccatgcgtcnccacctccctccgctcatcatcttcctctccaccatcgtcggcatcttcacccagccactgcccctcggcacggtcgcgcccttctcagcctcggtgcagctacaaggacccaccgcgctggatgtgccccctccgctgcgtcctcaaccgtcgtggcccatcgactccaccgccgttgttggtcctccgccccaccaccttcaaccatcgcggcttccccgatgaggacgacaggaccgctacgaggacccgacgcgctggatgtgcgccctcctttgcgtcctctcggttctccctcggtcgcgccctctcgattctcccttcaccacg

SEQ ID NO: 1108 - DNA, 453 bp, Zea mays
  Clone ID: LIB143-053-Q1-E1-G8
ctcgttggtcgttacaacactctagattcactcgtattaaccgaatctgtgagccatgtcgaccaacaagggcagcgcggccaagggcggcggagggaagaagaaggaggtgaagaaggagacgaagctcgggatggcctataagaaggacgacaacttcggggagtggtactccgaggttgttgttaacagtgaaatgattgagtactatgacatttctggttgttatatattgaggccatgggcgatggaaatctgggagctactgaaagaattctttgatgcagaaattaaaaagctgaagctcaaaccatattatttccctttgtttgttactgagaatgttctacagaaggaaaaggaccacattgagggctttgcacctgaggtagcttgggttactaaatctgggaaatctgacctggaagcaccgattgcaatccgccccacaag

SEQ ID NO: 1109 - DNA, 414 bp, Zea mays
  Clone ID: LIB143-053-Q1-E1-H1
ggtcgacgcacgcctctagcgagtgtcattgtagaagcgtcgagcttttttcttctttgtcttgctgcgcaagaagaagggaaacgagaggagggcggcgatggcgaagaggctgctcccgtcgctgaaccgggtgctggtggagaagctggtgcagcccaagaagaccgccggcggcatcctcctcccggaaacatccaagcagctgaatgctgctaaagtggtggctgttggccctggtgagcgcgacaaggcaggcaatctgatcccagttgctctgaaggaaggcgacactgttcttctgcccgagtatggtggatctgaagtcaagcttgcggctgataaagagtacctcctcttcagagaggatgacattttgggcacacttgtggactgattcagatcgcgggcaag

SEQ ID NO: 1110 - DNA, 413 bp, Zea mays
  Clone ID: LIB143-053-Q1-E1-H10
acaagaccctacactgagtcgtactacaccttcctcttcctctacatctccatcctcaccgtcatgggcgtctccaagtccacctccaagtgcgccaccgtcggcatccagggcatcgcctggtccttcggcggcatgatcttcgccctcgtctactgcaccgccggcatctccggcgggcacatcaacccggcggtgaccttcgggctgttcctggcgaggaagttgtccctcaccagggcggtgttttacatcatcatgcagtgcctgggcgccatctgcggcgcgggcgtcgtcaaggggttccagcaggggctgtacatgggcaacggcggcggcgccaacgtcgtcgcgcccggctacaccaagggcgacggcctcggcgccgagatcgtcggcaccttcatcctcgt

SEQ ID NO: 1111 - DNA, 410 bp, Zea mays
  Clone ID: LIB143-053-Q1-E1-F11
tacaagactctacagtgactcgtattagtttcgctgtcttgttccgcgctccccaacccccctcccaaccccaaccccgtcccaacccccactacggccttccccccatggctcccctggcctcccttcctctcccgcccagtactgccgtcaccgctcgcttcctcgccgccctcgccatccgcgtgatcagcccatcgcggcccgcgctgccgctcctctcatccgcctccgcatgcggcttccctcacgcctctcgcgctccctgcagtgccgcccgcgagcaccgccgcggcaccgtgcgggaatgctctcgagctgatgctgctggagcagctccattatcaatgacactgttagacctcattgattcctgctggagatttttaatgccacatacaatcctagga

SEQ ID NO: 1112 - DNA, 443 bp, Zea mays
  unsure at all n locations
  Clone ID: LIB143-053-Q1-E1-C10
ccgggtcgatacacgactctacagacactccgtatactgtaccccaagcaccggcgcggcggcggcggctaccatggcagtcgggaagaacaagaggatctccaagggaaagaagggtggtaagaaaaagaccgtcgatcccttctctaagaaggactggtatgacatcaaggccccatcggtcttcagtgtgcgcaacattgggaagactctcgtgtccaggacacagggtaccaggattgcctctgatggtctgaagcacagagtctttgaggtttgtctagctgatcttcagggtgacgaggatcaggcttacaggaaaatcaggctccgtgctgaagatgtgcaaggcangaatgtgctcacaaacttctggggcatgaattttaccaccgataagctcagatctctagtaaagaagtggcagacattgattgaagccc

SEQ ID NO: 1113 - DNA, 436 bp, Zea mays
  unsure at all n locations
  Clone ID: LIB143-053-Q1-E1-C11
ctcgcgggtcgatacaagactctatatcaactctgactaatttgatgatcttcttcccaagtacctgagctttttgaagggtattgttgactcggacacgctgcccctgaatgtgtcacgagaaatgcttcaacaacatagcagtctcaagaccatcaagaagaagctgatccgcaaagcccttgacatgatcaggaaacttgctgaagaagaccctgatgagtacagcaacaaggataagacagatgaagagaaaagcgagatggaggagaagaagggccagtacgccaagttctggaatgagtttggcaaatcaatcaagctgggtatcatcgaagacgcgactaacagaaaccgccttgcgaagcttcttagatttgagagtaccaagtcggatggcaaacttgcctcncttgacgagtacatctcacggatg

SEQ ID NO: 1114 - DNA, 406 bp, Zea mays
  unsure at all n locations
  Clone ID: LIB143-053-Q1-E1-D10
gacattgatgatcctccctgcgctattgctgcaggagctcttttatttgttttggcaagtgatgtccaagacaataattcgctggattcagaaacttgtgtccatttccttcttaaattattaaaccctccagtgaatgttgttgatgccaaagcgccatcaataggttccaaacttcttggaatcagtaaatttcagatgcttaacagttccaataaggatgcagattctagttcagaggacatacttttaaaagttgaagaaatcctcttaagctgcaaagagatcaagccactagacagtgatgataagaaaacaacaaggccagaactatgttcaaagtggcttgctttgttgacaatggaaaaagcgtgcttgtctgctgttgcattanaggatacatctg

SEQ ID NO: 1115 - DNA, 423 bp, Zea mays
  Clone ID: LIB143-053-Q1-E1-D3
atctgggacaggacggagctgagcttctagcaacgtacagtgtatccgccatgagtcctttcggggcggtgatcacgccagaaaccctcaagtacatgtccaagtaccagggacgtgagatcacgcaggtggactgcgcacgggaggcgatgaggctgatccacgcggaagacaagaacctcaaggccgaggactcagcgtgggagctgaagaagaagttcggcaacggcgtgagcaccatggtcctcgtctacaacgccaccggggccagcctgagcctggtggacgacgggaaagactggatgggctccgtctacagctcgccgatcccggacaccttccacaacgggcagtggatcgccttcctccacgtcaagcccggctcgctggcgcagggcagccaggccgccagggtgttccgcg

SEQ ID NO: 1116 - DNA, 108 bp, Zea mays
  Clone ID: LIB143-053-Q1-E1-D4
ttcgatgcaagactctaaagtgagtcttattagttacaagcaagcatgctcacacataggcagttagcatctcactttgccttaggttctattcgagcggggtagcac

SEQ ID NO: 1117 - DNA, 439 bp, Zea mays
  Clone ID: LIB143-053-Q1-E1-D6
cgcgcgggtcgatgcaagcctctacactgagtcgtataagatcatgcaggcgcagaccctgtcggactcgagcaagcaggcgtacatgcgcggcaagagggtgctcgagatcaaccccaggcaccccatcatcaaggagctccgcgacaaggtcgcccaggacaacgagagcgaggagctgaagcacacggcgaggctggtgtaccagacggccctgatggagagcgggttcaacctccccgaccccaaggagttcgcgtccagcatctacaagtcggtgcagaagggcctggacctgagccccgacgcgaccgtggaggaggagaacgaggccgaggagcagccggaggtggagaaggagccggagccggagccgtcgtcctacgacaaggacgagctttaggctttcggatttgtttcaggtctagctagctcccgc

SEQ ID NO: 1118 - DNA, 447 bp, Zea mays
  Clone ID: LIB143-053-Q1-E1-E12
ctcgtgggtcgatacaatactctacaatgggtcataatatcgggttcatccggaacgaggacgcgcggaagtacatgcgccacctcccgcagttcccgcgccggccgttcgtcagcctgttcccgcggatgcagcccgtcgcgctggacctcatcgagcggatgctcaccttcaacccgctgcagaggatcacagtggaagaggcgctggagcacccgtacctggaacggctacacgacgtcgccgacgagcccatctgcacggacccgttctcgttcgacttcgagcagcaggctctgacggaagaccaaatgaagcagctgatattcaacgaggccatcgaactcaaccccaacttccgatactagctagctagctagttcggacacacatcttaattatacgtttcaggctgtgtagtctgctgcaggtttcaagtgttcgtgt

SEQ ID NO: 1119 - DNA, 447 bp, Zea mays
  unsure at all n locations
  Clone ID: LIB143-053-Q1-E1-E2
ggtcgatgcaagcctctaaaatgactcctacgtagtgggctctagatcccgatggcctcgcgccgccgcaccctgctcaaggtcatcatcctcggcgacagcggggttgggaagacgtctttgatgaaccaatatgtgaacaagaagttcagcaaccagtacaaggctacgattggggcggatttcctcaccaaggaggtgcagttcgaggacaggctcttcactctgcaaatatgggacactgctggtcaggaaaggtttcagagtcttggcgttgcattctaccggggagcagattgttgtgtcctagtctatgatgttaattctatgaaatcgtttgataatcttcacaactggcgtgaagagtttctaattcaggcgagcccatcagatcctgacaatttcccttttgttctgttgggtaacanagttgatgtagatggtggg

SEQ ID NO: 1120 - DNA, 448 bp, Zea mays
  Clone ID: LIB143-053-Q1-E1-E9
cgcgtaggtcaatacaacaccctacagtgagtcttatcattggaagggtgatgacagatggaaggcttaatgctcgcgtgaaatgtgatttgacagacaatctgatgctgaaagtaaatgcacagcttacccaagaggcacattactcacaaggaatgtttaactttgactacaagggaagtgactatcgagcacaattccaaatagggaacaatgcattctatggtgcaaattatattcagagtgttactccgaacctatcaatgggaactgaaatgttctggcttggtcaccaaaggaagtctggaattggttttgcctgtcgctataacacggacaaaatggtgggcactctacaggtcgcaagcactggaatagttgccttaagttatgtccagaagatttctgagaaggtttcccttgcgtctgatttcatgtaaaaccataa

SEQ ID NO: 1121 - DNA, 389 bp, Zea mays
  Clone ID: LIB143-053-Q1-E1-F1
ggatggatagaaagggagaatcggttagaagaaagaagagtccgaaagctaagtaatttacctcaactttactgcccatgttattaagatctattgatgatcgtcccacttactcctaggatgcacagacttaatggatcctggactaacatatttatcacgggttttgggttgtcttccttcccagttttgttttaccagtggagacacggagattggaggacagaagggcgcagcacaggactacagcgaggtgggaaggccagatcaagcaggagacaacaagaggatgtgataaatggtgatctctgcgagcagtatccctccctcccagctgatatgtagaggaagattgctgatcatctggatagaacttcgaagcctgcagc

SEQ ID NO: 1122 - DNA, 427 bp, Zea mays
  Clone ID: LIB143-053-Q1-E1-F10
tcgtgggtcgatacaagactctagaatgagtcgtatcatttcttggctggacaagtatgggttggtggtcttcttcagaagggcagtgatgtcgtctatgttactgatgatggtcaggaacagcagtacaatgtgcctcaagtcaagggtcatcgacttagaggtgggccacagatgattcagctgagcttggatggcaagaggatatacgtgacaaactcacttttcagccgatgggatgagcagtttttcggtgatgatcttgtcaagaagggctcccacatgttgcagatcgatgtcgacaccgagaaaggaggcctggctgtcaaccccaacttcttcgtcgattttggcaccgagcctgatggtcctgccctggcccacgagatgagatatcctggtggggactgcacctctgatatatgga

SEQ ID NO: 1123 - DNA, 423 bp, Zea mays
  Clone ID: LIB143-052-Q1-E1-H12
tatctctaaagtgagtcgtatctatcatcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaataccacggtcctcgccgcgccgaccaccaaggccagcgccggcggcttcgaggcggccaccgatggcggcggctgcgactgcaacacctgcaactgcggcaccagctgctgctgctcctgctgcagctgcaactgagccggtcaggcgatggcgcacgagagtctagaggacgacgacgagtcgtatacatataatagcggcgtctaaataagatcctgtcaactgcacccgcc

SEQ ID NO: 1124 - DNA, 401 bp, Zea mays
  Clone ID: LIB143-052-Q1-E1-H2
acgcgtctagaggacgccgcaccatggcgacggcacaggcagcgtcggcgtccccaacccaccaccgcgcgtctccagggacgtcgccgccgcagccgccgtaccccagcgccgccaggatcgccgactccgcctgcttcccccagtacaccgcctcgctcaagtgtttggaggccaaccaggacaagaccaagtgccagcagcagttcgacgattacaaggaatgcaagaagaaagagagggaggctcggctggaacggaataaaaccagatcactctttgggtgaacaatggcgtcccacctgagcaatatgctggcggtgcaataagtctcctgctgatgtgagcgaaatcacggcttttttctttggtttcatgatgatcctctgcaacttgtgcaa

SEQ ID NO: 1125 - DNA, 420 bp, Zea mays
  Clone ID: LIB143-052-Q1-E1-H3
tacagacacttgggtaataactgaagaactaggaatgaaccttgagaattttgagcctcacatgctgggtacatgcaaaaaggtgaccgtctctaaggatgacactgttattcttgatggagccggagacaagaagtccattgaagagagggcagagcagattagatcagcaattgagaatagcacttcagattatgataaggaaaagctccaggagcggttggcaaagctctctggaggtgttgctgttctgaagattggaggagccagcgaagcagaagttggtgagaagaaggatagagtgacagatgcactgaatgctactaaagctgccgttgaagagggtattgtaccaggtggtggtgttgctcttctctatgcatcgaaggagcttgataaattgcagacagcgaacttcga

SEQ ID NO: 1126 - DNA, 165 bp, Zea mays
  Clone ID: LIB143-052-Q1-E1-H4
atcgttcgagttaaatcttcgtcgctctcacgatctcatccctcccaatatttcgtcgtccacctcaaatagccgaactgaatcccagattactcagaaatttccaccgaaaagggaacagaacgagccagccctcgccaaaatgccaaacgaacctgctcccct

SEQ ID NO: 1127 - DNA, 413 bp, Zea mays
  Clone ID: LIB143-052-Q1-E1-H7
tagtcagcattatgcaatagtagtgcagcacacgttgtttaatttatcctctcttcctaaatgcatatagctcggttggtatatagtttcacttggcttcgtgtgcagcagaagcatgtcaagatcgagcgttggatggatgaacggatggacctgacgagatgcagctttcggtcgaccatccggagcaatggggctggggtttcttgtccaaggacaactattttcccttgttctctgttcatttctttcagctgcaccctgcagtaggcagagttgtcaagatagatagctcgttatgaaatgcagtgagtgacactgttaccttccattcaggagggagaaaaaggtaaggctcataaaatgcagggaactgcttgctgctgcaccttgtgattatataacaaccgaag

SEQ ID NO: 1128 - DNA, 336 bp, Zea mays
  Clone ID: LIB143-052-Q1-E1-H8
acgcgtccagccaatcttgaaaagatgaaattgcccactaagctttctggggcaactggagactccagtcgtcagggatcagaagatactgcacgccgtcctccttcagtgaaagcttctctgtcagtttcctttggacagcgtgctccacatcgggcttccaccagggattcatctccagttcgtccaacaatcaaccgttaaggtcaacgaagttcaaaatcaacaaccccgtctaattggtacccttgagggtcctgatcatgacggttctgaccgggaactggatcattctagtcgtgaccgtgacagagcccgggatcgttcaaaccggga

SEQ ID NO: 1129 - DNA, 411 bp, Zea mays
  unsure at all n locations
  Clone ID: LIB143-052-Q1-E1-H9
cgggtcgatgcaagcgtctaaatcgagtccgaatatcgcgatcagagcaggagcaggcaacgcgcaccgaaatcttccaatccacaagactcgctacttcgcagttggcagactcgcccgcagcgagccgctagcaaccaagcagaaatgtcgctggtgaggcgcggcagcgtgttcgacccattctccgtggacctcttcgaccccttcgacagcgtgttccgctccatcgtgccgtcgtcgtcgtcggcggcggcggcctccgagaccgccgccttcgccagcgcccgcatcgactggaaggagacgcccgaggcgcacgtgttcaaggccgacctccccggcgtgaagaaggangaggtgaaggtggaggtggaggacggcaacgtgctgctcatcagcgggcagcgc

SEQ ID NO: 1130 - DNA, 228 bp, Zea mays
  Clone ID: LIB143-053-Q1-E1-A4
gtcgatgcaagactctaaagagagtcgtaggacccaagatcgaagaggtcgattaaattggttagcatcgggcggtttgttttggtgtggtctgaagtactcctgaactctgaaggttgtctgtgagatggggtggtgtccacagtctgtgggctgtggtcgaacttcttaataaatataagttttagttcctaatttgttttcgtaaaaaaaaaaatcgaacaatct

SEQ ID NO: 1131 - DNA, 275 bp, Zea mays
  Clone ID: LIB143-053-Q1-E1-A5
taaatctatacgtgagtcgtattatgtcagtcgcacactccagagtcggcgacggaacgctcatcatgatctcacctcgtcacgcttaactcgcacgacatctgtcgctgatgcgccgtggaaggtcattcgagggcttatggcgtgagctctggtaggtcttccagagctttcccttccgctcttgaagcagcagtatcagcatgctgttccccgcgttcggacgcacgagttgttctgagacagcggcattagatggcgcttctctctactgg

SEQ ID NO: 1132 - DNA, 77 bp, Zea mays
  Clone ID: LIB143-053-Q1-E1-A9
gtattacagcagatcttaatttgccccgttcgacaacaaattttggcacaagatcgaagggactaaacacatgaaca

SEQ ID NO: 1133 - DNA, 433 bp, Zea mays
  Clone ID: LIB143-052-Q1-E1-H10
gtcgagcacgcgtccacgacgaatcatggcaggctggccgtccgtgattgttttggaacgggcagcgtgtttggttggtgcctgtgctgtgccgccgttcgtctctgggtagcgtagcgacggcgccacggcggcttccggctcgtgcgcgcgcgcgcgtgtccgggcgagaagagctgccaagggatggaggcgctgaggaagcaggcgagcaagttcaaggagcaggtcgccaagcagcagcaggctgttataaagcaattcagtactactggctatgagcggtcagattccattgtaattgatgaggttgaactacagagacatcaacagcttgagaaattgtatacttctactcgttctgtaagggatttccagaaggacatagttagagcagctgaaggtttggtgtctattggaaacaaacatattg

SEQ ID NO: 1134 - DNA, 255 bp, Zea mays
  Clone ID: LIB143-053-Q1-E1-B3
ggtcattgcaccactctagactgagtcatattacggcagctatcgtttgctgagtctaatgatcccaagtctcacagtaagcaggtgtctgctatcagaacatttcccgcttagtcaaccaatccatccacggttctgccatcacacgggagtttctgtaagctgtgatagtcgatctgacatacattcccagcctcatgtcactacagatatcttggattcagtcatagctgattggccttgccatctccaatc

SEQ ID NO: 1135 - DNA, 364 bp, Zea mays
  Clone ID: LIB143-052-Q1-E1-F5
aaagtcatccagtacagcttcgacgacgacggcaacaaggtccgggtcacgaccaccacccgcgtccgcaaactcgctcgggcgcgcctctcccgcagcgccatcgagcgccgccagtggcctaagtttgggggacccctcaaaggagacgccgggtccaagcccaacaaggtccccaccgaggagattctcctcgaacgcccccgcgccccagggagcaaagctgaagaatcagctgcatctggtgattcgctggctaaggccaacaagggaagtgctgttctcaaggtttgcaaaacctgttggaagaagggccatcactggacctcaaagtgtccgtacaaggaactggcaacaccgactg

SEQ ID NO: 1136 - DNA, 419 bp, Zea mays
  Clone ID: LIB143-052-Q1-E1-F6
tcgcgggccgacacacgcgtctacacttctgcattcaaaaaaccgagctagggttttagggggagacagagaagcagacggaggctccatggacaaccccgagatgcagcgattcattcagaaagagcagcagaaggcgatgatgaacgagatggtcggcaagctaacgagcgcgtgctgggacaaatgcatcaccagcgctcccgggagcaagttcagctccggggaatcaacctgcctgaccaactgcgctcagaggttcctcgacttgagcgtgctgattgccaaacgcttcgagatgcagtgaggcgtcgtcactcgaagctgttgcctggtcaatcgccctaagcttttcctttgatttgaggttccattgaggactttcggacgattcaacacagagtttagtggtttttttt

SEQ ID NO: 1137 - DNA, 394 bp, Zea mays
  Clone ID: LIB143-052-Q1-E1-F7
ctctgctaagcgaagcgaagcttcaagctagtctcggcggctctagaagacgatgggcaaggacgacgtgatcgagagcggcgctggcggcggcgagttcgctgccaaggactacacggaccctcccccggcgccgctgatcgacgcggccgagctggggtcctggtcgctgtaccgcgccgtgatcgccgagttcatcgccacgctgctgtgcctgtacatcacggtggccaccgtgatcgggtacaagcaccagacggacgcgtcggcgtcgggcgccgacgcggcgtgcggccgcgtgggcgtgctgggcatctcctgggccttcggcggcatgatcgtcgtcctcgtccagtgcaccgccggcatctcggggggccacatctgccccgcc

SEQ ID NO: 1138 - DNA, 435 bp, Zea mays
  Clone ID: LIB143-052-Q1-E1-F8
ctcgcgggccgacacacgcgtccactggaaatgctcagaatgctgttgtcaaggcaagcagcaaggatgaacctgatagcaccgacaactcaaaagatgatgctggtagtgaagacaagaattcaaaagatgaagtgaaatccagcgaaggtaacgatggatccaagaccaatggtctttcaaccaaaaggaagctagaggagaatgaaggtgagtcatcagaggagaagggttctgctaaaactactaccagaaagaagcgcagaagaaagagccgcaactagttgctcagaagctatgcagctcatcatcttaggggcgttccgcccttgcagtctaaagtctcaagttgctggcatgggacatgccatgtatgctttatattgcctggaccgttttaacagcttagcgctttggcaatttgggcatcatgag

SEQ ID NO: 1139 - DNA, 418 bp, Zea mays
  Clone ID: LIB143-052-Q1-E1-F9
agtataaggaggcagatgcccattcactatgggtcgaaccgtctgaactatttcacagtctcgtcacctatcgcaacacagctcccgcatgctgttggagctgcctactctctgaagatggacaagaaggacgcgtgtgccatcacatactttggggacggtgggacaagtgagggagacttccatgcagcgctcaacttcgcggctgttatggaggcaccggtgatcttcttctgccgcaacaatggctgggccatcagcactccgactactgaacaattcagaagtgatggagttgtcatccgtggccaggcttatgggatccgtggcatccgagtagatggcaatgatgctcttgctgtgtacagcgcaatccatgctgcccgagaaatggctgtaactgaaggaagaccaattt

SEQ ID NO: 1140 - DNA, 425 bp, Zea mays
  Clone ID: LIB143-052-Q1-E1-G1
cggacgcgtgggcaagcgcgcgcgcacacagagagagagagagagagagagagagagacaagacaacagcaacagatagaccgggccaagttcgtgagtccatcgtgtacatacggccgagtggcgacgccgtcgtcttcaccacgcacgccgcgcctcttccatagtctcgctcgcctccattaattccaatcctctctcctccgctagcgctccaccagcacgcaccggcagatgaagaacatggcgtctacgacggtacggtgatcaccttcatcatcacatcactcgttcatcgcccgccggcccgccggttgttggtaggccagggtcagccactcagccgagccagccatgaagctcgtcgtcgagatctccgacgcagccgacctcgcccccaaggacggcaccgcctcctgcaaccc

SEQ ID NO: 1141 - DNA, 397 bp, Zea mays
  Clone ID: LIB143-052-Q1-E1-G10
cgtctaaccacacgtctgccaacgcgtccgccactgcctcgtgtggccgtcgtctcccgttcggaacgccaagcccccctccggcgaaatggcccccaagcgaggtggcagggcgccggtgccggccaagaagaagacggataaagtgacgaaccctctgtttgagaagaggccgaagcagttcggcatcggcggcgcgttgccgcccaagaaggacctgcaccggttcgtcaagtggcccaaggtcgtgcgtatccagcgccagcgccgcatcctcaagcagcgcctcaaggtaccaccggcgctcaaccagttcacccgcaccctcgacaagaacctcgctacgaacctgtttaagatgcttctcaagtaccggcctgaagacaaggctgccaag

SEQ ID NO: 1142 - DNA, 405 bp, Zea mays
  Clone ID: LIB143-052-Q1-E1-G12
ctctacactaactctgcataggtgaatctgcaagcccgcccgcccgtcgctcgccaccgccatgttcggcatcgtcttcccggaccacacctttcccctcgacgccaccgctttcgcgcaggtggcgcccaattcctgggtcctcgatctctccactctcgcgctcgccgccgcgccgcgctcggcagtcgtcttcctgctccccgctgccgtgacagcgctgccgcccggcaaggccgtctccgtctacttccaggccgccaccaaccgccccttcgcattcttaggtgcgctcgggcccacgcgcccctcggccagcttcccgcttccggaggccggcgacgagccggagcctgctgtgggccccgctaaactgggtgtcgccgtggaggacgcggccgctct

SEQ ID NO: 1143 - DNA, 371 bp, Zea mays
  Clone ID: LIB143-052-Q1-E1-G2
atgcagagtccagacgccagacgccctctacttctctctagttagtgtacatttcaaactcttggccgccgcctcgctctctgttcgccgcgccccgccgcagaaatggcgctgccgaatcagcaggttgtggattaccccagcttcaagctcgtcatcgttggcgacggtggaactggcaaaaccacatttgtgaagaggcatcttactggcgagtttgagaagaaatatgagcccaccattggtgttgaagttcagcctctcgattttagcactaactgtggcaaaattcgtttctattgctgggacactgctgggcaagaaaagttcgggtggcccacggatggctactacattcatgggcagtgtgc

SEQ ID NO: 1144 - DNA, 437 bp, Zea mays
  Clone ID: LIB143-052-Q1-E1-G3
ggtcgagccaagcgtcgacaccaaatctcttcttcttcttcactccgcctcctagcacagctagcgcctgctccccttcgcctgtgatcatgtcttgcagcagcggcaagtgcgactgtggctccagctgcgcctgcggcagctcatgcatctgcatgtcccctaacgtggagaccgccgccgccagcagcatcaagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactgagccggtcaggcgatggcgcacgagagtcgagaggacgacgacgagtcgtataaatataatagccgcgtctaaataagatcctgtcaactgcacccgccattatcg

SEQ ID NO: 1145 - DNA, 428 bp, Zea mays
  Clone ID: LIB143-052-Q1-E1-G4
acgcgtccacaaatgtttgttgtgaacgctgggagtggatttaagtggatctggaacagcgtgaagggcttccttgacccaaagacttcatccaagattcatgtgcttggttcgaactaccagagcaggcttcttgaagtaatggattcgagtgagctgccagaattccttggcggttcatgcacatgtagtgacaagggtggttgtcttggatcgaacaaagggccgtggaatgatccttatatattgaagctgatccacaatttggaagctggatgcgtgagggaaatcaaacctgtttctgagggggaagaaagaaacagctcatcctttcggttggaacagatgaaatggcagggcttgctaagtgatacatcaaatgctgaatctggatctgatgttgatgaatttggtgcatcatttgttca

SEQ ID NO: 1146 - DNA, 252 bp, Zea mays
  Clone ID: LIB143-052-Q1-E1-G5
aacccacgcatccaagtttatccttttttttcatagggtagaaaggaaagcgtaattatccttcgcaaaagctgttaactgtgtattgaggcagcttatgtcaatatgtactatacctgttggtatcgattgttttaatgatccaatgcatttgattggtaaaaaaaaaaaaaaaacaacacaaaaaaacaataattcaaaacaaaacaaaaacaaatagcactcgacaacaacttaaagggaagatgagga

SEQ ID NO: 1147 - DNA, 173 bp, Zea mays
  Clone ID: LIB143-052-Q1-E1-G7
cacgcgtctactctgagtcatataaacaagctaggagcctatgagcatcttacttgagttagtgctcgcaaataagcattccaggaggctgaatgttgatgctatgtttccagagaatagtgtgcatgatgctcatcagctcttgaatgtgcagttgttaccagagagcggta

SEQ ID NO: 1148 - DNA, 379 bp, Zea mays
  Clone ID: LIB143-052-Q1-E1-H1
acttcgccactccgcatctctagctggcctgtcgaggaccctcgccatcctccccaggcgcaccaccaaacggtccaaacccccagcggcggcgctaggatttgagtctcagcgcgccggcaccgccaccgccaccggcggtgatggcagggcaggagcgtaggacaatcgatctggaggagggatgggcgtttatgcagaagggtatcaccaagctgaagaacatcctcgagggcaagcccgagcctcagttcagctccgaggactacatgatgctctacacgacgatatacaacatgtgcacgcagaagccgccgcacgactactcgcagcagctctacgacaagtatcgggagtcgttcgaggagtatatcacctc

SEQ ID NO: 1149 - DNA, 399 bp, Zea mays
  Clone ID: LIB143-052-Q1-E1-F11
agaagtattggacataccacttccagaattacaagcgctgaagacattaaaagttacataccatcatgccacaaaagatgaggtgtcagttcacagtataagattgccaaaaaacagcactgttggcgatgtgctaaacgatatcaaaacaaaggttgagttatctcatcccaatgctgaactgagattacttgaggtcttttatcacaagatatacaaggtgtttgcaccaaatgaaaagattgaaaacattaatgatcagtactggacactgcgtgcggaggaggttccagatgaggagaaaaaccttggtccctttgatcgattgattcatgtatatcattttacaaaagatactcaaaaccaaacgcaagttcagaactttggagaacctttttt

SEQ ID NO: 1150 - DNA, 425 bp, Zea mays
  unsure at all n locations
  Clone ID: LIB143-052-Q1-E1-D6
agattgatccgtcgcccgcagggccacagcagccgcggcgaggtcgtccgtcggattcggaagctcaggcggaactgcaccccatggaaatggaatcgagagaacttacacgctgcttcgcaaccgtattatgcagttattactgaaaagataatacagtacctatggcttctctggacgccgtgcgaggagacctcgccctgctgattctgtacctgaacaaggccgaggcgcgggacaagatctgccgagcgatccagtacgggtccaagttcatcagcaacggcgagccagggcctgcgcagaacgtcgacaagtccaccagcctggcccggaaagtgttccggctctgtaagttcgtcaacgatctgcacgctttgatcagccctcctgccaaggggactccgctcncgctgattctactc

SEQ ID NO: 1151 - DNA, 418 bp, Zea mays
  Clone ID: LIB143-052-Q1-E1-D7
acaaggcaccacacctcttcctcctcttcctcctcctagcacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcgaggcggccaccgagggcggcggctgctactgcaacacctgcaactgcggcaccagctgcggctgctcctgctgcagctgcaactgagccggcccgcccggcccggcgatggcgcacgagagtcgagaggacgacgacgacgaggcgttaaaattatataccaacgtctaaataagatcctgtcaactg

SEQ ID NO: 1152 - DNA, 414 bp, Zea mays
  Clone ID: LIB143-052-Q1-E1-D8
accagctttaacatcattcccagcagcaccggtgctgccaaggctgtcggtaaggttcttcctgaattgaatggcaagctcactggcatgtccttccgggttcccaccgtggatgtgtcagttgttgacctcactgtcagaatcgagaagggggcctcttacgaggaaatcaagaaagctattaaggctgcttctgagggcccactcaagggtattatgggctacgtggaggaggatctggtttccaccgacttcaccggtgacagcaggtcgagcatcttcgacgccaaggccgggattgccctgaacgaccacttcatcaagctcgtctcttggtacgacaacgagtggggctacagcaaccgcgtcgtcgacctgatccgccacatgttcaagacccagtagaaagagata

SEQ ID NO: 1153 - DNA, 414 bp, Zea mays
  Clone ID: LIB143-052-Q1-E1-D9
aggagaaccctccgagcatcctagtgactcccatggctccggccatgtcggcgcagttcacaagaatcaccttcagcaacctgtttgtccgtcgggctggcccaggcagcacggagctgaccgtggagggaaggccatccgaccagctgggtaggagaaacctcactgacagccccgtatttgacggccgtggccctgacgccagcctcgtggctcgcgtacagggagtcgctacccagatgggcgacgtgcgccagttgtacaccgtcgtgttccaggagaggccgctcaagggctccacgctcgtcaccgaaggcgcgatgacggaagggtcagacgagtgggcgatctacggcggaactggagtgttcgcgatggcgagaggcgtcataaggagaacgtttcttgccgaca

SEQ ID NO: 1154 - DNA, 414 bp, Zea mays
  Clone ID: LIB143-052-Q1-E1-E10
agcgacagggcttgccctttccccgccccaagggtacacggtcgccgccacctgccctagccgcaggagggagcgttcgccgccccgccccgccctccgtctcccgtcgcctcgccccccgcgctccgtctgccgcccctctccggagaaatgtctgagcatctctttgaggacaccttcgtcgtcactagactcgaccctgatggcaaaaagtttgatagagtttctcgtgttgaagctcgcagcgagcagttagatatgtatatgcagctagatgttgccacagatgtttatcctatgcatgctggcgagaaatttaacatggttatagcgcctactctgaatttggatggcacccctgacactggctactatactcaggctggcagaaaaactctggcagacaattatgag

SEQ ID NO: 1155 - DNA, 410 bp, Zea mays
  Clone ID: LIB143-052-Q1-E1-E11
aagcagtatcaagtaacagcatactctcctacgcgaatcgattaacgggcggcactcacccaccgtgtggcctgccaaactgtcccctaggccccggccccgcccgcgcctggccagtggccatccatcccttcccttcgcttcgacgcaccaatcttgtcccggcgcctgccaaatccagcaaggccacacagcccgaggcaggaagggcagcgcaggaacagggagcgagcagcgcacgggcaatggcggcttcttccgggacgcgctccgtgcgcctgctggtgctgctgctctgccttctcgggttctgcgtcgcgctgagccaccaggagtcggcggcggactcgtgcgccagggccaaggtcgcggtcgccagcctcgtgcccttcgactccacgtccttccgc

SEQ ID NO: 1156 - DNA, 412 bp, Zea mays
  Clone ID: LIB143-052-Q1-E1-E12
actcatccgaagagatccgtcacactgcaagttttgaaaactgaactgtaagatggcatcagcagagctttcccgtgaggaaaatgtgtacatggcgaagctcgccgagcatgcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaacgct

SEQ ID NO: 1157 - DNA, 365 bp, Zea mays
  Clone ID: LIB143-052-Q1-E1-E2
acccacgcgtccggtcttcgataacaggaccaaggaccgaaggctccaagcgcagcaacttgacaaattgctctatgtagtggactcggtttgtgcaaacaatggaggaaaaccatttacagatcaaatgttcactcgcatcaaggaggtgcatgatagggaaaaagaggtgcataccttgggatattcagatgagcagatatctgagttgaaggaggagattcatagaactagggatgaacagcttgcacagataaccagcatggtcgaggaaaagctaaaccgcactgtggagaagctgcaacagcagctcatggaggaacagaacgcaaggctggaggccgagaaggtggcgcatgaagcta

SEQ ID NO: 1158 - DNA, 370 bp, Zea mays
  Clone ID: LIB143-052-Q1-E1-E3
gcttgccacagtgaggtcatagaagatagctgaacaaggtcagatcattgaggtgttacggcacatgacatctcacttgataatgtatacacgtatcacacacaatcactgtgattagcagaccgatttccccacatccagcaatatgtgattttgtccaggccctgttgtaacctgtatgggtcatgatttctaatatatatcacgtattatatgtttggaagcaccgtttttaatactctgaataatccatacatttcattgcactgcgacgaagtggaaagagaagagaagtggatggcacagtacatgacaccttcccagcactgatactgtaaactttgtacctcacttattacgtacttattat

SEQ ID NO: 1159 - DNA, 415 bp, Zea mays
  Clone ID: LIB143-052-Q1-E1-E5
accagctttaacatcattcccagcagcaccggtgctgccaaggctgtcggtaaggttcttcctgaattgaatggcaagctcactggcatgtccttccgggttcccaccgtggatgtgtcagttgttgacctcactgtcagaatcgagaagggggcctcttacgaggaaatcaagaaagctattaaggctgcttctgagggcccactcaagggtattatgggctacgtggaggaggatctggtttccaccgacttcaccggtgacagcaggtcgagcatcttcgacgccaaggccgggattgccctgaacgaccacttcatcaagctcgtctcttggtacgacaacgagtggggctacagcaaccgcgtcgtcgacctgatccgccacatgttcaagaaccagtagagagagatat

SEQ ID NO: 1160 - DNA, 392 bp, Zea mays
  Clone ID: LIB143-052-Q1-E1-E6
tagaataacccggattcaatcccttcccaagggaatcctgcccccatagttgtatcaaaaagggcaaataccaatgatttttgcaaggctgttcttgttcaaaaataaccaagggcaagacttgaatccaggacattggggaccaatggggttggaatggggtactgtaattccgctgcaacaaccgaaccttaacgactccttgttgctgttgaaggccattctggattccgcttcagtgcaatggaagttgaaaccttggttaagtaccaactgcctgttgttgtaatcgttttcaacaacaaccgttttcaacgccgggacccgagaagccctgaccagattaccggaccctacaaagattacccagccccaaactcctttgttcccgc

SEQ ID NO: 1161 - DNA, 404 bp, Zea mays
  Clone ID: LIB143-052-Q1-E1-E7
gctccccatttcagaagcatatgctgtcatggagactgatgaagacgtgaagatgaacacacaaattgatgagatcaatgcatactcttttctttacccggtggaactgccagggaagaaatttaccttcaaatgggtagagtccagaaaaccagagcgatattcctctgcagcgccactatcgcctgatgcaaggcaacgtatcgtatcagagcgagttgacatgatacacaatgttgtcatctcggtctcgattgggccaccgaattcacgttttttgccttcaaaagacaagagctcgtgggatccaaaagatgttgctgattgcattttatctgatagatctaccatgaaggtgacaactggccagcgcatgacagagagttctgtccttgacgcacacg

SEQ ID NO: 1162 - DNA, 234 bp, Zea mays
  Clone ID: LIB143-052-Q1-E1-E8
aagttttcgagccattaggggccgaggctgagttgagtgtgtgaaacttcctatggcctgccacactcagttttcttatttgtgctgcaataataatgtatacaaaacagaaatgcgatgcccacagaaaaaataaatgttgtgtcttcatgaaaaaaaaaaaaaaaaaaaaaaaaaaaaaaaaacaaaaaaaaaagaaaacaagacaaaagaaaaagaacgataaaggcaacg

SEQ ID NO: 1163 - DNA, 392 bp, Zea mays
  unsure at all n locations
  Clone ID: LIB143-052-Q1-E1-E9
acccacacgtccggcgagagacgggcaggggagaggaaaaaaaaatctaaccctagcatccgcagcgctagggttcgggggttgcgatggcggcggcggcgagacagcgggggacggtgaagtggttcaacgacaccaagggcttcgggttcatctcccccgaggacggcagcgaagatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggcggangaagangcggcggcggctacggctcccgcggcggtggcggatctggcggccgc

SEQ ID NO: 1164 - DNA, 285 bp, Zea mays
  Clone ID: LIB143-052-Q1-E1-F1
tagcgcaacatcccagtacgtggactggtgcccgacggggttcaagtgcggcatcaactaccaggcgccaactgtggtgccgggtgccgacctcgccaaggtgcagcgtgccgtgtgcatgatctccaactccaccagcgtcgtcgaggtgttctcccgcatcaacagcaagttcgacctcatgtacgccaagcgcgcgttcgtgcactggtacgtcggcgagggcatggaggaaggggagttctccgaggcacgcgaggacctggccgccctggagaaggacta

SEQ ID NO: 1165 - DNA, 407 bp, Zea mays
  unsure at all n locations
  Clone ID: LIB143-052-Q1-E1-F10
acaataagtcacacaagaaggacatcagcggcaacccgagggcgctccggcggctgcgtaccgcgtgcgagagggcgaagaggacgctctcctccaccgcccagaccaccattgagatcgactcgctctacgagggcatcgacttctacgcgaccatcacccgggccaggttcgaggagcttaacatggacctcttcaggaagtgcatggagcccgtggagaagtgcctccgcgacgccaagatggacaagtcacagatccacgacgtcgtgctcgtcggaggttccacccgtatccccaaggtgcagcagctgctccaggacttcttcaacggcaaggagttgtgcaagagcatcaaccctgacgaggccgtcgcgtacggcgccgctgtccangccgccatcctc

SEQ ID NO: 1166 - DNA, 396 bp, Zea mays
  Clone ID: LIB143-052-Q1-E1-D5
gagacgagaaatatgcaagggcgaaaagtgtgtacgataaatcctgcaaggccatcaaatattacatgcagtccatgcattcacaggagcaagaaacagagcgtcgtccccggcatgtcccgataattctcaggtttgcgaaacaaaacactacaacagcgacgccagcaacacaatccaccgtgccaatgtcaaaagcaaatggagacaagtacactagagatgttacatggctagaaaaagttatccgttcggtcccctcctctcgagtgggagaattcacaggtaataaaggggggcctgggtggccatatgaccagacactgaaagggaagggggcggtggtacagaggatgatgatggattcccggtcgtgttgctccacgataagggcgc

SEQ ID NO: 1167 - DNA, 385 bp, Zea mays
  Clone ID: LIB143-052-Q1-E1-C10
agaactacacaacttctgatggatcggtgaaaattcaaaaagagagtgaggtgcggctgaagattattggtactcgtgtcgatgctacagaaattttttgcattggcacaataaaggatgattttctgggtgttatcagcgatcctggtgcggcagtgtaaatggtctaagaagcgagattgtactccattgttctgacttctgagtactatcgcagacgtgtgtaatcgctggtccgttaaaactgcaatggctgtactgactgcggaacttgttgagaatgatgtgactaggaccttgtttagggcctgtttggttctttagtatggccctgattggcacaactgctgtttattgaaaaaacagcttatctgataagctggtg

SEQ ID NO: 1168 - DNA, 409 bp, Zea mays
  unsure at all n locations
  Clone ID: LIB143-052-Q1-E1-C11
acgcagattcccacctgttccgccgccggccaccgcgttgctcccctcggcagccaggatgacagaagcaccatttctgccgcgtgagaagctcttcaagcagcaacattacttccagaacttgaccaagcacacctacctgaaagggcgctacgacgtgatcacatctgtcgccatcccccttgcactcgctgcctccagcatgttcatgattgggcgtggagtttataacatgtctcatggggttgggaagaaagagtgatcttccactggttaactattgtttctgcttggcatggaagtcataccgttgagactgcgaagtcctcttcgcttgcaaaataatacggccaaataacaattcgactacattttcgcatcaattttctgtntgtatttgtgggtgtga

SEQ ID NO: 1169 - DNA, 170 bp, Zea mays
  Clone ID: LIB143-052-Q1-E1-C2
ggtcggcccacgcgtctacggtaactcgtattaatgcgtcggatctgagtcgacatctagcgtcgcatcatctttcacttcacagagagtcgtttactggagtttctactgggaggagactagtacttcatagtcctcagcctgtgcatgatcccgttcgtgatccaggt

SEQ ID NO: 1170 - DNA, 372 bp, Zea mays
  Clone ID: LIB143-052-Q1-E1-C3
taggcagggtcatagcttacgctgctggggttatgggcgagcccgttcgtgctccgggcgcgcatcgcgctcagcctcaaaggcctcacctacgcttactccgaggagaacctcgacgacaagagcgagtttctcctcagctccaaccccgtgctcaagaaggtgcccgtgctcatccaccacggcaagcccgtctgcgagtcccagatcatcgtgcagtacgtcgacgaggctttccccgccgccgcacctaatttccttccatccgacccctacgaccgcgccattgctcgcttctgggcctcctacgtcgacgacaagttctacagcgcgtggatacccgtgttcaggggcaggacggcggaggagatg

SEQ ID NO: 1171 - DNA, 422 bp, Zea mays
  unsure at all n locations
  Clone ID: LIB143-052-Q1-E1-C4
aatcaagttttcatgtctgatctcgacattcagatcccaactgccttcgatcccttcgctgaggccaatgctggggactctggtgcggcagcagggtcaaaggactacgttcacgtgcgcatccagcagcgtaatggtcgcaagagcctgactaccgtccagggattgaagaaggagttcagctacagcaagatcctcaaagatctcaagaaagagttctgctgcaatggtacagtggtccaggacccagaacttggacaggtcattcagctccagggtgatcagaggaagaacgtctcgaatttcctcgtccaggccggcattgtgaagaaggagcacatcaagattcatggtttctgagcaaccgccgggtccataacanaccaaccctgcatgcagggccagcttattatatataatat

SEQ ID NO: 1172 - DNA, 427 bp, Zea mays
  Clone ID: LIB143-052-Q1-E1-C5
acaagcctctagcatgagtctcactaccactgctatccctgatgactggatgggtcttgatgttggccctgatgccacgaaaaccttcaacgaagcattggacaccaccaagactgttatttggaacggccccatgggagtgtttgagttcgagaagtttgcagctggaactgaggcgattgccaagaagctagctgagcttacaaccacgaagggtgtcactaccatcatcggcggcggcgactctgtcgctgctgtcgagaaggctgggctggcggacaagatgagccacatttcgaccggcggcggtgcgagcttggaactcttggaaggcaagactctacctggtgtccttgccctcgatgacgcctaaatccgctgctgctgctgctgctgctactcaggttctgccagctttgcgtgtcat

SEQ ID NO: 1173 - DNA, 421 bp, Zea mays
  Clone ID: LIB143-052-Q1-E1-C6
cgaaccccgtgttttgcggggagaaggcaagtcgttcgacgctcgtcgacgttcgaagttatgcgcaaatcggaatcgccatcgtccttacaaacaccgattgggtttgtttatggaccgagagatgatgatcgagccagtgatgtggtgccaaccacaagatgccgtggtggacgacctgaagaatggacttaactagtggatgctcgccaagcgagtacccccccagcaaacactatctaagtgttaaattaaagacaagccccggttttatgcataaccgtttatatatgctattttactacaattaatgtttgtaggtttgtactgtgcacttaagtgtaagagttgactgaaaccctagttgcatgaactcaggattcctttttgagatggatactagcatgctaggtcgagtagc

SEQ ID NO: 1174 - DNA, 382 bp, Zea mays
  Clone ID: LIB143-052-Q1-E1-C7
tatactgactcataacaatctgcttcagctagccccaagtttagtcggccgatcattcactgaagtagtaatggcctccgtcaacagctggaccctcgagatcgcgtcgccggtggctccgcagcgcctgttccgcgccgccgtgatggactggcacaccctggcgcccaaggtcgcctcccacgtcgtcgccagcgcgcagcccgtggagggcgacggcggcgttggcagcgtcaggcagttcaacttcacctcagtcatgccgttcagcttcatgaaggagcgtctcgagttcctggacgcggacaagtgcgagtgcaagaacacgctcatcgagggcggcggcatcggcgtcgccatcgaaacggcgacgtcgcacatc

SEQ ID NO: 1175 - DNA, 405 bp, Zea mays
  Clone ID: LIB143-052-Q1-E1-C9
accagttcatagtcggcgccaccaacccgggcctcaggggccagagcctcgcggccgtgctgtcggccggcatgtcggcgggcaagagcggcagggagctccaggccatcgaggacgagtggctggccgcggcgcggctcaagaccttctccgagtgcgtcagggacgccatcgcgggcctcggcgtcgcgggccaggagaagcagcgcaggctccaggagtgggaccgcgccaccggcggctacgacaggtgcgtgtccaacgaccaggcgcgcgacatcgccgccagcctcggcgtcacgtccgtgttctgggactgggacctgccgcggaccagggaagggttctaccgcttcagggggtccgtggcggcggccgtggtccggggccgcgccttcgcgccgc

SEQ ID NO: 1176 - DNA, 415 bp, Zea mays
  Clone ID: LIB143-052-Q1-E1-D1
acggacgcgtgggttaggacatggtgaagaggagaatatggaagaaggaacagatgtacatctttgtgatattaatggcaaagaagtagatgaaaccttgttagaaaatagtgtgtgtacagatactgaagaaggatgtgctcattgtaaccaggaagaccagaattcatctgacagcaccaacagaggaaaaagtgatgtagataacatgtgttatacatcttgtgacgaggttaggtctgaatcattttcaggcgatgaagttgttatcaaaactacaattgatagcactgccagaacatttgttaatttgaaagatgagcaggttttgtcttcagaaatgtatacccgcatgcagcactcaatgcacaaagatggtactgctggctttcagacatctgggggtgttcctggt

SEQ ID NO: 1177 - DNA, 407 bp, Zea mays
  Clone ID: LIB143-052-Q1-E1-D10
acattcaccaaaccctacgctcgctcgctcgccggagccctcattgaaccgagcaggcgggcggaggaggctcgacgatgttccgcaaccagtacgacaccgacgtgaccacgtggagcccccaggggcggctcttccaggtggagtacgccatggaggccgtcaagcagggctccgcctgcgtggggctccggtcccgcacccacgccgtcctcgccgccgtcaacaagcccgcctccgagctctcctcctaccagcggaaggtgttccgcgtcgccgaccacgccggggtcgcgctcgccggcctcaccgccgacggccgcgtcctctcgcgcttcctccgcaacgagtgcatcaaccactccttcgtctacgaggcgccgctccccgtctccaggctcgcgctc

SEQ ID NO: 1178 - DNA, 426 bp, Zea mays
  unsure at all n locations
  Clone ID: LIB143-052-Q1-E1-D12
gcaagcctctaaactgagtcctattagatgtgtctcatcctagaccattcgatttccatcatcatactctcccaccagcagttccttctaaccagcagccttctaccattcctgttgagaatgctccagtacctcatcataacagatggccagagtattctggtggtgttggtctatcctattcatctcatcggcctccatatggtcagcatcaacctcctgggaatcttgattcaggaagtaacttggtttatccctctttccagagatatccatcaaatctaccagtcagtaacaatattggtcccttatctgatgccgatttgactaaatcgtctatcanaccccactacaatccatttgcatctacctttgataaaacagatccaagtctagatattgggcctcctgtaagccctaatgcag

SEQ ID NO: 1179 - DNA, 424 bp, Zea mays
  Clone ID: LIB143-052-Q1-E1-D4
acgtgttttgagggaacggcagcatcagaatcaaacatatttgtcaagcaggtcttctaaccagtctaatcaaaatgctatcaagcagacacaggatcaatctgacgatgatgacatcagcagcgatacttcctacaggagaactcgtagcggacgtcgtcgtggtgctgcccgtcttgccgtgccaaaacaagaggactccagtgattctgaagaagttgttgttgtgaaaaagaatcgacggaaacgtaagaaatctgtgcataaacacagggctggatctaagttgaagcatacttctggtagtcctcccaaaacaggtcgtttgggtagacctccacttgtcaaatctgaatgtggctgcttacctctgcagccaggaaaagggaactgaatgttcctgaacggtcaggagctctacgcg

SEQ ID NO: 1180 - DNA, 415 bp, Zea mays
  Clone ID: LIB143-052-Q1-E1-B7
actctggcctgtcgttggtatcgttgtcgccggcaaccaaggcggcggtgccgatttctcctccggtggtggctgccagcggtactaccaccagcgccagattttgtggcaccaccatgccaccatctggctccgaggtcatcaacatgcactcgcaggctcagcagcaagccagcaggaaggcaaggcggtgctggtcaccggagcttcaccggcggttcgttgccgctttgcacgaactcggtggccctcaagtggctactccgaaacagatcagggaggtgatgcaagtggacgggcttacaaacgatgaagtgaaaagccatctccagaagtaccggttgcacaacagaagatcctcccccggcgcggcggcggctccggtgagccagtcgatcatgctggtggatggcgt

SEQ ID NO: 1181 - DNA, 393 bp, Zea mays
  Clone ID: LIB143-051-Q1-E1-H9
acgctcgtggctgccctgctcatactgcttgccctcgccgtatcgtccacccgcaacgcacaggaggattccatggccgacaacaccgggacgttggcgggcggcatcaaggacgtgccggggaacgagaacgaccttcacctccaggaactcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtgaagaagctctacgaagctaaggtctgggagaagccatgggagaacttcaaggagctgcaggaattcaagcctgttgaagagggtgctagcgcctaaggatctctc

SEQ ID NO: 1182 - DNA, 426 bp, Zea mays
  Clone ID: LIB143-052-Q1-E1-A1
taaagaaaggtgtacgaaagtataccgaattactaggacaagggacaaaacagaaagctatgggggtgggggaaacctgcttttccatctctttgctgccaaagaatagataaaagttgatgtcatgtttgtgcagaaacaaggttgtaatggaaggtttcatgactgcaataattcagtttcttgaagcgttagaatcattctatgttgttgaaagagatggttcaatcatcctttttttggttactcttggtggttgtcattcttcagattacatcaaaaagatgacattatcccttggtctcaagaaaatattcttgcttactacacgaactgcagacgaatatttacctctgttattctcttgacttattactatgtgcaaatagtagcaatgctccaattttcagtttttcgtatgcttgc

SEQ ID NO: 1183 - DNA, 414 bp, Zea mays
  Clone ID: LIB143-052-Q1-E1-A10
gggtcgacgcacgcctctagcataagtcgtgataacctcaaacctcacggctcacgccagcgtccgcgagccccgttctccggcgatcctgtcatgccagacgcgtctccgccccgctcggtccaccaccccgacgccgccacatgtctgcgcagtccatttcgccggcctctgcgtgcgcgcagttcacctacccggcggcagcggccccggctgacttccccgtgcccttccacctccatggggcgcaatacaccgcatggaccggagccgcgccggcggtgcctgtgtacaacgccagctatcccatgccccaggtccagcaggggcaacagttgtgccagtgggactcgaagataattactcctgaagcgctagctacttgtaaggctgctattgcaaatagtgagaaag

SEQ ID NO: 1184 - DNA, 446 bp, Zea mays
  Clone ID: LIB143-052-Q1-E1-A12
gtcgatacaagactctagattgagtcgtattaggactgtccatgtgtcgccgacttgacaaatggtccttagttgatgtcaattcgtcgatgcattttcctgcttctccaggagcacatagcacaacagaggatccgattgcgtgaaacccttcaacatattgcacgactgcattaacgcacatccagacgcagtctccaacgagattttggacgaagacgacaatgacgacgacgcagatgagtccaacctgagagttagagctcgatcatggtccagataatccaaccctaacgtttgagattgcatgatattaaatgatactcgtatagaacttctcaagtactggagtatcggaatgattttaaagagcacaaaggcatcatatattgaatggcagtcatatccatattatctttggtacaaaactcccacgtttttttttt

SEQ ID NO: 1185 - DNA, 424 bp, Zea mays
  unsure at all n locations
  Clone ID: LIB143-052-Q1-E1-A2
agatgcaatctgacaaggaaaaactttggattacaaataagattgcacattcttgggttactgttccattggagacgaataaagaggaatggtttgtaaagcaaggtgatatggtcaagcaggtcattggcagttccccagttcatttccaaacaaactacaaggagagcatgggcgaagataaaattatattctgtggtagtgaactattctacgtgccccggcggtttgttgaggactttggtgaccttgtgggtcttgtcggcaatttggatttgcatcacaagattgcggtcccaatgttcttcttggcaatggactcgactcaaaattttgactctgatgctctggctggaacagtgttcaggccacagttgccagctaatgcgacgttctcgtcnatttatacagctcaagcacctgc

SEQ ID NO: 1186 - DNA, 399 bp, Zea mays
  Clone ID: LIB143-052-Q1-E1-A3
gtaaaacggctgggcaggaaaggtaccaagcaattacaattgcttactaccgaggagctgtcggggcgttgctagtcaacgatgtcactaaattaataacatttgaaaatgtgaaaaggtggttgaaggagctccgggaccatgctgactcgaacatagtcgtaatgctcattggcaacaagactgaccttaggcacctgcgctctgtcgccgttgaggatgctgcaagctttgcacatagcgaatgtttgttcttcatcgagacctctgcgctcgatgcgacaaacgtcgagaaggccttccacaccgttctagccgagatctaccggataatcagcaagaagcccctgtcttcggaggagtctggtttggggtccggtaacctcagacaaggacagt

SEQ ID NO: 1187 - DNA, 418 bp, Zea mays
  Clone ID: LIB143-052-Q1-E1-A6
acaacgcgctagctagttctattgccgcaccccagatctccaggagggactcgttctttcagctaactacactgcacgcaatggccaccacggcgaccgaggcggcgccggcgcaggagcagcaggccaacggcaacggcgagcagaagacgcggcactccgaggtcggccacaagagcctgctcaagagcgacgacctctaccagtacatcctggacacgagcgtgtacccgcgggagccggagagcatgaaggagctccgcgaggtcaccgccaagcacccatggaacctgatgacgacctccgccgacgaggggcagttcctgaacatgctcatcaagctcatcggcgccaagaagaccatggagatcggcgtgtacaccggctactccctcctcgccacggcgctcgccctccg

SEQ ID NO: 1188 - DNA, 432 bp, Zea mays
  Clone ID: LIB143-052-Q1-E1-A7
ctcgcgggccgacccacgcgtctacggctctcctggtcagcgccgtcgtcgagttcctcctcaacttcgtcgcgctcaacaatggcatactcggcatctttctcaacctcttcagatgtaagctggtgatcccactgaaccgggaggcgcccaacttccggtccatgatcgggatgatcgacgggaggacggagctgaagccgctgccagccagcggcggcccagaggaccggcggctgcaggtggtgggcgtctccgccgccgccggatccggcggcgatgactactacttggacgtggagagcggcagcgcggcggtgccgctggtgcagcagcagtacgtgaacgggcggctcgtccgcctccgcaccttctccgtgttcgaggtgagcatgatggccgccaagatcgcctacgagaacgccgcctaca

SEQ ID NO: 1189 - DNA, 426 bp, Zea mays
  Clone ID: LIB143-052-Q1-E1-A8
aagctgtctcccgaccactccgccgcccgctccaatggcggcgccggccagctcctcatgcttccacccacgcgcgaccgccagcccgccgtcttctctcagcgtcggcaccaaggtcttcgtcgggctcagggcgcagaccaagctcggttcgtcggagtcgtcatgcccgaatgtcagcgctgggttccacactgcggtcaaccggagaatctctctcaggttgtccaaaaagaaggcgaccagagcccgcatctcgatgatgcctattggtactccacgtgtgccttaccgaacacctggtgaaggaacctggcaatggcttgacatatggaacgctctgtaccgtgagcggattatcttcattggggacaatatagatgaagaattcagcaaccaagtgttggcaagcatgctctatcttga

SEQ ID NO: 1190 - DNA, 404 bp, Zea mays
  Clone ID: LIB143-052-Q1-E1-A9
ctcgtgggtcgatacaagcctctagagcgagtcattgaatagctcgtgcgtgctgtgcaaggaaagtaacccagcagatcgatcggtcgaggcgggtaggacaggatccagaggtagctagccatggcggaggaagcgtctgcgcctgcggcggggacggaagcgccgccggggaagatgacgatggtggtaggggtcgacgagagcgagcacagcttctacgcgctgcagtgggcactgcagcacttcttcccgccgggccagccgcagcagtaccgcctcgtcgtcgtcaccgccaagcccaccgccgcctccgccgtcggcctcgccggcccaagcgccgcggatgtgctgccgtacgtggaggcggatctcaagcgctccgccctgcgcgtcgtcgaaaa

SEQ ID NO: 1191 - DNA, 423 bp, Zea mays
  unsure at all n locations
  Clone ID: LIB143-052-Q1-E1-B1
cacgtagccgcacaactgacgcgagcccaggggcattccagaggtctggagctccacggtggagcccgcagatgcctgattcctcggacggcaggcgttcgtcttccagcaggcgccactcatctaaccccaagaactacgagtctaccattaggggcatgcagggcctaaactttgatggcgatgacagggtgcactattagcatctcatctgtctgggagggtatcgcctcccctccccatagatggatgtaccaaggacggccagataataagaggtttgggtgagtgagcccgagcagtccgggtgacgtctcgtangaactgtgtatgctgcttagcctctgttgttgtacaggcttgtcatttgtttggtctgcgctttacggtanggcgcgccttgtccggtgaacgatgatggtg

SEQ ID NO: 1192 - DNA, 418 bp, Zea mays
  Clone ID: LIB143-052-Q1-E1-B11
acagacactcggggcagccgccatactcctgtccacctgagtacctgaccggcatccttccccctcctgcccgatccctcgaggcggagatccctaggccgtcggccgggatggcgggggcgctggccctcgcggtgttgctcgccgtcgcgtcgctccatgctgaggcggtgtggctggacgtgccacagtcggggaccaagtgcgtgtcggaggagatccagtctaacgtggtggtgctcaccgactattccatcatgtacgagtcccacccctattcgcaccccaccatcgccgtcaaggttacttcaccatatgggaacaccttgcatcacagtgagaattctacagttggtcaatttgcattcacaaccgcagaagctggaaactacgttgcatgcttctgggttgatagtgc

SEQ ID NO: 1193 - DNA, 447 bp, Zea mays
  Clone ID: LIB143-052-Q1-E1-B12
ctcgtgggtcgatgcaagcctctaaagtgagtcatatgacgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggtgcccactcgcccttcgccgtcgcgatctccgaggaggagcgccacacgcagcagatgcagtccatcagtgcgtcgttggcgtctctgacgcgtgaaaccgggccgaaagtggtcaagggcgacccggccgcgaagggcgaggccgccgcgcagggcgcgccatcgacgccgagggcgcaccagcagcaccgccaccccgccgcccccgccat

SEQ ID NO: 1194 - DNA, 415 bp, Zea mays
  unsure at all n locations
  Clone ID: LIB143-052-Q1-E1-B2
tacagacactcgggtcatccttccgcggactagttttttctgaagattcggcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcanaagcttggtgctaatgcgattctggctgtgtc

SEQ ID NO: 1195 - DNA, 413 bp, Zea mays
  Clone ID: LIB143-051-Q1-E1-H8
cgacaaaggggaaaggttcgcttcttgtggcatcttgctttccttcgagtgccatggccgatccggcggaggagaacgttgtctcgccgccaccgacccctgcggccccagccgtgggcgcctcagacccgcccctgcagcctgctgctgacagcgcctcaacggagaaggtgtctgctccggcgccggaggtaaggtcccggggattcaggcttcttggagaggacacttccgtgcacaaatcccttgggggcggtaaaactgctgacgttctcttatggaaagacaagaaaacttctgctgttgtaataggcggcgcaactgtcatctgggttctgttcgaagtgcttgattaccacctcctgaccctgatatcccatgtactgattggtgtgcttgccaccttattcctg

SEQ ID NO: 1196 - DNA, 439 bp, Zea mays
  Clone ID: LIB143-051-Q1-E1-G2
gtccatacaagcctctaaagtgactcgtaggattctcctccccctccggttcgggttcgggttcgtgaggttctccggggttcggtttcgtgggtgggcggatcgagatggcggcgtcggatgttgagtaccgctgcttcgtctgcggcctcgcctgggccacggacgaccactccctccacaacgccttcagcacctacggcgaggtcctcgagtccaagatcatcctcgatctggacatgcagaggtcccgctgcttcagtctcgtcaacgtctccacggaggacgcgatgcggaatgccatcgagggcactaacgggaatgagctggacggccgcaacatcaccgtcaacgatgcgcagtcccgcggcggccgtgtaagctgctgcagttgctaccgtggatgccgtggaggcggcggctagggcagtggcgggcg

SEQ ID NO: 1197 - DNA, 435 bp, Zea mays
  Clone ID: LIB143-051-Q1-E1-G3
gggtcgcagcacgcgtccgaacacacgtccgccactccacgtcgtcgtcgtttgctgccgctgcgcaatggaggaggagcgctgcttcaacaactgggatctggacgccgtcgtccgcctgggctgccgccgccgcctctccccgccacggcagcccgacccgtttgcttcgcttctccctccgaccctgccgtcgccgtcgccgtcgccgccgcagaaggagaagcccgtggtgccagcgctggctaaaggaccagagccagagccatacgccgggtggcgctttcctaacctcggtgctggcggcgggcaagacggcgacgagctcatgagggccatgttagcagtccagccttccctgcctcagcctctgccaacgacaacgccaacgccaacgccaacgctttccccggcagcaggagagcatcgacagtc

SEQ ID NO: 1198 - DNA, 57 bp, Zea mays
  Clone ID: LIB143-051-Q1-E1-G4
tactccctgaggtgagtcgtattaaaaaggtccgtcggcgttaggtgggtgtgcgca

SEQ ID NO: 1199 - DNA, 376 bp, Zea mays
  Clone ID: LIB143-051-Q1-E1-G6
accacgcgtccgggcgcccaaggccgacaagaaggagtacgacgagacggatcttgcatatctgcagaagaagaaagatgaggaaaaagcactgaaggagcttaaggccaaggcacagaagggcgcgattgggggctcgggtctgaagaaaagtggaaagaaatgagactggtcacccgtctccaatacctagaggatgataaggcagctgtctatctgtgttgcgcttcactaagtgtgattgtaacagtggtacctcttgtgttctgtgttccgcgatgttgcagttggttgcttgatcgaaagatgtttcaacctcccatctgctagctatgatacagatggtcccctgataataatgatgacatattctgtg

SEQ ID NO: 1200 - DNA, 421 bp, Zea mays
  Clone ID: LIB143-051-Q1-E1-G7
attaagttaaacgatgttcaaatcgattggaattctgaggatctgagctaccttagggaggataagttttcaaccaaatttggaaaagaggtggctagtgccactcctctccgtggatcagatgctgtgttgaaagcccacaatatggctgaggatgtaaggatccaatacgacgaccaagaaggtttcgagcagatagctcgtcaatttggaatattcgaagaatggaaggatggcatcccaagaacggcttacaaaggagtggtggtcttccggtacaacagtagtcaaaggcgaatatttctcgtcagcccagattctcttcgtcagctgggggtgtagcatgttgagaaggtagatttttacccttggaatggcaaatatcatggaattgcttaactggtttctgtgaacatggagg

SEQ ID NO: 1201 - DNA, 426 bp, Zea mays
  Clone ID: LIB143-051-Q1-E1-G8
gaccatgcggccaggatggcaacccatcaggacgaggacgacgataaggacttcatatacgtattgctgtctcttcagaaggagtatggcctcaccagagaccatatcaaggctatcttgatagacatgttcgaggccggaaccgacacctcgtacatgacgttggagttcgccatgacggagctcatacggaagccacacctgatgaagaagctgcaggaagaagtgcggcggaacgtgccggcggggcaggagatggtcaccgaggacaacctccccggcatgacctacctcaaggccgtcatcaaggagacgctccgcctgcacccgccggtcccgctcctcctcccgcactactccctggacgcctgcgaggtcgccggctacaccatcccggccaacacccgcgtcgtcgtcaacgcctgg

SEQ ID NO: 1202 - DNA, 402 bp, Zea mays
  Clone ID: LIB143-051-Q1-E1-G9
tagaacatggttcttgtaccttacccagttcaatagttctctttctatcagaagcttcagttattacagtaggagcttcagtttggataatgttcttggtcccctcagattcatcatcattactatctgtgtgattcaagtctccagatgctgctttgcataaagtatcaagcttctcctgcaagcaaatcagttctcgagcaacagacttcctagcttcccttacacttggatgcaagccctggattgcgtcaagcttcaggagtaaattcataatagtttcacctatggccacttgctctttttgtgttggcttactgcaagaatctaaaaggcattgaatctgcttcctcacaacttgcatctgttcatgcacatgcttgatcttccagagtttatcca

SEQ ID NO: 1203 - DNA, 410 bp, Zea mays
  Clone ID: LIB143-051-Q1-E1-H10
cctggccgacccacgacgtctagtcggcttgaacaaaacagaacgtgttcgaggcagccatcgagacctcatatctggtgctggagtccgccatggccgagctcatgaaccacaggcgcgtcatgaagaagctgcaagcggaggtacgggcgtacggagcggagaagaagctggacatgatcagggaggacgacctgagcagcctgccgtacctaaaggcgtccatgaaggaagcgctgcggctgcacccaccggggcccctgctgctgccgcactactccaccgccgactgccagatcgacgggtaccacatccccgccaacacgcgcgtcctcgtgaacggctgggccatcggcagagacccggcggtctgggagaagcccgaggagttcatgccggagaagttcatg

SEQ ID NO: 1204 - DNA, 424 bp, Zea mays
  Clone ID: LIB143-051-Q1-E1-H11
ctcgcgggtcgacacaagcctctagagcaactcgtgcaagccgcgccaagcaacaaagagggaccccgcttccatggaggtggtgggcggcgtgtcgctgaggccgtcgccagcgccggcgcgtatccggactaccctgccacccgtcgacgtaggcggacgcttccttctccgccgggtcgcggggcgccagccggcgaggcgcgcgctggtcgtggaggcccggggcggcaggggctggtcggagcggcagatgcagcagcagcgccgcgcgccgctgctgccgaaaatcgaggacgacggcaacccgcgattcgtcatcttcatccgcaccgccaatgtctacttctggtacccgctcaacatcatcacgggcggtacgacggcgaagatcatgctcgccgccaaggacaacttcctcggg

SEQ ID NO: 1205 - DNA, 419 bp, Zea mays
  Clone ID: LIB143-051-Q1-E1-H12
cgcccgggccgttacaacaccctagactgagtcgtatgaggcgcgcggcagtgggcggagacgacgaccgatcggtcagaaggaatgtcgtcggcccaaatcgtgccggcggaccatgtgtgctatgtgcactgcaacttctgcaacacagttctcgcggtgagtgtcccggggaacagcatgctcagcatggtgacagttcggtgtgggcactgcacaaatctactgtcagtgaatctgagagcactcatgcactcagtcccagaacaagatcagctccagcaggagaacatcagggtccatggcacgttgcgtgagcatcatcagtgcggcggcggccaccatctggagctgggctcttcgtcgtcctcaaggttccggttgccgatgatgatgtcgtacgcgccgcagaacgaaca

SEQ ID NO: 1206 - DNA, 420 bp, Zea mays
  Clone ID: LIB143-051-Q1-E1-H2
taaaccgactctgtccaccgagatatttttctcttctctcctgtgcggccactgccacccgccccgttcgttattatatatacaacaacaggctgccagtctccctcgttgacatcggttcaccgtccgcccaggtaccttccgtacgtacaagaggcggtcgcgacgctctagcttgcattgcaccagcgcgcagagcggaaggaggtggaaagcgcccagagagatctcgagagagagagagaggctggtcggcacagactagttcattccgtttggatagagacgcacgcaacgcaggccaccacaacgtgaggagcgggaggaggagggagaggatgcaggcgcatcaccgtcagtcgtactacgcggtgctcggcgtgcagccgggcgccaccgccgccgagattcgcgccgcct

SEQ ID NO: 1207 - DNA, 172 bp, Zea mays
  Clone ID: LIB143-051-Q1-E1-H4
gacacgaagcagcatgaaataacactggatgaagcatgtgagcagataaaagaacttacagaagattcatggaagttcattattgaacaaagccttgcactagtagaatacgcgataattgtgccacgaacggtactagtagtttgcacgagctgtgccctacatatcaaag

SEQ ID NO: 1208 - DNA, 362 bp, Zea mays
  Clone ID: LIB143-051-Q1-E1-H5
ctcgcgtgtcgacccacgcctccggatttgctgcaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaagggggggggccccccaaggggtccaggctttatgtcgccgccagggggattcaagccccccccaagggggcccccaagttcatttccgggggccgttttttaaagaggcggtcgggggaaaacccggggtttgcccacttttaccccccggggaaaattcccctttttccaaaggggg

SEQ ID NO: 1209 - DNA, 417 bp, Zea mays
  Clone ID: LIB143-051-Q1-E1-H6
atgcctcccagtccagtcccccacccaccaccaccactcctcccctcgccgccgcccgttcccgaccgatccggccggatcgccccgccatggaccagtacgagaaggtggagaagatcggggagggcacgtacggggtggtgtacaagggcaaggaccgccacaccaacgagacgatcgcgctcaagaagatccgcctcgagcaggaggacgagggcgtcccctccaccgccatccgcgagatctccctcctcaaggagatgcagcaccgcaacatcgtcaggctgcaggacgtcgtgcacaacgacaagtgcatctacctcgtattcgagtacctcgacctcgacctcaagaagcacatggactcctccacggacttcaagaaccaccgcatagtcaaatccttcctctaccaga

SEQ ID NO: 1210 - DNA, 438 bp, Zea mays
  Clone ID: LIB143-051-Q1-E1-H7
ctcgccggtccacacacgaaactgactcgtgtcaactcaagtatccatccttattgagtacagtgttgatccatggactcggaaggagttgtagcagcagaggtggcagatgagactactaaaccggcaatccaagaagacggcgccgagagcaaggccgggatgactgatctgctgatgctgaccgacaagtcgcagctgcaggcgctggcgatgctgctgcggaacaacgacgagctcatgatgagccaggcgatcaagtcggatacggagcgcattgagtacctcaagacggtgagcgactgctacacgcggacgatgaagctcctcgacgattccatggcggccaggaccacgtacgagcgttcgggcgggacgaggagcctcgtcgccacggacatggacgactacgtcgtctacaggctcaacgcgtgcttg

SEQ ID NO: 1211 - DNA, 412 bp, Zea mays
  Clone ID: LIB143-051-Q1-E1-G12
taaaaacacgtcataataccaccttcttttcctgcgttcccctgctcgatccccgacgagaattcgctcccgaacccatcgatctgctctccgcagtccgccgatccgtggatcgatccgtgcgcgggctcggtccgccccgggttccgatctggtcgccgcctcgcctgaggagatgaacggcgccgggggcagccaccaccaccagcagcagaggctccggcagcagcagcagcaggcgctcctgatgcagcaggcgctgcagcagcagcagcagcagcagcagtaccagtccggcgtcctcgccgccgcggcggcggcggccatgacccagatggaacctgtttccaatggcaaccttccacctgggtttgatccttccacttgtcgcagtgtctatgttggaaatgtg

SEQ ID NO: 1212 - DNA, 159 bp, Zea mays
  Clone ID: LIB143-051-Q1-E1-E4
ctctgaggatagtcgtatgagggaagcggaccgacttcggatacgacaaggatttcgaggtgcgctactcgcttgggaagctgctgggccatggccaattcggcgacacctttgccgccgtccatcacgcgtccagcgaccgcatcgccgtcaggcgca

SEQ ID NO: 1213 - DNA, 412 bp, Zea mays
  Clone ID: LIB143-051-Q1-E1-E7
agctctgcaacgttgtccatggcatatgctggtgctgtttttgcagatgcatgtttgaagggtctgaatggagttccagacattgtagagtgctcttttgtgcaatcaactgtgacagagttgccattctttgcctccaaggttcggctcggcaagaatggagtggaggaagtgcttggtctgggtgagctcaacgagttcgagaagaaggggctggaaaacctcaagggcgagctcaagtcttccatcgacaagggtatcaagtttgcccacgggaactaggcaccttgcccggcttgtaacaattgatgccccttgcatttttgtttgactgcctatttttcctgccccccgtatggttggggcaatgaggcgtagtggtcgataataaaacccagcgggacaaagaaaa

SEQ ID NO: 1214 - DNA, 422 bp, Zea mays
  Clone ID: LIB143-051-Q1-E1-E8
aggcgtcttcacaaacgccggcgcaaactctcgcccgagcccgacagatcttcaattccccattccgcccaccgatcgaccttcacgccagtctcggtctcttccggaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctgggaagcacgttccccgtgcaatcttcgttgatctagaacccactgtgatcgatgacgtgcgcactggcacgtaccgccagctccttcaacctgagcagctca

SEQ ID NO: 1215 - DNA, 381 bp, Zea mays
  Clone ID: LIB143-051-Q1-E1-E9
agatgtggcccctctcaccctgggtattgagaccgtcggtggagtcatgaccaagttgatcccgaggaacactgtcatcccgaccaagaagtcgcaggtgttcaccacctaccaggaccagcagaccactgtctccatccaggtctttgagggtgagcgcagcatgaccaaggactgccgtcttctgggcaagttcgacctcaatggcattccgtcagctccgaggggcacaccccagatcgaggtgaccttcgaggtggacgccaacggtatcctgaacgtgaaggcggaggacaagggcacgggcaagtcggagaagatcacgatcacgaacgagaatgggcggctgagccaggaggagatcgaccgcatggtgcggga

SEQ ID NO: 1216 - DNA, 402 bp, Zea mays
  Clone ID: LIB143-051-Q1-E1-F1
gggtccagccacgcgtccgcagacacgtgggcggacgcgtgggcggacgcgtgggctctggaggaatttgagaaaataagagaggagaagaggaaagcactacttgcattgaaggctgaggagaggaaagttgaagttgacaaggatttgcagtctctgcagccactttcaaacaagaaagaaaatgatgaagttttcattaagctggttagtttccctgtaattaatgctttgataccttaagtttgctgagctttgcacgggttcttcgatgttcttttgttctcgtagggttctgacaaggataagaagaaggaaaatgctgagcgtgatgagcgtgccaagaagtcggtgagcatcaacgagttcctgaaacctgctgaaggagaaaggtactatggc

SEQ ID NO: 1217 - DNA, 102 bp, Zea mays
  Clone ID: LIB143-051-Q1-E1-F11
cacacgagtctacatgtgctccgtctacgtggtggtctgctagggtgcggcaatccacccggactagcatcatctgatcttcgatggcaaatatgtatatga

SEQ ID NO: 1218 - DNA, 413 bp, Zea mays
  Clone ID: LIB143-051-Q1-E1-F12
gggtcgatacacgactctacaccacatcagtgataggagaaagcagaccaacctagccacccagggagaaaggccaaaagggaggggagagtgtcgtcatggcttccattgtcgcttccaggagggccgttcctctagttcgcgctctggagaagctcatcgcagcgtcctccgcgcccgggactggctccgccctcaggccggtggcagtcgccggcggcctccgtggctacaacaccggcgctccgctccgacgctacgagggggccgagtcggaagacgatagcgtccgcgagtacgatgggcggcacggcggccgggactacgccgtgcccagcctgttctcagatattttccgtgatccgcttagtgcgccgcacagcattggccgcctgctgaacctgatgggcgac

SEQ ID NO: 1219 - DNA, 405 bp, Zea mays
  Clone ID: LIB143-051-Q1-E1-F2
gggtccagcacgcgtccgaaagaaggtgagcgaagtgatgggagatgccatagatgatgctttggaaggagatgaggaagaagaagaaactgaggagcttgtgaatcaagtacttgatgaaattggcattgatatcaaccaagagcttgttggagccccgtcggccgctgttgctcaacctgcttcagcgggaaaggttgcccaggctgaaagtgctgggaatgctgacactggaatccacgcctatttgcaagcaaggctggacaatctgaggagaatgtaggtgctacaccagcaaaacagtaatgccttctagctctgttgcctgcgaatgtgaatacctagtcaatcaaagcaaaaagtttacaagccaatgtgtatgttgaaaataatgaaacgttccat

SEQ ID NO: 1220 - DNA, 423 bp, Zea mays
  Clone ID: LIB143-051-Q1-E1-F3
agacactacacagcgcgcgactgacatgtcgatgctcaccagcatactgggccgcaagcatcagcagccgccgccgccgccgcagcagcagcagcagcagcagaagggcggcggcgcgcgcactggcaccggcgccggcgccggcacggaggcggcggcagtggagccggtgagcatcgacatcgcggagcaggggccgctagtggacgccatcacgctggcggcgttcgcggcgccggcgctaggcctgccgccgttcgcgacggccagcatggactggaaggagacgccgacggcgcacgtgttcatggccgacctccccgggctgcgccgcgacgacgtgaaggtggaggtggaggaggagaggctgctccggatcagcgggcagcggcagcgcgccgccgaggaaaaaggcgaccgctg

SEQ ID NO: 1221 - DNA, 426 bp, Zea mays
  Clone ID: LIB143-051-Q1-E1-F4
actcggcagcatgccctacctcaaggcgaccatcaaggagacgctgcgcctgcacccgccggcgccgttcctcctcccgcactactccaccgccgactccgagatcgacggctacttcgtcccagccgggacgcgcgtcctcgtcaacgcctgggcgctcgggagggaccgcacgacgtgggagaagccggaggagttcatgccggagcggttcgtgcaggaaccgggcgccgtggacgtccacatgaagggcaaggacctcacgttcatcccgttcggctccggccggaggatctgccccgggatgaacttcggattcgcgaccatggagatcatgctgggcaatctcatgtaccattttgattgggaggttcctggctctgcagcaggggtgtccatggacgagtcctttgggctgacgcttcg

SEQ ID NO: 1222 - DNA, 416 bp, Zea mays
  Clone ID: LIB143-051-Q1-E1-F5
accacgcgtccgagaccgaagaagaggagagagaggcgcaacgcaggcgcgcatctcacccctccccttgccggctggcccctgctgcagctctgctccggtcggctctgcccctcgctctgctgactgctctgccgctgctgctgtcgcacgcgcgccaccaacccgccgatgcgcgcgtagcggcgtaggtaccatcatcatccatccccgcgacgacgcaccacccacccctgcagtctgcatcatccccttccccactcccggctggtctgctgcggccacccctgcgtcgatccacctccgctgcttcctgcctcattatattcgcccgcctcgtcgcctccgaccccgccacagaaggccttccagaaccctccgagccctcatctcagcaccgccccgctccactctct

SEQ ID NO: 1223 - DNA, 289 bp, Zea mays
  Clone ID: LIB143-051-Q1-E1-F6
aagagctgcactgcacgctcctcaaattcccacgccgcatcgccacgcaatgccctgctcaccgccgaacggtttcaatggccgcaagcacatcggcgccatgctacgacgcgcccgagggcgtggacgtccgcgggcggtacgaccgggagttcgcgggcatcctcacccgcgacgcgctggacttcgtggccggcctgcagcgcgagttccgcaccgccgtccgctacgcgatggagcagcggctggaggcacagccccggtacgacgccggcgagctgccgcggtt

SEQ ID NO: 1224 - DNA, 422 bp, Zea mays
  Clone ID: LIB143-051-Q1-E1-F7
accacgcgtccgcttctcgatcgcttgctacttccactcgcgctacaagtcagggcagtcaagcacttacaagaagaacggaaaacctgctgccatacgctatggaactggttccattgctggttttttcagtgaggatagcgttacattaggtgatctggttgtgaaggatcaggaatttattgaagctacaaaggagccagggcttaccttcatggttgcaaaatttgatggcattcttgggctaggctttcaagaaatctctgttgggaatgcaacaccagtgtggtataacatggtgaaacaaggtctcatcagcgaccctgttttctctttctggtttaaccgacatgctgatgaaggagaaggtggtgaaattgtgtttggtggaatggattctagccactacaagggtgatcaca

SEQ ID NO: 1225 - DNA, 353 bp, Zea mays
  Clone ID: LIB143-051-Q1-E1-F8
aaaaaagtcataataaaaaaaaaaaaaaaaaagaaaaaaaaaaaaaaaaaaaaaaaaaaaaaaataaaacaacaaaaaaaaaaacaaaaaaagaaacaaaaaattaaaagatacgtcgtcccaaaacagaactcacatcatacatcaacgacctggggggctccctacggagggcttgacgttttagaagccgggggagttcatggcggacccggttcgtgcaggaaccgggctccgtgtacgtccacatgtttggcaacgttctcaggtggaacaccttcggctccggccagatgatccgccccggaatgaacttctgtttcgcgaccatggagatcatgcagggcactctc

SEQ ID NO: 1226 - DNA, 392 bp, Zea mays
  Clone ID: LIB143-051-Q1-E1-G1
cacaactcgcccctctggccgcctccgtcctccgccttatcggccgccgcctcctccttcgtcagtcgcatgtctctcgaggacgagaagcctttcttcgtcgtcgctgtcgtccccaactgggtgatgctagagcgcgtcgtcttccgcagggacgacgagtccttctcggacggaagcgaggccatcgtggcgaccgaccggcatcgcgtcctgtttcgcgtcggcaccatgatgttcgcaagtctggttcaggaattcttcatctacagcacctcaggtgccgacacttcctcttcgctgactgcgctcccgccttgtgccgagcctgacatggattgtagccgccgtgagggccgcctacctcgtaaacgtgcttctcggggatgacg

SEQ ID NO: 1227 - DNA, 294 bp, Zea mays
  Clone ID: LIB143-051-Q1-E1-G10
agcgcaacgtgtcaaccttgctgcactaccaaggtatctttgcatcaggaaggaggcacgtacctacccgccacatcaacctaggctcaagcattcgagtcatggtcaaggacgaccctaacgcccctgactccgtcctcgacacagcagtaccactagtacgctccacccatgcagatgcctcaaggagagtctgcccaccgtgctgaccgtgtagctcaactccccgtccgtcaacagtaatggcttcaccgtctacgacgcccgctgtgacctgaccttccgcgtgtactg

SEQ ID NO: 1228 - DNA, 412 bp, Zea mays
  Clone ID: LIB143-051-Q1-E1-G11
cgcgcgggtcgatacaagactctaggggaaggcgtaataaatagacacggtgctcggatctcgggcagacgacgacgacgacgacaagacgtgcagggagacgtatgtgttggatctccacatactgagcttcgtgaacggggcggagcgggaggagcacgagtggaggaggatcttcctggcggctgggttccgtgactacaagatcacgcacacccgaggcatcccgtccatcatcgaggtcttcccgtgatgatcatggatcgagagtcgatcatatatgcatgtttgtacgtgtttgtgtcataataaatcgatcgatcatgttgtttaccctttttatttcggtatctagttgcatctgtgggcgggctaaaataaatcacggccggccgggcttcatcaagcccat

SEQ ID NO: 1229 - DNA, 428 bp, Zea mays
  Clone ID: LIB143-051-Q1-E1-E2
gggtccagacacgcgtctaaataaaatcatctgcttcagccttcagctagccccaagtttagtcggccgatcgatcactgaagtagtaatggcctccgccaacagctggaccctcgagatcgcgtcgccggtggccccgcagcgcctgttccgcgccgccgtgatggactggcacaccctggcgcccaaggtcgcctcccacgtcgtcgccagcgcgcagcccgtggagggcgacggcggcgttggcagcgtcaggcagttcaacttcacctcagtcatgccgttcagcttcatgaaggagcgtctcgagttcctcgacgcggacaagtgcgagtgcaagaacacgctcatcgagggaggcggcatcggcgtcgccatcgaaacggcgacgtcgcacatcaaggtggagcccgcggccggcggccggg

SEQ ID NO: 1230 - DNA, 422 bp, Zea mays
  Clone ID: LIB143-051-Q1-E1-C6
accacgcgtccggtagcctccaccaacagtctgccccgggtcgatcgaggtagcacgacgcccgaaatcacttgactctccgggaccgttgacgtgatcatcgccgggaggaccgagggacgtgtggagtcttcgcccttaccccctaactccaagcgatccaatgactgccaaacttcaaggtgtccaacgtcgacaattatgaacccaagcaagacccgggcggctggctagctgtctacacgaccgctgcccgggccgctacggcgatggaagatgtcttgatagcgtacatacccattgtcctatggcaggacacgctgcaatggctccgacatctacctcgacattgcatcgacgactaggacgacatcagccgctggtttgtcgctaactttcaatccctttctgataaaccgacg

SEQ ID NO: 1231 - DNA, 99 bp, Zea mays
  Clone ID: LIB143-051-Q1-E1-C7
tgagtcgtattatcctccatgatcaatcttccactggacgataggtgtggtacaaggcgcgaagtcacttcactctcaggtaccgttgacgtgatcacc

SEQ ID NO: 1232 - DNA, 361 bp, Zea mays
  Clone ID: LIB143-051-Q1-E1-C8
agtggatgtgcatgggtgctgactactgtttgaacgaactggccacgccttggctctcattttctgccagcatcggatgtttttgactgaccccagggcaccttatatctattgttgtgagggttaaattgtaaaatttctggcccgtggttcattccttaccaactaatgcactcaggtgtaaaagaaaattcctgtaatgtatacacaaacatttatatacaattttgcactgtaaatatactaatattagtttcaatggagtgcacccacaaattaatgtacctgcccatgtaaataatttatttttttcttacaatgaaatttctattaaaatgttttaagctagttctaagatcgc

SEQ ID NO: 1233 - DNA, 228 bp, Zea mays
  Clone ID: LIB143-051-Q1-E1-C9
gggtcgatacacgcgtctacatcgtcttcgacgcggagccgctgggcgagcccgggcggcacgcgctggacgcctgcgcgctctgcgccaagccgctgagccgcaacagcgacatcttcatgtacaagggcgacaccccgttctgcagcgaggactgccgctacgagcagatgcaccacgacgcggcgtacgcgcggcaagcggccaacaaccggcggaagcagcagc

SEQ ID NO: 1234 - DNA, 243 bp, Zea mays
  Clone ID: LIB143-051-Q1-E1-D1
gtccatgcaagcctctacactgagtcgtattaattgtctgtttgctacaggttgcactgtgtgtgaggttggatcatttggattcatatgttcgtggagacatgtgatcgacaagaattcggtggcagaaacttcagtttggcagattatgtagagcataattttgattcattcttaggccttttttgtttgtgccagattggtgggttggaacgattactaaccagattgtttctctaattt

SEQ ID NO: 1235 - DNA, 408 bp, Zea mays
  unsure at all n locations
  Clone ID: LIB143-051-Q1-E1-D10
atactagagtactatactggtcaatgcgactttttgtacgattacgtcccttanagtccctgagattgtatgtgatcttgtgctgtcaacttgcattacacgaaacgtcgcgcacttggagtgtgcttcgtgacgacccatattggtgatgtgttggatcatttgcttgaaaatgtacaatgtttgttcgaagcagttgccttcagtattgagcatcgtggaggtaacatcaccatcagctgtatatgtcgtatgtcctatgaaaatcatttgactttgctccgcgccatgggtgtccacggtatctagctaggctagacgttcccttggatttttggtgtaaaatctggaggtcgaaccactcactgcctattgaagtaaaggatacaaaaacagttgtgctgtctt

SEQ ID NO: 1236 - DNA, 405 bp, Zea mays
  Clone ID: LIB143-051-Q1-E1-D11
agactgattctaatgaactagccgactccagcacgcaacgccagcatctccatcacagcacctctctgctacagtactggctgtctcctgtccggtatgatgcaactgcaatgtgcggccaccccttctgatcctgtccacctgtggtccaggcctgaaactcaagctcaggtagcggtgctgcacgcgctgctggtcgtcaacagtggcatccgtgtcgtcagtgctcctgctgcgaacggcacgaactgcctgtgtcgcttgagctgtgtgtcgctctctcacgcgttcgtgttcgggatcgctacgtcggcgtaccacgtctacggcaccgcatcgattagcggccgtagtccctccatctgggattcattcgcgcatgtcctaggaaatattgcagggaat

SEQ ID NO: 1237 - DNA, 397 bp, Zea mays
  Clone ID: LIB143-051-Q1-E1-D12
cacgcctctaccgcgcttccctgccactgcaggggcgtcggatgatgacgaagacgtggaggatgaggatggtgggctcgctggcggggagggctccggggaggctaggcggcggaggatgctggcgagggaggaggcgaagctggagaaggagattgttcggatggtgctggccggggaggccgaggacaagctcaagcccaattcgggccagtccgtggctgtcggcgaccaccacctctgcgtcggtttccacgacgatgccagcggggagtatcgcatctgggaatggcatggccacgtcatgctgttcgacgacgaggaaggatactccgcagagtacatttatggcaaccacttcgagccgctcgctgctgccacagccagggccaagaag

SEQ ID NO: 1238 - DNA, 124 bp, Zea mays
  Clone ID: LIB143-051-Q1-E1-D2
tgagtcgtattaaatgtctgtttgctacaggttgcactgtgtgtgaggttggatgaattggattcagatgttcgtggagacatgtgatcgacaagaggtcggtggaaggggagtcagtttggga

SEQ ID NO: 1239 - DNA, 444 bp, Zea mays
  Clone ID: LIB143-051-Q1-E1-D3
gggtccagccacgcgtccgcgatcactcatcaatcgccagaggagttgttgatcgaggtgagtgaggttgaaaagcacaccatcgtcatggacggcggatactacggcggtcgcgatcagcgctacagcggcgggtactacggcggcggtggcatcgcaacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgacgggaaggtggtgctggcgccggcgaaccccaaggacgagtaccagcactggatcaaggacatgcggtggagcacgagcatcaaggacgaggaaggttacccggcgttcgcgctggtgaacaaggcgaccggggaagccatc

SEQ ID NO: 1240 - DNA, 447 bp, Zea mays
  Clone ID: LIB143-051-Q1-E1-D4
cgggtcgtgtaagttaccaaaggtctttgcatgaacattcaccatttacaaagtggtgatagcggttaacatctcttatgataatttcacgctgctcaatctgtgaaatcagcttgatgacaacatggcagtcctcacaaactcgaagattctttgtcacaagcaactttgtcctaggcggtgtactaatgagtccaaatgcaatggccaacctctcgctgtggccccataccatgttcctcttttcatcatcttccacattatggaaaaccggcgtggtgtcaggcacatagccagtttgactgatgagaccttccaatcgctccaactcttcatatatatcatctgatctaggatgagaagcatcacccacaagaaaaccatgggacttccctttcaattcgatccagctacaagcaatgatctttttcaagcctctattggtca

SEQ ID NO: 1241 - DNA, 318 bp, Zea mays
  Clone ID: LIB143-051-Q1-E1-D5
attcccagagacgtactcaagttgcgagcaagaggactgaaaaagctagggacgatatttcaaggcgcaaaatcaaactaccgtcgtgaaaacagcctgcgtgttgaagatgacgcggcagaagccacaccgtcgcactgaggatggtggacaaatctggatatgatgtcatatactgcgtcaccggctcaccgagactgagcccgaaagccgaccactgtggaaggagacaaacgatgctgtttttccaaagatttttgtacggtataagcgcaaggtattgctaccatgccatactttatcgctgtccgcactgca

SEQ ID NO: 1242 - DNA, 378 bp, Zea mays
  Clone ID: LIB143-051-Q1-E1-D6
atccgagaaaagctccccgtctcctgcagtcctgttactccagttggttcgccgcagtgcagtgcttgtctttgctcgggcggcttggttgcagtcaagatggggaaggacggagaatctgccaagctgaacgaggagaagaagtccaaggatgagatgcatctgaaggtcaaaagcaagggcgaggcgtccggcgaggaagacggcaaggaggaggaggtcgaggtacagattgaggccaagtttgttgagaaggaataggtcaaagacacgggtgacggtgcggcatgaaagggtaccaagaagaaggatacacaggagaaagacaagaataagaaggaaggtggtgacgattcagggaaggcagaggaagacaag

SEQ ID NO: 1243 - DNA, 155 bp, Zea mays
  Clone ID: LIB143-051-Q1-E1-D7
tgagtcgtattaaacgagttgtcgagtgacgcgagtgaggtctgctcgctgacctgcgtcacggtgcgcgggcagtatggtggtcgtcattatcgcgacagcggggggttctactgcggtggtggcagcgcaacagccgggggcgctcatggggt

SEQ ID NO: 1244 - DNA, 422 bp, Zea mays
  unsure at all n locations
  Clone ID: LIB143-051-Q1-E1-D8
accacgcgtccgaaccactcccaaatactccaaggcacgttatgaagagattgtgaaggaagtctcatcctacctcaagaaagttgggtacaaccctgataagattgcctttgttcccatttctggttttgagggcgacaacatgattgagaggtccaccaaccttgactggtacaaaggcccaaccctgcttgaggctcttgaccagatcaccgagcccaagaggccttcagacaagcccctgcgtctgcccctccaggatgtgtacaagattggtggtattggaactgtaccggttggtcgtgtggagactggtgtcatcaagcctggtatggtagtcacctttggtccaactggcctgactaccgaagtgaagtctgttgagatgcaccacgaggcacttcangaggctcttccgggtg

SEQ ID NO: 1245 - DNA, 189 bp, Zea mays
  Clone ID: LIB143-051-Q1-E1-D9
cggggtcgtattagagcactcgctggggcagtcccacccggtgcacgtggtgccctacagcccggacttcctggacgagtccgtgccgtggatggagatccgcgacatcggcaggggcatcaggtgcgactgcaagctcgagctgttcgtggtcagcgtgcagtcggtgaagctcaacgtcgtcgcccg

SEQ ID NO: 1246 - DNA, 410 bp, Zea mays
  Clone ID: LIB143-051-Q1-E1-E10
acctcgcccccaccgcgggcgtcgccgccgccgcgtcgtccgccgcgtccgcgcttcccagccacatgttcgagcccggcgcgtactccctcggctcccgcgtcgccacgatcatgtccaagggcgccaccttcgcggtggtcgggttcgcggccgggctcaccggaaccgcgatctccaacgggctgatcgcgatgcggaagcgcatggacccggcgttcgagacgcccaacaagccgccgcccacgctgctcaacgcggccacctgggcgctccacatgggtgtcagcagcaacctgcggtaccagacgctgaatgggatcgagtacctgctcggcaaggtcgcaccggcgccggtgttcaaggtgtccgttgttgctctccgctgcatgaacaacgtgctgggtggg

SEQ ID NO: 1247 - DNA, 422 bp, Zea mays
  Clone ID: LIB143-051-Q1-E1-E12
acgcccgggccgacacacgcctctaatctaaatcatggatccctcagtatacacgtttctgatggcagggaaggttggccagaactggcaccctatgaagccatccatgttggagctgcagcaccgcagatccccgaggcgctgatcgagcagctgaagcccggcggcagaatggtgatccctgtcgggacagtcttccaggagctgaaggttgtggacaagaagttggatggcactgtcagcataagagacgaaacgtctgtgcgctatgtgccgctcactagcaaggacgcccagttgcacgcaagctgagtgatctatcatgtcaaaaaaatgttatcctcacctgacaaggtgaggcattcaatcgaatcgctacccttgtaaatgtattaatcctactgtctcagtaaatgcgctgg

SEQ ID NO: 1248 - DNA, 425 bp, Zea mays
  Clone ID: LIB143-051-Q1-E1-C5
acccaaggcgaggcgttgaaacccttaaccctcttccacctcgaagcggcgcgaggagggagagtgtgagtggactcaggaggcggcgggcgaaatgaagcttaacgtcaagaccctcaagggcaccaacttcgagatcgaggcgagccccgatgcgtcggttgctgaggtgaagaggatcatcgaaactactcagggtcagagtacctacccagcagaccagcaaatgctcatataccaagggaaaattctgaaggatgagaccactttggaaagcaacggagttgctgagaacagcttccttgttataatgctgtccaaggctaaggcatcgtcaagtggagcttccaccgctactgctgcaaaagctcctgcaactccagcccaacctgctgcccctgccacatcagttgtaagaacaccta

SEQ ID NO: 1249 - DNA, 453 bp, Zea mays
  Clone ID: LIB143-051-Q1-E1-B1
gggtcgatgcaagcctctagagagactcctccgaggcacctcatctccggcgaagggaaatggcgaccgttccaggggatctgatctggcagattgtgaggaagaacaactccttcctggtgaagcagtttggcaacggcaatgccaaggtgcagttcaccaaggagcccaacaacctctacaatgtacactcctacaagtactctggcttagcaaacaagaaaactgtaacgatccagccagctgctggaaaggactcggctgtggtcctctctactaccaagaccaagaagcagaacacacccgcgaagctcagccacaagtctgtaatgcgcaaggagttccgcaagatggccaaggctgtgaaaaaccaggttggcgaaaactattacaagcctgatctgaccaagtcgggccttggtaagctgagctccgtgtaccgcaacctccaag

SEQ ID NO: 1250 - DNA, 415 bp, Zea mays
  Clone ID: LIB143-051-Q1-E1-B10
ctcgcgggtcgatacacgactctacacctgtgctcatgaaggttgattgggacaaatggcaggacgaggatgatgaagacgctggatttaatgactttggtggtatggacttctcgaaactggacataggaggtgctgatgacgacgatattggggatgatgaagatgatgtggttgaaagtgctaacaaagatgaagaaggaggtaagacagaagagagcaaggaggaggaagcagctcctgcggctgcagaggaagtgaagccatgaagaatcatttgactttgctccgcgccatgggtgtccacggtatctagctaggctagacgttcccttggatttttggtgtaaaatctggaggtcgaaccactcactgcctattgaagtaaaggatacaaaaacagttgtgctgtctt

SEQ ID NO: 1251 - DNA, 420 bp, Zea mays
  Clone ID: LIB143-051-Q1-E1-B12
acaacaccctacactgacgtcgtgagtacacactccggcagccgagcgatcgagctccccggtcgctagcacagccggccactgcacacgacggtgctggtaggttgcaagcacttgcaggatggcgcaggtcgctaagacgcttctccttgtggccctggtggtcgtgtcggcggtggagctgtgccgcgccatcgagttcgacgagcgggacctggcatcggacgaggcgctgtgggacctgtacgagcggtggcagacgcaccaccgggtgcaccgacaccacggcgagaagggccgccggttcgggaccttcaaggagaacgcgcgcttcatccacgcgcacaacaagcgcggcgaccgaccctaccgcctccgcctgaaccgcttcggcgacatgggccgtgaggaattccgttc

SEQ ID NO: 1252 - DNA, 404 bp, Zea mays
  Clone ID: LIB143-051-Q1-E1-B2
gagataccactctctgatcagcagctgatcgctcagtcttgcagctcgatcattctttagctgctctagctcgagcctctagccctagctagtagctagcgactcggtcgtgtagtcatcaatcttctgatcgtcacccatgggcattgccgaggtccagaccccgaccgtcgtggcgaccgaggaagcgccggtggtggagaccccggctccgcacgccgtcgtgcccgatgaggctgcccccgccgtcgtggccaacgtggaggagccagctgccccggcggagaccgagccagctgccgccgctgagcccgaagcggcccccgtggcggcggacgaagagacgccaaacgatgaagagacggcaaatgatgcggagcctgagccggagccggtgggggctg

SEQ ID NO: 1253 - DNA, 399 bp, Zea mays
  Clone ID: LIB143-051-Q1-E1-B3
aagcctctaaagtgaatcgtctcatactactcaaatccatccttactgagcttactgtttgatccatggactcggaaggagtagcagcaaaggtggcagatgagactactaaaccggcaagccaagaagacggcgagagcaatgccgggatgactgatctgctgatgctgaccgacaagtcgcagctgcaggcgctagcgatgctgctgcggaacaacgaggagctcatgatgagccaagcgatcaagtcggagacggagcgcgttgagtacctcaagacggtgagcgactgctacacgcggacaatgaagctccttgacgactccatggcggccaggatcacgtacgagcgttcgggcggaacgaagagcctcgtcgcccgggacatggacgactacg

SEQ ID NO: 1254 - DNA, 424 bp, Zea mays
  unsure at all n locations
  Clone ID: LIB143-051-Q1-E1-B5
ctaagatcgagctccagcagcagcaagtcaagttcgggagagagagagacacagatcgatcgatggcgatgatgaagaagaagggcggcgccgcaacaacagcggtggcagcagtggcgttggtcctgctggcggcggcggcggttagggcggacgtgaactgcgcggacgtggacgcaagcctgcgcccctgcgtcggctacgtgacgggcaaggaggcggccccggccgccgagtgctgcgccggcgtgaagcggatcagggccatgccgtccggcccggcggagcggcggcaggcgtgcgagtgcgtcaagcaggcggcggccaattaccagccgctcaacgccgacgccatccgcgacctcnccgcgcagtgcggcgcgccgctgccgttcccgctcaacctcaacttcgactggcacac

SEQ ID NO: 1255 - DNA, 94 bp, Zea mays
  Clone ID: LIB143-051-Q1-E1-B6
tcacgggtcaacacaagaatctaaagcaacatggcaaaacgatgtgacgtaacaataagttacatggcgaaataaaaactttggttcgttgtgt

SEQ ID NO: 1256 - DNA, 442 bp, Zea mays
  Clone ID: LIB143-051-Q1-E1-B7
tcgccggtcgatacaagcctctacaccgcgtcgtcctattcctcctcctagcacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcgaggcggccaccgagggcggcggctgcgactgcaacacctgcaactgcggcaccagctgcggctgctcctgctgcagctgcaactgagccggcccgcccggcccggcgatggcgcacgagagtcgagaggacgacgacgacgaggcgtataaatataatagcagcgtctaaataagatcctgtcaactgcacccgccatta

SEQ ID NO: 1257 - DNA, 444 bp, Zea mays
  unsure at all n locations
  Clone ID: LIB143-051-Q1-E1-B8
tcgtgggtcgatacaagcctctacactgacgtcctgactacgcgtccgcagttctcactctagcgctctctctccctcgctctctctctacacatatatatcagtataggatggatgtgcaaacctagcttgctgctgcctttctagctgagaactgagctgtagctgttggtacggttttcctcctcgctcttcttctcctccttcttgctgctggttgccgggagctgagatcgatcgagagcactgctgttgttcgtgcggccggcggcggcggcgcgcggcagtgggcggagacgacgaccgatcggtcagaaggaatgtcgtcggcccaaatcgtgccggcggaccatgtgtgctatgtgcactgcaacttctgcaacacagttctcgcggtgagtgtcncggggaacagcatgctcagcatggtgacagttcggtgtg

SEQ ID NO: 1258 - DNA, 416 bp, Zea mays
  Clone ID: LIB143-051-Q1-E1-B9
aacaccctatactgacgtcgtactactcacagcaaggcccaagggcagtgtgcatcatttcagcaactggagctatttctacagcaacccttcaccaggattcagactccggtggtgtggttacatatgagggccgatttgagatcctgtgcctttctgggtcatacttggtggtagaggatggtggcacacggacccgaagcggaggtctttgcatagctttgtgtggtcctgaccacagggttattggtgggagtgtaggcggagtcctgacagcagctggaacagttcaggtgatagtggggagcttcatgtacggaggttcgaagaagaacaatgttaaagcggaggtggacatggaacccgaggaggtggcacccgcgggagcacagtggcatggtccctcctgcgatgag

SEQ ID NO: 1259 - DNA, 415 bp, Zea mays
  Clone ID: LIB143-051-Q1-E1-C1
aacaccctagactgagtcgtatcacccagcgcagcagccgccgcagcacatcgctatctcgatctcagccatggcggaggtggagcagcaacaggacacgccgaagctgttcaaccgctggaccttcgatgatgtccaggtgaacgacatctcgctgaacgactacctcgctgtgaacgcgacgaagcacgcgatgtacctgccgcacaccgcggggcgttactccaagaagcggttccgcaaggcgcagtgcccgatcgtcgagcgcctcacaaactccctcatgatgcacgggcgcaacaacggcaagaaggtcatggctgtccgcatcatcaagcataccctggagatcattcacctgctcaccgatgccaaccccatccaggtcgtcgtcgacgcgattatcaacagtgga

SEQ ID NO: 1260 - DNA, 409 bp, Zea mays
  Clone ID: LIB143-051-Q1-E1-C10
acaacactctacacagactcggactagagaggtggcagggctgccagctttaacatcattcccagcagcaccggtgctgccaaggctgtcggtaaggttcttcctgaattgaatggcaagctcactggcatgtccttccgggttcccaccgtggatgtgtcagttgttgacctcactgtcagaatcgagaagggggcctcttacgaggaaatcaagaaagctattaaggctgcttctgagggcccactcaagggtattatgggctacgtggaggaggatctggtttccaccgacttcaccggtgacagcaggtcgagcatcttcgacgccaaggccgggattgccctgaacgaccacttcatcaagctcgtctcttggtacgacaacgagtggggctacagcaaccgcg

SEQ ID NO: 1261 - DNA, 412 bp, Zea mays
  Clone ID: LIB143-051-Q1-E1-C3
gggtcgatacaagcgtctacaatacaactgataatgatatagcggttatagacaagtcatttggttttgatactgctgtagaagaagcccagcgtgccattaatgcagctcatgtggaagcttcaagtgctgaaaatggaataggtttagtgaagcttatgggtcgctatagtggatttattgccatgtatgctactcttgcaagcagagatgtggactgctgtttgattcctgagtcacccttttatttggaaggggagggtggactatttgagtatatagataggaggttgaaggagaacaatcacatggttattgttgtcgcggagggagcaggacaggatcttattgctcaaagtatacctgctgcagatcagcaagatgcatctggaaataagctgcttcttgatgt

SEQ ID NO: 1262 - DNA, 231 bp, Zea mays
  Clone ID: LIB143-051-Q1-E1-A8
tgagtcgtattacacgcgctcgctcaatcttgcagatctctcattctgcatgtgctccacttcgatcctctatccctagctagtagctagccatacggtcgtgtggtcagcaggcttctggtgttcacgcataggcactgcgtctgtcgaggccccggtcgtcacggtgatcgaggaagcgtcggtggtggagacgccggttccgcactctgtcgtgcccgaggaggctgt

SEQ ID NO: 1263 - DNA, 420 bp, Zea mays
  Clone ID: LIB143-050-Q1-E1-H11
gtgggtcgttacaagactctagactgagtcgtaggacggtcgcgggcgtcgtccagtttgacagaggaacggggcgactcgggttgcgccgtcagatcatcgttgaacgactcatattagttagccagataccagttgggacccctgatctacaccattgattcactagtgggcggtgaagatctggttgccgcgcccatcgcgagaactaatctggaccgtagatctagagataaatgattcggattaagttgggtcatgttggttcggatgggagcgatccagggcatcgtgtgtcgatcggatggctctgataggatctgaggttatttaaatctgcactgttggattttgatcgggcgggtgacgtcaggtaccggttcgagcgacgatagatctaatccatgtcgtccaccgttg

SEQ ID NO: 1264 - DNA, 367 bp, Zea mays
  Clone ID: LIB143-050-Q1-E1-H3
acaagcctctaaaatcagtcgtaataggcagcagcacaagcaagaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgaggcggccaccgagggcggcggctgcgactgcaacacctgcaagtgcggcaccagctgcggctgctcctgctgcagctgcaactgagctggcccggcccggcgatggcgcacgagagtccagaggagg

SEQ ID NO: 1265 - DNA, 399 bp, Zea mays
  Clone ID: LIB143-050-Q1-E1-H4
tccttacaagcctctacagtgactcgtagcagatctcgtggttatgttatattgttatgtttcttcctcttggtgtgacgcagggaaccgcgcctccggccggacgccgctggactgggagacgcggtcggcggtcgcgctggcggcggctcgcggcgtggcgcacatccactccacggggcccacggcgtcgcacggcaacatcaagtcctccaacgtccttctcaccaagaactacgaggcgcgcgtgtcggaccacggcctccccacgctcgtcggcccctccttctcgcccaccagggtgtccggctaccgcgcaccggaggtcaccgacatccgccgcgtctcgcagaaagcccacgtctacagcttcggcgtcctcctgctggagctgctcac

SEQ ID NO: 1266 - DNA, 340 bp, Zea mays
  Clone ID: LIB143-050-Q1-E1-H6
gtgggtccatacaagactctgaagcgcgtcatggggttcgacctcggcaatgagagctgtatcgtggcggttgcgcggcagcgtggcatcgacgtggttctcaacgaggagtccaagcgcgagacacccgccatcgtttgcttcggggacaagcagcggttcatcggcatcgccggcgccgcgtcctccaccatgaaccccaaaaactccatctctcagattaagcgcctgctcggccgcaagttctcagatcccgagctgcagcgcgatctcgcctccttcccattccgagtcacggagggccccgatggttttcccctggtccatgtaccgtacctgg

SEQ ID NO: 1267 - DNA, 396 bp, Zea mays
  Clone ID: LIB143-050-Q1-E1-H9
gggtcgatacaagcctctaggatgagtcggagaacgacgctgacgaggtcatcccgaacggtggtgtcgagcacagccatggcgcaaacgggtttcgtgtcgcggctgctggcgaagcccgtggcgaggaggatgaggacgtggaggaagatgacgacgacgacgatgactttgaggaggaggatttgggggaggagattgatgaggatgttgatgacgaggatgctgttgtggaggtgcatgatgtaccaagtagtgacgacgaggaagatggcgtggaggaggatgaggaagaagaggatgaggacgaagatgatgaagaagaggaggaggttgaggatgaaggtgaagaggcggagccacagagcagtggtagggttgccatgatgacaggcg

SEQ ID NO: 1268 - DNA, 457 bp, Zea mays
  Clone ID: LIB143-051-Q1-E1-A1
actcacgggtcgatacaagcctctacacacacgcctgggaaacatgctactggagagttcagtgttattgaagcaccgtttgatcgctcaggaaggcaagaggatgatgccgttgggaatgtcaacctagatcaagagccagcagatctgaatggtgactcttctcaacacgatttcgacaccctcccagagtttgatagtctgaacccagtaggctcgaagcgcaggcacgaggagaaggagaaggagaaggagaaggagaaggagaaggagaaggaatggaaatgggctaggcaaggcgtccccatcttcatgcaggccctgtcggaagctgtgagctttacccacggtggcacggacccatacgagggtatttacaaagccattgaggacatggatgagtatcctttgccggcacgccttgatctgctgacctatcttgctcagaatcgtcaca

SEQ ID NO: 1269 - DNA, 452 bp, Zea mays
  Clone ID: LIB143-051-Q1-E1-A5
ctcgcgggtcgatacacgcgtctaaatcacactctggcagccgagcgatcgagctccccggtcgctagcacagccggccactgcacacgacggtgctggtaggttgcaagcacttgcaggatggcgcaggtcgctaagacgcttctccttgtggccctggtggtcgtgtcggcggtggagctgtgccgcgccatcgagttcgacgagcgggacctggcatcggacgaggcgctgtgggacctgtacgagcggtggcagacgcaccaccgggtgcaccggcaccacggcgagaagggccgccggttcgggaccttcaaggagaacgcgcgcttcatccacgcgcacaacaagcgcggcgaccgaccctaccgcctccgcctgaaccgcttcggcgacatgggccgtgaggaattccgttccgggttcgccgactcccgcatcaacgacctccg

SEQ ID NO: 1270 - DNA, 420 bp, Zea mays
  unsure at all n locations
  Clone ID: LIB143-051-Q1-E1-A6
atgaaattggttgaccaataccatggaagcagctccaacgctgactactactacatgtcagcaaggtccttgtccaggagtccagtgccaactgctggtatatggtccggcagtaatcgtcaatcatcaagaagtcctccacaaatgaatgatcaaaggggatctttaattggtgagatcgctccggaacattctgcaccatctactgttacaaaaaatgccctctcagtggcaccatggatgggtcttctattgggtacgtgcctcttgcacattttgattggaaacaaacatanggagatggcaagtggcactgtcataccaattggaagaaagcttttactgtntgtggatgatcatggaaaatcatcgcttagccagagcagtggaagtgaaattggaagctttcttggttgggct

SEQ ID NO: 1271 - DNA, 162 bp, Zea mays
  Clone ID: LIB143-051-Q1-E1-A7
tactactccctgaggtgagtcgtattagcataccattggagcagctccaacgcttgctactactacatgtcatcagggtccttgtccaggagtccattgccatctgctggtaggtggtccggcactacacttcaatcgtcaagttctcctccagagttgact

SEQ ID NO: 1272 - DNA, 382 bp, Zea mays
  Clone ID: LIB143-050-Q1-E1-G9
ctctacactgagtcttatgatgctcgccttgaagcttcaaatcccagtgacatgacgggcgaaactggaacgcttggttacatggcacctgaggttctcaatggaaatccctacaacaggaaatgcgatgtttacagcttcgggatctgtttgtgggagatatactgctgtgatatgccatatcctgacttgagcttttctgaggtcacgtctgcggttgtccgtcagaacctgaggccggagataccacgctgctgcccgagctctctatcgaacgtgatgaagcgctgctgggacgccaaccccgactagcgacctgagatggccgaggcggtgtccatgctggaggcgatcgacacgtcgaatggtggaggcctgatcc

SEQ ID NO: 1273 - DNA, 363 bp, Zea mays
  Clone ID: LIB143-050-Q1-E1-E6
acaatcctctaaattcagtcgtactgatgttcagccactcccagactgtggttgtgtgcccaggctgccaaactgttctgtgccaacctaccggtgggaaggccaggctcaccgaggggtgctccttccgtcgcaagggcgattaggtcctgcttctcttaacgtgagaagagataaatttggtgttttgcaactttctcaggatatgtactgtactcggtgaggattttgttaattattatggctgttagcgtggcctgacaatgcttgtgtgtaaacctgcactttgtttgagcgtagtgacatctattatggtgctgtttggcttttgctgacggagtggctatgcaaattaaatcagct

SEQ ID NO: 1274 - DNA, 346 bp, Zea mays
  Clone ID: LIB143-050-Q1-E1-E7
ggtccagacaagcgtctgcacacatgcattttaggcacaccagaacagaagaagaaaaaaaaaacaggcactgagctgagatggcgaagcacttggctgccatgtgcaggtgcagcctcctagtgcttgtactgctctgcttgggctcccagctggcccaatcccaggtcctcttccagggtttcaactgggagtcgtggaagaagcaaggtgggtggtacaactacctcctggggcgggtggacgacatcgccgcgacgggggccacgcacgtctggctcccgccgccgtcgcactcggtggcgccgcacgggtacatgcccggccggctctacgacctggacgc

SEQ ID NO: 1275 - DNA, 369 bp, Zea mays
  Clone ID: LIB143-050-Q1-E1-F1
ttccgcgtccacccacgcgtccgacaatgtcggcaacctccatacatatatatgtgctactggagataatagtgctgttctacattatggacatgcggcagctccaaatgaccggactttgaatgatggagacatggcactaatggatatgggagctgaataccatttctatggatctgatatcacatgctcataccctataaatgggaaattcaacagaagtcagacaatagtatacaatgctgtgcttaaggctcataatgctgttatatcagacatgcggcctggagttaattggatggatatgcacagattagcagaacgggcaatacttgaatctctcaggaaggaacaaattgtacaacggga

SEQ ID NO: 1276 - DNA, 315 bp, Zea mays
  Clone ID: LIB143-050-Q1-E1-F3
agaattctagggttttgctgctctccgaccccgagctccgaaggccgcagcatcaggcgcggcccccctcgcgtgtgaccgagatggcgctgccgaatcaggggacagttgattaccccagcttcaagctcgtcatcgtcggcgatggtggatctggtagaactacatttgtgacgaggcatctcactggagagtttgagaagagatctgaaccacccactggtgtggaagttcatccgtcggatttcatcactaactgtggtaagatcaggttctactgctgggatgccgcagggcaagagaactttggtgggc

SEQ ID NO: 1277 - DNA, 403 bp, Zea mays
  Clone ID: LIB143-050-Q1-E1-F4
cgccggtcgatacacgaaactacatcatctcctattaagaccacagttgaagttgaagaagggatggagcttgacagaggatatatctcccctcagtttgtcactaaccttgaaaaatctattgttgagttcgaaaatgctcggattcttgtcactgatcagaagatatcatcgataaaagaaattattcctctgttggagcagacaacacagttaagagcaccacttcttataattgcagaggatgtaagtggcgaggcgctggcaacattagtcataaacaagcttagaggaattttaaatgtggctgcaatcaaagctcctggttttggtgagaggcgtaaagctcttcttcaggacattgccattgttacaggtgctgaatatcaatccaaagatcttg

SEQ ID NO: 1278 - DNA, 376 bp, Zea mays
  Clone ID: LIB143-050-Q1-E1-F5
gggtccagacacgcgtccggagaaagtgatggaagacgaggaggaggggacggtgtggcacgtggcggagcgcggcaagccggagttcgcgcgggccgtggcgctgccggagaacgtgcgcgtggacgggatcagggccggcttggagaacggggttctcaccgtcgttgtgcccaaggaagtcgccccggcccggcccaagcccaggtccatcgccgtctccagcaagctctgatgagtctgaggcgatgagtggcagagtgtacggtgcagtgttaaaccatgccgcaaatggcgggtacatctgaattctggtcgtgtgtgtgtccgtgtcacctagaaaatgcgcacctcgtgtaaattgtgatacaatttc

SEQ ID NO: 1279 - DNA, 389 bp, Zea mays
  Clone ID: LIB143-050-Q1-E1-F7
ggtccttgcaagcctctacagtgatgtcatcggatcatgaaagcccaggcgctgagggactccagcatgtctgggtacatgtcctccaagaagacgatggagatcaaccccgagaacgccatcatggaggagctccgcaagcgtgccgaggctgacaagaacgacaagtccgttaaggaccttgtcatgctgctgttcgagacggcgctgctcacttctggctttagcctcgacgatcccaacacctttggcagccgcatccaccgcatgctcaagctgggcctgagcatcgacgaggacgaggaggctccggaggctgacaccgacatgccccctctggaggatgacgctggcgagagcaagatggaggagggtctacaagctggggt

SEQ ID NO: 1280 - DNA, 370 bp, Zea mays
  Clone ID: LIB143-050-Q1-E1-G1
acaagcctctaaaatgagtcgtattaaccaacaaggactcctctaccatcaccagggatcactagacgcgtgtatgcacacgcacttggtccgatcctgtcgtccgtgaccctgtttgcttgttcgcgagtccagtatgggtttgtgcatgttttcagtgtcatggtttccttttctacgaatttggcgttgtaagttcgattcgcaggtacgttgctgtgttttttttctgcgccatcaggtgtctgtaaacgagtcgggcgggtttgagtgtcctttgttgtgataataaagttggtaaatcgtaattaatatatatcatgcgactgtcatgctatggcctagtatgtgtttggtaattttcataaaa

SEQ ID NO: 1281 - DNA, 380 bp, Zea mays
  Clone ID: LIB143-050-Q1-E1-G10
gtcgttgcaagactctacaatcaatcgtactacccggtcgctagcacagccggccactgcacacgacggtgctggtaggttgcaagcacttgcaggatggcgcaggtcgctaagacgcttctccttgtggccctggtggtcgtgtcggcggtggagctgtgccgcgccatcgagttcgacgagcgggacctggcatcggacgaggcgctgtgggacctgtacgagcggtggcagacgcaccaccgggtgcaccggcaccacggcgagaagggccgccggttcgggaccttcaaggagaacgcgcgcttcatccacgcgcagatcaagcgcggcgaccgaccctaccgcctccgcctgaagcgcttcggcgacatgggccg

SEQ ID NO: 1282 - DNA, 251 bp, Zea mays
  Clone ID: LIB143-050-Q1-E1-G12
atagtacgtcgtattaagcacagcctccctctctcgcggccctttcccacacatccgagcgatggagagtcctccttccattccttctgtcctcgtgaaggcgtctagtgaggcgtgctttcttgctcgcctctgccaggcactggtcacaagaaggtcgcctcgtgttcgggtcatcttgccttcacaagggggacgggagttccctgctagggggagaccttccgttgcacgtgtacgcacgcatgcag

SEQ ID NO: 1283 - DNA, 390 bp, Zea mays
  Clone ID: LIB143-050-Q1-E1-G2
catacaagacactaaactgggtcggattaaggagacctgcgccgcccctccggccacgcgagctcgccgaaatggtcgcccacaggttccatcagtaccaggtggtgggtcgcgcgctgccgaccccgaccgatgagcaccccaagatctaccgcatgaagctctgggccactaacgaggttcgcgccaagtcgaagttctggtacttcctgagaaagctgaagaaggtgaagaagagcaatggccagatgctcgccatcaacgagatcttcgagcgcaacccaaccaccatcaagaactacggcatctggctgcggtaccagagcaggacggggtaccacaacatgtacaaggagtatcgcgacacgagcctgaacggcgccgtggagc

SEQ ID NO: 1284 - DNA, 404 bp, Zea mays
  Clone ID: LIB143-050-Q1-E1-G3
tcgtaggtcgatacaagactctaaattgagtcgtacgacaaagattatatactaggattgctttggggaaggtatttttatatagagtctaataatcttgctttagcaatctttatataatggattttgatggtcaaagttggagaagtttgacttaggagttaggaggacaaacctaaatggacttaatactcgtgaaaggaggaaacacacaattggcatggtctaccgacatcgctattagttgcatggcatttagccgtgcagtaaacctaagtaaaagcaatattttgtaactggaattttgctttgccaccaggctaaaagaatggatgttgtatggggagagactgctggtgttgaaggtcaattgttgctgttgtgccctctccttttccccctgc

SEQ ID NO: 1285 - DNA, 334 bp, Zea mays
  Clone ID: LIB143-050-Q1-E1-G8
tactacaccctaaatcgttcgataaagtgttgggcacgaatacatggacgatttcttcggctgctgcgagtcccttttggctcaagacggcatatttgtcctgcagttcatctcaatcccagaagaacggtatgaggaatacaggcgcagctcagacttcatcaaggaatacatcttccctgggggttgcctgccttcgttagcccggatcacgtctgccatgtctgcagcatcaatgctctgcatcgagcaccttgagaatattgggtaccattactacccaacgctgatacagtggatggacaacttcatggccaataaggatgcaattttg

SEQ ID NO: 1286 - DNA, 404 bp, Zea mays
  Clone ID: LIB143-050-Q1-E1-E5
gggtcgatacaagcgtctacactgactctcacaaccgactcgtcagacgtcagccagcagttctaaaccaaggattgatccacgagcttccggaaagcgaggcgcgcgcgcagcgtctaggtgctggtgccggtgccgcccacggatcgggctcgcggatccgcgttcctgctcagcatcttgctcgcaagatccttgttcgcgttttcaattgccaaataggagaccaacaagctcgggaccgtgatcggtatcgatctcggtaccacctacacctgtgtcggtgtgtacaagaacggtcatgtccagatcatcaccaatgaccagtgtaaccgtatcacaccctcatgggttgccttcaccgatagcgaaacggtcatcggtgaggctgccaaaaaacaggg

SEQ ID NO: 1287 - DNA, 299 bp, Zea mays
  Clone ID: LIB143-050-Q1-E1-C9
aagcctctacagtacgtcgtagaaccgcgtccgcggcggcgggaagacgtcgcagatctacgccatccgccaggccgtcgccaaggggctcgtcgcctactaccagaagtacgtcgacgaggccgccaagaaggagatcaaggacatctttacccgctacgatcgcaccctcctcgtcgctgacccccggcgctgcgagccgaagaagttcggcggacgtggtgcccgcgccaggttccagaagtcgtaccggttagcggccgcctgcgccatcgcgatttttcacatcgttgtgggtg

SEQ ID NO: 1288 - DNA, 359 bp, Zea mays
  Clone ID: LIB143-050-Q1-E1-D1
ctcgccggtcgacacacgcatccagacaaaatcataccaccaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttaaaccttgtcaacttggaaaggtcgtttgccgagaaccactacgccgatctcgcctccaagcccttcttcaagggcctctttgacaacatcatctctggccctgtggtggccatggtctggaaggacaaaagcctcttcacaactggccgcaatatcattggcgccactaaccccctggc

SEQ ID NO: 1289 - DNA, 397 bp, Zea mays
  Clone ID: LIB143-050-Q1-E1-D10
acgcgtccggcgcttcccccaaccgaagcacctgcaccgtccgccgccggggggtcatcgagcggtggcgcggcggcatcttcaccgcgcgccgcggcggcgagctctcctccgatgacggcgaccgccctgttggctgccgtggcggctcccctgctcgcctactactgctgctacctcttctgagggtttccttctgctgctgctgccgtctaggctgagtgacctatttctatgtatgtgacgattcaagttaacttgtggagcgcggctgcgcgtgcgtttgtgcttgtgcagtcgccactgttgctgtgttcttgcgatactcttgtcacttgacaggtggtgttgtatggaccggtttagctggctcaacggtaaaaaataaaaggggggg

SEQ ID NO: 1290 - DNA, 428 bp, Zea mays
  Clone ID: LIB143-050-Q1-E1-D11
tgggtcgttacaagcctctagcgtgagtcggctgacggcgcgccacgaccgcttcgtcgcgggcctccgcgaggtcggcatcgcgtgcctgccgggcaacgcgggcctcttctcgtggatggacctgcggggcatgctccgggagaggacgcacgacgcggagctcgagctgtggcgggtcatcgtacacagggtgaagctcaacgtgtcgcccggcacgtcgttccactgcaacgagcccggctggttccgcgtctgctacgccaacatggacgacgacaccatggaggtcgcgctcgaccggatccgccgcttcgtgcgccagcaccagcacagcaaggccaatgccgagcgctgggcggccacgcggccccttcgtctcagcttgccgcgccggggagcaaccagcggtttccatctcgccatct

SEQ ID NO: 1291 - DNA, 383 bp, Zea mays
  Clone ID: LIB143-050-Q1-E1-D12
ctccctatagtacgtcgtattataccactgcaggggcgtcggatgatgaccaagacgtggaggatgaggatggtgggctcgctggcggggagggctcctgggaggctaggcggcggaggatgcttgcgagggaggatgcgaagctggagaaggagattgttcggatggtgctggccggggaggccgaggacaagctcaagcccaattcgggccagtccgtggctgtcggcgagcaccacctctgcgtcggtttccacgacgatgccagcggggagtatcgcatctgggaatggcatggccacgtcatgctgttcttcgacgacgaaggatactccgcagagtagatttatggcaaccacttctaggccgctcgctgctgccat

SEQ ID NO: 1292 - DNA, 398 bp, Zea mays
  Clone ID: LIB143-050-Q1-E1-D2
tcgcgggtccacacacgcgtccgaatcgtcacttcgtcacttagcttcactcggtacggttctgcttctacatctatatatcgttagtttggtatgtactaacggctcgatctgcacaaggcaaagaaaagaggcaacgacgatggctgctgcggcggcgatgatggtctccggaggacgggcggcgctggtggtggcgggcgtgctctgcgcggtggcggccatggcggcggcgcagcaggcgtcgaacgtgcgggcgacgtaccacctgtacaacccggcgcagaacgggtgggacctgaaccgcgtgagcgcgtactgcgccacgtgggacgccgacaagccgctgtcgtggcggcagaagcacggctggaccgccttctgcgggcccccccggc

SEQ ID NO: 1293 - DNA, 380 bp, Zea mays
  Clone ID: LIB143-050-Q1-E1-D3
taaactgactcgtcatacacgaggactcgcagaacaggaccaagatcgccgagcttctgacataccactccaccaatagtggtgatgagctgaccagcctcaaggactacgtgaccaggatgaaggatggacagaatgacatatacgacatcactggtgagagcaagaaggcagtggagaactcccccttccttgagaagctgaagaagaggggctatgaggttctgtacatggttgatgccattgacgagtatgctgttggtcagctcaaggagtttgagggcaacatgcttgtctctgccaccaaggagggtctgaagcttgatgagactgaggacgagaagaagaggaaggaggagctgaacgagaagtttgagggg

SEQ ID NO: 1294 - DNA, 343 bp, Zea mays
  Clone ID: LIB143-050-Q1-E1-D4
atgaaatgcaggacagtgcatcacccgtgactgtcattggcacaaagaatgacgtacagggagtggcaggacatgaaatggaggacagcggatcaccagccacagtcattgacacgaagaaagaagagacagaacatgagatggtggacagcgtatcacctttgatggatgttgacacggaggaaggggagatcagctgctgacggtagctacacctctcttcacccgcataatttattgaggcagacatccttgcttggttgttagattaggcaatttcataagcagagtgatgcagaaacattagtgtgatctgctttcatcgtagaaccatgtggtgtgg

SEQ ID NO: 1295 - DNA, 360 bp, Zea mays
  Clone ID: LIB143-050-Q1-E1-D6
gtgggtccatacaagcgtccgaataaatactgcccattcagttcgccatcggcagccgagcaccatgagctccacaggcggcgacgatggcgccaagaagtcttggccggaagtggtcgggctcagcctggaagaagccaagagggtgatcctgtgcgacaagcccgacgccgacatcgtcgtgctgcccgtctgcacgccggtgaccatggatttccgccccaaccgcgttcgcatcttcgtcgacaccgtcgcggaggcaccccacatcggctgagaatcaaatctataaaatgaataactcggacatgtcatgcgtgcatgtccgtctccgaataatggatgtgtgtgcatcgttcc

SEQ ID NO: 1296 - DNA, 75 bp, Zea mays
  Clone ID: LIB143-050-Q1-E1-D7
ggcatactgtaagggttgttttacgctattgataatacactgtactgttcagctgttgaactctatttcttagcc

SEQ ID NO: 1297 - DNA, 348 bp, Zea mays
  Clone ID: LIB143-050-Q1-E1-D9
tccctatagtaggtcgtattaaaagcgcggcctgtgtctccggcctttgccgcttccacagggagtccggggccatgcagagctccgtaaagctcgcggtgcttgctctactgctagcggcagcagctcaccacggtctgctgccgctgccgacggcgcgatgctactggctcaacccggagatctacgacgccggcgggctgagccgccgcgcgttcccggacggcttcgtcttcgggacggccgcgtcggcgtaccaggtcgaggggatggccaagcacggcgggcgggggcccaggcatctgggatgccttcatagaggttcctgggagcagccctaacaattcc

SEQ ID NO: 1298 - DNA, 396 bp, Zea mays
  Clone ID: LIB143-050-Q1-E1-E10
tgggtcgggccaagcctctagcataactcgtatgtagcaatggcgggggagacgaagaagggcctggtgctgctggacttctgggtgagcccgttcgggcagcgctgccgcatcgcgctggcggagaagggcatcgcctacgagtactcggagcaggagctgctgggcggcgccaagagcgacatcctcctccgctccaacccggtgcacaagaagatccccgtgctcctccacgacggccgccccgtctgcgagtccctcgtcatcctcgagtacctcgaggaggccttcccggaggcctcccccaggctgctccccgacgccgtctacgcgcgcgcgcaggcccgcttctgggcgggctactccgacaaggtctacgaagccggcatgcggctg

SEQ ID NO: 1299 - DNA, 352 bp, Zea mays
  Clone ID: LIB143-050-Q1-E1-E12
cctaaactaagtcatactatcggccagctgctgagtttctggcatcttacccagacatatgtacctatggtgttgatgaccatgatgcagatcaaattcatgttatcgtggcatctttgtatcaaaaagatgcagaagagacagttgatggtattgaaaatacaactgctacccagcttgatgttgctgatagtggaagcctttcagatcgtgtttctcatgttgaggttgtaattagcttgctgcctgctagttttcatgctgccattgcaggagtatgcatagagttgaggaagcacatggtaatggcaagctatgttgatgaatccatgtcagacttgagccaagctgc

SEQ ID NO: 1300 - DNA, 296 bp, Zea mays
  Clone ID: LIB143-050-Q1-E1-E3
atcgctcactgcgtgcgctaaaagcagcagcagctccagccgtcgccgtctccactctccagtctccagcactgctccgcgcgcgccggattgagggagggcaggcggactatgaggagagattagtcgcttcgggcttggatgatagcacaggatattgcgcgccaggtacatcgctccatcatgtagcaggggagcagaggtccgagagctcatagatgcgagtctcgggagttgaaagcttacggaagctgtgatgttgcctcctggagaggtattcggtggatgtcttgcgg

SEQ ID NO: 1301 - DNA, 359 bp, Zea mays
  Clone ID: LIB143-050-Q1-E1-E4
tgggtccatgcaagcctctacactgacttctgctacaccaccgccttcttcttgatccagccaagccagggatcgccatgtcggactcggaggagcaccacttcgaatcgaaggccgacgccggagcgtcgaagacctacccgcagcaggctggcaccgtccgtaagaacggcttcatcgtcatcaagaaccgcccctgcaaggttgtggaggtttctacctcaaagactggtaagcatggtcatgccaaatgccactttgttgccatagatatattcaacgggaaaaagctcgaagatattgttccttcgtcacacaactgtgatattccgcatgtgaaccgtactgagtaacagctg

SEQ ID NO: 1302 - DNA, 419 bp, Zea mays
  Clone ID: LIB143-050-Q1-E1-B1
ctcgcgggtcgacacacgcctctagagcggttctacgtacgagtcgtcgcatcaggtcccctcgattcgccggcggcgccaccaaccaagctcatacatctgaattgactagtcaaactcagtgatctctttggggactaatcaaactcaagaactaagtttcatgtctgatctcgacgtccagcttccatctgcttttgatccgtttgcagaggcaaatgctgaggattccagtgctggtgctggatcaaaggactatgtgcacgtgcgtattcagcagcgcaacggaaggaagagtctgacaactgttcagggcttgaagaaagagtacagctacaacaagatcctcaaggatctcaaaaaagagttctgctgcaatggtactgtagtccaggatccagagctaggccaggtcattc

SEQ ID NO: 1303 - DNA, 433 bp, Zea mays
  Clone ID: LIB143-050-Q1-E1-B11
tgggtcgatacaagactctagagtgactcgtctcatctcacttcctcagtcctcgtccgtctctgctccctcctctctctacctagcaagctagccagccttcctgtagcgcggcagagatggctgcccctgcctccaccacggcggcggcggcggcggcgctgctgctgctgctgctcgtgtcgctcgccgcggcggcggacatgtcgatcgtgtcctacggggagcgcagcgacgaggaggcgcggcggatgtacgcggagtggatggcggcgcacggccggacctacaacgccgtcggcgaggaggagcggcggtaccaggtgttccgggacaacctccgctacatcgacgcgcacaacgccgccgccgacgcggggcgtcactccttccgcctcggcctcaaccgcttcgccgacctcaacaacgacga

SEQ ID NO: 1304 - DNA, 272 bp, Zea mays
  Clone ID: LIB143-050-Q1-E1-B12
gcgggtcgctacgatacccgatacttactcgtaatgaagagtgtgttttagcgttgattgtacacctgtttgttctttgtaaagccggtgcatgatctgggaatttgtttcccatgtgaggtttcaaaacgatctctgctctaccacaactccacaagccaagtttgcaagtgggcgtcgtcaagaactcaagatctatggcacatacgttttcctgtgtgtgggttcccttccacttgtctccaatatattcttacaacaagagcatctcc

SEQ ID NO: 1305 - DNA, 398 bp, Zea mays
  Clone ID: LIB143-050-Q1-E1-B2
ctcgtgggtcgatacacgcgtctacactcactctcactatctctctccgtcggcgacgagcctgggcgacctgcgccgccgcccctagcccaggtctccatcggacgcttcgccaggtcttgtttagacccatcgccggcaccgagcaacttttgttatcggatcccgcatcgtggaatgcttgccaaagggaggaaggtagctggaaggcgtgaagaaatgtctgcaaattatgcgtttggaccacaggatgatgatgcgattattaaacacaggcttctgactaggacaacgaccaccaggggtgaaccgccactaaagaagcttcagaagaagttcatgtcctttgcaactgagatcgagaaggatgcagataacataagtgactgtgaaagact

SEQ ID NO: 1306 - DNA, 344 bp, Zea mays
  Clone ID: LIB143-050-Q1-E1-B4
tgcggacactcgtgcggacgcgtgggtggaagggcagccaataaggtaaggggtgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgtcgtcgccaccctccggcgccgccatcccggtggtggacctctcggtgacgcggcgcgaggacctagtcgagcaggtgaggcacgcggccggga

SEQ ID NO: 1307 - DNA, 405 bp, Zea mays
  Clone ID: LIB143-050-Q1-E1-B5
atacaacactctacagtgagtcgtaataccagagccggagagcccagtgaaacagagccggtgaacgcagcccagtcagtgagtcccccgatcccgactccggcgatctccccaaccccatggccgccgccggcgaggcccccagcacgctcctccgcttcctctacttcgtcggcgccggagtaatctgcaccaaggccatcaacacctatcgcgactacgagcagaaggagtccaccgccgccctcgccgccgccgaatcggcgttggctgctgccgcggcggccgagcccgctcctgcaaccgccgccgcgaagccctgattgtggacgagggcctgtcttcggcggttagggttctcgggatgttgctccccagaggggagatagatattttcctttggtt

SEQ ID NO: 1308 - DNA, 388 bp, Zea mays
  Clone ID: LIB143-050-Q1-E1-B6
gcgggtccatacaagcctctaatctaagtcatagaaggcatccctccggaccagcagcggctcatttttgccggcaagcagctcgaggacgggcgcacgctggccgactacaacattcagaaggagagcaccctccacttggtgctgcgtctcagaggtggcatgcagatcttcgtgaagacacttactggcaagacgatcacccttgaggtggagtcctcagacaccattgacaacgtcaaggccaagatccaggacaaggagggcattccaccggaccagcagcggctgatcttcgccggcaagcagctggaggatggtcgcaccttggctgactacaacatccagaaggagagcaccctccacctggtgctccgcctcaagggtg

SEQ ID NO: 1309 - DNA, 425 bp, Zea mays
  Clone ID: LIB143-050-Q1-E1-B7
gggtcgtatgcaagcctctatactgcatcgatatagagcgagaagaaagtaaggagcatcttagacgagctctctggcgatgcccatagcctgtattggaaatccgaagacgatgtaggcgttgctggtctgggaggcgaaaccgaggcgcacccttacgtctccttcaccataaattttgtctgagacaaagtatggttcctagaccgtctgtggcctaggcaatataatacttggaagcagctattggaacgcaagcgcggaacgagcatgtatattactctgttgatttatcggttcatgtggtcctgtagttcatatcacagagagatcagccgacggatgctgtaatttctgaggaacctatggaattcctgtagttcatgtggtcctgtaatttctgaggagtacctacctaattccct

SEQ ID NO: 1310 - DNA, 330 bp, Zea mays
  Clone ID: LIB143-050-Q1-E1-B8
aagcctctatactgagtcgtatcagcacacccccatccatgggcgcagccctgctcagctgctcgccggcggtgcgcgcgctcctctcgccggcactctcgtctcgcgtcgtcgcgtccaagcaggactcctcgtctcccgcgccgccgctacctgccaaagccgcctctatcacaaagaccttctcgatctaccggtgggacccggactcgccgtcgacgaatccgcacctcaaggactaccacgtggacctgtccgactgctggccgatggtgctggactcgctgctcaagatcaacaagtagcaagacccgtcactcaatttccgcc

SEQ ID NO: 1311 - DNA, 378 bp, Zea mays
  Clone ID: LIB143-050-Q1-E1-C1
ggttcagatgttgctataaagagaatcaacgatcgatgctttgctgggaaggcttctgagcaagagcgtatgaggactgatttctggaacgaggcagacaagcttgcatctttgcaccatccaaacgtagtagccttctatggtgttgttgtagatggacctggtggatctgttgcaacggtaacagaatacatggctaatggctcactccgacaagcattacaaagacatgaaaagatctttgatcggcgtaggcgtctactaattgcaatggatgttgcatttggaatggaatatctccatgggaagaatatagtgcattttgacttgaagagtgacaatctgcttgtcaacctaagggatcctcaacggcctata

SEQ ID NO: 1312 - DNA, 221 bp, Zea mays
  Clone ID: LIB143-050-Q1-E1-C10
aaccctctagaggaagtcctactacaggtgatcaggtcgctagctcccggcttaactagtaggcagccatgaatttcggtgggaatggcaacgcgacgatccggtgcaagtactgcagggcgagcctgagcgtgatccccggcgagcgcgccatccagtgcgcgcaatgcaactgcgtgacccgcatccggcgggccgaccgcatcccgctggcgcggccg

SEQ ID NO: 1313 - DNA, 426 bp, Zea mays
  Clone ID: LIB143-050-Q1-E1-C11
gtcgggacaagcctctacactaactcgcactcttcgcaagccagtaggtcaccactcaccactcaaaagcttgtgaagcaggtgagatgggcaaggaggtggatgtgtccactctagaggtcggcggcgtccgtgaccgtgactacgcggaccctccgccggcaccgctgatcgacatcgacgagctcggcaagtggtccctgtaccgcgccgtgatcgccgagttcgtggccacgctgctgttcctgtacatcacggtggccacggtgatcgggtacaagcaccagacggacgcgtcggcgtcggggcccgacgcggcgtgcggcggcgtgggcatcctgggcatcgcgtgggcgttcggcggcatgatcttcaccctcgtctactgcaccgccggcatctcgggcgggcacatcaacccgggcg

SEQ ID NO: 1314 - DNA, 123 bp, Zea mays
  Clone ID: LIB143-050-Q1-E1-C12
atcaacttcaaaaagtgcttaggaagacgttttcagcttaaaagaagaaaagtaaaatccgaaaggcatgggatggaactaaagtcgtttataatgttgcttcatggggcgccactgctgttg

SEQ ID NO: 1315 - DNA, 415 bp, Zea mays
  Clone ID: LIB143-050-Q1-E1-C2
ctcgcgggtcgacacacgcctctacactaaatctccatatcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaaccctgaggagatcccatggggttcggttggcgctgaatatgttgttgagtccacgggtgttttcactga

SEQ ID NO: 1316 - DNA, 391 bp, Zea mays
  Clone ID: LIB143-050-Q1-E1-C4
tcgcgggtcgacacacgcctctacagtcactcgtgcgaacgcgtgggcggacgcgtgggctacctactactcaagtatccatccttattgagtacagtgttgatccatggactcggaaggagttgtagcagcaaaggtggcagatgagactactaaaccggcaatccaagaagacggcgccgagagcaaggccgggatgactgatctgctgatgctgaccgacaagtcgcagctgcaggcgctggcgatgctgctgcggaacaacgaggagctcatgatgagccaggcgatcaagtcggagacggagcgcattgagtacctcaagacggtgagcgactgctacacgcggacgatgaagctcctcgacgattccatggcggccaggaccacg

SEQ ID NO: 1317 - DNA, 390 bp, Zea mays
  Clone ID: LIB143-050-Q1-E1-C5
gtactatccagcctgatgctatcaatctcataaggatctattgccattttagtgctacagtttttgctcatctcagttattgtttgatgaggtttctttgaagataaactgtttcctgactgttttgtcaaaattttcggattaactgcaagagatttttagttcagaggccaagtattccatgttacgtttttggttttgctagtggaatgagttttgggtttaccggagtgactttttttttgttttgcttctcagagtaacagattgtgtggtctctcaggatatggtttgtgttcatttcaattattgttcaatgtaaattttgcttgaagatgcatcatttttatgtatgaattgaaacgttcaattgcctgcaagaacttgagt

SEQ ID NO: 1318 - DNA, 342 bp, Zea mays
  Clone ID: LIB143-049-Q1-E1-G8
ctcgcgggtcgatacacgcgtccaatgttgcacatcgaagtcgacaccgagaaaggaggcctggctgtctaccccaacttcttcgtcgattttggcaccgagcctgatggtcctgccctggcccacgagatgagatatcctggtggggactgcacctctgatatatggatctgaggtcaaggattcggcgtaattaacaggctgctggagaatccctgttgttgtatgcactgtaattaacatggtatccgtgcggtgttctgtcttgtactgcgactgttgccagtggaataaggcatggtttcatgagaactctagattaataaaagaagtcctgattct

SEQ ID NO: 1319 - DNA, 384 bp, Zea mays
  Clone ID: LIB143-049-Q1-E1-G9
acgctccctgccgtgacgaatttatacacagctgctatctaatccggccgtgagtgcactggatgcaatgatgacgaagcccgcagccatcgttgttgctgctatcgccgtcctctccgtcagcctgctggctgggtcgtcgtgccttgcccttgcgcggtgcaacggcgacgtctccatcgtgggctactcacaggatgacctgtcgtcgcacgagatcctggcggagctgttcgagcgctggctgtcccgccaccgcatggcgtacgccagcctgtatgagaagctccggcggttccaggtgttcaaggacaatctgcaccacatcgacgagtacgatcgcaaggtgaccagctactggctgggcctcaacgagttcgccga

SEQ ID NO: 1320 - DNA, 421 bp, Zea mays
  unsure at all n locations
  Clone ID: LIB143-049-Q1-E1-H1
tcgtggatcgatacaagcctctacactgcgtcgtatcattgcaaccgattgcctatccccctcccaaccaaagaccgatggcgcccaaggccgagaagaagcccgcggcgaagaagccggcggaggaagagcccgccgccgagaagacgacgcccggaagaagccaaggcggagaagcgggtccccgcggggcaagtccgccggcaaaganggcggcgaaggcaagcgtggcaagaagaagggcaagaagagcgtggagacgtacaagatctacatcttcaaggtgctgaagcaggtgcacccggacatccgcatctcctccaagggcatgtccatcatgaactccttcatcaacgacatcttcgagaagctggccggcgaagccgccaagctcgcgcgctacaacaggaagccaacatca

SEQ ID NO: 1321 - DNA, 428 bp, Zea mays
  Clone ID: LIB143-049-Q1-E1-H10
tcgcgggtcgacaaacgcgtctaccgttgctcgcctcaggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagagggcatcatca

SEQ ID NO: 1322 - DNA, 386 bp, Zea mays
  Clone ID: LIB143-049-Q1-E1-H12
ccctagactgagatcgatgattcaagaaaccaccgagagcccaaccgcacaggcaggagagagagcagggagccagggacagtagcgtggggccggggagcaaagatggaggggaaggaggaggacgtgcgcctgggcgccaacaagttctcggagcggcagcccatcggcacggcggcgcagggcgccggggccggggacgacgacaaggactacaaggagcccccgccggcgccgctgttcgagcccggggagctcaagtcctggtccttctaccgcgcgggcatcgccgagttcgtcgccaccttcctcttcctctacatcaccgtcctcaccgtcatgggcgtctccaagtccacctccaagtgcgccaccgtcggcatcca

SEQ ID NO: 1323 - DNA, 179 bp, Zea mays
  Clone ID: LIB143-049-Q1-E1-H2
acccacgcgcctagctttattacaaataaatttgcttctgcaattcaccgatgggattcgcttcataacgtgattttacataactgaactctgagagtctatcctattgctttgtgctttgggacaatgagactgatataacttttacggtcctgttaaatatagagtgtgctgcactg

SEQ ID NO: 1324 - DNA, 317 bp, Zea mays
  Clone ID: LIB143-049-Q1-E1-H3
cccgtcccgcacactaacccaaggcagataagatcggataagggtcgcagatcgaagcggtgccagggtgcctgcaaatgacattcagctctcgccgtaagacccttcatcagcaacgactacatgacctacatgttcaagtacgacactgtgcacggacagtggaagcaccatgaagtcaaagtgaaggactccaaaacccttctctttggtgagaaagaggttgctgtgtttggctgcaggaaccctgaggagatcccgtggggttcggttggtgctgaatatgtggttgagtctactggtgttttcactgacca

SEQ ID NO: 1325 - DNA, 254 bp, Zea mays
  Clone ID: LIB143-049-Q1-E1-H4
aatcctagcacctggcctccgtcgcgcatcagcgcatccccatggcccaacatcaagatcgggatcaatgtggttcggcacgatgagcacgctggacgccaaagtagcccggcacagtgacgatgtccagctcgtcgccgtggaggaccccttcatcaacaccgactacactgacctacatgttcaagtacgacattgtgcacggacagtgggaagccacaggaactcaaggtgaaggaccccaaaacccttct

SEQ ID NO: 1326 - DNA, 390 bp, Zea mays
  Clone ID: LIB143-049-Q1-E1-H6
tacaagactctagagtgattcgaaccaccgccgctagaagaagagctcggcgattcccaggtcccgcgagaatatgccgaagcagatccatgagattaaggacttcctcctcaccgcgaggaggaaggatgcccgctcagtgaagatcaagaggagtaaggatgttgtcaagttcaaggtgcgctgctccaagtacttgtacacgctctgcgtcttcgatgctgagaaggcaaacaagttgaagcaatctcttcccccaggtttgaccgtcgaggaggtctgattggatacatggcaacgccgagttgaactacccaagcttctttatcagtagcagagcatgctactctatgtacttttggaacctaagctattagacctgtcagtgtt

SEQ ID NO: 1327 - DNA, 414 bp, Zea mays
  Clone ID: LIB143-049-Q1-E1-H7
tagcataaatcatagggcaggagcagccgcagtcccggcgatcccgccgccggtcgccctcacacctcctcgtcactgccttcgtttctctttccaacaatcaagatgagccgtggcggtagcgcgggtggtggtcaaagttctctgggttacctctttggaagcggtgagccccccaaaccagcagtggcaccaccagctgtaagtgctccacctgctgctgcaggtgctccacctgctgagaaaccacctgctgcaaagcctgatggcaccagtcagattgctgctggggttaccagccaaaccaataactatcaaagggctgacggtcagaacaccggcaacttccttacggaccggccttcgaccaaggtccacgctgctcctggcggtggctcttccctgggatacctg

SEQ ID NO: 1328 - DNA, 410 bp, Zea mays
  Clone ID: LIB143-050-Q1-E1-A10
aacactctacagtgaatcatcatatgcaagaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgaggcggccaccgagggcggcggctgcgactgcaacacctgcaagtgcggcaccagctgcggctgctcctgctgcagctgcaactgagctggcccggcccggcgatggcgcacgagagtcgagaggaggaggacgacgacgaggcgtataaatataatagcggcgttcagtaaataagatcctgtc

SEQ ID NO: 1329 - DNA, 394 bp, Zea mays
  Clone ID: LIB143-050-Q1-E1-A2
acaagactctaaaatgagtcgtactagcggacaaggagcaggcggaggaggagctgtgccaagccacaatgggtatctcacgcgactcgatgcacaagcgccgtgccaccggtggaaagcagaaggcctggaggaagaagcgaaagtatgagcttggtcgccagccggccaacaccaagttgtcaagcaataagacagtgaggagggtccgtgttcgtggaggtaacgtgaagtggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgcccc

SEQ ID NO: 1330 - DNA, 402 bp, Zea mays
  Clone ID: LIB143-050-Q1-E1-A7
ggtcgatgacaagcctctaatcagagtcgcatcatgatgatgagattgaggttgaaattgatagtatggatgctgagacactttgggagcttgaccggtttgtggccaactacaagaagaacctgagtaagcaaaagaggaaggccgagcgagcgatgcttgccagacaagatgcagagttgcgtgcgcagcgccttatacaacaaccgcaaccaaccccagtcccccaagaacctgttggtgaaaaatctctaaagcaagttgcaaaaggtgagcaactaccaacatctgcatcagagaaaaacgacgagaatagacagaacgtgagtggttcaagcaattcaagcagctccagcagtgactcaggatcatcgtccagtgactcagacagtgataactcct

SEQ ID NO: 1331 - DNA, 367 bp, Zea mays
  unsure at all n locations
  Clone ID: LIB143-049-Q1-E1-G3
ccaagactcgcggatcgacacacgcctctagtacgtatcacagtccattattgccgtctcccttttgcgtgagcaaagaaagagagcgagaagcagtcgccatgtctggcatcatccacaagatccaagagaaactccacatggggggcgaccacaagaataaggaggaggagcaccacaagaaagccgaggagcaccacaagaagganganggggagcaccacaagaaggacggcggggagcacaaggaaggcatcgtggagaagatcaaggacaagatcaccggcgagcacggcgacaagtccggcgaccacaaggagaagaaggacaagaagaagaaagataagaagaagcaccgcgagggcca

SEQ ID NO: 1332 - DNA, 278 bp, Zea mays
  Clone ID: LIB143-049-Q1-E1-E4
cccacgcccccagcgccgaccaccaaagccagcgccggcggcttcgatgcggccaccgagggcggcggctgcgactgcaacacctgcaagtgcggcaccagctgcggctgctcctgctgcagctgcaactgagctggcccggcccggggatggggcacaagagtcgagaggatgaagacgaccaccatgcctataaatataatagcggcgtccagtaaataagatcctgtcaactgcacccgccattatccatggtcgctcgctccccgcctgcgtct

SEQ ID NO: 1333 - DNA, 420 bp, Zea mays
  Clone ID: LIB143-049-Q1-E1-E5
acagcctccaaagccactcccaaacccccgcttccagaaccttctcgaagctccccgccgcctcctccactcgcaccgatggcgaaggaaccaatgcgcgtgctcgtcactggcgccgcaggacaaattggatatgccctggttcccatgattgctaggggtgttatgcttggtgcagaccagcctgttattctgcacatgcttgacattccgccagcagctgaagcccttaatggtgttaagatggagttggttgatgctgcgtttcctcttctgaagggagttgttgctacaactgatgttgtggaagcctgcactggggtcaatgtggccgtcatggttggtggattccccaggaaggagggaatggaaaggaaagatgttatgtcgaaaaatgtttcaatccacaaatcccaagca

SEQ ID NO: 1334 - DNA, 362 bp, Zea mays
  Clone ID: LIB143-049-Q1-E1-E6
ctcgcgggtcgaaacacgcgtccatcgacgatcatggcatgagcgtggttattttgagaagggactacaaggacgagaaggtcgaggttactgtcagcatgcctaatttagaaggaggccccgagtttggtgatgaggatggcgagggcgatggtgagagcgctgtcaaggacgacggagaagcagaagaagatgacgagagtgccggggatagcagcatctctcttaaggtggtagtttccaaagactctggcccaaagctcgagttcacatgcacagccttccgcgaggagattaccatcgatgatatgctgatagttgagaaaacagacgacgaccacggagaaaaaaaattcccccta

SEQ ID NO: 1335 - DNA, 354 bp, Zea mays
  Clone ID: LIB143-049-Q1-E1-E7
taccgagaataggggcagcggagtcaaccaggtacgatgtgctcggtagcgaggctggcgtttgtgcttgcactggccatagccgcctcgtcaattgaggttgcggagagcagagattttaatatctttgctcagggcagcttgcctgatgcaaccaagggatcgtctggtctagctgcaaccagtggaaagttgtgtcagttatgcgagcagtactcatccgaggcgctcctctatctcacacaaaacgagacccagactgagattcttagcattctacaccatgaatgtgccagccttgcccctctcaaacagcagtgcatcacgctggttgactactacgtaccccttttc

SEQ ID NO: 1336 - DNA, 375 bp, Zea mays
  Clone ID: LIB143-049-Q1-E1-F1
tactgtgtctcaatataaccctcctccagtgctcttctcttctagccgccgccgcaaccgcttgctagcgctctgcgctctcatcctcgcgtccgtggaaggtcgtctcgccatggcctccgagacggagacgttcgccttccaggcggagatcaaccagctgctatcgctcatcatcaacaccttctactccaacaaggagatcttccttagggagctcatttcaaactcctccgatgccttggataagatcaggttcgagagtttgacggacaagagcaagctggatgcccagccggagctgttcatccacatcgtccctgacaaggccaacaatactctgacaatcattgacagtgggattggtatgaccaa

SEQ ID NO: 1337 - DNA, 412 bp, Zea mays
  Clone ID: LIB143-049-Q1-E1-F10
actcgcgggtcgacacacgcctctacaatggggcgacccagctgcatgaccgccgggtctggatggctggggcgctcttcgtctatttcttcagcgtctcggggggcatgtatgggattatcaggcacacacccatgttcctcaccgaccgcgcggatcccaacaagctcgtgttcttctaccaggggtcagggatgcagctgggggctgaggggtttactgtcgggttcttgtacacactcgtgggtctcatgatcgctgtggtgacacacttgttggtgaaggtggagagcctgcagacgcagcgccttgcgatgctcgctgtcatggtggtcgggtggtgggctgttaggaaggtgatctacttagataactggaagactggctatagcattcataccttcttcccgag

SEQ ID NO: 1338 - DNA, 351 bp, Zea mays
  Clone ID: LIB143-049-Q1-E1-F2
acgattccttcttcaatcttctttagattcatcagtgttgccttcttcaccgtagcagatctagtaacgctgacattgtggtcccagagtggtgccttgggagacctgaccagctagcaaataagcccagccaactccgatcgcaccagcacctgcaccactgcaccagccgcccgcaacccgcaaagctgcttcccggactatctagggtttcgtgtacgccgcttgatctagtcctctctcccggcacgccagggcgcagcgttgatggcggcggcaccggcggacgctaaggcggaggccgccaagatggacctcctcgaggacgatgacgagttcgaagagttcgag

SEQ ID NO: 1339 - DNA, 331 bp, Zea mays
  Clone ID: LIB143-049-Q1-E1-F3
acacgcggacacaccacaggcgcgcaagcccaaccgatcgagcagctctagcatggcgagcggcggctactactacgaccagagcgccggctacggcggctacagctactccgcggcgccgatgacgacgccgtcccacctcctggtgttcctggccaccgtggcgctgctgggcgccacgtcgctctactcgcgctacgagtccgcggtggagagcctggtggaccaagtgcggttcgccgtggtgctgtccccgctgctgctcctgctcgcggtccagtactgggcgggcacggccgggtctcggcggccccggggcggcgccctcccg

SEQ ID NO: 1340 - DNA, 387 bp, Zea mays
  Clone ID: LIB143-049-Q1-E1-F5
aagactcacctgcatttttggcacaccagaacagaagaagaaaaaaaaaacaggcactgagctgagatggcgaagcacttggctgccatgtgcaggtgcagcctcctagtgcttgtactgctctgcttgggctcccagctggcccaatcccaggtcctcttccagggtttcaactgggagtcgtggaagaagcaaggtgggtggtacaactacctcctggggcgggtggacgacatcgccgcgacgggggccacgcacgtctggctcccgccgccgtcgcactcggtggcgccgcaggggtacatgcccggccggctctacgacctggacgcgtccaagtacggcacccacgcggagctcaagtcgctcaccgcggcgttccacgcc

SEQ ID NO: 1341 - DNA, 357 bp, Zea mays
  Clone ID: LIB143-049-Q1-E1-F7
aggtctaggactcgcgggtcgacacaagcctccatgatgagtcttactattcatatcatgtccgaacggaccgacacatggatatcccgccgctgcagggcctgtccgaggtcgaacaactggagccgtagggcatagtgcgcgcgcaccacacgttcaccgggggcgagtcggggactttcaaatggattgtgacgcattccgtcgactcgccactggacgacctgtggcccaacatgctcagcttcagaattccgcaacggtataagcacttcaacttatgttgcaactttcagggcaatgaccgcggcacccttagcagcgtacgctacgtcaacgtcttcaccggcctcccgg

SEQ ID NO: 1342 - DNA, 367 bp, Zea mays
  unsure at all n locations
  Clone ID: LIB143-049-Q1-E1-G1
ctcgcggatcgatacacgcctctacacagagtcatctatcgctcaccagaggaactagcggaccaggcaaagccgagccgcaaccgcgaagatcttgcgtggcctccttttcccagatcgtcactgtgccgctcgtgccctccactcccggtccgcccaaccaataatccatccatccatccaccaccaccaccccgctgcggcgatgtgcggcggcgccatcctctcgggtttcatcccgccgtccggggtggcggcggcngcggcggcggccaagaagaagcagcagcagcggtgccgtgtgactgcggacctgctatggccggggcccggcagtaaggaagctccccaggaccaggaggaggac

SEQ ID NO: 1343 - DNA, 86 bp, Zea mays
  Clone ID: LIB143-049-Q1-E1-G10
ctctaaactcaggctcacaattactcatctttgacttctctctgtggagcacttgtgatcgaagatcgtgccctgttttctgtact

SEQ ID NO: 1344 - DNA, 410 bp, Zea mays
  Clone ID: LIB143-049-Q1-E1-G12
agtgccactgcgtgcaaccggggttctacggcaacaagggcgcctgcccctgctacaacaactggaaaaccaaggaaggagggcccaagtgcccctagaataagatccaccgcagctcccgtccgccattgtccccccttctccgaatctggaacgtgttgttcatcttcgaccaccccctaggcttggcattttattactagtataatgctagtgtccgcccgttgcttaatctggaatgctaccagccagatctccatgctctcctgtgagccactcggcagagtgaggattactaggtagggtggcatgtcatgtgctccaccctccactggtacgagtcaatcaactaaagctacccccggattgatgaggaacatcccgcgcgattagtggggcatgtcaataca

SEQ ID NO: 1345 - DNA, 420 bp, Zea mays
  Clone ID: LIB143-049-Q1-E1-C10
gactcgtgggccgatgcaagcctctacactgagtcgtatcacagtcccctctagccgccgcctaccgctcgcgctctcctcgcgttcgggaaggtcgtttcgccatggcctcggagacggagacgttcgccttccaggcggagatcaaccagctgctctcgctcatcatcaacaccttctactccaacaaggagatcttcctcagggagctcatctccaactcctccgatgccttggacaagatcaggtttgagagtttgacggacaagaccaagctggatgcacagccagagctgttcatccacattgtccccgacaaggccaacaacacgctgacaatcatcgacagcggcattggtatgaccaagtcagaccttgtgaacaaccttggtaccattgcgccgtcaggcacgaaggaat

SEQ ID NO: 1346 - DNA, 369 bp, Zea mays
  Clone ID: LIB143-049-Q1-E1-C11
tctacagtgaatcgtattattgggggagtagacttattaccaacgttggtgtcctgttatctagtttaacctgaacctgttcttaaaaactgtgtcagaaagtcggtttgttctataatatattgtctgtgctatgagctacaataagcaagagtattttaaattagaaagcagttttctaaatgatgcaaaggcagattggtttgagattgcacatggaattcttttagtgaacatcttatcttagtcaagcagtagttaagattaactgttttacttattacccccaagaactctttgaaactcgactaactattctgtggtttctttcaggtagatgactgttttgggcacccgcaagtgggttgt

SEQ ID NO: 1347 - DNA, 422 bp, Zea mays
  Clone ID: LIB143-049-Q1-E1-C2
ctcgcgggacgacacacgcgtccaaccatctccacccaagaccgccgccctcatccgtctcccccgtcttcctcgccctcgtctacctcgcgctcgtcggaaaaaacagctcagagacgtgctcggcttgaagtatacaaagaacagctcttgctagaaaccaagcaaaaaacgggacaggactgaagaatatgatgacttgatttgcatcgtaccgaagacattgctggccggaaattgatgagtccatggatgagtccatgatggacttggagaatgaggcagtgctacggaacgactgcgagaaggaagccgtgctgcggaatgaattctgccaaattgtatcattataagggggttgtgtatcataaattaaaaatcttgtgccaaggaagttagacctgcaaattgggcatacatgc

SEQ ID NO: 1348 - DNA, 286 bp, Zea mays
  unsure at all n locations
  Clone ID: LIB143-049-Q1-E1-C4
gtaccagtaaaaaactctttcgcaacacttggaacagtaaactaagacgttcaagcttccactgtctcggtgggagcctcgatcagaagaccctttgtcggcttagccaagaggtcggtgaactcctgnaacggggtcttggcatacttggtctcggcccagaactcaggagtgaggaagccgtaggtcttcatcagacaatcaaaggttgccttgacgaagttaccgagtgtcttggtggagccacgggacgaggtaaagacatcttcaatgccggggaaactgg

SEQ ID NO: 1349 - DNA, 385 bp, Zea mays
  unsure at all n locations
  Clone ID: LIB143-049-Q1-E1-C5
acaacactctagaatgagtcgtcttaatcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaagaccacggtcctcgccgcgccgaccaccaagggcagcgccggcggcttccaagggggcaacgagggcggccgctgcgactgcaacacctgcaactgcgggaccaactgcggctgctcctgctgcaactgcaactggaccggtcaagggatgggncacgagagtccagaggacgacgacgagtcgtataaatataat

SEQ ID NO: 1350 - DNA, 384 bp, Zea mays
  Clone ID: LIB143-049-Q1-E1-C6
tcgtgggtcgttacaatcctctacagtgagtcatattagatgcaaactagttgccaagcagattgcggatgacggaagggtgttcagcatatggaggcctctctgccctaatgggtatgtctcaattggtgatattgcgcatgttggcatccatccaccgcattttgctgctgtatacaagaatatcaatgggaactttgcactgcctcttggctatgacctggtttggagaaattgtgctgaggattacaagagccctgtatcaatatggcttccaaggccaccggggggatacgtagctcttgggtgtgttgctgtcccttcattcaatgagcccactcttgactgtgctttctgtgtggatgaaagactccccgatgatgc

SEQ ID NO: 1351 - DNA, 358 bp, Zea mays
  Clone ID: LIB143-049-Q1-E1-C8
acaacgcaacagcacaatcatgataccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgaggcggccaccgagggcggcggctgcgactgcaacacctgcaagtgcggcaccagctgcggctgctcctgctgcagctgcaactgacctggcccggcccggcgatggcgcacgagagtccagaagaagaggacgacgacg

SEQ ID NO: 1352 - DNA, 254 bp, Zea mays
  Clone ID: LIB143-049-Q1-E1-C9
ctcgcgggccgatacaagcctctacactgacgtcgtactactacgtccaccaaatcgtctcttcaagcttacgagtacttctcaatggtggggaaaaagtggcactgttgatttcaagtactagtgggggcaccccaacggactgacactctagtcggtgcttgctgggaatggaagtgctacaaaagttgtccgacaatttatctgctcgcccgcaggatcatgacatcgggattgagacaatcattgtcttc

SEQ ID NO: 1353 - DNA, 392 bp, Zea mays
  Clone ID: LIB143-049-Q1-E1-D1
tcgcggatcgatacacgcctctaggctgactcatataccatggtggacgttgcttgaagaagctgtgaaaagcgctgacggcaaactcggcaagccggagatattcccagcctctactgacgctcgctacttccggaaaatcggattaccagcatttggcttttcacctatggcgaacaccccgatactgctccatgaccataacgagtttctgagcaaagacgagtacctcaagggaatcgggatatacgagtccatcatcagggcactggccactcatgaagatggcggcaaagatgacgaatccagggcagagctgtgagcctgtgactgaggagaaccttgaaccttacctcgcttttgccgcagaccaaatggagcactggaagtca

SEQ ID NO: 1354 - DNA, 351 bp, Zea mays
  Clone ID: LIB143-049-Q1-E1-D2
agcgcgccacgccgaacctgcgagccatcagcccatcacccacccaacccctcgccacgcagatctagggagcttgccctcccaccgggcggtgattcttccgtcccatcaccgatgcggacgccggcgatgctccggtgggccgcggcgctcgcggtcctgctcgccgtcgccgcgccggccgccgggttctacctccccggcgttgccccgagcgatttcgcgaagggtgatccgcttccagtgaaggtgaataagttgacatctatcaagactcaactcccgtatacatattattcccttccgttctgcaagccagataccatagtcgacagtgccgaaaatcttggg

SEQ ID NO: 1355 - DNA, 398 bp, Zea mays
  Clone ID: LIB143-049-Q1-E1-D3
acggacgcgtgggtccagagaatggctacaatgtcagatgaagaaattgcaaaaattcatccagaccacaacagaaaatctttgagttcattactgccacgcctacactattaccagggtggtaactgtatggtacatgacatgtttggccatgaggttgtggggaaaataaaggaacaatattgtgatgcatttctaacagcacactttgaggtccctggagaaatgttctctttggcaatggaagcacaacggagagcaatgggagttgttggatccactcagaatatcttggatttcattaaggatcatgtgatgggagctctggacagaaatgtagatgaacaccttcaatttgtgcctaggaacagaatcagggatgattacttcaagtggtg

SEQ ID NO: 1356 - DNA, 387 bp, Zea mays
  Clone ID: LIB143-049-Q1-E1-D5
ctcgcgggtcgatacacgcctctagattcagtcgtaccaccattccgtcgtgtcaccaccgccgccgccggagtgtgtcatcgccgattcgcctggtatggcagcaccgcccgggggagcggggatagtgtggcagacgccggccaacccgcccgagtcgcacgactacatcatccgcaacggtcggcgctacgtgaggccttactacttcgagttcatctcccatgtgaagaacagatgggctggaaagaccatcgttgacctcttcactgatgagttcaaagggcgttcccgcgattactatgttcatgcagtgaagtgtgggaggcttcaagttgatgggcaaatggttcacacagactatattgtgaaatcatcacaaaagat

SEQ ID NO: 1357 - DNA, 179 bp, Zea mays
  Clone ID: LIB143-049-Q1-E1-D9
ctcgcgggccgacacacgcctcaaaattaagtcgtattagtaacatattttttaatagaaggccagggaaggtttacttagtgagcgtcaactactactgtgacagactagtttattcttatagaggcgccacttattttttgtaccttgtgtaacagggaataatacgtaaggattag

SEQ ID NO: 1358 - DNA, 406 bp, Zea mays
  Clone ID: LIB143-049-Q1-E1-E11
gactcgtaggccgttacaaccctctagattgagtcgtattaggagctgcgcgcgccggagctcacgctgtgcgccaacagctgcggcttcccgggcaacccggccaccaacaacctctgccaggcctgcttcctggccgccacggcttcctcctccgcctccgtctcgccgccgccgccctcctcctcctcgtctccggcggtgctccagttcgacgaccagcagcaaaatccgaggccgtgtgcgccggcggcgtccgggcccacggaggaaccgcccaggccggcccgggcgtcagcgccggcgtcgtcctcgtccgtccgccggtgccagacctgccgcaggcgggtggggctcacgggcttccgctgccgctgcggggacctcttctgcggggcgcaccgct

SEQ ID NO: 1359 - DNA, 359 bp, Zea mays
  Clone ID: LIB143-049-Q1-E1-C1
tatcatgagtcgaatcaatcatcgcatcacaccacacggactgcgtgactaatccgtccgtccagcgaccggcagtggcgctgatggagcgcgagtacctcagcgtggtcatgttcacgtggctcgcgcacgggcagttcacgccgtacctggaactggccaggcgattcacatccgccaaagacgcctacatcgacttgaccgtccagctcgtctctacgcccgtcaacctgtccgctattacgcggtaccagacccctcggatccgcgtcgcggagctccacctcccggcggcgccggacctgccgaccgagctgcacaccagcaatcacctggccgcgcgcctcatgcctgcgctc

SEQ ID NO: 1360 - DNA, 388 bp, Zea mays
  Clone ID: LIB143-049-Q1-E1-A1
agaaagcaactgagggggcgctctcaattgatgacatggcaggaggaacattcaccatctccaacggtggtgtctatggaagcctcctcagcacacctatcatcaaccctccacagtcgtctattctggggatgcattccattgtgcaacgccctgtggttgtgaatggtgacatccttgcgaggccaatgatgtaccttgcgctgacttacgaccacaggttgatcgatggcagagaggctgtcttcttcctgcggcgcatcaaggatgttgtcgaggaccccaggaggttgctgcttgacatataaattcatgcaccagcgctgcgctgccctgccggactgttttgtgcaattgtgcctatctggaaataatgccatggaaattt

SEQ ID NO: 1361 - DNA, 361 bp, Zea mays
  Clone ID: LIB143-049-Q1-E1-A10
agctcctccgcctccacctccgcccgccccctgatccggatcgacgacgccgaccccagatccctttcctctccgccgtctccccgcccgcccgcccgccgatcccacatccctcccaggccttcaagcagtgaaggagccttatgagctggttggctggggctttactccaattctggtgctactaagatgggccagggcctgctcagcaacaagtctgggacaagactaagcatagatgaaatagcaggcgcttaccatttcttgctcttgctctcccccgtggtttccttctgggactgcatcttccgcaagataagatactcattcagacctgagtgggtgtagcagcatcctgcac

SEQ ID NO: 1362 - DNA, 380 bp, Zea mays
  Clone ID: LIB143-049-Q1-E1-A12
ctctaggcagctgcgcctgactgaggcccgacggcaagacccaggtgacggtggagtacgtgaacgagggcggcgccatggtgcccgtccgcgtgcacaccgtgctcatctcgagccagcacgacgagaccgtcaccaacgacgagatcgccgccgacctcaaggagcacgtcatcaagcccgtgatccctgagaagtacctcgacgagaagaccatcttccacctcaacccgtccgggcgcttcgtcatcggcgggccccacggtgacgccggcctcaccggccgcaagatcatcatcgacacgtacggcggctggggagcccacggcggtggcgccttctccggcaaggaccccaccaaggtggaccgcaacggcgcc

SEQ ID NO: 1363 - DNA, 364 bp, Zea mays
  Clone ID: LIB143-049-Q1-E1-A2
atagtgagtcgatattagaatcatctgaatcgtcaagggccattccatgtggcaacgagagaattgccttacgatccgatgcaattgaatctgtcactcgctcattatcatgggaggaggaggtgagctcaccgtcgcctttacttgactcgggaatttgacccctctctcaagcgtggacgacgatgaacgtgaatgtgttgcctttgtacaaaagattgtatcagctgctgggctacgcgacctgcggttggatatggtcttcacaagccggtatgtgcctgacagccctgttcaccctgcattgtgcgacaagctattggacctgaaggatgaagctgctaactccacggagccgaggtcg

SEQ ID NO: 1364 - DNA, 213 bp, Zea mays
  Clone ID: LIB143-049-Q1-E1-A3
cccagccactgtggaggaggccaacaccgagtcgatgccgggctatacggacaagatcaggtccgcggctgccggcacaacggagtacggcaagcagctggcgagcaccgtgtacgagaaggtcgccagcgtccgcacagccgtggcgggcaaggttcagcaagccacgcagtcggcccgcacggcgactcccggggtccgcgcgcaccggga

SEQ ID NO: 1365 - DNA, 51 bp, Zea mays
  Clone ID: LIB143-049-Q1-E1-A5
tcactactaggactcgtgggccgttccaactgattaaagcgaatctataca

SEQ ID NO: 1366 - DNA, 406 bp, Zea mays
  Clone ID: LIB143-049-Q1-E1-A6
ctcgtgggtcgatacaagcctctacattaattcatatgaatcgtcaagaagcattccttgtagcaacgagagaattgccttacgatccgatgcaattgaatctgtcacgcgctcattatcatgggaggaggatatgagctcaccttcgcctttacttgattcgacaatttaaccccaatctcaagcgtggacgacgatgaacttgaatgtgttgcctttgtacaaaagattgtatcatctgctgggctaggcgacctgcggttggatatggtcttcacaggctggtacttgcctgactgccctgtagaccctgcattgtgcgacaagctattggaccggaaggaggaggctgctaagtcgagggagcggaggtcgaaccaaaagcttcttttcgattacgtgaaca

SEQ ID NO: 1367 - DNA, 382 bp, Zea mays
  unsure at all n locations
  Clone ID: LIB143-049-Q1-E1-B1
gcgtccgcncacgcgtccggggcattcacattaacttgaagggttttgctattggcaacggactaacagatccagcaatacagtacaaggcataccctgattacgcattggatatgggattaattacaaaaacacaatttaacaggatcaataaaatagttccaacttgtgaattcgcggtcaagctttgtggtacttctggaactgtatcttgccttgctgcgtactttgtctgcaatacaatattcagtgccatcaggacaatcataggcaataaaaattattacgacatcaggaaaccatgcatcggaagcctatgctatgatttctctaatttggagaaatttctcaacctcaaatctgtcagagagagcctaagggt

SEQ ID NO: 1368 - DNA, 403 bp, Zea mays
  Clone ID: LIB143-049-Q1-E1-B10
ctcgcgggtcgatacaagcctctaaactaagtcatattaaaaaaaaaggcaggaggccggcgaactacgcgaggaaaaattttctttcccgggaggctcgggagtcggacacgccacacgctttggtcaaaatcgtttccggttgttagcgcggctgctgctgccgctgctgtcgggggcgagcaggaaggggagcgaacgagcttgggcagctcaagaagaggggacgggggagggagcctgtggaaggcacctgagtacgcgtgaaggagcccgcgcgagagtaggggggaaaccaaatcgagagacatggactcggagcacgggatctcgcgcctggccgccgccaagcgttactacgcggcgcagctcggccgcgtcgacgatgtgcccgggatgggga

SEQ ID NO: 1369 - DNA, 370 bp, Zea mays
  Clone ID: LIB143-049-Q1-E1-B11
gacgcgcgggacgacacaagcccctagagcgagacggagaacggccaccctttttttttttttttttttttttttttttttttttttttttttttgtttttgtttttttttttttttttttttggtttttttttttttgtgttttttttttttttgtttttgtgtttgtgtttgtggggaacaagaacgggattggactaaggagggaggggaaaaccaagggacagaggagggagccaggggaaaggatttgaggacgcgtgcaggaggggggggaaaagtgggggggaaaaggtacgaggggaagggaggcggaagggggggctggcgcaaaaggggggggggcgaaaggggggcacccgggggttaa

SEQ ID NO: 1370 - DNA, 433 bp, Zea mays
  Clone ID: LIB143-049-Q1-E1-B12
actcgtgggtcgatacaaccctctacactgagtcgtctcacgactctctcctcgccggcgacgccgcggagtaggtgcaacagaaactgctcgaggcggaggcggagcctgcggctgcacagacatgggtgatcacgaggcgcgcggtgatgacttcgagaagaaggcggagaagaagctctcgggctggggcctcttcggctccaagtacgaggacgccgccgacctcttcgacaaggctgcgaactccttcaagctcgccaagaactggagcagagctgcatcagtttacatcaagattgctaactgtcatttgaagggagatagcaagcatgaggctgcctcagcgtacgtcgaggcagcaaattgctacaaaaagttttcacctcaggaagctgcgcaagccctaaaccagtctgttaatcttttcctg

SEQ ID NO: 1371 - DNA, 396 bp, Zea mays
  unsure at all n locations
  Clone ID: LIB143-049-Q1-E1-B2
caatccaagcccctagagcggttctaagtacgagtcgtcgcatcaggtcncctcgattcgccggcggcgccaccaaccaagctcatacatctgaattgactagtcaaactcagtgatctctttggggactaatcaaactcaagaactaagtttcatgtctgatctcgacgtccagcttccatctgcttttgatccgtttgcagaggcaaatgctgaggactccagtgctggtgctggattaaaggactatgtgcacgtgcgtattcagcagcgcaacggaaggaagagtctgacaactgttcagggcttgaagaaagagtacagctacaacaagatcctcaaggatctcaaaaaagagttctgctgcaatggtactgtagtccaagattcagagct

SEQ ID NO: 1372 - DNA, 348 bp, Zea mays
  unsure at all n locations
  Clone ID: LIB143-049-Q1-E1-B3
agtcatattaatcgccattttgactgagtccctttcgtttctgtacgccgtcagggagctttctccggccgccgttctactcggttgccagggagaaccagccgttggctgaacctggccactaatttcctagccgagcccaggcaactgaccggacgaccgtcgatgaatcggccggcagccatactcggctgttcagtctgcgcggcgaagcggggccctgcgggctctcccgccggcgtgcgcgtnccctagtgcgggcgcgccgccgtcggtagagcggtcagcggtggtccctgcaaacccggctaaatctgttgttactgtgaactttcgttttctcgcccg

SEQ ID NO: 1373 - DNA, 451 bp, Zea mays
  Clone ID: LIB143-049-Q1-E1-B4
actcgcggatcgatacaagcccctacaatgactcaaaatactcgctacccggcggcggctacaagctcttcgtcggttcagcaccatgaggccaccggctagaggacgacatggtgggaagggtggcaggttcgatggcggcggccgtgggggcagcagctgcggccgtgggtttggcggtggtagaggcgggagaggggacaggggagggagaggtggcaggacccccataggcggccgtagcggcggtggcacgggtggccgcggcggtggcatgaacggcgggagcaaggccgtcgtggtggcgcacaagcacgccggtgtcttcatctccaagtccaaggaggatgcgctctgcaccaagaacatggtcccgggagagtccgtgtaccgagagaagcgtgtctccgttcagaatgaggatggaacaaaaatcgaatacaggatgtgg

SEQ ID NO: 1374 - DNA, 428 bp, Zea mays
  Clone ID: LIB143-049-Q1-E1-B5
tcactactaggacgcgtgggtcgttacaagcctctacaatgagtcgtactagcaggcggccgggcaggtcggcatggagcctcacatggagagcgcgctgcggcagggcctgtcggaggcggagcagcgggagctggagggcgtggtgcgcgcgcaccacacgttcccggggcgcgcgccggggacgtgcacgtcgctggtgacgcagcgcgtggacgcgccgctggccgccgtgtggcccatcgtgcgcggcttcggcagcccgcagcggtacaagcacttcatcaagtcgtgcgacctcaaggccggcgacggcgccaccgtgggcagcgtccgcgaggtcaccgtcgtctcgggcctcccggcctccaccagcaccgagcgcctcgagatcctcgacgaccaccgccacatcctcagcttccgcg

SEQ ID NO: 1375 - DNA, 331 bp, Zea mays
  Clone ID: LIB143-049-Q1-E1-B6
ctcgtgggtcgatacaagcctctacaatgagtcttattattgcagcaatggcggccaaggtttgacaaggcatgacgtcctgattaagccccctcgcggcagccacaagatttgttgcagcgtgagacaggagctgcggctgcggaggaagtgagcaaaagcatggatctttccggcacgcagggcgagctgccgatggcaacaatgcacgccggcgggtcgccgtacctggggctgcaccacgggcacccacagcagcacaaccatggcgcgaacggccggcacatgtcgccgccggatgttgtggccgaggaagccaagaaccgggagc

SEQ ID NO: 1376 - DNA, 403 bp, Zea mays
  Clone ID: LIB143-049-Q1-E1-B7
tcgtgggtcgttacaagcctctaaagtgagtcgtactatccggaagctgaaaatagcagaagaatccagaggcgactccaggtttgtcggcgatgctgcgagcgggaggcaggcggctcctcgccccggggctccgtcggctcggcctgggcacaggcgcctccggcgaggcgggtcctgccgcggcggcggcgggggtgagggcgtaccacgagcgggtggtggaccactacaacaacccgcggaacgtaggttccttcgacaaggacgaccccaacgtcggcactgggttggtcggcgcgccagcctgcggcgacgtcatgaagctgcagatccgcgtcgacgagaactccggcaagatcgtcgacgcctgcttcaagacttttggctgcggctccgccat

SEQ ID NO: 1377 - DNA, 382 bp, Zea mays
  Clone ID: LIB143-048-Q1-E1-H9
ctcgcgtttcgatacaagcctctacacttcgtcatatcacagcacgatcgagccagttgcaatcacacagcgcagacgatgccgaccatcatcgtctcggtggacctggaatgcagccgctgccgcgccaagatccagagggtgctcaacaggatccaagagaagggcgagttctgcatcgatgacatcgacttcgacgagaagaacaacaaggtgaaggtcacggggcccttcgacccggacaagctcgccgacaagctgtgctgcaaggcgtgcaagatcatcaagcagatcgagatcgtcgagcccccgcccccgccgccgcccaagcccaaggaggagccgaagaaggaggagcaagccccgccgccgccggagaaga

SEQ ID NO: 1378 - DNA, 253 bp, Zea mays
  Clone ID: LIB143-048-Q1-E1-G11
ctcgcgggtcgatacaagcctctacatcgagtcgtcgcagccgccgcctcctctctgctgccgtcgccatggggagaaggcctgcgagatgctatcgccaaatcaagaacaagccataccccaagtccaggtactgccgtggtgtccctgaccccaagattaggatctacgatgttggcatgaagagaaagggtgttgatgagttcccctactgtgtgcaccttgtctcttgggagaaggagaatgtctccag

SEQ ID NO: 1379 - DNA, 409 bp, Zea mays
  Clone ID: LIB143-048-Q1-E1-G2
gggtcatcccacgcggccagcctcgcaccacaccgccgccagcccgaattgacgctgcagccctaagggtttcccgttcggccattggcggggtaaggggaaggaaagggtctgcctggcgggcaaagacgacggcggccaaaagcaccgacaaggacaaggacaggaagaaggcccccgtgtcgcgctcctcccgcgccggcctccagttcccggtgggtcgcatccaccgccagctcaagtcgcgtgcctctgcgcacggccgcgtcggcgccaccgccgccgtctattccgccgccatcctcgagtacctcaccgccgaggtcctcgagctggccggcaacgccagcaaggacctcaaggtcaagcgcatcaccccgcgccacctgcagctcgccatccgcgggga

SEQ ID NO: 1380 - DNA, 330 bp, Zea mays
  Clone ID: LIB143-048-Q1-E1-G3
gtgagtcgtaatagccgccagcccgagtgaccgctgcagcctagggtttccgtcggcgatggcgggtaagggacggaagggtctgctggcggccaagacgacggcggccaatatcaccgacaaggacaaggacaggaagaaggcccccgtgtcgctctcctcccgcgccggcctccagttcccggtgggtcgcatccaccgccagctcaagtcgcgtgcctctgcgcaccgccgcgtcggcgccaccgccgccgtctagtccgccgccatcctcgagtacctcaccgccgatgtcctctacctggccggcatcgccggcaggggcctcaa

SEQ ID NO: 1381 - DNA, 343 bp, Zea mays
  Clone ID: LIB143-048-Q1-E1-G5
acttgagcgatcaggacattgttgccctctctggtggccacaccttgggaaggtgccacaaagagcggtctggtttcgagggggcctggactacaaaccctttggtctttgacaactcttacttcaaggaacttctgagtggtgataaggagggccttcttcagctcccaagtgacaaagccctgctgagcgaccctgttttccgccctcttgtcgagaaatatgctgtggatgagaaggctttctttgatgactacaaagaggcccacctcaagctctccgaactggggtttgctgatgcttaaatagaccctatcttggagtgatacattctgctgcctgt

SEQ ID NO: 1382 - DNA, 386 bp, Zea mays
  Clone ID: LIB143-048-Q1-E1-G8
ttttaatataattgctatgcttagtgtgtgactcgttagttttttctttagggtcaaaaatggaaaaaaacttagtaatgatagaaaattaactaataaccaacctattgcttcgtattgtcgagatcctaactaagaaacagtcactatgtgaataaatacatctatcaaaaatgagtagatctatcatatagttgtagcaactgcatttttttctctacaaaagaaacctgattctaggctgtgaagcaaaactaaagggatgtggataaaaggagggatgatagatagaaggaagaagaataagaaagatataggattcccatatgtatggtctatgaattacatcataaaaaaaaggcaatgtgataaagcatcaatattat

SEQ ID NO: 1383 - DNA, 412 bp, Zea mays
  Clone ID: LIB143-048-Q1-E1-G9
acaccgccggaccaccaccgaccctccttccctctcgcgctatggcccagactgttgtgctcaaggttggcatgtcctgtgagggctgtgttggagctgtcaagcgggtcctgggcaagatggaaggcgtcgagtcctacgacgtagacatcatggaacagaaggtcaccgtgaagggcaatgtgacacctgacgccgtcctgcaaactgtttccaagactggcaagaagacttcgttctgggaggctgaggccgtgacaagtgaatccgccacacctgccggcgccaccgcctgacaggttcgatgatctggaagtgcccagcaaaaaaatgtgaatgtatttagcttggatctgttacaaataattgcaaactgctagctcggtctgtacattttacagttgctatttgt

SEQ ID NO: 1384 - DNA, 340 bp, Zea mays
  Clone ID: LIB143-048-Q1-E1-H1
agtgagtcgtcataatccgtggtccgtgtccgcgtcgagtgtgtccgctagtccgctccccctcagtcctcagttcctcacctagcggtagcgtgcgcgcgggatacgtagatggcggcttcggacgcggcagcggcggcggcaacaccggtgacgccgacagaggggacggtgatcgcgatccacagcctggaggagtggagcatccacatctacgacgccaacagcgccaacaagctggtggtgattgacttcactgcaacatggtgtcctccgtgccgcaccatggctccaatttttgctgatatggccatgatctccccaaatgtggttttcccga

SEQ ID NO: 1385 - DNA, 378 bp, Zea mays
  Clone ID: LIB143-048-Q1-E1-H10
acacgcgtctacgtcgcctcacatgaaaccaccgcctccccgatctcgtcgagaggaagcccaatcccgaaaccgccgccctattccaatggcgcccaaggccgagaagaagcccgccgccaagaagcctgcggaggaggagccggcggcggagaaggccacggcggggaagaagcccaaggccgagaagcggctccccgcgggcaagtccgcaggcaaggagggtggcgagaagaaggggaagaagaaggcaaagaagtcggtggagacgtacaagatctacatcttcaaggtgctgaagcaggtgcacccggacattggcatctcgtccaaggccatgtccatcatgaactccttcatcaacgacatcttcgagaa

SEQ ID NO: 1386 - DNA, 390 bp, Zea mays
  Clone ID: LIB143-048-Q1-E1-H11
agagatctcatctgcaccgcaggcgtgtccgtccttcacgagatcgcgcttcgggtcgttcgtgccggatgcaccgaggtactcttccgggcgttcgccaacgctccctgcgatgtgctagacagtttcttgtcaattcttcgggtcgaatgctcgcagcagacgactgaggccgtgatcaagcggtggacgacggtgacggagatcatagggaaggccatggtcgccatgcggaggcagctgtacgcgcagaacccaggcgccttcgacggtttcagggacgaatacttgctggccatcgcggagaaccgcatcctgatcctgctcgacttcgccaacggattcaccagcatcacgtcgcacgagaagctcgtgtacatgctcggcatg

SEQ ID NO: 1387 - DNA, 333 bp, Zea mays
  Clone ID: LIB143-048-Q1-E1-H12
gccttcacccctcgtcgccgccgccgccaccgccgtcgccgtcgcaagcgacgatgctcaacatcaacttgttccgcactgacaagggcgacaacccagaccttattcgcgagtcccagcgtagtcggttcgcctcccgtcgagctcgtcgacgaggtcatcgccctcgacaaggcatggcgcgaaaggcagttcgagctggataagatccggcaggagcttaacgctaccagcaagaagatcggcaagctcaaagccagcaagcaagaagaggaagcgaagaagctcatggagagcacagacgaaattaagaaaaggttgacaggcaaagaa

SEQ ID NO: 1388 - DNA, 384 bp, Zea mays
  Clone ID: LIB143-048-Q1-E1-H2
aaaagaaagaaaagaaaggaaggagcagcagcgctgcggaagcagagcgcgaggaaggagacggatttgctcggctgggatcccccgccaggggtccacatggcggcgtcgccttgagccgggcctctcctacccgcgacgtcctgcgatgccgccgcggggagcggcgctcctcctcctcctcgtcgtgctctgcgcagtgcaactgggaacatcaagctcaacaagtcttgcatcatacttattcggattctggagtagaacccaccagcatcgctttcctgcactagcccctggcccagccccttctcctcaacctgaaggcgccattattgctcacccagtgcataggcatcacagaagaagaacacatgctttcccaac

SEQ ID NO: 1389 - DNA, 296 bp, Zea mays
  Clone ID: LIB143-048-Q1-E1-H4
agcggacgcgtgggtcctgttagaatttctgtgcgtcattcattccttgttttactcgttatgaagaccgtatcagtggggaggaggaggttcagtgcagtgtttcaactggtcttcctgctgttcaacgggctcacacggagaccttttatagtcatcttcgtcatccgagaatcaatctccggcatgtcggttttggggcaccgttgtttgcatccgtgaccataaagctaaagaattcggtgtttcacacgtatgcggattctggcatgcctgtcattagcatcattttcctg

SEQ ID NO: 1390 - DNA, 350 bp, Zea mays
  Clone ID: LIB143-048-Q1-E1-H5
gatccgtgttccgtgtccgcgtccagtgtgtccgctactccgctccccctcagtcctcagttcctcacctagcggtagcgtgcgcgcgggagacgtagatggcggcttcggaggcggcagcggcggcggcaacaccggtgacgccgacagaggggacggtgatcgcgatccacagcctggaggagtggagcatccagatcgaggaggccaacagcgccaagaagctggtggtgattgacttcactgcaacatggtgtcctccgtgccgcgccatggctccaatttttgctgatatggccaagaagtccccaaatgttgttttcctgaaagttgatgtggatgaaatgaag

SEQ ID NO: 1391 - DNA, 376 bp, Zea mays
  Clone ID: LIB143-048-Q1-E1-H6
tgcagagtgtgctggtttattgcttctcatgggttgtaattttcgttgttttactcgttatgaagaccgtatcagtggggaggaggaggttcagtgcagagttccagctagtgttccggctgatcaagggtctcatatttataacttttacagccatcgtggtaatcctaatagcaatccctggcatgacggttctggacatctttgtttgcatccttgccttcatgcccactggatggggtttgctcctgattgcccaagctatcaggcctgtgattcaaaagatcgggctgtgggggtcgatcaaggctcttgcccggggctacgagatcctaatggggcttctcctgttcacgcccattgctttccttgcctg

SEQ ID NO: 1392 - DNA, 416 bp, Zea mays
  Clone ID: LIB143-048-Q1-E1-H7
acccgcgggaggtgttcgaggactacctccgcgacatagcgccccggtacacggccgagacctaccgcctgctcacccacaactgcaacaacttcagccacgaggtggcgcagttcctcgtcggcactggcgccggcgtgcccgactacatcctcaacctccccgccgaggtcatgtccagccccatgggcccgctcatcatgcccatgatccagaacctcgagtccacgctcaggagcaacgtcgctccgcagaccacgcagttcgtgcccacgcccgcctccgtatccgcgccgaccgaggctcccgcctccgagcgaaaagcgccggcgccggcggagaaggcttcgaaggaagctcctgcgcctgcgaagaaggaagcccctactcctgcggctgacccgctcgggaacgcc

SEQ ID NO: 1393 - DNA, 385 bp, Zea mays
  Clone ID: LIB143-048-Q1-E1-H8
cccacgcgtcaaaggacgcgtgggtcctgttagaatttctgtgcgtcgttcatatattcttgaggactcctacaatcagcttaggatgcgctctcctcaggacttgaagggtagactcactgttcattttcaaggagaagaaggaattgatgctggtgggctgacaagggaatggtaccaatcgctttcacgagtcatttttgacaagagtgcccttctatttacaacagtcgggaatgatttgacgtttcaaccgaatcctaattctgtatatcaaactgagcacctctcatactttaaatttgctggacgagtggttggcaaagctctcttcgatggtcagcttttagatgctcattttactagatctttctacaaacacata

SEQ ID NO: 1394 - DNA, 415 bp, Zea mays
  Clone ID: LIB143-048-Q1-E1-G10
agacgttggctgcgggtggcaagcgatggttgcctacatcaacgtcggatgctactacttcatcggcatacccctcggcgtgctcctcggattcaagttcggtttcgggatcaagggactgtggggaggcatgattgggggtaccctcatccaaacacttgctttgatctggatcacgttaaggactgactggaacaaggaggtaatttttaagccaccgtaaatttccttggttaccgtgccgtgtcactgacagatggtcctcaaatccaccgcgcgtgccgatgtgttcgtcttcgtccatatgctcggttattccttccaagctcaggcttctgttgtgtgggcattttttctctgtgttttgcttccttttttcttgggcactaatttaaccgttttccccccccctttt

SEQ ID NO: 1395 - DNA, 397 bp, Zea mays
  Clone ID: LIB143-048-Q1-E1-E3
accatcttcgaggacgagtcgctctccaacccgcaccgcgccaccggcggcgcccccaagttcatccgcaagcttgtggaagggattgaggataccgtgggtatcggcaagggcaccaccaagatatacgccaccgttgatctggagaaggcccgcgtggggcgcacccggatggtctccaacgagcccgtgaaccctcgctggtacgagtccttccacatctactgcgcgcacatggccgccgacgtagtattcaccgtcaagatcgacaaccccatcggggcctcgctcatcgggagggcttacctgcctgtcgaggacatcctgggcggagacgagatcgacaagtggcttgagatatgcgatgagaagcgcgagcctattggggacagcaaga

SEQ ID NO: 1396 - DNA, 360 bp, Zea mays
  Clone ID: LIB143-048-Q1-E1-E7
aggcagggtagggcaggcggcgatccgaatccaatcgccggagggaggaagccaccggtggccgcagtgagggcggcggaggtagagtcaaagggatgacgcgcgggaagcagaagattgacgcgcagcggcgtaacgcggagcgaaaccagaaatccaaggggtctcagctcgaggcccgcgccgtgggcctcaagatcgtctgctccatctgcaaggtacaattggcaaatgaaaaacagctgaccgatcactatggatcaaagcatccaaaggagaaacctccgagcacatcgagcaccgaataaccatggctggtcgtgacgcagaaatatagattctgcttggctggtttgaaga

SEQ ID NO: 1397 - DNA, 391 bp, Zea mays
  Clone ID: LIB143-048-Q1-E1-E8
aactggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtgg

SEQ ID NO: 1398 - DNA, 416 bp, Zea mays
  Clone ID: LIB143-048-Q1-E1-F1
cgcgggtcatcccacgcgtgccacctcctctgctcacccccacctcccggtccggcagcagagagcgggggtgcagagagatcgagatccggaggccgcgagtgggagcgccaccaccagcgactgcggcaatggcgggcacggtgacggtcccggggtcgtcgaccccctccacgccgctgctcaaggacgagctcgacatcgtgatcccgacgatccgcaacctcgacttcctggagatgtggcggcccttcttccagccctaccacctcatcatcgtgcaggacggcgacccgaccaagaccatcaaggtgcccgagggcttcgactacgagctctacaaccgcaacgacatcaaccgcatcctcgggcccaaggcctcctgcatctccttcaaggactccgcctgccgctgc

SEQ ID NO: 1399 - DNA, 148 bp, Zea mays
  Clone ID: LIB143-048-Q1-E1-F10
tacagggaatcggaggacttaccgtggcccactgatcttggattctagatgccgtgggattcgtgtgttctttaggtccttcggtgacgatgtttgtaatccggattcgaatcatcggtaacagtaaaggaaacttgatagactgctg

SEQ ID NO: 1400 - DNA, 218 bp, Zea mays
  Clone ID: LIB143-048-Q1-E1-F12
aatacaatactctatacagacgtcgtattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaagaacaaaaggaaaaagaagaaagaaaattgagataacgaaaaaattaattaaaaaagacagtaactggaaataccctgaaggggacctcatt

SEQ ID NO: 1401 - DNA, 403 bp, Zea mays
  Clone ID: LIB143-048-Q1-E1-F2
ctgcctcctctacctgtccggctgtcccggctccagcatttccaccctcgcgcggcggtcgccggagcgagcagagctgccggaaggcccgtcggatccgccgccgccaagatgaatgacgccgatgtagccaagcagatccagcagatggtgcggttcatccgccaggaggccgacgagaaggccaacgagatctccgtctccgccgaggaggaattcaacattgagaagctgcagcttgttgaagctgagaaaaagaagattagacaagagtatgaacgcaaagagaagcaggttgaagtacggaagaaaattgagtactctatgcagttgaatgcttctcgcatcaaagttcttcaagctcaggatgatctagtaaacaaaatgaaagacgatgcgatga

SEQ ID NO: 1402 - DNA, 398 bp, Zea mays
  Clone ID: LIB143-048-Q1-E1-F3
gttgaggttctcaaatcgggcccgctaaagtcgagagacaggttttcgcgaacatttgcatctagccatctctactcaactgaattcttgtgctcttgtggcattcacaaagtccattttcagactgagctagttcagctgtcattttttttttcagccaaaggtcgcgttcttttggacctgctcttgattcgttcgttcgttcgtttggattgattgattgattgattcctttcgacttcccttcaccacccccctgctccgtcaagcgtgcctctgttcttctgccattgctggatcgcgtttgtctgtttgttgggttgctggcgctgcggccatggatcccttccacggcattgtgaaagaggagttcgacttggacttcgacttcacctgcg

SEQ ID NO: 1403 - DNA, 407 bp, Zea mays
  Clone ID: LIB143-048-Q1-E1-F4
ttcacgggtaaacccacgcggccggacgttctgagcaaggaggagacatttctggcctgcacccttggctggtgtattgaatggcttcaagcttattttcttgtgcttgatgatattatggacaactcccagacacggcgtggccagccttgctggtttagagtgccacaggttggtctcattgcagtaaatgatgggattatccttcgcaatcatatctcacgaatccttcaacgccacttcaaaggaaagccatattatgttgatatcattgacttgttcaacgaggttgagttcaagacagcttcagggcaaatgttggatcttatcactacccacgagggtgaaaaggatctaactaaatataacttgacagttcaccgccgcatcgttcagtacaagacagc

SEQ ID NO: 1404 - DNA, 426 bp, Zea mays
  Clone ID: LIB143-048-Q1-E1-F6
cacaggtcatggactcgcgggccgacccacgcctcaatcgccctgcgagagagctaatccagaaggaaagaaagaaggagctggagaagctgaagtgtgagaaaggagaaactccgtcggatcctccgaagaaggaaaaggaggagaccatcattctaaggccgctgaacatgacagatctgaaagaagcaaagaaccaggtggctgcaagtttcgctgctgaaggcgccataatgagcgagctgaggcaatggaacgagttgtacggtgaaggcggctccagaaagaagcagcagttgacatacttcctctgagcaatatgaaaatcatgcgcaaaaatgtatgaacataatttgagaagtagagtagagcacaaagcagccatgaggaaatagaccgaacatgtaatcgtgtataagaagaaca

SEQ ID NO: 1405 - DNA, 353 bp, Zea mays
  Clone ID: LIB143-048-Q1-E1-F7
acttctttactcctgcgcatgtgatgccacttctggaaatagttcgtactcagcacacttcaccacaagttgttgttgacttgctggatgttgggaagaagattaagaagacaccaatagtcgtcgggaactgtactggctttgcagttaataggatgttctttccatacactcaatcagcactcttttatgttgatcttggtatggatgtttataagattgatcgtgcttgtaccaaatttggaatgcctatgggtcctttcagactggcagatctggttggttttggtgtggctgtggccactggtatgcaataccttgaaaatttcccagagagggtctacaaatcaatg

SEQ ID NO: 1406 - DNA, 385 bp, Zea mays
  Clone ID: LIB143-048-Q1-E1-F8
ctcgcgggcagatacacgcctcagaattgattcgtaggagacaatgttgcgtatgccctgtctcatggactaacggtcattgcatgtgttggtgatacccttgatcatagggatgctgagtctaccatggatgttgttgctgcacatccagaagcaattgctgataacatcaaggactggatcaacgtaattgttgcctatgaaccactttgggctattggaactggtaaagttgccaccccagctcaggctcaggaagtgcacgcctccctgaaggattggctaaagaccaatgccatccctgaggttgctgaatctactaggatcatctacggaggctctgtaactgctgcgaactgcagatagctagcagcacagcctgatg

SEQ ID NO: 1407 - DNA, 292 bp, Zea mays
  Clone ID: LIB143-048-Q1-E1-G1
gtgagtcgtcatacacggttctcgggatcatgtgaaacggcctcacggtggagtaggcattgaggtcgcctcgacaagcattggtgtcaaattgtggggtgttcacgaaggcagttgtcggtgaagtgtccgtcgtcaggaagtgtactggggtttgcatcctacggctgttctcatacagacaagcgcgagatacgtcttttaggtggatcttggcagctctcttgacaacattaatcgttcgtgtaacaaatttggcatgacgagctgtcctttcgcccaggtctatctg

SEQ ID NO: 1408 - DNA, 392 bp, Zea mays
  Clone ID: LIB143-048-Q1-E1-E2
gccagcgaaaactcagagtctcgagtttcctcggagcggaggcgatggctgggaagggagggaaaggcttgctcgccgcgaagactacggcggccaagtccgccgagaaggacaaggggaagaaggccccaatctcacgctcctcccgcgccggcctccagttccctgttggacgtatccaccgtcagctgaagcagaggactcaggcaaatggtcgtgttggtgccaccgcagccgtctactccgctgccatcctggagtacttgactgccgaggttctggagctggctgggaatgctagcaaggatctgaaggtgaagcgtatcacccctcgccatttgcagctagccattcgtggagacgaagagctggacaacctcatcaaagggcac

SEQ ID NO: 1409 - DNA, 337 bp, Zea mays
  Clone ID: LIB143-048-Q1-E1-C4
gtgagtcgtgagcaatgggccacccattggcgtaatcgacgcgatcggatcatcccgttccaagatgatagactctggtcggctacctgtaggaacatggcgaagaggcctgtgtcgatgaaggcggcggtgtaccgctgtccccttcagcaaatgttatgcggcgctgttggatgacatcaatatcacaatccaacacagggtcaccgtataactgggatctctgccatgctcttcctcactcccatcatcggcacctaccaatacgccatgtggtacaaagagcaggagaagctttcccacagatactaaatgggatgtcctccaagttgctgcg

SEQ ID NO: 1410 - DNA, 404 bp, Zea mays
  Clone ID: LIB143-048-Q1-E1-C6
aactggcggccgtgctggacttcgacatgctgtgcgcgtccgtggcgctgtcggcggagaggaggaaggccggcgcggcgctggcgggcgcggccggcgactgcggcggtggaggcggaggggtgcagaggatgtgggagggcgacgtcgtgctggattgcctagacgaccggcgaatcgcgctcgagacgtcctgctgcccatgctaccggtttggtaagaacatgcggagagccaatctcggatcttgcttccttcagggaatggtttactgcattctgttggctgctgtcctaatcagcctaattgccttttctgtaacaaggcatcatatatatttatatatgggaatcggctctgtcctcttgatagccatctatactggttatttccggagaagaatc

SEQ ID NO: 1411 - DNA, 415 bp, Zea mays
  Clone ID: LIB143-048-Q1-E1-C7
aaagttagcgccgctaatccgctccctattcaccatccaatccaatcggcttcccccaggcacccatggcgacggcggtggaggttcccgtggaggcgccggtgaggacagtgaaggtcaccaatgtctctcttagtgcaactgtgcaagacattaaggagttcttttccttttcaggagatattgatcatgtggagatgcagagtggtgatgagtggtcccaagttgcatatgtcactttcaaagatgcacaaggcgcagaaacagcacttcttctttcgggtgccacaatagttgatctttctgtcatcattgcacctgctccagagtatcagccacctcctactgcctctgctccaccaatgagtggaaccagagttccagttggtggtggagacaacaacgttgttcacaa

SEQ ID NO: 1412 - DNA, 411 bp, Zea mays
  Clone ID: LIB143-048-Q1-E1-C8
aattcattcttgtgtgcctctccggatggagatcctctgcagtgccatgtcggccagactgcgagcaaaagctgacttttctggcggacgaagataggagtagcatgcatctagctgtcttgtgaaagtactattatttatcaaaatacagaatcggtcctcaaactttggtacgttgttggctccctgaattcaagaaatcggaaaaaaaaacaagtcttgtaactttgtcgggtctaaaattagatttgtctaaaccgaatgcgccgatgtggcgtgacactattattaggtttagtgtatttaaacacctctaaatatatgagaaaggcgtgccactattattaggtttaaaacaaaaataaatggaaccaacattgcaagttggtggtggggaaaagaaacttggtc

SEQ ID NO: 1413 - DNA, 365 bp, Zea mays
  Clone ID: LIB143-048-Q1-E1-C9
agcggctgccctttttttttttttttttttttttttttttttttttttttttttttttttttttttttttttttttttttttttttttttttttttaggggcctggattacatgagacaagcattagtacaaggaaaaaacagagtcacattacataccaagcagttcaggaaagctgatactaataacttcagcttaactgtgaaaacgaaggcaggctaatgcgcctcagctttatgttacaacaaaggccaaacagacaacaggagagccacagcagctataccaacacatgaaacagggtgccaatggcctccagcttcctttttttttcctttctttcctttaggcaaacagctaacagc

SEQ ID NO: 1414 - DNA, 262 bp, Zea mays
  Clone ID: LIB143-048-Q1-E1-D11
actcgcatcctatattcggtgtcgcgttgggagttgccatcgtatctgttcctctcgccaccaagttcagcctaatgtttggtgtctgagagcgatttgctgcgtctcatgagaaacatcattttccgtttctgtgtctgtttttcatcgtctcggttaccttgcgacacaactgtaggtgccgttggaataatatctttgccatgcttgcagacttgtgtaataagtaaataaacctataaaataccagtttaactgtttt

SEQ ID NO: 1415 - DNA, 70 bp, Zea mays
  Clone ID: LIB143-048-Q1-E1-D12
tacaggcccaggactcgcgggacgatacaagcctctacacacacgtcctgacctcaacgcgtccgcttct

SEQ ID NO: 1416 - DNA, 217 bp, Zea mays
  Clone ID: LIB143-048-Q1-E1-D2
gtgactcgtcaagatttatcttgcccacttacatttgggtactacaattgggcattttctacctttaaattagtgtccctagtgcagagacgctccttcactttagtggaatacggcgatctcgcttgcggtttagggggctccgatgttgccttgagtctatcacatcctttattgggtcagcatctatccgatccttttgtgggatcacactaag

SEQ ID NO: 1417 - DNA, 428 bp, Zea mays
  unsure at all n locations
  Clone ID: LIB143-048-Q1-E1-D3
cttgggctgtcggcctcacgttttccactgcttccagaggcttcctctcgagtccgcagtctctcttccctacgaagttcagaagttgtcacaatgactcgcggcgaccagagggaacgcgaccggcagagggcgcaggcgcggcggcccgcggccaaggggcgcgacgacgggctcaccccggagcagcggcgggagcgggacgccaaggcgctgcaggagaaggctgccaggaaggcggcgcangccgcgggaggcgcctgcgccaagggcggcaagaacaccggcaagaagtagccggggtctttactctttagttcgcaggatctgctcgtgttggaagatctgtanttgcctagatctggaatgcaatgcgatttcctgggcgttgtccccagcaattgcgaaacaacgggtcacaattaaaa

SEQ ID NO: 1418 - DNA, 260 bp, Zea mays
  Clone ID: LIB143-048-Q1-E1-D4
gtgagtcgtaatatcacgttttccactgcttccagaggcttcctctcgagtccgcagtctctcttccctacgaggttcaaaagttgtcacaatgactcgcggcgaccagagggaacgcgaccggcagacggcgcaggcgcggaggcccgcggccaaggggcgcgacgacgggctcaccccggagcaccggcgggatctggacgccaaggcgctgcaggagaaggctgccaggaatgcggcgcaggccgcgggaggcgcct

SEQ ID NO: 1419 - DNA, 415 bp, Zea mays
  Clone ID: LIB143-048-Q1-E1-D5
acgttagcttcggaagggaacattggtcaagttgagttactagaggaagggaaagcattactcgatgaggacttctatgaagataagaaaatccttctcaggggataccagagatcaatggtcaaatcaatgagcctggcagcaaaagttccacattttcattatctagaggagataaattgtgattctcttgtgcaactaaaaaccacatttcaaaatgagaacaaggatcaaactatcaagcacactttccttccgttcctcataaagtcactttctatggcactgagtaaataccctatgttgaacagttctttcattgaggaaactaacgaagttgtgttcaaggggcctcacaacattggggtggcgatggctacaacacatggattagtcgtgccaaacatcaagaaag

SEQ ID NO: 1420 - DNA, 376 bp, Zea mays
  Clone ID: LIB143-048-Q1-E1-D6
tttatatgttacccactgaaatttgggtactagatttgggcattttctacatttaaattagtgtccttattgcatataggctcgtttattttagtggaatataaggatgtgattgcggtttagaaaactccgatgatgccttgagtctatcatatcctttattggtaccgcactatcatatcctttattggtaccgcactaagtaaatgcagcaataatttcacttaaaaccttcgttgtttgtgaaagacaggggcggagctacagggtatgccgagtgggccacggcataccctgtagttttggcccaattaaggctaaatatcaggagtttttaacctaataaactaagagacggtttaactgcttccaaatt

SEQ ID NO: 1421 - DNA, 431 bp, Zea mays
  Clone ID: LIB143-048-Q1-E1-D7
ctcgcgggtcgatacaagcctctaccatcagtcatcttactgactcctgtaaatccaattgaagaagtggaaggagctactaaagcgggaagggagatcaggttttataattcagagatgcatatggcagcgtttgttcttccgacatttgccaagagggagctagaagcatactgtgcttccacggaaacggagcaggcggaggaagtagcggccacggcaccacaaaagctaactgcggcgcccaagcgtggaattaccaccgcatcctagctgttggatacacacatagccatgtactattattatcacgcacgtaatctaagcatcgaagtcgagtgcgtgcgtgttgggtgggggtacgcgcatcgcggtttgacgcgcgatgtatttgataataattcgtgctccgaggtaccaacaagcaacga

SEQ ID NO: 1422 - DNA, 399 bp, Zea mays
  Clone ID: LIB143-048-Q1-E1-E1
acgcggccagtgctgcctaatatgatcagcatgcggccagagtagtacccatttggcacctgctgtaaataatcattaggttcgagcaggctgttgctcgaagcttcctcatctcgtttgccgtcacccgggtggaatctagagacagtgaacgcaggttgtgcaggtcattcaggtgtttgaggccagcattggacacccgtgagtttgacacgttcaagttgatcaaagcagtcaggccagagatcagctccaaggttttgtctgtcagattagcattttgagaaagattcagcaacgtcagggccttcagatccttgatgttcttcactccagcatcagtaacgaacccaccacagacttcaagagaaacaaggattcttaaaatatctgaagcaa

SEQ ID NO: 1423 - DNA, 400 bp, Zea mays
  Clone ID: LIB143-048-Q1-E1-E11
ctctagtttaactcacatcaaaggttgaagagcagcaaaagctgattttgaaacttgaggatgacatactaaagggctacagttcaactgataggaggggctcactcttgaatgactgggatattcaagaaatcggctcaagtgaagcatccgagggctctgatccaaggcatgcatcggcagatcaagatcaaagttcgatgctcaaggtcatttgcaaccagagggatcgtttccgtgcacgtctgcgtgaaactgaggaggaactgaggagactaaaagagaagcatgagatgctgactgttgaactggaaaaaactaaagctgataatgtgcaactgtatggaaagattcgatatgtccaagactatagccacgacaagattgtttccaggggaac

SEQ ID NO: 1424 - DNA, 398 bp, Zea mays
  Clone ID: LIB143-048-Q1-E1-C3
agtaacgaatcagaagcatgggcaacccattggcgtaatcgacgcgatctgcgcatcacgttcacaagatgagaatctctggccggctacgcgggggaaaatggcgaagacgcctgtgtcggtgaaggctgtggtgtacgcgctgtcgcccttctagcaaaaggtgatgccggcgctgttggatgacatcaccatcacgatccaccatagtgtcaccgagaactggatctctgccacgctcctcctcactcccatcatctgcacctgccaatacgccatgtggtacaaagagcaggagaagctttcccacagatactaaatgggatgtcctccaagttgctgcggcttgtcgcagttgaattttccatgatgggttgtaaaatccgtcaatgtcaatt

SEQ ID NO: 1425 - DNA, 328 bp, Zea mays
  Clone ID: LIB143-048-Q1-E1-A9
actcgcgggacaatgcattcgactagaatgcgacggatcatggctcgtcaccgcgtacatatggccgcagctgtcggcggcgctggagtccgacggcatcttcaagcttctcacggcggagtacctcggtctagctatgtgagcaactgaacggaacacagttagctcgacggatcgatcatatatgtgttttctttcttttgattcgaatcgatgcatgatgtgcttcctttgtttttctgtcagcttttgtacctgtacgccagcagatgagactctggtctttgggatattatatatctgctaaataaagatgagctcgacatat

SEQ ID NO: 1426 - DNA, 372 bp, Zea mays
  Clone ID: LIB143-048-Q1-E1-B1
tgcaagtcgctacaaaaccctagcgccgccgcgggtgccaggccgcgagcgtcgccatgggcatcgtgtttacgcggctcttctcgtcggtcttcggtaaccgcgaggctcgcatcctcgtcctcggcctggacaatgctggcaagaccaccatactctatagactgcaaatgggagaggtcgtctccacgatcccgacaattggattcaacgttgagacggtgcagtacaacaacatcaagttccaagtatgggatcttggtggtcaaacaagcatcaggccatactggcggtgctactttccaaacacccaggctatcatatatgttgttgattcaagcgatacagataggcttgtaacagcaaaagaag

SEQ ID NO: 1427 - DNA, 399 bp, Zea mays
  Clone ID: LIB143-048-Q1-E1-B10
acccaccgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagttgagttgcaaacaatgaacgtgcagcagcccgctgatgttgccggaccc

SEQ ID NO: 1428 - DNA, 386 bp, Zea mays
  Clone ID: LIB143-048-Q1-E1-B11
gtcagtcgcccatggcggatgaggaggtcactgatccaaaggcgctcctagaggatcgttcaaaagctaagtgtgtgtcgcagtggtatgattatcagaaatgtgttaaaaggattgaggacgatgagactgggcacaagcactgtaccggtcagtactttgattactggaaatgtgttgacaagaatgttgcagagaaactctttgagatgttaaaatgacaaattttccctccatttatccacttaaagttggtaataattgtatcacttgtgaggcctatagactattaaggcacttaatatttgtcagagaacttttgcctcttgggtaacacaaattttccactgccagtttgcatttcatttctgctactagtattgaac

SEQ ID NO: 1429 - DNA, 406 bp, Zea mays
  Clone ID: LIB143-048-Q1-E1-B12
aggtattttggcatggaacgctagaatctgagatagaccgtgtctggttggtagtgctctgatgcagtttgttctgtttattcatgatgaacttgtatggtttgaatgctactatgtttttaatatgtgcaacaatatatttcttttgttctttttttatttatcacggtttagttcaaaaatgaactagcggatgataaatatttaagaacggaggtaatatctttttgtatgatgcatagcaggttatgaacttgcagtctgtagtttatatcttagaccactgaattttgtttctttttgctctttgtaactgtaggtgatcaaagtggagcaaaatgcccgtggtgtggatgcacctgaggtgcattgagaaaatcgaagcgctgacgtgagcgagaaatat

SEQ ID NO: 1430 - DNA, 378 bp, Zea mays
  Clone ID: LIB143-048-Q1-E1-B2
agttggacgcgttcacctcctgcacgcaacctcatctcgtcctccagatcctggatggccgtcctccttgataccttgcctcgcgagtgctctcggtgagctactttgttttgatttatcaggaaatccgtttgcttcatgttatgcaggctcagatctgattgctggattcggcatcttacgggcttgaatatagctaggactgggagaaaacaacaaacccgcgttggatcctgtatcgatctggagaaatttctaagtcgtcgtcgtcgtcgtcgttcggttcggagcggatctgaggcgacgatggctggaggcggcgggatctcttggtctgcagtcctgcttcacctcgatggatgatgtctctgcgctgaa

SEQ ID NO: 1431 - DNA, 382 bp, Zea mays
  Clone ID: LIB143-048-Q1-E1-B3
ccagagaagcacgcagcctaaaaaaaccgtatcgtctcgcctgttcagtttccttctcttcccgcagcccggtttgccgaccaggttccaccgttccagagtagccaagcgaatcccgtgtctggttcgcgcgatggcggaggagcagtccaacccccagcaccagcaagcggaggagagggaggttatggtggagcagcagcagccgaggagggccccgaagctgaggtacctggacttcgtccaggtggcggctgcccaggccgcggtgtgcctcgctgggctctacggcctcgccaaggaccacgccggcccgctccgccccagcgttgacgccgtcgagtctgccgtgaagggcgtcgttagccccgtccacgaacgc

SEQ ID NO: 1432 - DNA, 403 bp, Zea mays
  Clone ID: LIB143-048-Q1-E1-B4
accggagccggacagcgagcaccgaaagggaagttggcggcggcgcatatttccttcccatcttttcctgtcttccaattttgaactgaaaaaaaatacatttttttccggcgtgaatcaagataactataataaacaaggtatatatacgcagaggcagcattgcatttgcatttgcatttgccgtgggggaagaggtggaggaacctgattcctcaccgcccacatcgactctcttcatcagttcgtccgtccaggtcaatttgcttgagttgggtgggccaacaaagttatattctcggtgacgcggcgggaggagtggtcggcgacggcgacgagaagaaccaaaatcttgggataacggcgtaactgaatggctactggcttgtcggccactatttga

SEQ ID NO: 1433 - DNA, 418 bp, Zea mays
  Clone ID: LIB143-048-Q1-E1-B5
gccttcccggttacatgttcactaacaaggtcgggacggcatggcccttggagctgcgtaccatcactacctgcagctcgccggcgaccatggcaccgccacacacgcactgctcctcggcgtacttatcttcctcgtcatccgcctagtatccgcaaggcgaaccggcacaacctcagccaacaaacgtaagcagcaacagcggcttccgctcccgccttcgcccccgggcaagctgcccatcatcggccacctccacctcatcggcgccgagacccacatctcgatccgggacctggacgccaagcacgggcgcaacggcctgctgctcctccgcatcggcgccgtgcccaccctgttcgtgtcctcgcccagcgccgccgacgccgtcctgcgcacccaggaccacatcttcgcg

SEQ ID NO: 1434 - DNA, 236 bp, Zea mays
  Clone ID: LIB143-048-Q1-E1-B7
acacatcccaaaagtgagtcgtgttacgtgcagccaagttcagtttccttctatactctcaccccggtttgactgactggccgtcatttcaccagattatgcaggggagtcccatgtcgggttccctcgtacgcgccttgccacataagccccttgcaccagctggcgtaagagagggaaggtatgcgtggatagcacctcccagacagatggtcaccatgataaggtacctggga

SEQ ID NO: 1435 - DNA, 404 bp, Zea mays
  Clone ID: LIB143-048-Q1-E1-B9
tacatccctctagactgagtcgtaatattcgctgcgatcatccctaggaacacgacggttccagcaaggagggacatgctgttcacaacgacacacgacaagcagaccgaagccctaattgctgtgtatgaaggagaatgggaacgtgctgaagataaccatctgttagggtacttcaagattactggaattccggcagcccctaagggagcagttgatatcagtgtatgcatggatatcgatgctgccaatgtcctcagggtgttcgcaggggtcgtcaagcctcaaggcccagccattccaccgttcatcgaggtgaggatgccaacgctggacgatggccatggttggtgtgggcaagctctagcaaagatgtatgggaagattctcgaccttgctgttct

SEQ ID NO: 1436 - DNA, 374 bp, Zea mays
  Clone ID: LIB143-048-Q1-E1-C1
gccacttccacaacggacagtggatcgccttcctccacgtcaagcccggctcgctggcgcagggcagccaggccgccagggtgttccgcggcagggacgtcgatggccggactcgggacttcgtcgtcgcctggtacatcccgtgggacaacataccgacacgagcttacactgaaattggcagtgaaaactacttcaagactcggtggagtagtgtcaaaacgagtctaggacattcaaggagagtgacccgtgccaaggacgagaactgtgcgtcaactgtcagcatcggtggctacactacagccttctgcatcgcagtcctacaacaccagttccagccgctgccggaagagcgcgaataatcaatcaat

SEQ ID NO: 1437 - DNA, 395 bp, Zea mays
  Clone ID: LIB143-048-Q1-E1-C10
gccacatggcgggcaaggtgctcgtcgccgtctccgagcacgtgaaccgcctcgtcgccgcgcggctccagttcgacgtcatgggcgtcgagaccgtcctcgtcgcgcgcaccgacgccgtcgccgccacgctcatccagaccaacgtcgacgcgcgcgaccaccagttcatagtcggcgccaccaacccgggcctcaggggccagagcctcgcggccgtgctgtcggccggcatgtcggcgggcaagagcggcagggagctccaggccatcgaggacgagtggctggccgcggcgcggctcaagaccttctccgagtgcgtcagggacgccatcgcgggcctcggcgtcgcgggccaggagaagcagcgcaggctccaggagtgggaccgcgcc

SEQ ID NO: 1438 - DNA, 409 bp, Zea mays
  unsure at all n locations
  Clone ID: LIB143-048-Q1-E1-C11
agtctcctcctttccacttcctctcccgttgccaggcatggggttggcctagttgtgcccgttgagcactagcagcctccttgaaacctccagatctgtgcctccaaggcccccgttcctcggcaacaagggtcctatctgtggtgtgccagacttcaagatgaggggaaagaagagtgatgagctcgaacctgtcgatgctggcgatgaagatgatgatggtggtgacgatggggacgaggatggtgactttggggaggagggtgaagaggacgtctcagaaggggagggatatgacaacccaaagggcaatgagaccaagaagcaaagaggtgatcctgaggaaaatggtgaggaagatgaggaagaaccagaagatcagganggtggcggcgacgacgatgatgac

SEQ ID NO: 1439 - DNA, 432 bp, Zea mays
  Clone ID: LIB143-048-Q1-E1-C12
actcgtgggtcgatacaagcctctagagtgagtcgtactaggcaggcgccggtgcgcccgcagttccccaggccggtcgcccagcccccaacttcgacgtcatcgtggtgggcgccggcatcatgggcagctgcacggcgcacgcggcggcgtctcgcggcgcccgcgtcctgctgctggagcgcttcgacctgctccacccgctgggctcctcgcacggcgactcccgcatcatccgggacgcctacgcgcagccgcggtacctccgcatggtgcgcctcgcccgctgcctctgggccgccgccgaggcggaggccggctaccgcgtgctcaccccgacgccgcacctctccatgggcccgcggagcagcgcctcgctcgccgccgccatcgctaacatcggtgccgaggaggtggacgtggacgaccttc

SEQ ID NO: 1440 - DNA, 345 bp, Zea mays
  Clone ID: LIB143-048-Q1-E1-C2
agtgagtcgtgaaaagtggatcgccttcctccacgtcaagcccggctcgctggcgcagggcagccaggccgccagggtgttccgcggcagggacgtcaatggccggacgcgggacttcgtcgtcgcctggtacatcccgtgggacaacataccgacacgagcttacactgaaattggcagtgaaaactacttcaagactccgtggagtagtgtcaaaacgagtctacgacattcaaggagagtgacccgtgccacggacgagaactgtgcgtcaactgtcagcatcggtggctacactacagccatctgcatcgcagtcctacaagaccagttccagccgctggc

SEQ ID NO: 1441 - DNA, 417 bp, Zea mays
  Clone ID: LIB143-048-Q1-E1-A8
acagcagcaccagtagagtctccttcctctccggcggcgatgtctgggcgcggcaagggcggcaaggggctgggcaagggcggcgccaatcggcaccgcaaggtgctccgcgacaacatccaacggatcacgaagccggcgatccggaggcttgcgaggaggggcggcgtgaagcgcatctccgggctcatctacgaggagacccgcggcgtgctcaagatcttcctcgagaacgtcatccgcgacgccgtcacctacactgagcacgcccgtcgaaaaaccgtcaccgccatggacgtcgtctacgccctcaagcgccagggccgcaccctctacgggttcggcagctaagcgcgccctctccatctgggggtgggcctaatactggtggcgtttctcccttgggttccctggtcc

SEQ ID NO: 1442 - DNA, 240 bp, Zea mays
  Clone ID: LIB143-047-Q1-E1-G9
gtgggccggcccaatactctatattgattcgtactatttctttcccctcagttttagttttcaggtttgggaggggggccatgaatgatgaactgtccgtgggagcaaaagaattgcgatagtatttattcagattcatttgtgattctttagcctggtcggttggtcctgttgtgtttgggttaaaaaaaatggcagtggcgtgaggaatggagaaagtttttattgtgttatggcatg

SEQ ID NO: 1443 - DNA, 343 bp, Zea mays
  unsure at all n locations
  Clone ID: LIB143-047-Q1-E1-H1
cttcggccaagccttcggcggccttatccacggaaaccttgcggctggtttcccggctttggctggtaaccaccttcggcctgttcctgatgcccgttctgcccaaccgaagccaagctgctccaagcagcggcggaagagacctcgtgatggcagccggaaagacaagcagtgagaccccagagatactggaactcatcctccatggaaggcgttgcaagagcacgagggccaagattaagctatgtattttaccatttcatgcangagctgcttgctagtagttgctaagctttgagcctcttgcaagcttacctctatatgtagtgtacccgcaaatctt

SEQ ID NO: 1444 - DNA, 216 bp, Zea mays
  Clone ID: LIB143-047-Q1-E1-H3
gcgggccatcacacgcggccatctccctccctaaacgctccccaaatccggtttccaaggccggaaaaatttaaccggccgaccgggcaacggtattccattcaatcccaattagggcgaaaaaattccaatccggcggaaggaatggcttccgaaaacaacttcagttacttaacctccggcggcggcttcccggcggggtacccggcccggaat

SEQ ID NO: 1445 - DNA, 143 bp, Zea mays
  Clone ID: LIB143-047-Q1-E1-H5
caagcctcaggagtgagtcgtatcattcgactccatcgctgggtcgttcaccgccgcctcaggacacggcgtcgtaacgggtgacgcgctcggcgcatgaactgcagaatacatggacgggttcgtcatcgggccacgctcga

SEQ ID NO: 1446 - DNA, 358 bp, Zea mays
  unsure at all n locations
  Clone ID: LIB143-047-Q1-E1-H6
ctcatgggccgacacacgcctcaataacgcgtcctcatattccccattctccatcgacgcaccggcggcggcgcaagtgaagcgaagaggaaaggaagctacgagatgtcngcgaccactgcagcggtgcccttctggcgggcggcggggatgacctacatcggctactccaacatctgcgctgcgctggtccggaactgcctcaaggagcccttcaagtctgaggccgcgtcccgcgagaaggttcatttctccatttccaagtggacggatggcaagcaggagaagccaactgtccgcacagaatccgatgactaagggctggcgccatggcgacatagtccttcctacagatgat

SEQ ID NO: 1447 - DNA, 271 bp, Zea mays
  Clone ID: LIB143-047-Q1-E1-H7
ctcgcgggccgacacaagcctcagtaatgagtcgtagcaatcctaatgttcctgatcatcatcctgctcggggatgtggcgccagtcacagaaacagagcctagaagcgtgcggctagtacaggaggcgccacatacgaaggtggtggaagatggggccaaggcggggacggtgccggtgtcaaccgtcgcgtggactacgcttgcgatggcctcagctacggggttgggagcggtgcccttctttttcatggagctcgaagcgcaatggg

SEQ ID NO: 1448 - DNA, 425 bp, Zea mays
  Clone ID: LIB143-047-Q1-E1-H9
cgggccgacccacgcgtctaagcaaaatcgaaccaaaacggagagagacaatcgagagagatggcaaactgttttggtgacgtcgtggacaattacaagctagacacaatgccaagatatatcggcaaaaagaagactcgagaagaccgggcacgagaggcctcctatctcagtaatgagaatgagaagtacaagaaagctaaagactatgtgaacatgctgaaggactggtacggcaatggagcgtcgacgctgtgcgtgatctacaaccagacgggcggaaccctgcggtacgtcgacgacaaggactggctgggctacccggggccgacgccctacccgacggagatcggcaacgggcagtgggcgtccttcctccacgtccacaagaacggggcctcgtcggggtccatggccgctgtcgt

SEQ ID NO: 1449 - DNA, 374 bp, Zea mays
  Clone ID: LIB143-048-Q1-E1-A1
tacggacgcttgggcgcgggcggacaaggagcaggcggaggaggagctgtgccaagccacaatgggtatctcgcgtgactcgatgcacaagcgccgggccaccggtggaaagcagaaggcctggaggaagaagcgaaagtatgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaag

SEQ ID NO: 1450 - DNA, 398 bp, Zea mays
  Clone ID: LIB143-048-Q1-E1-A10
atggagcgtcgaagctgtgcgtgatctacaaccagacgggcggaaccctgcggtacgtcgacgacaaggactggctgggctacccggggccgacgccctacccgacggagatcggcaacgggcagtgggcgtccttcctccacgtccacaagaccggcgcctcgtcggggtccatggccgctgtcgtctaccgcggcaaggacggcggcggcagcgagcgcgacttcgccatggcctggagcaccccctggggcgcctccaagaacagggcctactgcgagatcggcaacgtcggctccttccagtcgcagtgggacaatctctacaaaaaactcaacaaggccggatacactaccaacgcaagtggtaccagctcgtctatttccgccgcaactgcc

SEQ ID NO: 1451 - DNA, 58 bp, Zea mays
  Clone ID: LIB143-048-Q1-E1-A12
ctcgcgggtcgacacacgcctctagatggactcatctaatctttgcatttttcctttg

SEQ ID NO: 1452 - DNA, 310 bp, Zea mays
  Clone ID: LIB143-048-Q1-E1-A2
gtgagtcgtcataaatcgggcaaggagcagggagacgacgacctgtgcacaacccgaactaggtatatctcctcaagccaggcaaggcactcctgcccatcgatggccgtcacaccgcctggaaggaacattcctccacgtacgactcttggtgcacgaaccagccaacaccaccattgtcaagcggtacgacactgacgacggtccgtattcatggaagtagtttgaaatggacgcctcttcgccttgatactggtaatctactcatggagtaagtcatgctgttacccgcacgacccctaccctcgac

SEQ ID NO: 1453 - DNA, 365 bp, Zea mays
  Clone ID: LIB143-048-Q1-E1-A3
ttcccgggccagaactcgcggctcgacctcacgcgtccacagacgcgtacgcacgacggtattacgcactcaagcttatttagtttagcacacaccatcagccaaagcatactagggatcatatgcatgccaagatgttattacagcatcagattcagagctccagaagaagatggcgcatagctgcacgaggcttgcacgtggcctccaacgggacggctttgggcagagtgagcccgccgcccgcggccatgtcgatctcgtggccgtccactcggtcccagtcgaagcactggatcagcgtgccgagcaccaggctgatggtccgcagcgcgagggtctccccagcgcacttgctccgcccc

SEQ ID NO: 1454 - DNA, 388 bp, Zea mays
  Clone ID: LIB143-048-Q1-E1-A4
cgggtcatcccacgcgtccaaacaactcctgtataccaggaagaccgaacctgttgaaggagcccagtggacgggaatagtgacaacaatcgctgtcgagatgctgaaagcaaacatggttgatgctgtggtttgtgtacaaagtgatcctgacgacaggcttgctccaagacctgttttggccaggacaccagacgaagtaattgcagccaaaggtgtgaagccaacattatcaccaaatctcaatacacttgccttagtcgagctggtgtaaagcggcttcttttctgcggtgtgggctgtcaagtgcaagctttgagatctgtagaaaagtaccttggtttggaaaagctttatgtgcttggaacaaactgtgttgacaatggta

SEQ ID NO: 1455 - DNA, 386 bp, Zea mays
  Clone ID: LIB143-048-Q1-E1-A5
acggacgcgtgggctccgccgccgacccgccgcggtccgtggactggcggcaggagggcgcggtgacgggcgtgaaggaccagggccactgcggaagctgctgggccttctcgacggtggtggccgtggagggcatcaacgccatccggacgggcagcctggcgtcgctgtcggagcaggagctgatcgactgcgacacggacgagaacgggtgccagggcgggctgatggagaacgccttcgagttcatcaagtccttcggcggcatcaccaccgaggccgcgtacccgtaccgcgcgtccaacggcacctgcgacggcgatcgggcccggcgcgggggaggcgtcgtcgtggtgatcgacggccaccagatggtgccggccggc

SEQ ID NO: 1456 - DNA, 410 bp, Zea mays
  Clone ID: LIB143-048-Q1-E1-A6
actcccggcggcggcggcggcggcgcagcagcggcagcagcatccgaagatggtgaagttcctcaagcccggcaaggccgttatcctcctccagggccgcttcgccggcaggaaggcagttatcgtgcgcgtgttcgaggagggcacccgcgaccgcccctatggccactgcctcgtcgcaggcctcgccaagtacccaaagaaggtgatccgcaaggactccgccaagaagactgcgaagaagtcgcgcgtcaagtgcttcatcaagctcgtcaacttcactcacctcatgcccacccgctacaccctcgacgtcgatttcaaggatgtcgccaccggtgggcccgacgcactctctacccacgacaagaaggtcgccgcctgcaagacggccaaagcgcgccttgaag

SEQ ID NO: 1457 - DNA, 347 bp, Zea mays
  Clone ID: LIB143-047-Q1-E1-G8
aacaaccagcaaagtgagtgtgatcgatcacacactgcacacactgccatggccgtcatgggcaaggaggacgagcaggagcagcagcagcacaaggaggaggaggtggtccaaggagatgtgcgagtcgtcgtccagcaggagacgtcggcggacgaggaggccgagtcggcactggtgcgcaagatctccggcctggccgccgccatcgccaggctgccgtcgctgagcccgtcgccggaggtgaacgcgctcttcaccgacctcgtcacggcctgcatcccgcgcagcaccgtggacgtggagcgcctgggcccggagctgcagcgcatgcgcgcgggcctcat

SEQ ID NO: 1458 - DNA, 420 bp, Zea mays
  Clone ID: LIB143-048-Q1-E1-A7
aacaccacacctcttcctcctcttcctcctcctagcacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcgaggcggccaccgagggcggcggctgcgactgcaacacctgcaactgcggcaccagctgcggctgctcctgctgcagctgcaactgagccggcccgcccggcccggcgatggcgcacgagagtcgagaggacgacgacgacgaggcgtataaatataatagcagcgtctaaataagatcctgtcaactgcacccg

SEQ ID NO: 1459 - DNA, 383 bp, Zea mays
  Clone ID: LIB143-047-Q1-E1-E7
tcgtgggccgatacaagcctcagcactcagtcgcattagccgagctcctcgaaaccctaggagcgtgcttgaccggcggcggcgacgtgatggcgatggaccctgacgcggtagcgaaggccttcgtggagcattactaccgaacgttcgacaccaaccgcgcggcgctggttgggctgtaccaggagacctccatgctcaccttcgagggccagaagttccagggcccctccgccattgccggcaagctcggatctctccctttccaggcctgcgagcatcagatcgtcaccgtagactgccagccatcgggtccccatggaggcatgctcgtcttcgtctccggttccatacgcaccggccccgaggagcaccccatcaag

SEQ ID NO: 1460 - DNA, 360 bp, Zea mays
  unsure at all n locations
  Clone ID: LIB143-047-Q1-E1-E8
cacaagcctcaagattgagtcgcatcaccctcttatcaagtcctcctcgggttagggttccttagggttttgtggaggggcgatggcggcggctgatgtggagtaccgttgcttcgtcggcggacttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggccgcngcggcgg

SEQ ID NO: 1461 - DNA, 279 bp, Zea mays
  Clone ID: LIB143-047-Q1-E1-E9
agacgacgagagttcagccgcttcagtgtcgtcgccgtgatcgctggtagtctgccaatttttttttaatttttcccgcggaccgtcagtagaacaccgccacgcccagggggcgcgggggcagagggattcagatggtagcgggctgctgcccctttttttttccacacacttttgtacctgtagattatagaatgtacaatgtttttgcaaatattttatctctgtatgtaagaagggataaggtctagatcagaagagggaataatcagttaatct

SEQ ID NO: 1462 - DNA, 257 bp, Zea mays
  Clone ID: LIB143-047-Q1-E1-F1
gtgagtcgtataagagggcccgtttcgggcctgaaccctggtttggcgtacagaagggcttcacgcttactttcctgtgcatgtcgagatcacgtgtagcactcagacactgcgtgtgcagccttgctggtttagattgtcacaggttggtctcactgcaggtaatgatcggatgatcctgcgcatgcatctctcacgaatccgtcagggctatttcagatgataaccacattacgttgtcatcactgacttgttca

SEQ ID NO: 1463 - DNA, 429 bp, Zea mays
  Clone ID: LIB143-047-Q1-E1-F10
cgggccgacccacgcgtctacaaagcgacactagctagtccctaccaaagcatacttcctgaaacactcttgcaatccactgagttctgtttgttgagacgcatagagctagagtcgacaatgtcgctcgtgaggcgcagcaacgtgttcgaccccttctccatggacctctgggaccccttcgacaccatgttccgctccatcgtcccgtcggcgacctccaccaactccgagactgccgccttcgccagcgcccgcatcgactggaaggagacgcccgaggcgcacgtgttcaaggccgacctccccggcgtcaagaaggaagaggtcaaggtcgaggtcgaggacggcaacatgctggtcatcagcggccagcgcagcagggagaaggaggacaatgacgacaagtggcaccgcgtcgagcgcagc

SEQ ID NO: 1464 - DNA, 427 bp, Zea mays
  Clone ID: LIB143-047-Q1-E1-F11
ggccgacccaagcctctacactaagtcgcatcaccgcgtcacctcctcttcgccgccgccgacgcttcacccggcagccagccatggatgaggagtacgacgtgatcgtactaggcacggggctcaaggagtgcatcctcagcggtctcctctctgtagacggcctcaaggttttgcatatggacagaaatgactactatggaggagattccacctcactcaaccttaatcagctctggaagaggtttagaggggaagacaagcccccagcacatctaggtgcaagcagagactacaatgtggacatggtgccaaagtttatgatggcaaatgggacattggttcgaaccctcattcacaccgacgtgacaaagtacttgtcattcaaagctgtttgatgggagctatgttttcagcaaatggaaga

SEQ ID NO: 1465 - DNA, 219 bp, Zea mays
  Clone ID: LIB143-047-Q1-E1-F2
cgagggcctccaaattgttcatgattccaaggtagctttccgtaatccaggaaaaggtttcgcacaaaaatcacctgacatcggtcccgtgaagccccgtttttcatctcgaaaacggcttcttttacaattcatgaaggccaggtcccaagcttgctgtcaaaattgcaacagcagtaccatttccgctacggctctccgggagacacctggggaatc

SEQ ID NO: 1466 - DNA, 375 bp, Zea mays
  Clone ID: LIB143-047-Q1-E1-F3
cgggtcagcccacgcgtccagctccgatgaaatccaccaccgcggccggggcctcccagatctcgctggaggcagcggcagcggcggcggtggggggcgatggcgctcaacatgaagaccctgacgcaggcgctggcgaaggcgtcggctgtcatcgagaagacggtgtccacgacggtgcaggaggtgacgggcccgcgcccgctgcaggactacgagctgctggaccaggccgggtccggcgggccgggactcgcgtggcggatctacacggcgcgaccgcgggacggcgccccctcggcgccctaccccgtcgtctccgtctgggtgctcgacaagcgcgccctcgccgaggcacgggcccgggccgggctg

SEQ ID NO: 1467 - DNA, 311 bp, Zea mays
  Clone ID: LIB143-047-Q1-E1-F5
ctcagggttgggacttaatagatcatgtcgggcaaacaggctcgagcttccaagcaatatgagaaggcagcccagtacattgactaccacacttcgttcagtgaagatgagaagaagcatccaagacatctgcaattcagcggcaacctatacactgctgcctgcaatctgaagttgaccgattacaaggaaactgcaaatctttgcacaaacgttctggaactacacagcagcatgtcaatgctcactacaggaaggtgcaagcttacattcagcttactgacctagatctagcataggccgatatcaaa

SEQ ID NO: 1468 - DNA, 334 bp, Zea mays
  Clone ID: LIB143-047-Q1-E1-F6
actcatgggcaaatacaagcctcaaaactgagtcgtattagaccgtgtcaagcagccctcgtcgcacccagaagtcgaaaatcttgggccctgccaagatggcgtgaatcagtccgttgccgacgccttcgaaggcctggacacagaagataaactcgctggcgtcaacagcgcagtggactgcaacctcctcgatacgtatgcctcaggttcggcaactgtcatcgtcaccgatgaggccccagcgcagcccaatgagtcgaacaactccttcatggaatacatcaacaccaatggcagcaattaaggtaacatctccaccggcaactccaac

SEQ ID NO: 1469 - DNA, 414 bp, Zea mays
  Clone ID: LIB143-047-Q1-E1-F9
cgggccggcccacgcgtccacatagatggaaagactctggatggacggaacatacgggttaatcatgctaacgagaggacaggtggcttccgcagcagcggtggttatggtggtggcggctatggtggtggtggtggcggctatggtggcggtggctatggcggcggctatggtggtggtagcggtggctatggcggcggcggcagcggtgactatggtggcggcagcggtggatatggtggcaactacggcaacagggctggtggtggctatggtggtggtggtgattatggagttgcaggtggggctgaaggcagttttgctgctggaggtagcgacagctttggcagcagtaactttgctgacagtggttttggtgaaaaccctgcctgtagctttggcgcaacgggtggt

SEQ ID NO: 1470 - DNA, 420 bp, Zea mays
  Clone ID: LIB143-047-Q1-E1-G10
gcgggccgacccaagcgtcaacacagacgcctgctaacgcgtccgggccgcccttttttttttttttttttttttactagtaaatgtccatcgcatttcaattagctgacaaacgacccaaacaatacaatagcttctgcttaatattgcagaacactggagtagcgagttcaccacgagagcagcaagacacaaacgagaagaaaatagcggcagagcacagggctcgcaatcatatacggccctttatttaaccgaccacggactcacgggaggacgaggcacccttcagcgacgggcagaggggtaaccttgacaggaacataggccgtagggccctcaccgtcgctggcttcctcctcttcctcatcatactgaaccaggccagcagcgctgaagatgtacgccctcacttcctcg

SEQ ID NO: 1471 - DNA, 302 bp, Zea mays
  Clone ID: LIB143-047-Q1-E1-G2
ccggggcctcccacatctcgctggaggcagcggaacctgcggcggtgcggggcgatggcgcccaacatgaaaaccctgacgcaagcgctggcgaaggcgtcggctgtcatcgacaagactgtgtccacgacggtgcacgaggtgactggcccgcgcccgctgcatgactaccagctgctggaccaagccgggtcctgcgggccgggactcgcgtggcggatctacacggcgcgatcgccggaccgcgccccctcggcgcactaccccgtcgtctccgtctgggtgctcgacaaacgcgccct

SEQ ID NO: 1472 - DNA, 257 bp, Zea mays
  Clone ID: LIB143-047-Q1-E1-G5
aacgatccttgagttgacgagcacatacacagctgctagctaatcctgccgtgagtgcaatgcatgcaaagatgacgaagcccgcagccatcgttgttgctgctatcgccgtcctctccgtcagcctgctggctgggtcgtcgtgccttgcccttgcgcggcccagcggcgacttctccatcgtgggctactcagaggatgacctgtcgtcgcacgagaacctgacggagctgttcgagcgctggctgtcccgccac

SEQ ID NO: 1473 - DNA, 399 bp, Zea mays
  Clone ID: LIB143-047-Q1-E1-E6
ctcgcgggccgacacacgcctcagcactccatcatcgtaaggccacagccaccatggtgaagctggcgacggcgcgcgagtgccgcgcatacagcctcggcgccggcgcggggtccggcacggggttgcgcaaccggtgggagtacatcaacgccggggtgtacatcttcgcggcggtcctcctggtcggcgggttcctggcgcagctcctgccgtggggcgggcccagcagcccggggctcgtggtcgccgcgatcgggctcgccggcttgctggccgtcaacacgcacgacctcctcgcgcactccgccggcgtcgatttacgcctcgggatggtggtcgggcttgacgcgcagatggggctcgtccagctcggcgtccccgccgtgcagatcgttg

SEQ ID NO: 1474 - DNA, 383 bp, Zea mays
  Clone ID: LIB143-047-Q1-E1-C7
ctcacgggccgacacacgcgtcaacacacacttctggcaatcttgaacggaacctagctgcattggctcgtgcagctgctgttaaggttgcagagcaagttaaaactcttagacttggcaaggaaatacaaccaattactacaacccttcttgattcaaggcttgctgatggtggtgaagttgaaatggaagttattcctatggagcatgatatatcaaacacttacgaaaatccatctcctatgattgttgatgaggctatgctagaaaaagtacttgggcctcctagatttgatgacagagaaactgcagatcgtgtagcaagcccaggagtctcagttggccttgtctggacttcggttggtggggaagttcagtttgtg

SEQ ID NO: 1475 - DNA, 113 bp, Zea mays
  Clone ID: LIB143-047-Q1-E1-C8
gagtcgtactaacagagccgaaagctggagcttccagtggccgggagacaacgacctgaaggtgctcggcatgtggacgagccagttcgtgatcggggtcggcatcgtgctca

SEQ ID NO: 1476 - DNA, 421 bp, Zea mays
  unsure at all n locations
  Clone ID: LIB143-047-Q1-E1-D10
ccaagcctctagcgagaatcgcgataagagcaggagcaggcaacgcgcaccgaaatcttccaatccacaagactcgctacttcgcagttggcagactcgcccgcagcgagccgctagcaaccaagcagaaatgtcgctggtgaggcgcggcagcgtgttcgacccattctccgtggacctcttcgaccccttcgacagcgtgttccgctccatcgtgccgtcgtcgtcgtcggcggcggcggcctccgagaccgccgccttcgccagcgcccgcatcgactggaaggagacgcccgaggcgcacgtgttcaaggccgacctccccggcgtgaagaaggangaggtgaaggtggacgtggaggacggcaacctgctgctcatcagcgggcaacgcagcacggagaaggaggacaagggcgac

SEQ ID NO: 1477 - DNA, 318 bp, Zea mays
  Clone ID: LIB143-047-Q1-E1-D3
caagcaagaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgaggcggccaccgagggcggcggctgcgactgcaacacctgcaagtgcggcaccagctgcggctgctcctgctgcagctgcaactgagctggcccggcccggcgattgcgcacgag

SEQ ID NO: 1478 - DNA, 329 bp, Zea mays
  Clone ID: LIB143-047-Q1-E1-D5
acaagcctcaagactgagtcgtattagcctttataccaccaaagcctggtgctccaactggggaattaggtgatgtaaaatcagattttaaaggtgaagaaattattcaaaaagaacaatattgtgaaagagaacctattgttgctgcaagagagaatttgctaattgatctttcgtgtggtgccgagtcgatagatgtgtcagatgtattggaatctttaatggaagaaaggagtggaacttcgtacgtgccagtatcaatagaggacttcctagccgcttcagcagtggaagaaccacaatattctagccctaaagcgttatctcct

SEQ ID NO: 1479 - DNA, 372 bp, Zea mays
  Clone ID: LIB143-047-Q1-E1-D6
ctcgtgggccaatacacgcgtcaagcatgcacatcaaatagtcgctcatcccgcctgcctgccgccgccgccgtcatgtaatcatatcagccctcttggcgtcgtcgccatcgtcatgtaatcatatcagcccccctggcgccggcgccggttcctgccgccggctcccattggaaatggtggacgacaccagcagatacaactgcttcgagcctgggacggtcttattatggagctcaacaacttgatggcgctcaactggcggcccaggtcgtattcgattgttaatgcattcaatagacagacattcgcaactcttacagatttgtacacttagtttacattttcttttttggtggggggcaattttgt

SEQ ID NO: 1480 - DNA, 370 bp, Zea mays
  Clone ID: LIB143-047-Q1-E1-D7
tcgtgggccgacccacgcgtcaacgatgtgtcctccatatcaacacagcaagtcagcaacaagcaaagcagcgacccgagagatggacgcgaggatgttcgggctggagaccccccgggtggcggcgctgcatcacctgctggacgtgcccgacggcgacaaggcgggcggcggcgccacgcgcacctacgtccgcgacgcgcgcgccatggcggccaccccggccgacgtcaaggagctcgcgggagcgtacgcgttcgtggtggacatgccggggctgagcacgggcgacatcagggtgcaggtggaggacgagcgggtgctggtgatcagcggcgagcggccccgggaggagcgcgaggacgccaag

SEQ ID NO: 1481 - DNA, 170 bp, Zea mays
  Clone ID: LIB143-047-Q1-E1-D9
tagtttaacacgtattatgtttttctgtaaagcttagaaatacttattttgttaatgcatagaaaatcaatgaaaaaaatgtagagcttttatgaaagtcaaaatggacatcaacgatttacgctaaaacttgtacccatttacgctgttttagttcacattttatgttg

SEQ ID NO: 1482 - DNA, 373 bp, Zea mays
  Clone ID: LIB143-047-Q1-E1-E1
ctcgcgggccgacacacgcggccaccatgcgtccgggaaaggaggttccgaattccggcgacggctctgcgcccagccctctacactcagcaccagttgggaccaacgaagcaccagccgtcgaagcgagagaccaccagcagcagacaagctctccgtcgtcgccaccgcctccagatctcatcagcatctgagtaaccggaatcgaaaacgttaccgttcctcgcaaaaatccccgcttcagtgtagcaagcttaggtcgtaattttaggtttgcaataagtttatttggcctcctgtgctgtacatatccgagtttgtttgttggttggttgtgtccggtctgtcatgtttcatttgctggtgcggtgtg

SEQ ID NO: 1483 - DNA, 349 bp, Zea mays
  unsure at all n locations
  Clone ID: LIB143-047-Q1-E1-E2
acgcgtccagagtacttcataaaaaatgggtaagactgtcagctggatgcatagaactcatctgacaaatcacgacagagtctatggctatggtcncgcctcattactcagccttctagctttgctccagttaagggcctttacctctatagtggtgttagttcacggaagactatgcttatggacttgttctatcaacagctgccatctaattggcgacgcttcagtattcactttcaagatctcatgttgaagttagatattcgtctacatatgcacaaatgtgtttcagatccccttgaggttgtatcatctgagatttcagatcatgccatcatattatctcgtg

SEQ ID NO: 1484 - DNA, 339 bp, Zea mays
  Clone ID: LIB143-047-Q1-E1-E3
attaagggccaaaaagggcttgaaggtgttggggatttgggcaagccccatggtgatcagggtggagtgggcgctgcggctgaagggcgtcgagtacgagtacgtcgacgaggacctcgccaacaagagcgccgacctgctccgccacaacccggtgaccaagaaggtgcccgtgctcgtccacgacggcaatccggtcgcggagtccaccatcatcgtggagtacatcgactaggtctggaacggcggctaccccatcatgccgggcgacccctacgagcgcgcccaggcgaagttctgggccaggttcgcggaagacaagtgcaacgctgctctgta

SEQ ID NO: 1485 - DNA, 329 bp, Zea mays
  Clone ID: LIB143-047-Q1-E1-C6
ctcgtgggcagatacaagcctcaagaatgagtcgtagtatgctgttgctgtcgagacagactactcatacccacatgctgacaaaatcaaggagtacctcaaggacccaagcaagtttgctgttgccgccccggttgctgctggggactctggcgctgcagctgctcccaaggaagaagagaatgctgcggagcctgaagaggagtcggacgaggaaatgggcttcagcctcttcgacgactagagctgctgttttcgtcaaactgctgcaagttttggctttttttatcatctacaagtactgtttcctaaattttttagcagacaaa

SEQ ID NO: 1486 - DNA, 316 bp, Zea mays
  Clone ID: LIB143-047-Q1-E1-E4
ccggcccgttgccttgattttgtggaacaaaccaatggcccgcaccggcgccatggtttcctgcatgctgctcctgttggtggcgcaactgctcatggtgatggccacgcagacaccggcggcggcgggcaaccaacgcggagctggacgccggctgctgtggcaggtgacctgccactacagcgcctgtaactgccgcacttgcccgacatatggctgggcgtgctgcagcacttgctgctagctagctagctagtgtgagttcttccgcgcgcgcgcagccttttgcacacccctcttgcttaactcatgcatg

SEQ ID NO: 1487 - DNA, 402 bp, Zea mays
  Clone ID: LIB143-047-Q1-E1-E5
ctcacgggccgacacacgcgtcaaatcaaaatgcttgcagaaattaaagaggagcagggacagatttacgaggctgctgatttgatgcaagaagttgctgttgaaacatttggctctatggcaaagacggagaaaattgctttcattcttgagcaggtccggctatgcctggatcggcaagattttgtcagagcacaaattttatccaggaaaatcagtactagagtatttcacgcagatccatcaaaggaaaaatagaaaccaaaggaaggtgacagtattgttcacgatgctcctgcagatattccttcccttctagaattgaagcgcgtctactacgaactgatgattcgttattactctcacaacaatgattacttggaaatctgccgttgttacaag

SEQ ID NO: 1488 - DNA, 162 bp, Zea mays
  Clone ID: LIB143-047-Q1-E1-A2
aacccccaaggccaagccaacaaaccctccccaatccccaactccaaactcaatccagccgccttaaggaaggaaaattccaagaaccaaggcgccttcggccaaaataaaccttaccttcaaaaccccaaaggcaacaaattccaaattcaaggcaacccc

SEQ ID NO: 1489 - DNA, 298 bp, Zea mays
  Clone ID: LIB143-047-Q1-E1-A3
actctacactgcaatcactctatagtgagtcataatactgcctgaccagacctacctgattgcaacagccaacagcagctggtctgactgacatggcaaaggacatcgaggcatcggggcccgaggcgggcgagttctcggccaaggactacaccgaccctccgccggcgccgctggtcgacgcggaggagctcacccagtggtccctgtaccgcgcggtcatcgccgagttcatcgccacgctgctcttcctctacatcaccgtggccaccgtgatcgggtacaagcaccagacgga

SEQ ID NO: 1490 - DNA, 321 bp, Zea mays
  unsure at all n locations
  Clone ID: LIB143-047-Q1-E1-A7
cactcaatactgagtcatatgtatccgtactcatctgcttcactccgggctccggctacggcggcactcttctctggcaaacggaacacagaaacctctaggcgacgaatcgagcaggtanaagagtaatcaaggatccatggctgagcatcttgcgtccatctttggcacggagaaaggacgcgttaactgccccttccacttcaagattggcgcatgccgccacggcgaccggtgctcccgcctgcacaacaagccttccatctccccgacgctgctgctctgcaacatgtaccagcggccggacatgattaccccggg

SEQ ID NO: 1491 - DNA, 364 bp, Zea mays
  Clone ID: LIB143-047-Q1-E1-B1
cattgtacaactaagtcgtaaaacgtaaatcgtctactttggattacgagatgtttttcatttcaatataatatacatttgaacataagttatcgtgatattatatgttaccgttgcaacgcacgggcactcacctagtaaagaccaaagagtaattgtcactcgcgcgcggcacccaattttttctggcgcccaaaattggccgtagaggcccacctccagttgaactatggaccaaaccctatttcctcttttccaccacccggagttccgccgccagaagcaaggccccttcgtcgcctccgtccgccgcgctctcaactccatcgccatcctcctctgactcctccgacgacggctcctc

SEQ ID NO: 1492 - DNA, 352 bp, Zea mays
  Clone ID: LIB143-047-Q1-E1-B10
acccaagactctacatagagtcgtaggaatcattttcagaggaccaattcatgtcactgaaatcttactgctaaggatgcaaccaagtagcagaagagaattctcttgccctttgttagtcttggaaactggagcttgtggagtgatgcttcctggaagcgccattgagaagtcaagttgacaacaagtgactgctaacaagtagagctatctgccttttttgggtaatgtttcgggcagtttttctcaattttgtggcaatcactgatgatctaaataaaaataatactactacactgctgtacgtgaaaactgaacagatttgctgtctggaaatgtaactatttttaac

SEQ ID NO: 1493 - DNA, 428 bp, Zea mays
  Clone ID: LIB143-047-Q1-E1-B11
cgatccaacaccctagattgagtcgtatcacctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggccgccggcgccggcggttacggtggtggccgtggaggcggcggctacggcgg

SEQ ID NO: 1494 - DNA, 197 bp, Zea mays
  Clone ID: LIB143-047-Q1-E1-B4
gggcttattcaaaaatggttcccgaacaaaaggtggtaaaaaaggccccggcggggcttcccggcggggccggccccaaaaaaaacccggtctctcgctccttgaaggccggcctcaatttccccttaggccttatcggccgcaacctcaaccaggttcgctagtccaaccttgtcggaaccggggcccccttcaac

SEQ ID NO: 1495 - DNA, 376 bp, Zea mays
  Clone ID: LIB143-047-Q1-E1-B5
ctcacgggccgacccacgcctcaacccacacgtccggtacccaccccgtggtgccaagctcgcggagccggcgacgcagcaagggatacggtaccctcccgtccacgcgacgacaggacagacacccaccccatcaccggaagcaccgccaaagcccaaagccggccaattccgacgccatggccgacgtcgacgacgacgctgtcctctccgacgtcgacgaggacccactcccgcccccctccacctcttccgcctcttcccacaaatcccttccacaagctcaaccccaatcacagtccgatgcccaggcgcagcagcagcggctgctggacctggccgcggagctcgaggaagagcgccgcctccgccgcgc

SEQ ID NO: 1496 - DNA, 319 bp, Zea mays
  Clone ID: LIB143-047-Q1-E1-B8
agcccacgcgtccgcccacgcgtccgctctcttccgcctccgattgagtgggctcaccttctttccaagccagcacaagcttgcaagcaagcaagctcctgaaatttcagctcgcttctcctcaaaaggtcgagcagaccagactcctccgaccgaagctctacaacttcccagttagcctgtcaaggaactgcttggccggagatccaaacaaacccctgtgttggggttctccggggttccttgcgctggagggaggtttcgttctcgctggccatggtttggctgagaagcagcagcggcagcatcttgatgccaa

SEQ ID NO: 1497 - DNA, 374 bp, Zea mays
  Clone ID: LIB143-047-Q1-E1-B9
ctctaatcaaagtcatagcatggaaatgccaacagagtccggtaaatgatatagccctctgattatactaacatactgtaccaactcaactagaagaatttggagtacgacttgtgacctatgatcttcctggttttggtgaaagtgatccacacataggccggaatctcaattcttctgcactggacatgctctatctggctaatgctctcaatattccagagaagttctgggttgtgggctattctggaggtggcatgcatgcctggagtgctcttcattacattcctgatcgaattgctgcaatgttcgcacctatggcaaatccatatgactccaagatgacgaaagatgagaggagtaaaacatgggat

SEQ ID NO: 1498 - DNA, 367 bp, Zea mays
  Clone ID: LIB143-047-Q1-E1-C1
tcactccagattaattcgcaatatctgtgctcgcgcttcgtccagcttccccggccggaaaaggtagcacggcaagggcagaggatgagtgaccccaagtacgcctacccctaccctgcgcaaggttactaccaggggccgtaccagggcccgccggtgatggcgccgccacagtacgccgcgccgccgcccagaagggagccgagcttcctggaaggctgcctggccgcgctgtgctgctgctgcttgatcgacgagtgctgctgcgacccgtccatcatcttcgtcagctagactagacgaggaagaacctattggtatatataatatgtatgtatccagttgtactcttagctttattcctgca

SEQ ID NO: 1499 - DNA, 277 bp, Zea mays
  Clone ID: LIB143-047-Q1-E1-C2
tcacgggtcaacacacgcctccaaaatattcatcacacaacaaggaacccccccttagccaaaccccaacaataagaactcccaattggaacccaagaaacattacctgggcgggctaacccaaaaaattgtgaaggcttttgcaaacaaccccaatttcggcttcaacccttccggaaacagggtgaaaaccgggttaaccttcaacaacccaaggtgcgtccctgccctgggctacgacaatggctgcacgcaccgggaaagtgtcccgggtgcc

SEQ ID NO: 1500 - DNA, 311 bp, Zea mays
  Clone ID: LIB143-047-Q1-E1-C4
tactatccatcattcgccaacttgcagagatcagggaaccggaattccatccactgactgaccgctcatggcgaaggtccacctctacttcgccgcggcctgcgccgtcgtcctcgcgctcgccaccccggccctcgccggtgaccccgacatgctgcaggacttctgcccggctgactactcctccccggtgaagctgaacgggttctcttgcaaggcgaacttttcggcggacgacttcttcttcgacgggctgaggaacccgggcaacaccaacaacccggcgggctccgtggttacggcggccaacg

SEQ ID NO: 1501 - DNA, 92 bp, Zea mays
  Clone ID: LIB143-047-Q1-E1-C5
ccacgcgtcagaaataagtcatactataaaataaagaataaaaaaaaaaaaaaatgaaaaaaaaaaaaaaaaagacaaacaaaggcagacgt

SEQ ID NO: 1502 - DNA, 423 bp, Zea mays
  Clone ID: LIB143-047-Q1-E1-A10
cgggccgacccacgcgtctagttcgcgcagccacaagaatgtgatatccctcgttggtttctgcttcaagaatgatgaccttctgttagtgtatgagtatttgcaacgaggcagcctggaagagatactgcatggtaaaaaagaatgcaagagcatatttggttggactgagaggttcagcgtggctatgggagttgctcgtgctctggattatctccatagtgataacaacagtcgtccagtgatccatagggatgtcaagtcatcaaatatcctcatttcaaaatgctttgaaccaaagttatcggactttggtctcgcagtctgggctgctgatgtgacatctcagatgacatgcaatgatgttgcaggaactttcggatacttggctcctgaatacttcatgcatggcaaggtgggcaa

SEQ ID NO: 1503 - DNA, 365 bp, Zea mays
  Clone ID: LIB143-046-Q1-E1-G12
agctgctccgcgcccccgacgccggtgattaggagcaggagcaagaagggttcggaatggccaagtctaagaaccacacggcgcataaccagtcgttcaaggcgcacaagaacggcatcaagaagcccaagcgccaccgccagacctccaccaaggggatggaccccaagtttctgaggaacttgaggtactcaaggaagggcaataagaagagttgtgaggctgagtcagaggagtgagatgatgcctgagtttgtggcgacaaatgcatctcttgtatcgttagggtcttagttgtgaacttaattttcacatctgtatgattaaaagagattcatcaattggtactgaagtgttgttttttt

SEQ ID NO: 1504 - DNA, 279 bp, Zea mays
  Clone ID: LIB143-046-Q1-E1-G2
acgcacgggtccatactgacgtctgtcatgactcgtagtgctccctcttctgactccctcgaggtactctcatcgcgatcgaccgggtcctcgagcgcgggagatggcggatcaggagaccccagttgcagttgaggcccctaccccggtccttggcgagccgatgtacttgacgactgctctgcagcttgtcatggacgactcgggtgctcatgatggccttgttaagggtcatcgtgacgctgccaaatcaattgacaggcatgctgctcagctttg

SEQ ID NO: 1505 - DNA, 439 bp, Zea mays
  unsure at all n locations
  Clone ID: LIB143-046-Q1-E1-G3
gggaccacccacgcgtccggagaactctgtcttccactgcccagaccaccattgagattgactcgctgtacgagggcattgacttctactccaccatcacccgtgccaggtttgaggagctcaacatggacctgttcaggaagtgcatggagcctgttgagaagtgcctgagggatgccaagatggacaagagcagcgtccatgatgttgtccttgttggtggctccactaggatccccagggtgcagcagctgctccaggacttcttcaacggcaaggagctgtgcaagaacatcaatcctgatgaggccgttgcctatggtgctgccgtccaggccgctatcctcagtggtgagggcaacgagaaggtgcangacctgcttctgcttgacgtcactcctctctctctgggtctggagactgccggaagagtgatgac

SEQ ID NO: 1506 - DNA, 402 bp, Zea mays
  Clone ID: LIB143-046-Q1-E1-G4
gtccaaagtgtgctctaaaatgcgtcctattaagtactccagaatgaggtcaggacggcgacgcccgacggtcgcatggtgatggaggaggacctgagccggatgccatacctgaaggccaccatcaaggagtccatgcgcatccacccgccggcgccgttcctcctgccgcacttctccacccacgactgcgagatcaacggctacacgatccccgccggcacgcgcgtcatcgtcaacgcgttgggcgctcgccagggacccgacgtgctgggacaaggccgatgagttcttcccggaacgctttcctggaaacaggccgcaacgccgatgtcgacatgtacggctaggacatccggtttcgtgccgttcggggctgggcgcaggatctgcccgggggcc

SEQ ID NO: 1507 - DNA, 207 bp, Zea mays
  Clone ID: LIB143-046-Q1-E1-G6
tacaagcctctaaaatgagtcgtattacacaaacaaaaaaaaacaaacaaggtaaaacaaaaaaacaaacaaaaagggtcaacaagcaaggaaaaatggcggaatcaagataccccagttgcaattgagggggcctaccccggtccgtgtcgaccctaggtgacctgatcactgcactgcaacgtgtcatgaacatgtccggtgatc

SEQ ID NO: 1508 - DNA, 391 bp, Zea mays
  Clone ID: LIB143-046-Q1-E1-G9
tgagtcgtatcagcctcacacgggtcgaaagcagaaacccgtgaacaactcataactcaaggctcacgccaccgtcgtcagcccccgttctccggcgatcctgtcattcgagacgcgtctcggcccctctccggtccagcaaccccgacgccgccacatgtcgacgcagtccatttcgccggcctctgcgtccgcgcagttcagctacccggcggcagcggccccgtcttacttccccgtgcccttccacctccagaacgcgcaatacaccgcatggaccgcagccgctccggcggtgcctgtgtacaacgccatctatcccatgccccaagtccagcaggcccaacagttgttccaaaaggactcgaatataattactcctgaagctcta

SEQ ID NO: 1509 - DNA, 381 bp, Zea mays
  Clone ID: LIB143-046-Q1-E1-H1
acaatggtctaaaatgagtcgtattaccctgtcctcaccagttcaacgcctcttctccgttcacccggcgtgtgctctgcctctctctctctctcgtgcagcgaccgccgacgcgcttcgccagaccttcgccggcgacgagcactcaccagggcttgaaaatgtcaacaagcactttgaaagaacccaatgtttctcaatcaaaagacgtggagaatggaaaagacaattctgtgaaatcctgcatcagcaagcctgtgttgaatggcaacaaatgtgccaacaaggaacaaaatgttctgtcttgttgccctggcgctgtgacaaatggaaacgaggctggaaatgcagacgtggagtacattgattctgagaatctag

SEQ ID NO: 1510 - DNA, 342 bp, Zea mays
  unsure at all n locations
  Clone ID: LIB143-046-Q1-E1-H12
gtcgccgccgccgcaaccgccgtcacagtcacaccaagaacaacaacggttaacaacaagaacaacaataacaaaacaaaacaataaccacaaccaccgcaaggagaagggttaacctgcaaaccccgggccgtgaaaccaaaagggtgaagaggcagggtaaggaggaaggaggacgcacacgagcaggccgtaccaagagaatctgctcaacatggcggaggcgcggcgggagatcgtcancgccctcaagattcaccgggccagcagcaggaggcagcagcaacccaagtaccagcgtcatcaggagccgccgctgcgtcaaacaccgtttgcgcaact

SEQ ID NO: 1511 - DNA, 438 bp, Zea mays
  Clone ID: LIB143-046-Q1-E1-H2
acgcatgcgtccagaatcacgtctaggactcggcatttgcttggctgctgctcccttctcccaccgaccaactcgatcccgcgccatggatcgcgccgaccccgcgcggggccgccttgccgtgctctcctcccacctccgtggtgcaggggccgaggaggcggcggggctggagaggtcgccggtatccgcgccggcgcccgggccccgcgccggcgcgcttgccgtggtggacgggaggaccgggaagcggcacgaggtcaaggtctccgaagacggcaccgtgcgcgccaccgacttcaagaagattaccactggaaaggacgacaagggtcttaagatttatgatcctggttaccttaacactggccctgttcgctcgtccatctgctacatcgatggagatgagggaatccttcgctataggggttatccaat

SEQ ID NO: 1512 - DNA, 418 bp, Zea mays
  Clone ID: LIB143-046-Q1-E1-H3
tcgcgggacgacacacgcgtctacacagtctgctggtaatgaaggataaatcaaaatctaatgtgcaaagtttgtatgatgccatacgtgttctgttgaaacctgatgacaaccgagtggtagcttctcaggtatatggatactcccggagatttgctgaaatcggggttgcagaagttcttgtcaatgcacttcgtgagcaagtcgctccttccagtttgccatctgcttgtgctgctttaaagtcgattgcagtcaatgatgaaatatgccgttccatatctgaaaatggtggaattgatgtgcttcttcaatgcatcgacgaggcaggtgagcagaagaacaaagttgtagcaagatcttgctgctctttgttgtccaagcttgctgcaagcgatgcaaacaagttcattatcat

SEQ ID NO: 1513 - DNA, 169 bp, Zea mays
  Clone ID: LIB143-046-Q1-E1-H7
tactacacccttacgtgagtcgtattaaacgtcggcgcctgcgtgagcggcgtgatcagccatgttctgagggctcgtgtagtgggtggctcagctgcgggggtccaccgtggggtgcctcgtgctccgcttctcgacgggcgggcaggctacgggcacctgctggctg

SEQ ID NO: 1514 - DNA, 375 bp, Zea mays
  Clone ID: LIB143-046-Q1-E1-G1
aaagtcagtcgcatcactgctccggtcgttcacccgccgcagctgcgcgggcccgagcgctttcgcttaccgccaccaccaacgacagcaaccttggtctcccttctccaccagcgccgctgcggtcacgcaggacgaagcggcgaagaggttccctggactagggccgacggcgaagggggagaaggccagggtggtggtgttggggacagggtgggcggggtctcggctaatgaaggacctcgatacacaaggctacgacgtggtctgcgtcgccccgcgcaaccacatggtgttcacgccgctgctcgcctccacctgcgtcggcacgctcgagttccgatccgtccctgagccggtcgcgcgcatccagcc

SEQ ID NO: 1515 - DNA, 378 bp, Zea mays
  Clone ID: LIB143-046-Q1-E1-E12
aggcaacccccacgaaaaccttcaaacccacaagactcgctacttcgcatttggcaaactcgcccgcaccaagccgctagcaaccaaccagaaatgtcgctggtgaggcgcggcagcgtgttcgacccattctccgtggacctcttcgaccccttcgacagcgtgttccgctccatcgtgccgtcgtcgtcgtcggcggcggcggcctccgagaccgccgccttcgccagcgcccgcatcgactggaaggagacgcccgaggcgcacgtgttcaaggccgacctccccggcgtgaagaaggaggaggtgaaggtggaggtggaggacggcaacgtgctgctcatcagcgggcaacgcaacaaggagaaaggagacaag

SEQ ID NO: 1516 - DNA, 367 bp, Zea mays
  Clone ID: LIB143-046-Q1-E1-E2
gtctaaagtcactcgtaatagagaaaaaaaacaggcaaggaaaatggctccgaccgccgccaaggacagtggctccgccgatcgctggcgcgaggtgcaggcgttcgaggacagcaagctgggtgtgaagggcctggtcgactccggcgtcaagtccatcccggccatgttccaccacccgccggagtccctcaaggatgtcatttctccaccagctctgccctcctccgacgatgcgccggccatcccagtggtggacctgtccgtggcgcggcccgaggatctggtggcccaggtgaagcacgcggccgggacggtgggcttcttctgggtggtgaaccacggcgtgccggacgaactgatggcc

SEQ ID NO: 1517 - DNA, 425 bp, Zea mays
  unsure at all n locations
  Clone ID: LIB143-046-Q1-E1-E3
caaatatttacatccaacgaggatcgaacacatgctcctgcaagagataacacagcanacaaatcttatgctatgcctgcccctaatctggatcattcattctccactatacagttaagagagccaccagtcgtcctgaagccttcagaacaccagtctgagcaggaggcacttgaaatagcaattacaaagttgctattgaagtcatattacaatattgtcaggaaaaatgtggaggacttcataccaaaagcaattatgcatttcctggttaatcacacaaaaagggcactgcataattacctcataacanaactttatagagatgatcttttggaagacttgctcaaagaacctgatgagctaaccataaagaggaagcagatacgtgaaaatcttagggtccttcaacaagcttacaaaac

SEQ ID NO: 1518 - DNA, 424 bp, Zea mays
  Clone ID: LIB143-046-Q1-E1-E4
acacgcctcacacccaccacaagaacaccaaagccacatcccatccatctccacggtgaggcttgagcgacccgagcaaaaaaaaatcatccgcgacgcagcgacgcaggtttgttctctgatctctctggttcttcttttagcagcagggacgcacagcacaagaaaaggtccggttcaagaggctcttctattgggtttttttagaatcctcaagagaagcgtgttcttgggttaggatttttttctcacctcatcacacctctcctaggaggaacagagatgcagagaaccttttttctcttctggatccttgccgccttttggccttcgaaagggggttgttttgcaataccctccctctgttttttttcttcttcgcagaaaaccgaccccgttttccctacttgtattgaggaacaga

SEQ ID NO: 1519 - DNA, 378 bp, Zea mays
  Clone ID: LIB143-046-Q1-E1-E6
gacacccgagagtgagtcgtattacaggcaaggaaaatggctccgaccgccgccaaggacagtggctccgccgatcgctggcgcgaggtgcaggcgttcgaggacagcaagctgggtgtgaagggcctggtcgactccggcgtcaagtccatcccggccatgttccaccacccgccggagtccctcaaggatgtcatttctccaccagctctgccctcctccgacgatgcgccggccatcccagtggtggacctgtccgtggcgcggcgcgaggatctggtggcccaggtgaagcacgcggccgggacggtgggcttcttctgggtggtgaaccacggggtgccggaggagctgatggccagcatgctcagcggggtg

SEQ ID NO: 1520 - DNA, 282 bp, Zea mays
  Clone ID: LIB143-046-Q1-E1-E7
tcgtgggtcgatacaagcctctaaactgattcggcggacggcgcgagggtggtggtggcggctacggcggcggcggcggcggctggagggactgatgtgtggccccatcctggcttcggccgagttatcttatctatctatagtatcgtgttaccgttcgcttctgtcaccgtgttagtgtccgttctacctttggattaggtgttggtaccccttttgttcgctttggttgctcccgctatgaaacgagacgagagaagaatgagcaaggtttttgttcgc

SEQ ID NO: 1521 - DNA, 149 bp, Zea mays
  Clone ID: LIB143-046-Q1-E1-E8
atgagtcgtattacgaacagaggcgtcacgtccatcaccacggctgaaggcttgagcgacacgagcggacggataagaggccccaacgcagcgaccaaaagtgtgggcgcggctctcgaggattcatccttaccgatccctgggggtca

SEQ ID NO: 1522 - DNA, 66 bp, Zea mays
  Clone ID: LIB143-046-Q1-E1-E9
tgagtcgtattactcgggtctcttgttcagtggcgcgttgggagttgccttcgtgtacgttccgct

SEQ ID NO: 1523 - DNA, 366 bp, Zea mays
  Clone ID: LIB143-046-Q1-E1-F1
tcgtaggaccatacaagagtctatactgagtcggaggagcttaaatggagaaaaatgatgacgaacaagagcagttcgctcccggtccagcccagtcaggatctggtcaagtttttgcctttcatatcgaagaaattaataatttatgtatgagaatttttccaacattcgttttgggcggagacattgatctcaaaacactcgtaactgtcctactaagtggtggcatgggtccccaaaacatggtcatatggtgtgtctagtctgcccttcgttgcagccgggcaattttccttacatatattgcctttaatcaagtatcagatgagtgtcaagtcgctgcggttaattgtttgtttttctaaa

SEQ ID NO: 1524 - DNA, 326 bp, Zea mays
  unsure at all n locations
  Clone ID: LIB143-046-Q1-E1-F11
acgcctctacattgattcgtactactactgtgtgcaccttgtctcttgggagaaggagaatgtctccagtgaggctcttgaggctgcccgtattgcctgcaacaagtacatgaccaagtctgcaggaaaggatgccttccaccttcgggtccgggttcaccccttccatgtccttcgtatcaacaagatgctttcgtgtgctggggctgataggctccanactggaatgaggggtgcctttggcaagcctcagggcacctgtgctagggtggacattggtcaggtactcctttctgttcgatgcaaggacaacaatgctgcacatg

SEQ ID NO: 1525 - DNA, 308 bp, Zea mays
  unsure at all n locations
  Clone ID: LIB143-046-Q1-E1-F12
aaggtgtcaatcatgaatgatggttccatcgctgtcaaggttggaggaattgagataggtcaaggattgtggactaaagtgaaccagatgacggcctttggactgggacagctgtgtcctgatggtggcgaatgccttctggacaaggttcgggttatccaggcagacacattaagcctgatccaangaggtatgactgctgggagcaccacttctgaaactagctgtgaagcagttcggcaatcgtgtgttgcacttgttgagaggctgaagcctatcaaggagagtctcgaagctaagtccaacac

SEQ ID NO: 1526 - DNA, 339 bp, Zea mays
  Clone ID: LIB143-046-Q1-E1-F4
cgcacgcgtccgaactcgcaggtacacagctccgcccgtccccgtccgtccacagccagcgccgcctcccatctagcgcccgtccacagccgccgcagttccagtgagatcgagcgaggtaagcttagatctgagcgatttctctcgcgcgtcgcaggtaaagttcactcgacttcgactctctcatcctcttctgttcttcctggttccgtcttcttcctcgagcagacagcgagagacccgtggccttttagatcccgggcttcagatctgcagtttcgtcttcggtttgggtccagttccagcagtgtactagtactagtcgtgaggttgggtacc

SEQ ID NO: 1527 - DNA, 352 bp, Zea mays
  Clone ID: LIB143-046-Q1-E1-F5
aacatgctccgcctcaggcgcctccccgctgtctccggccgcctcgcgccggaggtcacctccgtctctgcggcctcctcccacagcgccgtcttctttcgcaccctccaaatcctcgtccagcaggggcccgtccgcctccaaaagctctctgctccggacaccgggatcgtggagctgaggctggagcggccggaggccaagaatgccatagggaaggagatgctccaggggctgcggagcgcgatccaggaggtggaggccgacacggctgcaaacgtcgtcttggtgacgagctcggtgcccaaggttttctgcgcgggcgctgatctcaaggaaaggaggttgatgg

SEQ ID NO: 1528 - DNA, 401 bp, Zea mays
  Clone ID: LIB143-046-Q1-E1-F7
ctcgtgggtccatacaagcctctaaactgagtcataagaagaagttgcggttgtacttttcttcctccgccgtcggctcagatctctgcgtgcgggctagcgatggcgtcgttctcggaggctcccccagggaacccgaaggcgggcgagaagatcttcaagaccaagtgcgcgcagtgccacacagtcgagaagggcgccggccacaagcaaggtccaaacttgaatggtctttttgggaggcagtcgggtaccaccacaggctactcctattccgcgggaaacaaaaacaaggctgtgatctgggaggagaacactctgtatgactacctgcttaaccctaagaagtacattcctggaaccaagatggtcttccctgggctgaagaaaccgcaggaacg

SEQ ID NO: 1529 - DNA, 276 bp, Zea mays
  Clone ID: LIB143-046-Q1-E1-F8
tcatgggtcgaaacaagactctaaaatgagtcatcactaggtgcttacgtagtatacttctgtctggattcacctttttttcgcatattgtgttaatactctgtaaattatcaaactggcttcctcaatgctcgtgtaattaaatgaaccgttgagtgaataagctataaggcaagatagactttctatggagtaaattctgaaagtatcaatatgtgttgaactagactaatttaaattttactttcgcaaccaataaggatcatcatattcagc

SEQ ID NO: 1530 - DNA, 303 bp, Zea mays
  unsure at all n locations
  Clone ID: LIB143-046-Q1-E1-F9
tcgcgggtcgaaacacgcctctagcgccaatcatattagccagcgccggcggcttcgaggcggccaccgagggcngcngctgcgactgcaacacctgcaagtgcggcaccagctgcggctgctcctgctgcagctgcaactgagctggcccggcccggcgatggcgcacgagagtcgagaggangaggacgacgacgaggcgtataaatataatagcggcgtccagtaaataagatcctgtcaactgcacccgccattatccatggtcgctcgctcctcgcctgcgtctcctggtcctggggt

SEQ ID NO: 1531 - DNA, 340 bp, Zea mays
  Clone ID: LIB143-046-Q1-E1-E10
cggccgaaggcccaacgaagcccaaaacgttcccaaaggaaaggaacaacccccccccaaggtaaaccaccgccggcggcggcaggaatgaggcaggatgtctccggtatccgtgcttgaccccccaacaaagggaaaggtggtggtgcagacgacggccggcccgctcgatatcaagctgtggcccaaggaggcccccaaggcggcgcgcaacttcgtgcagctctgcctcgagggctactacgacggcaccctcttccaccgcgtcatcaagaatttcctcgttcacggtggcgaccccactggctccggcactgggggtgagagcatctaatgggct

SEQ ID NO: 1532 - DNA, 295 bp, Zea mays
  Clone ID: LIB143-046-Q1-E1-C12
tagaaagcgggcaatgcaggaaaacggcgccgagagcaaggccgggatgacggatcggcggatgctgaccgaaaagtcgcagctgcaggcgctggcgatactgcctgcggaacaacgaggagctcattatgagccatgcgatcaagtcggagacggagcgcattgagtacctcaagaccgtgagcgactgctacacgcggacgatgaatctcctcgacgattcgatggcggccagtaccacgtaagagcgttcgggccgaatgaggagcctcgtccgccgggacattgacgacta

SEQ ID NO: 1533 - DNA, 401 bp, Zea mays
  Clone ID: LIB143-046-Q1-E1-C2
caccccgccaggatggcagccgcgctcagcgctggcgccagctttgacgccagccatggagggatgcactcgtcacggcctcataggatcctgcgggagatcgtgtcggaccctgtgccagccatggctcaggccctgcaggattttccgagtgaaaccctggaggtgctgcgggagacagtgcggggtatggttgatgctccggagaagagggatgaactgtcgagcctgcagcggaagctggagcgtcgctcggacctgactgccgaggtgttggggcgggcaaacaagacgcagctggagatcctggtggccatcaaaaccggcatggccacttttgtcactggtaagggccgagtctccagcagcgagcttgtggagatgtttctgatgacacggtg

SEQ ID NO: 1534 - DNA, 290 bp, Zea mays
  unsure at all n locations
  Clone ID: LIB143-046-Q1-E1-C3
tacaagcctctaaagtcactcgtatgattgtgaggaaagcgacaagctgaagatagagtttttgcagtcaggtggcgtacaattgacgcacaaggtttttcttctatanacaaaaggggagaaatgacacctcccccctcgagaattggggaacaaggacagatctgacacctcaattgcgagaaataaaaataacagccgacagttgcatgatccctgaacgaataaattcagaactagaaaacagatgtcagtaaacaacatgtggtgaatgttggaacttgaactgc

SEQ ID NO: 1535 - DNA, 425 bp, Zea mays
  Clone ID: LIB143-046-Q1-E1-C4
accacgcgtccgagttggtgttgagaagcacagcacagaggtcattgtaaaaaaatctggaagcctgcgtataaattctggaattcaaggatactcgctgctaaagacaactcagtctgggtttgaagggtttgtgacggatcgctataggcttcttcctgatacaagggaaaggatagtagcaacagaagttactgcttggtggaggtatccctttgaacatgtttcgcagctcccatcgaagccattctgcttcacgcagagatatcaggatgtaaagaaagtccttgcagagacgttctttggtcctccggatgttggtgtgtatagtccatccgtacaaaatacgctatacctcatggccaaggaagtccttacaaagtccccagatatatcgtcagtccagcttagaatgccgaaccttc

SEQ ID NO: 1536 - DNA, 400 bp, Zea mays
  Clone ID: LIB143-046-Q1-E1-C5
acaagcctctagagtgagtcgtactagctgccggacatgctgctgaggccgagaagactgagtcggcggaagccaagactgagtcggctcagagcagctgaagatgcttccgacatgatctaaactagttgtatcgtcaagttaattctgctgaatcggtggacaaacttctacgttgtggcactggccgatcccagtgacttgccctaaaatttacgttctgtctttacatgggcatcctagtgttatgctcatcacattattgatattgtttctgtgatgcttcctttggtcgacaatcatgtgctggagtttggtttactggattgcttttcttctgtggttttttggctttatacctgtatggaaagctggagccgcaaatggagaaatagggacg

SEQ ID NO: 1537 - DNA, 373 bp, Zea mays
  Clone ID: LIB143-046-Q1-E1-C6
tacactaaatctgtcaatactcgcccgagacgccctagccgaaccagtcagcccgagccttccgctgatgagcaaaagaataagacaagacgcctccggcgagtatccagttttgatgaggacgccggtaccttaactcctgctgctgaagaagtgcctgcaactggtcttactgacactgatcccgatgggtgtgcccaaactgttgctgatcccaatgggtgtgcttcttgcgttgccgctgtggaggatgaagacgaagaatatgaagctcccttaactcggaaaaacagtcggtagttcatcgccagcggtggaagtagtggagttccgtcacctgctttgtctgcccttattggtctgcaagaactgt

SEQ ID NO: 1538 - DNA, 255 bp, Zea mays
  Clone ID: LIB143-046-Q1-E1-C9
atccctgaggagccctgatcgactgtgaaataccaaaagagtggaaccaaatacgagacagtaggagagctctgtgtcctccgtgctccattgcattgcctgcgtgcctgcgtccagttcgatgttgaagttttgatcttgttctttggtatgttatatggagatgcgggagtccttgattgttacttgctcacgaacttctttcactgtgctacaaataatgtataatatgtaatctcattgactggccgtttg

SEQ ID NO: 1539 - DNA, 426 bp, Zea mays
  Clone ID: LIB143-046-Q1-E1-D10
gcgggtcgatacacgcctctacaccggtgtcgcatcatagtgatcatgaagctggaatgtcagtgctcatactggtcatccggttgggaatgctctgtcagatccttatcttttcttcccaccggctctaaatgggctagctggggcactgcatggccttgcaaatcatgaagtgcttttatggatcatatctgtaattgaggaaactgggagtggtgttaccacagatcaactcacagactatgtctggaagacactaaagagtggaaaggttgttcctgcgtttggtcatggagttctgcgtaagaccgacccacggtattcatgtcaaacggagtttgccctgaagcatttgcccaaggatccacttttccaattggtgtccaagttgtatgaagttgtacctcctatcctcaactgacctgg

SEQ ID NO: 1540 - DNA, 346 bp, Zea mays
  Clone ID: LIB143-046-Q1-E1-D11
gtgagtcgtattaaatgagtacgaacgctggaatgtcggtgctcatactggtcacctggttgggaatgctctgtcaaatccgtatctttctttcgcaacggctctaaatgggctaaccgggccactgcgttgccttgcaaagcaggaagtgcttgcatggatcatatctgtaattgaggaaactgtgagtggtgtcaccacacatgaactcaaagacgaggtcaggacgacactaaacagtggcaaggttgttcctgcgtttggtcatggagttctgcgtcagaccgacacaccgtattcatgtcaatcggagtttgcctcgaaacatttgcccatgggatcactt

SEQ ID NO: 1541 - DNA, 420 bp, Zea mays
  Clone ID: LIB143-046-Q1-E1-D2
tcgtgggacgacgcaagggtccaaattcagtcgtagcatagcagaagcatacttcccgaagcactcttgcaatccactgagttctgtttgttgagacgcatagagctagctgctagcgtcgacaatgtcgctcgtgaggcgcagcaacgtgttcgaccccttctcgatggacctctgggatcccttcgacaccatgttccgctccatcgtcccgtcggcgacctccaccaactccgagactgccgccttcgccagcgcccgcatcgactggaaggagacgcccgaggcgcacgtcttcaaggccgacctcgccggggtcaagaaggaggacgtcaaggtcgatgtccaagacggcaacgtgctggtcatcaacggccagcgcagcagggagaaggaggacaaggacgacaagtggcaccg

SEQ ID NO: 1542 - DNA, 145 bp, Zea mays
  Clone ID: LIB143-046-Q1-E1-D3
acaagcgtctaaagaggcacatcaaataggcttagtaaaatagtaaccctagtgttactgtaaccgcctccgcgagttcaggagtctataaatatatcagtatgtaatactgtttgtttttctcgctatgcacgttctagcatcc

SEQ ID NO: 1543 - DNA, 446 bp, Zea mays
  Clone ID: LIB143-046-Q1-E1-D4
tcgcgggacgacgcacgcgtccggcgagattcaggcagtgcgcacgccgtgcagccgtgcaggcctctcctccactcaaccgcgcgtcatggccatgttgcgcgagcatctcgacctcatccgcgctcacctcctcgacgacaaccacgacgccgtcagctccgatgactcggcgccatcgccatccccatcgccgccggggcgtacgccgctgccagcgctttccgtctcgctgcccccgaggccggcagtcgtcctgcagcagcagcacctgagggcggcggcgccgccgttgcagattcctcagcaggagcagcactgctgcccggaacccgaggaggacgatttccggcggtaccgccgcgtgcggcagcggccgtggggcaagtacgcggccgaagatccgggaccggcgcggaagggcgcgcgcgtgtggctgggcacct

SEQ ID NO: 1544 - DNA, 377 bp, Zea mays
  Clone ID: LIB143-046-Q1-E1-D5
ctcgtgggtcgatacacgcctccaatcagagtacgatattcacacagcgaaccgagaaaccaacacagcaacaagcaaagcagcgatccgacatccgagagatggacgcggtgatgttcgggctggagactcccctgatggcggcgctgcagcacctgctggacgtgcccgacggcgacgccggcgcgggcggcgacaacaagacgggcagcggcggcagcgccacgcgcacctacgtccgcgacgcgcgcgccatggcggccaccccggccgacgtgaaggagctgcccggcgcgtacgcgttcgtggtggacatgccggggctgggcacgggcgacatccgggtgcaggtggaggacgaacgggtgctggtggtc

SEQ ID NO: 1545 - DNA, 274 bp, Zea mays
  Clone ID: LIB143-046-Q1-E1-D8
aaaagaaacaaaccataaaaacaatacaagaaaaacaacaaagggcggccgtcctaaaggactgatgcctcgatcatcgtgcacctgatgtccgatgcacttcaagtctgacaaccaacgatccagtcaccggccgtcaatctacggcatctccattgggaacgccgtggcggtaaacagcgtggcctgcacggaccatatcgcccttccccaaaccggcgttttaccgacaaggccagcaccgatcggccttcgcaccaatttcccaccctca

SEQ ID NO: 1546 - DNA, 395 bp, Zea mays
  Clone ID: LIB143-046-Q1-E1-D9
agtccaaaagcttgtagggaaaatggtaaaatggttaaaggtcggaggccatattttctttagagaatcatgttttcaccaatctggagattccaaaaggaaggtgaacccaacacactatcgagaaccaaggttttataccaaggtatttaaagagggccattcatttgatcaagatggaggttcgtttgaactttctctagtgacctgtaaatgcattggggcttatgtcaaaaacaagaagaatcaaaaccagatatgctggttatgggaaaaggtaaaatcaacagaagacagagattttcaaagattcctggacaacgtgcaatacaaaacaagtgggatattacgttacgagcgtgtctttggtgaaggttttgtgagcactggtggaa

SEQ ID NO: 1547 - DNA, 397 bp, Zea mays
  Clone ID: LIB143-046-Q1-E1-E1
gagaatatcttataaatgtacaatgagatatgcaacaccattcaccacagcatcagttgacgttattgcacaacagttgcacatggctggttattcacgatggggatctgagaacgtgctaaatgggcgaacaggtgacagagtgcaagccttggttttcatgggccctaccttttaccatatgctgattcatatgtccgaatataatgtgaaattccgtatcactgggccggtgcatcccctcacgaggcagcctgttgccgacaggaaaaggtttggtggacttaactttggagaaatggagcgtgactgcctcgtcacccatgggtcatctgccaacctgcatgaacgcctcttcatgcttactgacatctcccagatgcacatctgccagaca

SEQ ID NO: 1548 - DNA, 387 bp, Zea mays
  Clone ID: LIB143-046-Q1-E1-A11
cactcaccggacaatgcatccgtactaaaatgcgacggaacacggctgccaatcgcggataaatggacatgccttcctggtcaagattaaaaaacggcggattcaaaaccaaggccaataacccttcaatgggcaacaacggaacttgcaatctcaaactgaaaaatacaagggttgtatccataaattcgttcgagcgtgtgcccatcaactacgagagagcgctgcagaaggccgtggcgcaccagcctgttagtgccagcattgaagcatctcggcgcgcgttccagctctacagttctggcatcttcgacgggagatgcgggacgtacctggaccacggtgtgacggttgtggggtacggcagcgagggcggcaaggactact

SEQ ID NO: 1549 - DNA, 149 bp, Zea mays
  Clone ID: LIB143-046-Q1-E1-A3
tggattagccaagattgttatcatagttttacctttacatgactaaccttacacatggttttgtatgactttctttttcagatgtgaactgtttgatgtcatgttggagatggatcgcatactgcgcccaagaagaactgccgttatac

SEQ ID NO: 1550 - DNA, 395 bp, Zea mays
  Clone ID: LIB143-046-Q1-E1-A4
cgtgggaccacacacgcgtccacagagaatcctaataaccggggtcaagaccaaggagctcctcatctgggtcaccctctccgacatgttcgtcgacagggacgacccctccaagatcaccttcaagacgctcaccgggctcggcaggacctactccgtctccgccttcgctaaggaacgcgccggtgacgacggcgcggcggccaagcacaaggatgatgcccccgccccgactgccgccggtaaggctgctgccagcaagtgaggtgcccggcgtccggagctttttaccttgccgtagtcgccatacttgcctccccaataatggcgtttgtaccccctctacctgcttcaaattagtgtgttttacgaatggaaacgaccatccaactttc

SEQ ID NO: 1551 - DNA, 428 bp, Zea mays
  Clone ID: LIB143-046-Q1-E1-A6
ctcgcgggtcgatacaagcctctaggctaagtcgcgataggcgtgaccaaggaggacgtcgaggcggccatcacctccgctctcagcccttccaatctcgtggtgacggacacgtccggagggtgtggcgcgagctacgagatcgaggtggtgtcggagaagttcgaggggaagcggctgctggagaggcaccggatggtgaacaccgcgctggcgtctcacatggcggagatccacgccgtctccatcaagaaggcgctcaccccggctcaggcccagccccagccccagccccagcctgagccggctgccgataagccccaggcttaagtgcttaacacccccaaaacggtttggtcccatatgccgatgcacgattacattggctatctgctagaataatgcggcgggatgcaatgctaaattgc

SEQ ID NO: 1552 - DNA, 413 bp, Zea mays
  Clone ID: LIB143-046-Q1-E1-B2
ctcgtgggacgatacaagcgtctacactgacgtcctaataggattcaactccagaaactacagaggaagagacagaagaagacgaagacgaagagaaagagaaaaagcccaagaccaagacaataaaggagactacttctgagtgggaacttctgaatgatgtgaaggctgtatggcttcgcagcccaaaggaggttactgatgaagaatactcgaagttttaccactcactagccaaggacttcggtgatgacaagcctatgggttggagccacttcactgccgaaggagatgttgagttcaaagctttgctctttattcccccgaaggctccacatgatctctatgagagttactacaacagtaacaagtcaaacctcaagttgtatgttaggagagttttcatctctgac

SEQ ID NO: 1553 - DNA, 401 bp, Zea mays
  Clone ID: LIB143-046-Q1-E1-B3
tcgttggacgatacacgcgtctacagtgatgtcctacagccattctctcttctccctgtcttcttctcgctcgcgcagcagccctctcacacggcagcagcacgccagcgcatgggcagcggctccatggccgagcgcccttcccagtgctccagccggcctcctctgcctgtgctcctcatcccacacagcagcgcgcagggagctttccccttctccgcggcgtccggcagcagggaacctttctcccctacgtgcaggagcttccaggccgcccagcgctccttcttcttcatggcatgagctcctctcatggccgccgacgccctactctcctccatggctggcatcagcacggagctcgacgcccctgtacagcccccacaccttcttcctcccac

SEQ ID NO: 1554 - DNA, 422 bp, Zea mays
  Clone ID: LIB143-046-Q1-E1-B4
cgcgggatcgacgcacgcgtccgcacacgcgtccgcccacgcgtccgcttgtgaccctccctcagccgcgtcgcgtcgcatcctacgatccaaagctctctctgctcgcagccatggcgaagaactacccgaccgtgagcgccgagtacagcgaggctgtggagaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaaggaggagttcccaatcctctcttacgccgatttctacaagctcgcggggattgtg

SEQ ID NO: 1555 - DNA, 354 bp, Zea mays
  Clone ID: LIB143-046-Q1-E1-B5
cactgacgtcgtgactaacgcgtgggcggacgcgtgggggacggtgtggacacggatggggaccatggcagcaccctcattgcggtactcgactgtcacccctgagcagtaccttgacgagaagaccatcttccaccttaacccatctggccgctttgtcattggtggacctcacggcgatgctggcctcactggccgcaagatcatcattgacacctacggtggctggggagcccatggtggtggcgctttctccggcaaggacccaaccaaggttgaccgcagcggagcctatgtcgcaaggcatgctgccaagagcatcgtcgccagcggccttgctcgccgcgccatcgt

SEQ ID NO: 1556 - DNA, 391 bp, Zea mays
  Clone ID: LIB143-046-Q1-E1-B8
ctcgcgggtcgacacacgcctccaaagtgactcgtgctaacgcgtgggcggacgcgtgggtcaccaagtgcgtgcgccggcggcaccgcctcccgcaccttctgcgcgctcgaccccgttcaggtcaccatgatggccaagcacctggacaccatcgacgtctccgggtggcagtgctcgtctacgcacacctccatgaacgatcccggcccggacctcgccgactacccctacgacaccgtgcccaacaaggtggagcacctcttcttcgcgcagatctaccatgaccgcaagcagcgggaggcgcgcatgtcgctgcaccgcgccgagcgcgcgcaggcgccgtacgtcgacttcctcaagcccatcagcgccgacggcgacacaggct

SEQ ID NO: 1557 - DNA, 183 bp, Zea mays
  Clone ID: LIB143-046-Q1-E1-B9
gaagcgtatcaccgagcttctgaaggttggcaaggacaagcgcgctctgaagcttgccaagagaaagcttggaactcacaagagggcaaagaagaagagagaggagatgatgggcgtcctcaggaagatgagatcggctggtacgcacactgacaagaagaaataaagcatttcaagttcatg

SEQ ID NO: 1558 - DNA, 344 bp, Zea mays
  unsure at all n locations
  Clone ID: LIB143-046-Q1-E1-C10
cgtttcaaccttttccatcgctcctaatcctaacaaccaaaaaatctgagccgtaattattggccccaaaggcggaaaaaagcccggcgcaaaaaagtgcggangagaaccctcggaaaagcggctccgcggagaaagcccccgcggggaagaagccaaagcggagaagcggctacctgcgggcaagtccgccggcaaggaggcggcaacaaaaggtagaagaagcgaagaagagcgtggagacctacaagatctacatcttcaaggtcctgaagcangtgcaccccgacatcggcatctcctccaaggccatgtccatcatgaactccttcatcaacgacatc

SEQ ID NO: 1559 - DNA, 387 bp, Zea mays
  Clone ID: LIB143-045-Q1-E1-F9
aaagtcattcagattaacgtggtcacagctatcaatcaacgcggataacacgaccgaccaataccaatagtgcaattggaactggagcttaactgtagatataccgtacgtcatcggcctcgatccggatcgatctcagccggctacctaacaaaacgtgtacgtagtactctgtaatcacatgaagtgtgcagctaatatctaaccggcacgttcagtcaacagataagtcatcactctgctgtggaaacacatgtagctaggcaatcctgtgctacgaagaagcaggatacctatttgtgtcgatgatacatgtactgattagactgcagactgagtcaaaactacagtgtgcataagaatcatagttacctgtgtgaaagggaa

SEQ ID NO: 1560 - DNA, 323 bp, Zea mays
  Clone ID: LIB143-045-Q1-E1-G1
gttcccgacgctggacccgcgcaccggcgaggtcatcgcgcgcgtcgccgagggcgacagcgaggacatcgaccgcgccgtggccgccgcccgcagggccttcgacgagggcccgtggccgaggatgaccgcctacgagcgctgccgcgtgctgctgcgcttcgcggacctgatcgagcggcacgcggaggaggtcgcggcgctggagacgtgggacaacggcaagacgctggcgcaggcggcgggggccgaggtgcccatggtggcgcggtgcgtccggtactacgccggctgggcggacaagatccacggcctggtggcgc

SEQ ID NO: 1561 - DNA, 407 bp, Zea mays
  Clone ID: LIB143-045-Q1-E1-G10
atttcttttgtaggttttcatgttgatgattcagaagttacattaaatgtttgccttggaaaacaattctttggtggtgaattatactttcgaggtattcggtgtgagaatcatgtgaattcagagacacaacatgaggaaatgtatgactacacacatattcctggttgggctgtactccaccatggtcgacacaggcatggtgctcgagctacttcatctggtctcagaataaatctgcttttgtggtgccggagctctgtgttcagagagatgaagaaataccagaaggattttccgagctggtgtggtgaatgccagcgcgaaaagagggaaaggcagagtcagtgtgttaaagcaacgaagatggcctttctcaggggttctggaagttcaaccaattaaat

SEQ ID NO: 1562 - DNA, 355 bp, Zea mays
  Clone ID: LIB143-045-Q1-E1-G11
cgggtcgatgcaagcctctacagtgactcctattgaggaacgaacggacaggttgttgcacagaagcgacatggctttcgcgcccaaaacgtcctcctcctcctcgctctcctcggcgttgcaggcagctcagtcgccgccgctgctcctgaggcggatgtcgtcgaccgcaacaccgagacggaggtacgacgcggccgtcgtcgtcactaccaccaccactgctagagctgctgcggctgctgtcacggttcccgccgccccgccgcaggcgccggcgccggcgccggtgccgccaaagcaagcggcggcacccgccgagaggaggagccgtccggtgtcggacaccatggcg

SEQ ID NO: 1563 - DNA, 241 bp, Zea mays
  Clone ID: LIB143-045-Q1-E1-G12
ggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaagccgcggctcctgctggtgccgaggagcccgtcgcggccgaaccggccgccgaggccgaagctgctgctcctgctggtccccaa

SEQ ID NO: 1564 - DNA, 334 bp, Zea mays
  Clone ID: LIB143-045-Q1-E1-G5
aacacagcatcagctcaaaaacctaacacacctcaacaagcagagcaaagacccgggattcgccggcgcggtagcgagagcgagagatggacgggaggatgttcggtctcgagacccccctgatggtggcgctgcagcaccttctggacgtgcccgacggcgacgccggcgcgggcggcgacaaggcgagtggtgccgcggcgggcggcgggcccacgcgcacctacgtccgcgacgcgcgcgccatggcggccaccccggccgacgtcaaggagctcccgggcgcgtacgcgttcgtggtggacatgccggggctgggcacgggcgacatcaa

SEQ ID NO: 1565 - DNA, 348 bp, Zea mays
  Clone ID: LIB143-045-Q1-E1-G7
aactcaagctctccgaactggggtatgctgatgcttaaatggtccatatcctggagcgggacacaaactgctgcctgtatggactcgtgcgattcagggtgaaccatcagattgtctagtgtcttctttgtaataaatttatctgttcttggtactttgtctatggttgaatcggaacccattttccgtttgcctagattcttaatttctggtgctgtatccagctgaaactagtagatctatgatcttgtggctgcagcatgttcttgtcacttttatctggtctccgttggttcggttcacaggttgtgtgctttaaaaggctgtgcttaagtcctgcaattcgag

SEQ ID NO: 1566 - DNA, 428 bp, Zea mays
  Clone ID: LIB143-045-Q1-E1-F7
acgcccgggccgatgcacgactcaatcgagactcataggatcatccttgcttaattaccaaggtacctttgcaggtaggtaggtagctagccgccatagcaagctaggccgaagcagaggagtgatggccaaggtccaccccaacgccgcggagtccgtccaggcagaggccgagggagagctgcccacggtgctgacggtgtggcgcaagtcgctgctcttcaactgcgacggcttcaccgtctacgacgcccgcggcgacctggccttccgcgtggactgctacgccggctcgttccgccgccggcgccgcgccgacgtcgtgctcatggacgccacggggaagccgctgctcaccgtgcgccgcaagaaccccggttcggcttaaacggaccgctgggtcatctacgacggcgacgccgacgacg

SEQ ID NO: 1567 - DNA, 405 bp, Zea mays
  Clone ID: LIB143-045-Q1-E1-D5
aagtcagtgcaattctcatccgaacccgatcatctccggccgccgctccctccggaccctccgtcgacatgggcaccgtcactgccgcagatccgcacccgtccttcctcgccgacaaggacgccaaggtcttcgtcgccggccaccggggcctcgtcggctccgccatcgtgcgccgcctcctctcgctaggcttcacctccgtcgtcgtccgcacccacgccgagctcgacctgactcgccaggcggacgtcgaggccttcttcgccgcagaacgcccgcgctacgtggtcctcgccgccgccaaggtcggcggaatccacgccaactccaccttccccgccgacttcatcggcggcaaacttcaaattcaagaccaacttcgtcgacgccgcgctgcgctgc

SEQ ID NO: 1568 - DNA, 231 bp, Zea mays
  Clone ID: LIB143-045-Q1-E1-D8
cctactgctactctgggtcactctacaacaccaaatgagcgacccatccatgcatcccatcctgcattagggggatgcatcatccttataccctattctatcataattattaactcatcattctatcatacatttttatatatttggcttattacttttacttttattttcctcgcttcttcagtttatacattgattttgattggtgttatcgtgatattctttttttta

SEQ ID NO: 1569 - DNA, 424 bp, Zea mays
  Clone ID: LIB143-045-Q1-E1-E1
cgggccggcccacgcgtccagccctacctcggcacggccaacctgtgggactacctgccgttcctgcggtggttcgacgtgttcggcgtgaggaaaaagctcatggccgccgtgaggtggagggacgcgttcctgcggcggctcatcgacgcagagcgccggaggatggacggcgacggcgacggcgagaagaagagcatgatcgccgtgctgctctctttgcagaagtcggagccggagctgtacacggaaaccatgatcatggcgctgtgcggggacttgtttggagctgggacggagaccacatcggtcacgacagaatgggccatgtcgcttctcctgaaccacccggaggctctgaagaaggcacaaggcgaaatataacccggtggtgggcaactcccgccgcctgatcaccgccgac

SEQ ID NO: 1570 - DNA, 358 bp, Zea mays
  Clone ID: LIB143-045-Q1-E1-E10
gggtcgagacaagcgtctaatctaactcatatcagattgagagagcagaccaacctagccacgcagcgagaatcgtcaaataggatgggaaagtgtcgtcatggcatcgattgacgcttcaagtagggcagttccgctagttcgtgctctggataaactcatggaagcgtcgtctgcgccagggaatggcaccgccctcaggcatgtggcagtcgcctgaggactccgtggctagaatacctgcgctccactccgacgctacgagggagcagcatcggaagaccagaatctcggatagtaccagtagctgcaccgccagctcggactacggcgtaccgatcctgttctcagatatttt

SEQ ID NO: 1571 - DNA, 419 bp, Zea mays
  unsure at all n locations
  Clone ID: LIB143-045-Q1-E1-E3
gggccgacccacgcgtctagaataactactcgaacgtgagcgccgagtacagcgaggctgtggagaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaaggaggagttcccaatcctctcttacgccgatttctaccagctcgcgggagttgtggccgtggaggtcaccggtgggcctgagattcccttccaacccggtatggaagagangcttaaacccccacctgagggccgccttcctgacgccact

SEQ ID NO: 1572 - DNA, 329 bp, Zea mays
  Clone ID: LIB143-045-Q1-E1-E5
aggatctagattaggaaaatgctagattcaggctagaagattcaggtaataaactaacttgtgaaataaaacttggcttaaggacccacttctagtaagcttttctgcaaaatgagtccttgaactttgatgagctttaccttgattcccaaaagccagcatacccttgagagtcttttctttagtcgggtaagtcttgctgagtaattgcgtactcagggttttatcccttgttgtttttgtaggagaagttttattcacttatctttgggttagttacttcatgtggaggacttgaagcttagaatgtttttatatatctcttatgg

SEQ ID NO: 1573 - DNA, 356 bp, Zea mays
  Clone ID: LIB143-045-Q1-E1-E8
cgcccgggtcgatacacgactcagcaacgtatcatacaagtatccatccttattgagtacagtgttgatccatggactcggaaggagttgtagcagcaaaggtggcagatgagactactaaaccggcaatccaagaagacggcgccgagagcaaggccgggatgactgatctgctgatgctgaccgacaagtcgcagctgcaggcgctggcgatgctgctgcggaacaacgaggagctcatgatgagccaggcgatcaagtcggagacggagcgcattgagtacctcaagacggtgagcgactgctacacgcggacgatgaagctcctcgacgattccatggcggccaggaccacc

SEQ ID NO: 1574 - DNA, 401 bp, Zea mays
  Clone ID: LIB143-045-Q1-E1-F10
ctctagatgcagtctcacaaccgtgctgttcgcaatgctggactgattgtcacatggattactgatcctatgcatggaaacaccatcaaggccccttgtggcctgaagactcgtccatttgactccattctggctgaagtgcgtgccttcttcgatgtgcatgaccaagaaggaagccaccctgggggcgtccaccttgaaatgactgggcagaacgtgaccgagtgcatcggtggatcacggaccgtgaccttcgacgatctgagcgaccgctaccacacccactgcgacccaaggctgaatgcctcccagtccctggagctcgcctttatcatcgcagagaggctgaggaagaggacgatgcgatcggggctcaacagcagcctgccactgccgccact

SEQ ID NO: 1575 - DNA, 420 bp, Zea mays
  Clone ID: LIB143-045-Q1-E1-F11
gggtcgagacacgcgtctacgcatccacatacaagaaaaagaaaagaaaacccctgttgccagcgacagaagaagaaggggccccttctccttggttgcgttgcgcctccctcctgtctgcgtgcgtgcaatcgacgcagaggcgcgggcgctcgcaccaccacaaccacgacccgatggctttcatgcgctcccgctcaaatgcatcttctggcatgggagttgctcctaacattagggagacattcgttgagcttcaaatgaagaaggcattccgatatgttatcttcaaaatcgaagagaagcaaaagcaggtggttgtggagaagacaggggctactactgaaagctatgatgattttttggcctctctcccagagaatgactgccgatatgcgctgtatgattttgattttggta

SEQ ID NO: 1576 - DNA, 322 bp, Zea mays
  Clone ID: LIB143-045-Q1-E1-F12
cgtattatacgagctcagcatcatggacggcttccccaagagcgtcggcggtggcggccctaacattccggcgggatcccaccccgcaggcgggagccatgcgggggcaggaggaggcgcgacgcagcggacgcagtatccgtatgtgactggtaattcagtcagtgccttgaaatacaaggatggtgtgatcatggcatgtgacactggagcctcttatggatcaactttgagatacaagagtgtggaacgcattaaggcagttggcaggcatagcatcagtggcgcaagcggagagttcagtgacgtccaggagattttg

SEQ ID NO: 1577 - DNA, 248 bp, Zea mays
  Clone ID: LIB143-045-Q1-E1-F2
gacccacgcgtctagcaaagggctgatgctgcaaagaaacgcgatgaggagaaagctgccaaggagcagaggaagtcggaagcacggaagtaactgcaatatcatggacgatgagaccacgaaggcatgatctgcgttagttggatatttatttctaatgcatcagttatcttgttataaacctggtccctattctgtatccccataaaatatgcattgacaaaattagtaacagtcttgtgggcgtg

SEQ ID NO: 1578 - DNA, 352 bp, Zea mays
  Clone ID: LIB143-045-Q1-E1-F4
gggccgacccacgcgtctgtggaaaggccgccgatgtttggtcatgtggagttactctgtatgtgatgcttgttggtgcctatccctttgaggaccccgacgaaccgaagaatttccgcaagacgcttactcggattatcagcgtccagtacgcggttcctgattttgtccgagtttcaatggagtgcaggcatctgctgtctcggatctttgtggcgaaacctgagcaacggataaccatcccagagatcaagaaccacccatggttcctgaagaacctgcccatcgagatgaccgacgagtaccagatgaacctacagctagtcgacatgaatgtcccctcgcaaagcct

SEQ ID NO: 1579 - DNA, 342 bp, Zea mays
  Clone ID: LIB143-045-Q1-E1-D3
agtcgaaactatgtacccaaagatggctggggaaacatggaagagtgtgcggcagtgcgtgggcgctcaatcacagcgaatgcttggggctgcaggaagttaacgtgacactccatcttcagacacacgtcgtgcagaatcacatattcggagcatgcttgaggatttcacacagactggcgaacactgcatgtcgcttcgacatcactgatggaatgaccatcgaaggttactgaagaatacctcgcatcacgaattacaaattgccgacatgatgtggactgtcgcaagtatggagactcacaatcactccttaggtgtgcattcatagtgttcaatgat

SEQ ID NO: 1580 - DNA, 336 bp, Zea mays
  Clone ID: LIB143-045-Q1-E1-B6
tacacgactctggagcgtgtcaaactagagcatcttcagtatctggaactttataagaataacattcaaggaacaatcccttctgagcttggcaacttgaagaatctaataagcttcgacttgtacaagaacaacatttcggggacaatacctcctgcccttggaaagttgaagtcccttgtattcttgcgtctcaatggcaatcatttgactgggcccatcccaagggaactcgctggaatatctagtctcaaagttgttgatgtttcaagtaatgatttgtgcgggacaattcccacgtctggaccatttgagcatattcctctgagcaacttt

SEQ ID NO: 1581 - DNA, 305 bp, Zea mays
  Clone ID: LIB143-045-Q1-E1-C1
agcctctaccgagtctcctacaacatgctcaagaacgcggccgacaagtcggaggacaagaagaggaagaagaggtcgtgagcgtcgagaacggaagctctcccacatgcataggagtaactgccagggttccttcctggggtggaagtgtggaactgagcttgaatgttaagaagtgttcctttgttctcttcctctcttgatgactctgtaaatagctatgtcaatctggttaagtttggtttggttgcaaaaaaaaaaaaaaaaaagaaaaaaacaaaaaaaagaaagaaaaaagagaaagg

SEQ ID NO: 1582 - DNA, 386 bp, Zea mays
  Clone ID: LIB143-045-Q1-E1-C10
cccattttcgccgccccctccgatctcgccgttctcgtctccttccgttggattagggctcttcatctgttcgccgcacttcgtcagtcgcccatggcggatgaggaggtcactgatccaaaggcgctcctagaggatcgttcaaaggctaagtgtgtgtcgcagtggtatgattatcagaaatgtgttaaaaggattgaggacgatgagactgggcacaagcactgtaccggtcagtactttgattactggaaatgtgttgacaagaatgttgcagagaaactctttgagatgttaaaatgacaaattttccctccatttatccacctaaagttggtaataattgtaccacttgtgaggcctatagactattaaggcacttaata

SEQ ID NO: 1583 - DNA, 419 bp, Zea mays
  Clone ID: LIB143-045-Q1-E1-C12
caacactctagagtaagtcgtattagatgataataaggtgctgattaaggcaataaaggttgctgaggctattgtgaggaaaaaccgcaacttagttgtattgtacaaatcggttataaatgatggatttaagctggatttggagcatgctcaagcacttgagaaggaaagaggtcacaactattacaatggaatgacaaaggaacagttcacgaatatgcagaaattcatccagggccggagttctaagaaaacaccatcaaagctgtaggttgctggtgacattttctgtggtccgtgtacgatgtacagctactgaaagcgtgttcagtagtctgaaaaataaagatgtcggtgtggcaatatatacagttaccgtcttctcatacttttacgtaagtttatgtttaattaacgtt

SEQ ID NO: 1584 - DNA, 409 bp, Zea mays
  Clone ID: LIB143-045-Q1-E1-C2
acccatctcttcgactcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggcatccctcttcctaacgtcaactccaagatcctatccaaggtaatcgagtactgcaacaagcacgtacatgccgccgcagccgcagccgccgcctcgaaggccggtttcgaagaacttggtggccgcttcggccaaagacacgccgcctccggtgaggacctcaagaactgggatgcgga

SEQ ID NO: 1585 - DNA, 323 bp, Zea mays
  Clone ID: LIB143-045-Q1-E1-C3
aggaccgggtggcgaaggctttgtgagggtcagcgcgttcgggcacagagagaacatcattgaagccgcaaggaggttaaagcagctgtataagtgagcaccgatgcagcttctgtgccctcctagacagatgtatcaataagaacacatcagggcaccaaaaaggcaaaaaaacgcttggtgaagctgccagaaaatgttagtttttttttaaaattctcgtgtggtgtccacattcaaaccatttcgaactctagacagtgcttgttgtaatcctgagacccttcattcactggtgaagttgtgattgtcttgtctgtgtt

SEQ ID NO: 1586 - DNA, 424 bp, Zea mays
  Clone ID: LIB143-045-Q1-E1-C4
cacaagcctctacaatgagtcgtatgtacgcgtgggcggacgcgtgggccgcctcagcccgccgccaggagagccggctcggtcggttcgtcaaagatcccggatctgctctgtcacgaggtctttcggcgggtgttgtctcgcgaggtgtagcgagccaagttcaggagagtttcgagaagctgaaatggctcctaaagctgctcctgccaagaatggtgatgccaagacccaggccttgaaagttgccaaggatgtgaagtccgggtcagtagaagaagaccaacaagatccgcacgtacgtgacatttcaccgccccaagaccctgaagaatgctaaggaccccaagtaaccaagaatcagcaataaccggagggaaaaagcttgatcagtaccaaattctcaagtatcccctcaccacag

SEQ ID NO: 1587 - DNA, 340 bp, Zea mays
  Clone ID: LIB143-045-Q1-E1-C6
cgggccgacccacaagtccaaccgtggcggcggctacggcaactccgacgggaactggaggaactgagcggtggggcccgcgcggccaagttatcctgttcgctaccgtgatgtttaccctagtccagagggtttatcttcgttcgtctcgtttgttgttgcccatctgtgtttttgattgcaaggtcgctctgtgtcagttgttagtgctgtgttcatcctcggctccagcagacccatgcatcaaccagcatggactgtggatcgatggatgctgttactcctgtcaggatttgttctaagttaatcctaaggaaaaaatggtgcttcttggtgctgc

SEQ ID NO: 1588 - DNA, 364 bp, Zea mays
  Clone ID: LIB143-045-Q1-E1-C7
ccgggctgacccacgaatcagggcatcgccctcaccagtttgctccttatagcgtaactcctacaggacacgaatcctgcaggggcaggagaatcatagttttaacttttaagctacccctcgaaactgcaacggaagcacaggagtttggaattggggaacaaaagaagacatccagttagcactagcaggcaaggctgaaggtttgctgccagcaagaaatttgcatggaacactaagaggtactacaagccttggttacacaaatcctggcaaagttgcaggtccaagtgcagcaggattcagcatgccgggaaatccaatctgctcagttccagccggcacgccacacttgcaactttcc

SEQ ID NO: 1589 - DNA, 381 bp, Zea mays
  Clone ID: LIB143-045-Q1-E1-C9
aaccacacgtccgcctgagtcttggtcagtaaaaccatcaagccctgcatttatccatgccacgcctggagttcagatggtcgcaggaggagatgatcttgggcaacaatacaacactcccgaatctgtgataaactacaggggcagtgacataatcatagttggccgtgggattataaaggcgagcgatcctatgaagaaggcgtgggagtaccgcttgcaagggtggcaggcatacaagaacagcttgctatgaaggaaggggggcgccatgagcatccccaagtataagggcgaatccagtcagtttggcgaaataagcgcatgcggaaaggttttcctgcagttgagtcaggacctaattgacatcagattcactgc

SEQ ID NO: 1590 - DNA, 403 bp, Zea mays
  Clone ID: LIB143-045-Q1-E1-D1
acgaatggtttgaaagtgatggcaattttgtccacaaaggactgcagtttggaagagtatatgggtgtgcccgcagcatcatcgttgctgaaagggttgtgctgcccgtccagcatgcatattggaaacaaggaaaactgctccaggtttacgtctgattgacaagtgggcagtactgattggtggcggaaagaaccacaggcttggtttatttgatatggttatgataaaagataatcatatttctgttgccggtgggattgcaaatgcaatgagatctgttgatcaattcctgcagaaggaaaaactcacaattcctgtcgaggtcgagacaaggacaatcgaagaagtgaaagaattggtggaattacgctgctgagaacaaaacttcattgacccgtat

SEQ ID NO: 1591 - DNA, 381 bp, Zea mays
  Clone ID: LIB143-045-Q1-E1-D11
tatatctccagccgcgcgtctccctgctctctgtgttcttcttcctccccgtacgcggctctctccagctcgctcagatctcccatggcgcttggcgtccaagcccctggttgagctcgccctgccttttctgctcgcccaatctcccttttcttcaatccgggattgaggtccttctctggtcatgctgcgtccattctctctacgattgtctctgtgtctcggttgagtccgtgctcctctgctcggcgtcttccctgctcgccagtggagcttcctccctgttgcggctcagcctctaggttgcttcctcgccgtgcccaaggttcctccatggctacgtttccccgctgtctgcgcgcagccgcgtcctcgagttta

SEQ ID NO: 1592 - DNA, 192 bp, Zea mays
  Clone ID: LIB143-045-Q1-E1-D12
tacagtacgtcgtattaggacaagcactacaagaaaatgttgaaaaattgtcagttaattaaaaaatgtctgggcccacactcttaatcgaagtaaaagtgtgggttttgttgcaccgacactcctaatttaagagtgtcggggtcccgcagaaaccgacacttttaatttaaaagtgtgagttttttctac

SEQ ID NO: 1593 - DNA, 406 bp, Zea mays
  Clone ID: LIB143-045-Q1-E1-D2
acacgacctggggggttcagatcggatcggaagcttccataagtttccatcgggcttcgccgctcgccggtatggcgatccgcaaggggtcttcgtacgccgtcgcggcacttctcgcgctcgcctctgtcgccgccgtcgcaggggaggtcttcttccaggagaagttcgaagatggctgggaaagtcggtgggtcaagtccgagtggaagaaggatgagaacatggctggtgaatggaaccacacttcgggaaaatggaatggagatgccgaggacaaaggtattcaaacctccgaggattacaggttctatgccatttcagccgaataccctgagttcaaccaccaggggttagaaacctggtgctgcagttctctgtgaagcacgagcagaagcttgactgc

SEQ ID NO: 1594 - DNA, 342 bp, Zea mays
  Clone ID: LIB143-045-Q1-E1-B5
aacccacacgtccggccgacatagggatgatggcttcctctagtcctcagcgtgcagccggcgccgccgtcgccggcgtgctgctggtggcggctgccgcactgtgctcgtgcggtgccatggcgcatttgagcgcggactactacgactgcacatgcactgacgcctacaacatcgtgaagcaggtcctgatcgaggcgcacaagtctgacgtgcgcatctacacgagcctcacacgcctccacttccacgattgcttcgtccaatgctgctatggctcggtgctcctgtacgccgttccgggggtggccaactcgactgagaagctggctccggccaaca

SEQ ID NO: 1595 - DNA, 440 bp, Zea mays
  Clone ID: LIB143-044-Q1-E1-H5
ctcgcgggccgacacacgcctctacacctcgcgtcttatcatccttatcgatctcctcgcacctcgtggcggcacctctccccttcgatccaccaagggtttaggatcggcggcgatggcggcgaggctggcacagctgcgcgctcaggcggtgcaggcggcggagttcgcctcgaagcacggcggctcctactacaaggagctcatggagaagaacaagcagtacgtcgtgcagccccccaccatcgacaaatgccaggagctctccatgcagctcttctacacccgcctcgcaagcctaccaggtcggtatgagtcattctggaaggagcttgatggtgtcaagcaggtatggaagaacaggaaggacctcaaggttgaggaccttgggattgcgactttatttggagttgagctttacgcatggttctgcgtaggcg

SEQ ID NO: 1596 - DNA, 431 bp, Zea mays
  Clone ID: LIB143-044-Q1-E1-H8
ccgggccgacacacgagtctaaatgtacttgtagtattaggactaggccaaaattagttgtcatatcccgctacatactgttgggtactctttttttttaaaataaaattgcattgatgtctagtaacaactccttttgtcaaggatgtaggtctgtttggctggctgataacaacgttgggaactcatacaaagagaaaacgttccatttaattatatactgatataaactgtggttatgaattaatagctgatttaatttgagacaatacagatggaaatggttgcatattaatcttctcttttgtttttagtatactgttttgttccgagctggagcagtgcattctgtttcccccgctattgaagccactcctgttgattcaactgaaagctccttcgatacatatcgttcgcccccaagacctctg

SEQ ID NO: 1597 - DNA, 315 bp, Zea mays
  Clone ID: LIB143-044-Q1-E1-H9
agcgtctatcgcgactcatgataaggcgcaggccaaggccaaggccaagccgccccctccctcctctcctctccgctcctctcctttcctctccactctctggcagccaaaggcgaggccgagatcctgcgcgcggaggatgggttccaggtctatgagccggctgtccgtcgagtctgcctcgggcagcggcggcggcggctgccgggaggccgagccggtgctgtgcgcgcctcgggcgcgcaggggccaggagcaggtggtggacgtccagcccggcgggggcgagctcatcatcggcgcgccgcgcttccg

SEQ ID NO: 1598 - DNA, 304 bp, Zea mays
  unsure at all n locations
  Clone ID: LIB143-045-Q1-E1-A1
acaagactctatactgatcatattaacgaccgatggctttcatgcgctcccgctcaaatgcatcttctggcatgggagttgctcctaacattanggagacattcgtcgagcttcaaatgaagaaggcattccgatatgttatcttcaaaatcgaagagaagcaaaagcaagtggttgtggagaagacaagggctactactgaaagctatgatgactttttggcctctctcccagagaatgactgccgatatgcgctgtatgattttgattttgttactggggagaatgtgcagaaaagcaagat

SEQ ID NO: 1599 - DNA, 419 bp, Zea mays
  Clone ID: LIB143-045-Q1-E1-A11
agattaagtcgtatgagatctgtgagcagactcgtagggaatacatacgtaaggcccgggcttttgaggattggtgccacaagcatccacagcccagagcgatcgacgtcgatccagatagcggtgaggggacaggacataaggatgtagtcaccgagaagagattcgcagtggagagcttgaagagcaagcttgacgatgaaattgaatcccataataagctatcaaagcaggtcagggagaagtccctctcgatcctgaaggcacatctcccagagctgttccgtgctctgaccgacttctccgacgcctccttcgaaatgtactcgaagctgaggctgatgtcgttgatgcaggatcagggaaacaactagatggacagtatgttcagaagttaggatcagtaataaccctccccc

SEQ ID NO: 1600 - DNA, 414 bp, Zea mays
  unsure at all n locations
  Clone ID: LIB143-045-Q1-E1-A12
gggtcgatacaagactctaaagtaagtcttatcagattcgaacgggaattgacaatattgaaattgaaattaaccttgcccgaacccttgaacccggtaatgggtttgacaacataaatttctgggttaataatgttttgggattcaaatttggaaaaaaaatttgaacttgtcatgggattaaagggactcctgaagcgattgggctccatcctgatggacctgtgaagagaatgatgtattggcagtccgttgatagcttggtttcccgtggtggtatattggtcatcacatcatgcagcagaaccaaggatgagttggtgcaagaggtanagaacttcaaccaaaggaagcttggtgctgtgggctcaagctcagaaggattgccggctagtgaagctgcggtgttcagct

SEQ ID NO: 1601 - DNA, 415 bp, Zea mays
  Clone ID: LIB143-045-Q1-E1-A3
gtccaagcctctacagtaactcgtggtatccacactcccttcccttcccttgtacccactccaatggcgccctccctcctcgccgccgtctcagcctcgcccttcctcctacccggcagcagccgcaggccgctgtgcgctgcccccacccgccgggccggactgcgcgtggccgcgcttaagtacgaccctgccaatgtggcaccgcagaacgaccgggtgctcgtccgtcttcagcagatccctgagaaatctgctggtggtgtattgctaccgaaatctgctgttaagtttgagaggtatctgatgggtgagattctatcggttggtgctgatgttagtgaagttgaagctgggaaaaaagggtcccttctcaggacacaaggcttacgaggtgggccttgatacggatgag

SEQ ID NO: 1602 - DNA, 421 bp, Zea mays
  Clone ID: LIB143-045-Q1-E1-A6
cgggccgacccacgagtccacgataccccaagcaccagcgcggcggcggcgaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggtatgaattttaacaatggaataacctgatatccctagtgaagaagtggcagacattaatcga

SEQ ID NO: 1603 - DNA, 194 bp, Zea mays
  unsure at all n locations
  Clone ID: LIB143-045-Q1-E1-B1
acgcgtccgcccaagcgtccggaagagcaagacgaatactatgatgagcccgaggaatatgctcctccccctggccgcggacgtggcagagggagaaggggcggcatgccttggcgtgggcgtggaggccgcgggccaccgcgcggtggccganggagctactactaggcgcgagaaatgcgacgtgccgaatg

SEQ ID NO: 1604 - DNA, 338 bp, Zea mays
  unsure at all n locations
  Clone ID: LIB143-045-Q1-E1-B10
acctttggattgagagtggtcagaacatgaaatgtgaaagtacttcagcttctaacagcanaggtcttgatacgccaagcaaggcgaatcgcaagagatctcgacccggtgaaagtgctaagccacgacctaaagaacggcagctgatacaagaccgtattaaagagcttcgtgagcttgtaccgaatggggcaaagtgtancattgatggtttgttggagaagacggttaaacacatgcttttcttacaaagtgtgacgaagaatgcagacaagctcaaagactctaccgagtctaagatacttggtagtgaaaatggccccctttggaaagactac

SEQ ID NO: 1605 - DNA, 320 bp, Zea mays
  Clone ID: LIB143-045-Q1-E1-B2
tcagcacaagcatcagcacacgcatcggccaacgcctccgcctaggcgtcggtttatgaaagggacaaaggtgctccatgccttggcgtgggcgtggaggccgcgggccaccgcgcggtggccgagggagctactactaggcgcgagaaatgcgacgtgccgaatgcgtgtgcttattagttatctgttagcgtttgctgcagtgctcttctatggagctccgaccccggactggaattatctcgtaggcccttccaggtgctactctacttcagctgctgtccctgtgcaactcgtccgggcaagttttgtggctcgct

SEQ ID NO: 1606 - DNA, 395 bp, Zea mays
  Clone ID: LIB143-045-Q1-E1-B4
ctatcaacaaatacccacagatacaattcgatttggttttcaataaagagtttgagctgtcacacacatcgaaaactaccagtgtatttttctctggttacaaggttgagcagccaattgagggagatgaaatggatcttgattctgaggatgaagaggaggagctaaacattccagtaatcaaggaaaatggcaaagctgatgggaaggaggagcagaaaaatcaagagaaggcagtagctgctacagcttcaaaatcaagtcttggccttgaaaagaaaagcaaggatgactctgatgattctgatgaggatgagtctgatgattctgatgaggattaatccgaagaatccggataaaggcaagggattatctcctgacgaaggcgatgatga

SEQ ID NO: 1607 - DNA, 409 bp, Zea mays
  Clone ID: LIB143-044-Q1-E1-H4
cgggccaagcctctagcatgattcgccatatttgcactcaagcaagtgagcagctcccccgccctccagcaacatggagacggccaacgttgtcatcctctcgttcttcttcatctttgcaatccaccgcctcttcaaccgcctccatagcaggagcacgaagatgaagccgctgccaccgggccctctagccatcccggtcctcggccacctgtacctcctcctcgagaagaatattcaccacatgttcacgcgcctcgccgcgcgctacgggcccgtgctctacctccgcctcggctcacgtaacgccgtgatcgtgtcctctgtcgactgcgccagggagtgcttcacggagcacgacgtgaccttcgcgatacgcccgaccttccccacgctgcatctcatgacc

SEQ ID NO: 1608 - DNA, 94 bp, Zea mays
  Clone ID: LIB143-044-Q1-E1-F9
tgagtcgtattagacagcggctcgaggagatggtgacattgagaggacgagtggagggcgcgcgctcctcgggctccgcctggtctcggcgttg

SEQ ID NO: 1609 - DNA, 279 bp, Zea mays
  Clone ID: LIB143-044-Q1-E1-G1
gatcagaggcgtccgagcagggagtcgtgatcgcgtgccacagcaacgctgagttcgacgcccacatgaccaaggcccaggaagccggcaagcgggtggtcatcgacttcactgccgcctgatgcagtcgatgccgcgccatcgtccccactcttcgtcgatcacgaccaacaagttcactcaggtcgacgtcgtcaaggtcgacgtcgacgaagtggaggaattcatcgcggcctacgacgtctaggcgatgaagatctaccacttcgtcgagaaggg

SEQ ID NO: 1610 - DNA, 425 bp, Zea mays
  Clone ID: LIB143-044-Q1-E1-G10
caggcctctagattcagtagtctgactccgccgacgctccgtcctccccgccgccgcccgtgctctcccccttcgtgaacccacagctgcagtatctgtctaatctgtacaatgacctgctgatggtgtttcggtttcgagaagagaaaacggtcccacaactcgttaattcaaagcaacccatccgttgtggtgaacaggggaaaacttctgatttgggtgatgcatcggagtccgattcggatggggattgtcaatctggcaaagaacttgcaccaccagttcagaagcatacaagagccaaccggaagcatatagatagcattactttagttgatatagctcagtacttccatcttccaatccgagatgcatcaaagacactcaagattggggtcagcatattgaagaggaaatgccgacag

SEQ ID NO: 1611 - DNA, 393 bp, Zea mays
  Clone ID: LIB143-044-Q1-E1-G2
ggcggccccctatcccgccggccctgtgtgtgtcccccgctaccagccatggcgtcgccgttctccgtgccttcgctgatcatggaggatgaagggcggttcgaggcggaggtggcggaggtggagtcgtggtggggcacggagcggttccggctcaccaagcgcccctacaccgcccgcgacgtggtcctcctccggggcacgctccggcagagctacgcgtcgggggagatggccaagaagctgtggcgcacgctcaaggcgcaccaggccggcggcaccgcctcccgcaccttcggcgcgctcgaccccgtccaggtcaccatgatggccaagcacctggacaccatctacgtctccgggtggcagtgctcgtccacgcagacctccacc

SEQ ID NO: 1612 - DNA, 423 bp, Zea mays
  Clone ID: LIB143-044-Q1-E1-G4
gttgcaacacccaatagtgagtcatatcatccggcgacgctggcgctggccgtgctcctggcggcgaccgtggtggctcccccggccgcggtgcgcgcggcgatgtcgtgctccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgcctcaagaacgtcgccaacggcgccaacgggagcggcacctacatcagccgcgccgccgcgctgcccagcaagtgcggcgtcgccctgccgtacaagatcagcaccaacgttaactgcaacacgattaattaagtgaggcgtcctgtgcgcgtcccgggcgaggaatgc

SEQ ID NO: 1613 - DNA, 437 bp, Zea mays
  Clone ID: LIB143-044-Q1-E1-G5
ctcgcgggtcgatacaagcctctagagtgagtcttattagcctggggaaggagcacgtcaaggtgtgggcggagcagaacagcctggtgatcaagggcgagggcgagaaggaggatagcgaggacgaggccgccccgcctccgagatacagcggtcgcatcgagctcgcgccagaggtttacaggatggacaagatcaaggcggagatgaagaacggcgtgctcaaggtggtcgtgccgaatgtgaaggagcagcagcgcaaggacgtgttccaagtcaacgtcgagtagatgtttccaaatagaagcaagtgccggtacgggatggaggattggagcctggaggggcactgccaaactaggattcctctctctcaatctgatctggattctggaatcagatttctcttctttcatttttctcgtctatcttctatc

SEQ ID NO: 1614 - DNA, 423 bp, Zea mays
  Clone ID: LIB143-044-Q1-E1-G6
ttacaacactctagactgagtcatgttatcagctcaccgccgagcggaagcggcgccgagcaaccaacccctctcctcgtccgccgccgtctccccggaccatggccatggccgccgcctcctcccggctgctctgggcgtcccgcgccgccgcctacctcaggatctccaccttccccagggccttctccaccgtgctgaaggatctgaagtatgctgacactcatgaatgggtgaaagttgagggtgattcagcaaccgtggggattactgaccatgcccaggaccatttgggtgatgttgtttttgtggagctaccagaagttggcatcagtgtatcccagggaaagaactttggtgctgttgagagtgtgaaggcaaccagcgatatcaattcaccagtgtctggagaggtggttgaag

SEQ ID NO: 1615 - DNA, 432 bp, Zea mays
  Clone ID: LIB143-044-Q1-E1-G7
ctcgcgggtcgatacaagcctctagagcaagtcatggaagcagcagctttgatcgggtggagtttcttgctcactgatcgtcgagttcctgttcgatcgaagttccaggtgcgcacgtacgcactgaagcctttggggtccgtgacgatgtcgaggagagccgcagcgttgttgctcgcgtgcctcgtcgccgtgacagcggcggcgctggcggacggcgcgctgctcccgtggttcggcggcggccggcgcgggctcgacgaggcagcggtgtccgacgtgggcctcctggcggccgacccgttccggatcctggagcacgtcccgttcggcttcgaccgggacgacgtggccatggtctccatggcgcgcgtggactggcgcgagacccccgacgcgcacgagatcgtggtcgacgtgcccgggatgcgc

SEQ ID NO: 1616 - DNA, 386 bp, Zea mays
  Clone ID: LIB143-044-Q1-E1-H11
ctaaactgagtcgtgattatccatttccagccatggcggtgtcgatcgagctcaccaaggagtacggctacgtcgtgctggtgctggtggcctatgtcttcctcaacctttggatgggcttccaggtcggcaaggcccgcagaaactacaaggtgttctaccccaccatgtaggccatcgagtcggagaacaaggacgccaagctcttcaactgcgtgcagagggggcaccagaactctctagagtggatgctcgttttcttcgtcatactgctgctgggcggtctgcagcacgcgaccatcgccgccggtctgggcggcatctacatcgtcgcgaagttcttctacttcaacggatacgccatcggcgttccggacaaccgtctc

SEQ ID NO: 1617 - DNA, 413 bp, Zea mays
  Clone ID: LIB143-044-Q1-E1-H3
aacgcgttggacgctttaatctggactggactgatccagaccagtcacttgagaaggagaatgcggcatttgaacaggcaatggtactagctggaagtgaatttatggagagcgttcgcttccatgttaaatcatggttaccggcaaggtctattgtcctggagtgtttgttatcaaaaggaaacattgatccaagtggagaaatcatggttttggatagattctgcccgtggaaacttcatttatttgagcttgaagaggagctgaagactgatcctctgaccaagtatgtgctgtatcaggatgagaggagcaagagttggcgagtccaagcagtcgcagttgctcctgacaggttcgagagccgaaaggctctgccagagaagtggaggggcatgagagacgacgaactt

SEQ ID NO: 1618 - DNA, 438 bp, Zea mays
  Clone ID: LIB143-044-Q1-E1-F5
ctcgcgggccgatacacgcctctacaatgcgtcatctcagtatacccgcctcaagtacaaagggaaagctgcgactcgctcggaagtggggtactgtacttcccgctcgctcgctctctgctctggtccttcacgctctaaccttcagttgaggttctctaatcgggcccgctaaagtcgagagacaggttttcgcgaacatttgcatctagccatctctactcaactgaattcttgtgctcttgtggcattcacaaagtccattttcagactgagctagttcagctgtcattttttttttcagccaaaggtcgcgttcttttggacctgctcttgattcgttcgttcgttcgtttggattgattgattgattgattcctttcgacttcccttcaccacccccctgctccgtcaagcgtgcctctgttcttctgccat

SEQ ID NO: 1619 - DNA, 417 bp, Zea mays
  unsure at all n locations
  Clone ID: LIB143-044-Q1-E1-E1
acacagctgctaggtactaccaggagaccttcggcgtccctccggccacgcgagctcgccgaaatggtcgcccacaggttccatcagtaccaggtggtgggtcgcgcgctgccgaccccaaccgatgagcaccccaagatctaccgcatgaagctctgggccaccaacgaggttcgcgccaagtccaagttctggtacttcctgagaaagctcaagaaggtgaagaagagcaatggccagatgcttgccatcaacgagatctttgagcgcaacccgaccaccatcaagaactatggcatctggctgcgctaccagagcacgactggttaccacaacatgtacaaggagtaccgcgacaccaccctgaacggcgcagtggagcagatgtacaacgagatggcctcncgccaccgcgtg

SEQ ID NO: 1620 - DNA, 385 bp, Zea mays
  Clone ID: LIB143-044-Q1-E1-E10
caagcctctaaagtgagtcatcctaccgggcgggagagagccaggaagaggagggcgacgatggcgtccggctggggcatcaacgggaacaagggccgctgctacgacttctggctggagttcagcgagtgcatgagccgctgccgccagccctccgactgcggcctcctccgcgaggactacctcgagtgcctccaccactccaaggagttccagcgcaggaacaggatctacaaggaggagcaacgtcagatcagagctgctgctcgtaaggccaaggaggaagctgagggtgcccctgctgttgcagcacaccattagtctctctgtctattttttgtgttgttgttttctgttaactcatctttggttcagttatgatgct

SEQ ID NO: 1621 - DNA, 403 bp, Zea mays
  Clone ID: LIB143-044-Q1-E1-E11
tcgcgggtcgatgcaagcgtctacactcgtctcgctctatctctctcctgccccaaccaaccaatggaggctctcgcgggcgccgcatcctcctccgttctccccgcgcgccacccgccctcccgcgtggccgcgcagtccctcgcgctccgccctagccgctgcggtccactccgcgcggttggcgcctgcggtgtcagtggcaaggacgacgcccacgccgccaacgggtctcccgtcctcaagctgaagagcgattccagtctaaatggagtcctaccgattgcagctgacaagtcacagaaggcttcatcaactaacgttagtactgactctagtggatctagagctggcctgtttagaacatccatatcacgtggtgtgcagagtgcaactttcgccc

SEQ ID NO: 1622 - DNA, 411 bp, Zea mays
  Clone ID: LIB143-044-Q1-E1-E12
actcgtgggatcgatacaagcctctacactgattcctattatcgtcgccttcgatcggcggctgcctccttcctccacttccgtcccttcaccgagccgccgccgccactatgaagggacccggcctcttctccgacatcggcaagaaggccaaggatctactcagtaaggactacacttacgaccagaagctgaccatctccaccgccagcgcctctggactgggcctgacttccacagctgtgaagaaaggagggctttattctcttgatgtcagttcagtttacaagtacaagaataccactgttgatgttaaagtggacactgaatcaaatatctctactacattgaccgtgttggacgccttgccatgcacaaagcttgtcacttctgtgaagctgcctgactaca

SEQ ID NO: 1623 - DNA, 412 bp, Zea mays
  Clone ID: LIB143-044-Q1-E1-E2
aggacggagctgagcttctagcaacgtacagtgtatccgccatgagtcctttcggggcggtgatcacgccagaaaccctcaagtacatgtccaagtaccagggacgtgagatcacgcaggtggactgcgcacgggaggcgatgaggctgatccacgcggaagacaagaacctcaaggccgaggactcagcgtgggagctgaagaagaagttcggcaacggcgtgagcaccatggtcctcgtctacaacgccaccggggccagcctgagcctggtggacgacgggaaagactggatgggctccgtctacagctcgccgatcccggacaccttccacaacgggcagtggatcgccttcctccacgtcaagcccggctcgctggcgcaaggcagccaggccgccagggtgttccg

SEQ ID NO: 1624 - DNA, 418 bp, Zea mays
  Clone ID: LIB143-044-Q1-E1-E3
acttacaatcacaacgaacaaaagctctcgatctcaccgacaccgaggaagaatagatcaatggcgtccgagcagggagtcgtgatcgcgtgccacagcaaggctgagttcgacgcccacatgaccaaggcccatgaagccggcaagctggtggtcatcgacttcactgccgcctggtgcggtccatgccgcgccatcgccccactgttcgtcgaacacgccaggaagttcactcaggtcgtcttcctgaaggtggacgtggacgaagtgaacgaagtcaccgcggcctacgaggtcgaggcgatgccgaccttccacttcgtcaagaacggcaagactgtcgcgaccatcgtgggtgccaagaaggacgagctcctggccctgatcgagaagcatgccgcgcctgcgcctgcgtctg

SEQ ID NO: 1625 - DNA, 243 bp, Zea mays
  Clone ID: LIB143-044-Q1-E1-E4
cttgatcgcctcctcaagctacgctgagtttggggggcaaatacgaaccgcccaccaagcgtgtgagctgatgggcatcgacttcactaccgcctggtgctgtccaagcgacagcatcttcggactgttcgtcaagaacgtcacgaagttcagacaggtcgtcttcatggaagtagagatccagcaattgaaggatgtcactgggtcctacgaggtcgatgcgatgccgaacttcgacatcgt

SEQ ID NO: 1626 - DNA, 415 bp, Zea mays
  Clone ID: LIB143-044-Q1-E1-E5
acccacgcgtccgattccaaaaacctggtgggagtccactcacaagagtgtgccaggtggttatagcagcatttcgtaagtggcacattgaagtgccacatgatacatctctcctatatgaagttgatggccaaacttcagcaattgaaggaagccggaagctggagcacacaaatgagctcgagtaattctaattttctgcaatgcaatcacttctttagtttcagtatcatgtgatgcaacatttatggaatatttggaaatgacagtacttatatgtcataaagacattgaacttcactgcaaagtttttattatttcaacttgaggatactggaaaattagtacataaatacaatgaacaagaattaggaattattgataggatcaaacaagcatgataattcctccagta

SEQ ID NO: 1627 - DNA, 386 bp, Zea mays
  Clone ID: LIB143-044-Q1-E1-E6
atgaggcgcaagttgtggagtcaaaggatggaaccatctcggttgcttctgcatttgctggttatcaggaagctgtgcaagacagggatcacaaattcttgacaaaagcagtggaagaagcatatcgaggagtcgattgcggtgacggaggtccattcggagcagttgtcgtctgtaatgacgaagtagtagtcaactgccataacatggttctgaagcacactgaccctactgcgcatgctgaagtaactgcaattagataggcttgcaaaaagcttgggaaaattgagctctcagactgcgaaatttacgcgtcgtgcgagccaggcccaatgtgctttggtgcagttcatctgtcccgaatcaagaggctggtttatggggcc

SEQ ID NO: 1628 - DNA, 420 bp, Zea mays
  Clone ID: LIB143-044-Q1-E1-E7
ctcgcgggtcgatacacgcctctagctgccatcgaccatacaggtgatcatcagagccatcccgttcaagagcaggtcttaagctgccgtggccgtgccgagacatgccagtccgaagaacgggcgtcttcctgtgatgtcttcttgtctgcccacgcctagtttctctgtcgattcctattcgtcgtctcttcagggctggtgctcactgctgcgccgttctgttaaccgaaacaagaactctgtgtattcctgtaccgagctgtgcatgttttttttttctttccatcgtggagaatttaagttattatccgtttgctgcaaggtttgccgtctcattttatgcgttgggatgttggcaagaaagggcagatgtcatgtgagaatttaaattaagtgaaatcgattcagggttttctt

SEQ ID NO: 1629 - DNA, 403 bp, Zea mays
  Clone ID: LIB143-044-Q1-E1-E8
tactctagatggactcactcggcgtcaccatcgaccccgcggaagcgggggcgtgcgcgtatccactcctcaaccaagtggagcatcccctcacgctagaccggagctggggggcgacgacgagccagccgccgccggtttgaccagacctgtggtgatggactgataaggtatgcctgtaggagggagagagctttcggtttagaaaataagagggtgccgcgggctggactgagagagcggaaggaaggaaggagccggcgatgggcgggtggaactggctcttctgcggccgatccaaagccggaggcggcgagctccggcctcccgagcccttccagctgccggcgcccttgcccgagtggccgcaaggaggggattttgctaagggcacaatatgcat

SEQ ID NO: 1630 - DNA, 412 bp, Zea mays
  Clone ID: LIB143-044-Q1-E1-F1
atagtaaatcatagtaccactgctgccacagtcccgacctttgcaattgatgatgcggtattggtcgaacggaataatggccggtggctccactcagccagtgggaggacctagcagtcacaatttgcacctccacagtcgccaggagttgatgatgtaaatggacagccattgagtcatcggagagatgataccgctgacgtcttgaactcaaggcttgaagctttccatagacgaagcgaacctgtgagtgagtagtactccaagaacggcttactggtgaacctgcgtggatacacatgaccgaacgacgtgacagctgatgtggagaaagccctctcgtgacgaaatgtccactcctgatgttaaacatgacatctaccagtacccctttgattgggtttcttcaaaa

SEQ ID NO: 1631 - DNA, 371 bp, Zea mays
  Clone ID: LIB143-044-Q1-E1-F10
tacaagcctctaaactgacgtcgtgctatccttttgctcggaacgcacacacagcccggtccccgatctccgatcccctcgtcgatccaagatgcagatcttcgtcaagaccctcactggaaagactatcaccctcgaggtggagtcttctgacaccattgacaacgtcaaggccaagatccaggacaaggagggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagacgatcaccctcgaggtgg

SEQ ID NO: 1632 - DNA, 349 bp, Zea mays
  Clone ID: LIB143-044-Q1-E1-F11
gagtgagtcgtattacactcagacctcttccccaaatcttcgattagattctcgttgacaagaagactagaaccgagcctgaccatgtcgctgatccgccgcagcaacgtgttcgatcccttctccctcgacctctgggacccctttgagggcgtccccttcggctccggcaacagcagcagtctcttcccctcgttcccgcggaccagctcggagaccgcggccttcgctggcgcgcggatcgactggaaggagactccagaggcgcacgtgttcaaggccgacgtaccggggctgaagaaggacgacgtcaaggtggacgtcgaggacggcaacgttcttcagatca

SEQ ID NO: 1633 - DNA, 327 bp, Zea mays
  Clone ID: LIB143-044-Q1-E1-F3
cccacgcgtccgcggacgcgtgggtaggagcttagccatgtgtatagatgtatttatctcttcatttccttcttaaagtttagcaagtcgggctcattatattgattagcgaataagtgctttcgttaccatggaccaataatcttcgaaacggcctgagttagactgcacacacatttatttatcagaaaagtttctagtcacactgcgcagtatcgatgttaaaaaaaaagaaaaaaaaaaaaaagaaaaaataaaaaaaaaaaaaaaaaaaaaagggggaaaacacaaaaggagagaaaacataagtgggggttcgtccaaaag

SEQ ID NO: 1634 - DNA, 399 bp, Zea mays
  Clone ID: LIB143-044-Q1-E1-F4
aagcgacatggctttcgcgcccaaaacgtcctcctcctcctcgctctcctcggcgttgcaggcagctcagtcgccgccgctgctcctgaggcggatgtcgtcgaccgcaacaccgagacggaggtacgacgcggccgtcgtcgtcactaccaccaccactgctagagctgctgcggctgctgtcacggttcccgccgccccgccgcaggcgccggcgccggcgccggtgccgccaaagcaagcggcggcacccgccgagaggaggagccgtccggtgtcggacaccatggcggcgctcatggccaagggcaagacggcgttcatcccgtacatcaccgcgggcgaccccgacctagcgacgacggccgaggcgctgcggctgctggacggctgtggcgc

SEQ ID NO: 1635 - DNA, 416 bp, Zea mays
  unsure at all n locations
  Clone ID: LIB143-044-Q1-E1-C2
ttcgattccatcccatgggttggcgttggcacgacgacgacggtgacagcggccggggcctcggcggtgtcnctgacctcgctggtggcgggggcgatggggcgcagtgcgccacgcgacgggtggtgcagtcccgctgccacacggaggaagtcgagcccggccgatttgtccgcaagtgcgagaagacggagcagctcctccgcgactgcgtcggcaggtatagcctgtgcctggtcctttccctcaatccgctaacgtggcgtttaatcggcggtgattgtgatcttagggtcgtgttatcacttgtccggcttacagctggtgatggctatggctttggtttattggttaagttagcctttgccgctaattttactctgttgtacttgtaactggcattttttctaagttaa

SEQ ID NO: 1636 - DNA, 422 bp, Zea mays
  unsure at all n locations
  Clone ID: LIB143-044-Q1-E1-C3
ctctagttcctgtcgaggatcctgaccggcgggggcggcctggcggccctgagggcggcgcgcgccgtgaaggagacgacggggatcgtgggccttgaggtggtgcctaacgcgcgagaggttctggtanggctctacgagcgcacgctcaaagagatcaaggccgtccccgaagacgagggttaccgcaaggccgttgaatccttcaccggtcaccgcctccagatctgccaggaggaggaggactggaagcgcatcgaggaccgaatcggatgcgggcaggtcgaggagctcatcgaggaggccgaggacgagctcaagctcatcgctaaaatgattgaatgggatccatggggtgttcccgatgactacgaatgtgaggtgattgaagacgacaccccaattcctaagcatgttcctca

SEQ ID NO: 1637 - DNA, 373 bp, Zea mays
  Clone ID: LIB143-044-Q1-E1-C4
gaagttaatcggggcaacgagccatttcgttactccagaacttgatgctgggccaatcattgatcagatggttgaacgagtctctcaccgagacacgttacagagttttgttgtcaagtctgagaaccttgagaagcagtgcttagcagaggctatcaagtcatattgcgagcttcgtgtcctaccatatgaactcaggaagactgtcgtgtgctgatcagagcgcccttaatggtctgtcttagtgtacttgtatatggattgataaaatgaattttttagcgtacatatatccatcccctcgacattactttaggtaagaaattccgaaagtgctttgattatgaagaacttgtacgagggaccccttgat

SEQ ID NO: 1638 - DNA, 438 bp, Zea mays
  Clone ID: LIB143-044-Q1-E1-C5
ctcgcgggccgacacacgcgtctaggtgtactctgggaagcagtcgccgggagggcacaacgtcgtctggggcctccatgacgcacttaaagcctacaatcctcagagcttgctctacggattcgtcggtggcacggagggactgtttgcaaacaagacgttggagatcacagacgatgttcttgcttcctataagaaccaaggtggtttcgatttgctcggtaggagtatcgatcagatccgcactactaagcaagtgaatgctgcaatgacaacatgccacagtctgaacttggatgggttggtcatcattggaggtgtgacctccaattcagatgctgcacagcttgcggagacccttattcagaataactgtaagaccaaggttgttggtgtgccagtttcattgaatggtgacctcaagaaccagtttgttga

SEQ ID NO: 1639 - DNA, 409 bp, Zea mays
  Clone ID: LIB143-044-Q1-E1-C6
accgcgactgcttctccatccttccacgaactagacgagggaagagcgctgaagctgtggaggaaaacgaaggatctccccgtgcttgtgtatgccaggtcgcctgctctccgtccgcatcccgtccctcgcgaaactcggcgctcccagcaggtgtgcaaaatccatggcttcagacactggcaagaagctcatccagatcgatgtgagctcggacacagtatgcccttggtgctttgtcggcaaaaagaacctcgagaaagcgatggagcaaagcagggacaagtttgacttcgaggtccgctggcatccgttctttctaaaccctgatgcgcctaaggacggcgtcaggaaatctgacttctacaaggcgaagtttggtcctgttcagtatgagcgtgtcatttct

SEQ ID NO: 1640 - DNA, 423 bp, Zea mays
  Clone ID: LIB143-044-Q1-E1-C7
gcacgcctctacagtgactcgtgctaacgcgtgggccagaccaccaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtcaacgtggagaggtcgtttgccgagaagcactacgccgatctcgcctccaagcccttcttccagggcctcgttgactacatcatctctggccctgtggtggccatggtctgggagggcaagagcgtcgtcacaactggccgcaagatcattggcgccactaaccccctggcttctgagcccggcaccatccgtggcgactttgctgtcgacattggcaggaatgtcattca

SEQ ID NO: 1641 - DNA, 430 bp, Zea mays
  unsure at all n locations
  Clone ID: LIB143-044-Q1-E1-C8
cccacgcgtctaaacagcgccatctaactttagctactacgtgtgcaagtgcaagcagcccactcgttcgaccatggctgcgagagcggcgctcctccagctggctgtcagcctggttatccttgccgccgtggcgagcgcgagcgcgaccaactgcccaccgccaccgctgccgccggccccaaagccgccgacgcccggcggccaccacggccacgggtcgtgccccaggaacgcgctgaagctgggcgtgtgcgccaacgtgctgggcctggtgaaggccaaggtcggctcgccgccgtacgagccgtgctgctcgctgctggacgggctcgtcgacctggaggccgccgtctgcctctgcaccgccgtcaaggccaacatcctcggcatcaaccttaacctcnccatcgacctcagcctcatcctc

SEQ ID NO: 1642 - DNA, 430 bp, Zea mays
  Clone ID: LIB143-044-Q1-E1-D10
tcgcgggtcgatgcaagcctctaatctacgtacaacaaaactccctccagatacatttcctgtcaaggttgccatcccagtcgtgcctacgatcagagtgcttgtgacattcacgaaattcgaggagctacagccgctagaggagttcggcacaccaccttcaagccctgacaaaagcaagagcccagcagtgcagcctccttcgagctcctggattcaatggatcaaggcgccttattaccgccagatgaacttgtctacggcgccaggcccgagcagccgcgtggaggacatccaccaccaggacccgttcgccatcccttcggattacgtgtggaccacacccgaggagaagaaaaagaagacacaggaaaacaagaacaggtccaagaaaggcaggaacgggtgatagagcattggtgggatggga

SEQ ID NO: 1643 - DNA, 434 bp, Zea mays
  Clone ID: LIB143-044-Q1-E1-D3
cgggccggcccacgcgtccagaaagtttgttgcatgttcttctcttgtctttgtcttaatcagcgggatatggatagtcattttcataagaacccatgttgcagtattttgtatagcatcttggcattgtttttgagcactaatgttgtttggatgtcatgtatgcagcatgtgcaggaattccttaattatgctaaatttgtgtcgtggtgggtttcattaggtgtggcttcatcaattggactaggttctggtttgcatacatttgtgctgtatctgggtcctcatattgctctgttcactattaaggctgttcaatgtggtcgaattgatctaaaaattgctccatatgataccatacagctaaaggttgggccatcatggcttgacaagaaatgttcagaatttggaccgcctgtgtatccagcatcagc

SEQ ID NO: 1644 - DNA, 428 bp, Zea mays
  Clone ID: LIB143-044-Q1-E1-D4
ccacgcgtccagataaaactaagatgatggagaggctatggggtgagaacttctttgaccctgccacaaagaagtggaccaccaagaacacaggttctcctacctgcaagagaggatttgttcagttctgctatgagccaatcaagcaaatcatcaagacctgcatgaatgaccagaaggagaaattgtggcccatgctgcaaaagctcaatgttaccatgaaggctgatgagaaggagttgattggcaaagctttgatgaagcgtgttatgcaaacgtggcttccagctagcactgctctgcttgagatgatgatattccaccttccttccccagcaaaggctcaaaagtatcgtgtggagaacttgtacgagggaccccttgatgatgtgtatgcaactgctatcagaaactgtgatccagagggt

SEQ ID NO: 1645 - DNA, 435 bp, Zea mays
  Clone ID: LIB143-044-Q1-E1-D5
tcgtgggccgatacaacactctacattgagtcgtattaaccggcatatcctgcacaagtattcaaatgaagatgtatcatttggctcttggttgatcgggttggaagttgagcatgttgatgagagaagcctttgctgtggtactcccccagactgcgaatggaaagggcaggccgggaacccatgtgcggcgtccttcgactggaactgcactggcatctgcaatccggtggagaggatgacagaggtacaccgacgatgttgggaaggccttggagccgaatggcacgcacagtctttgacttttgacagccaatagttggcgcttggcggatcattgtcgcaccattttcttcctcttctttatggccctgtaattaatatgcggagatgaacttgtatgcaatggctcggtttttcagatgtacagcaatg

SEQ ID NO: 1646 - DNA, 427 bp, Zea mays
  Clone ID: LIB143-044-Q1-E1-D6
acaaccccctacactcagtcgtactatgctcatactgcttgccctcgccgtatcgtccacccgcaacgcacaggaggattccatggccgacaacaccgggacgttggcgggcggcatcaaggacgtgccggggaacgagaacgaccttcacctccaggaactcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtgaagaagctctacgaagctaaggtctgggagaagccatgggagaacttcaaggagctgcaggaattcaagcctgttgaagagggtgctagcgcctaaggatctctccttctccatgtgcgagcctgaagc

SEQ ID NO: 1647 - DNA, 419 bp, Zea mays
  Clone ID: LIB143-044-Q1-E1-D7
acccacgcatccagggagtccttgcgctttggaagggtgcaggtccaactgtggtgagagctatggcactcaatatgggtatgcttgcttcctatgaccagagtgtcgagctatttagggacaaatttggcgcatgagaaatttctactgttgttggagccagcgctgtttctggattctttgcctcagcatgcagtttgccctttgactatgtgaagacacagattcagaagatgcaacctgatgcgaatggcaagtacccatatacagggtctttggactgtgctgtgaagaccttcaagatcggtggcgcattcaagttctacactggtttcccagtgtactgcgtcaggattgcaccccatgtcatgatgacctggatattcttgacgcagatccagaagtgtgagaagaagatc

SEQ ID NO: 1648 - DNA, 426 bp, Zea mays
  Clone ID: LIB143-044-Q1-E1-C11
tcgcgggtcgatacaagcctctaaaataagtctgactaggacgagactcagatggaaggcctcgcagacaactgcactcgggttatggtctggaatttggacttggaacctccacagctgaattaccctactagctggcagctgcagaagaacctagacatcgtcgtgccaataacataaaccgcgatgctgctgctgctctttttgttcgcgcctcctagtgagtgtggtggaatgatgacgacaatgcccatgccttcctgaacttggtagcgtccaggatcacgcgaagctgctctgccgagacctggttcgaataatgtggtactagtaacaatagttggaaagcgaagaagcctgcctgacaaaaggaaaaattctttctccccccgttgcgctgcattaccaatggatctcaacatagat

SEQ ID NO: 1649 - DNA, 426 bp, Zea mays
  Clone ID: LIB143-044-Q1-E1-A5
gccgacacacgcgtctacagaatttcatcataaggtgggagatatacagaagaagatgccagagcgatcattgtacagattttgagcgtagtggccttctgtcatcttcagggagtagtgcatcgtgatttgaagccagagaattttctcttcacaacaagagatgaaagcgctcctatgaagttgattgactttggtctgtcagattttattagaccagatgaaaggctcaatgatattgttggaagtgcttattatgttgctccagaggttctacacagatcatacagtatggaagcagacatttggagtataggtgttataacatacattctgctctgtggcagtcggccattctgggcaaggacagaatctgggatcttccggtccgtattgagggctgatcccaattttgacgattcacca

SEQ ID NO: 1650 - DNA, 420 bp, Zea mays
  Clone ID: LIB143-044-Q1-E1-A6
acttctatggatgagaatgctcaaaaactgaaagaaaactatcttcagaagctgaatgcacttgaatcccaggtccatgagctcaagaaacaaaaaagtgatgaggcagcaaagcgtttacaagaagatattcagcatataaaatctcagaaggatcagcttcaacaaaaggccaagcaagagtctgaaaaatttatgtcttggaaggctgcccctgaaaaggaagtaatacagctcaagaaggaagggagacgaaatgaatatgacatgcacaagctcttggctttaaatcagaggcaaaaaatggtcttacagaggaaaactgaagaagcagcagctgctacaaaaagattcatggagttgctggaagcaaagaactcatcacttgagacatatggcagtggaaatgcttcggggatg

SEQ ID NO: 1651 - DNA, 418 bp, Zea mays
  Clone ID: LIB143-044-Q1-E1-A7
acgctcgaaccagaggagccaagcagaggaagcgaggcggcggggggcggagatgtcggcgggactggtgaccgacgaggccaccgtggggcggctgtaccggatccggcgcacggtgatgcagatgctccgtgaccgtggctacctggtggtggaccacgagctcgccaccagccgccgcgacttcctccgcaagttcggcgagtccttccaccgcgaggacctcctcatcaacaagtacaagaagaacgacccatccgaccagatatatgtcttcttccccaacgatgacaaggtagggatgaagcacatcaagaagtacgtcgaaatgatgacgcacgagaacgtctccagagctgtgctggttctccagcagaacctaactccgtttgcgaagtcgtttctcatagagctggag

SEQ ID NO: 1652 - DNA, 419 bp, Zea mays
  unsure at all n locations
  Clone ID: LIB143-044-Q1-E1-B1
tacgatgcatcgtattacctcctccccctgaagtcgcgaagctcgcggaagcgccgagatgtaccatcccacgagaggcggcgtccgcggcggcagagatcaattcaaatgggacgatgtgaaggttgacaagcatcgggagaattaccttggtcatagtgttaaggctccggttggtagatggcagaaaggaaaggatctttactggtatactcgggataagaaatccgacacggaagatgctcttaaggaagaaatcaggagagtgaaggaagaggaggaacaggctatgcccgaggctcttggcttagctcctaagcgcagcaatcgaactcagggtaatcgcttggataagcatgaatatgctgagctgattaagagaggatcaacntgcgatgacttgggagcagggcacgctg

SEQ ID NO: 1653 - DNA, 384 bp, Zea mays
  Clone ID: LIB143-044-Q1-E1-B11
agaggcctcgccctcacccctccggcgaaaaccgattctctccggcgtttcctggtcccttagtgcaagcaaggacaccgctcctctagcgagctccgttctgaagcggcaagaaagatgattaatcttttcaaaataaagggtcaaaagaaagaggaggcagcaagtgctgctggaaaggcccctgttaagaaacagtctgctggggagctccgtcttcataaagatattagtgagctcaacctgccgaagaccacgtcaatttcttttcccaatggcaaggatgatctgatgaattttgagaccaccatccgacctgatgaaggatattacatgggaggcactttcgttttcacctttcaagtgtccccatcttatcctcat

SEQ ID NO: 1654 - DNA, 407 bp, Zea mays
  unsure at all n locations
  Clone ID: LIB143-044-Q1-E1-B3
tacgctaaggcgaaattgcaaacctgtcactagcgaagcatacttcgtcgagcacactcttgcaattaatccaccgagttcggtttagtggtttactctcagacgtacgcataaatatagcatagcatcatcgacaacaatgtcgctcgtgagtcggcgcagcagcaacgtgttcgaccccttctccctcgacctctgggaccctttcaacatgttccgctccatcgtcccgtcggcggcctcctccggcggcggttccgagaccgccgccttcgccaacgcccgcgtcgactggaaggagacgcccgaggcgcacgtgttcaaggccgacctccccggcgtcaagaaggangaggtcaaggtcgaggtgganggcggcaacgtgctcgtcatcagcggcaagcgca

SEQ ID NO: 1655 - DNA, 239 bp, Zea mays
  Clone ID: LIB143-044-Q1-E1-B4
acctgtcactagcgaagcataattcgtcgagcatacacttgctattatcccaacgagttcggttcagtggtttactctcagatttacgcacagatatatcatggcatcatcgacaacaaattcgcacgtgattcggcacagtagcatcctgttagacgcgttctcgctcgaactcagggagcctttcaacatgttccgctccatcatggattctgagggttcgtccggctccggtacag

SEQ ID NO: 1656 - DNA, 415 bp, Zea mays
  Clone ID: LIB143-044-Q1-E1-B5
ctctagccacacgcttgtgacggcggtcatccacggcgagaaggtgccgctgtactgcgccgggggcagcctgatgctgtccactaccaccggcggggcggtgcccctgacactggacttggacctgacctcgcagggctacgtgatctgcaagctcatgcgggtgacgcataatgtgcacgtgacgtgccccgtcgtcttggacgccattaacactaagcccgtcaggttctccaacaaggcctgcgctgtgtaaatggcctgaacgtcaaatacgttttcgtacatctgcgatccgactgcgcattaccaacgcgcgtacgatgccgtgcctgtacttagctatcgtgttggtcgtcaagtacaataagctgcacacacatatggtctgtttgagccttttggttccgtcgat

SEQ ID NO: 1657 - DNA, 429 bp, Zea mays
  Clone ID: LIB143-044-Q1-E1-B6
gcaagcctctagactgagtctgattacgccaaaagcagcagcagctccagccgtcgccgtctccactctccagtctccagcactgctccgcgcgcgccggatcgagggagggcaggcggacgatgaggagagatgagtctcttcgggcttggacgaaaccagaagacattccgccccaagaagagcgctccatcaggtagcaagggagcacagctccgaaagcacatagatgccactctcggcagtggaaaccttagggaagctgtgaggttgcctcctggagaggatatcaatgaatggcttgcggtgaatactgtggatttctttaaccaagttaatatgctgtatggcacactcacagaattttgcacacctgagagctgtccgacaatgacagctggcccagagtacgagtacagatgggctgag

SEQ ID NO: 1658 - DNA, 443 bp, Zea mays
  Clone ID: LIB143-044-Q1-E1-B8
ctcgcgggtcgatacacgcctctaaaatatttcggacgagattgaaagcgaagatgtcaaacccgcagattcttcagcaatttccctctctagcaagaaggagcctcttgttcaggctactttgtctagcatgtttataagggcagaagaaaaaaagagatctacaaggagtcctaaagggtcccctgcaaccaaaggtgctgctgctaagaagcagcgagcaagtccaatggcaaaacagccagcagggatcaagaaggttagcggaactcggggaaagaaaaaaccaaaggtgggagaagatgaaatcgaagagctctcaagttcctcccaggataacgacgcagatgatgatagtgacgaggactgggccgaataatgcgatggtacagacgacggataggttgggccgttggggaagcatatgcataattgatgtgcgg

SEQ ID NO: 1659 - DNA, 433 bp, Zea mays
  Clone ID: LIB143-044-Q1-E1-A3
cacgcgtccaaaaaatctgttccaatggaaactgatgcaaaggttgagccatcgaaaaggaaaattaagaaaacttctgttccgatccatgagttggtctacggcgcattgtctgccactgacctgcagaaggctgtagagaaagagtatgagatggctctgcaggacagagtaatggaagagaccaaagaaaagaaaaatgctgtggaagcttatgtctatgacatgcgtaacaagctgtacgacaagtataacgattttgtcacacccgaggagaaggaagggttgattgcaaagcttcaagaggttgaagattggctgtatgaagatggtgaggatgagacaaagggagtatatatttctaaactggaagagcttaaaaagattggcgatccaattgaggcacggcacaaggagtggacggaaaggggtt

SEQ ID NO: 1660 - DNA, 407 bp, Zea mays
  Clone ID: LIB143-043-Q1-E1-G5
accacagcagcacaagcaagaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgaggcggccaccgagggcggcggctgcgactgcaacacctgcaagtgcggcaccagctgcggctgctcctgctgcagctgcaactgagctggcccggcccggcgatggcgcacgagagtcgagaggaggaggacgacgacgaggcgtataaatataatagcggcgtccagtaaataagatcctgtcaactgca

SEQ ID NO: 1661 - DNA, 152 bp, Zea mays
  Clone ID: LIB143-043-Q1-E1-G6
gacccacgcatcaagttccaattatggtgtagttcaaaaattgctcgactaaactgcggtgtaacagttaaatgggcagatggaataatgtaatcatactgttccctcgttaggttgtcacttgaattgataatctggccttttttttggtt

SEQ ID NO: 1662 - DNA, 407 bp, Zea mays
  Clone ID: LIB143-043-Q1-E1-G7
acgctcctgagtcctgtccaccctgccaccgccgacgccgcgccgccgcagcaattgtcaccgtcgctatggcccgtatcaaggtgcacgagctccgggggaagagcaagacggacctgcaggcgcagctcaaggagctgaagtctgagctctccctcctccgcgtagccaaggtcaccggcggcgcacccaacaagctctccaagatcaaggtggtgcgcacctcgatcgcgcgcgtgctcacagtgatctcgcagaagcagaagtcggcgttgcgggaggcgtacaagaagaagaacctgctccccctcgacctccgccctaagaagacccgtgccatccgccgccgtctgaccaagcaccagctctctctgaagaccgagagggaaaagaagcgtgagaagtac

SEQ ID NO: 1663 - DNA, 396 bp, Zea mays
  unsure at all n locations
  Clone ID: LIB143-043-Q1-E1-G8
cataatacgctcgtgaagatgatgatctggaatcacttgagcgagatgttaatgaagaatccgggtggaagcttgtccatggtgatgtgttccggcctcctcgtggccaggtgtttctttctgccctagttggtattggcactcagctggcggctcttatcctgcttgtgattgtgttggccattgttgtcatgttatatgttgggcgaggggctatcatcacaaccttcattgtgtgctacgctcttacatctttcatctctggatatgttagtggtggtctctattcaaggaatggtggaaaaaactggataaaggctatgatccttacagcatcactttttccattcttgtgtntctcgattggattgttgttaaacactattgctatcttct

SEQ ID NO: 1664 - DNA, 373 bp, Zea mays
  Clone ID: LIB143-043-Q1-E1-G9
acgtcgtcctcgcagcgccggcgcgccatctcggtacgaaggcgacggcggcggtgacggcggcgttcaggatcgggatctcagcgacgacgtcagaggcttcccatcccgacccccgccagtcgcctcgcgccctcgactccggactccggtcctccgcacaccggccggttaccctgcgtttgaacctgctatagaaattataaaatggccgcggttgatgcgacaaccaaggagatggatgcactgcatgttggacaagatgatgaaacaaaagagagactgattacagaagacaaagctgcaaacagcaatcattctgttgttgcagctcagtccttgccaccagaggacgacgatgatgatgaagcac

SEQ ID NO: 1665 - DNA, 347 bp, Zea mays
  Clone ID: LIB143-043-Q1-E1-H1
ccaccctccaggacggttccccaaatatggtcaacctgtggggtttgtgtaaggccaagcggcgagagaattataagatactggagaagctctgggacaacatgttggccgggcctcgcccggagacagggctcgagaaactccgcaaggggaccaccgcccgtctgctcgtcatcaacaaagacgcggacggcggcagctacaagcgggcgcagtcgatgccgtcgaccccgacgacgccggtgacgccgtcgtcgtcgtcgtcgtcgacgacgccgcgcggcgccggcaacatatggcgcaacgtcttccatccggggagcaaactggccaccaaaggcatgggc

SEQ ID NO: 1666 - DNA, 327 bp, Zea mays
  Clone ID: LIB143-043-Q1-E1-H3
acaacaccctacaatgactcgtattatcacctcctccacctcctcctctttatccatctgccagggcgcacgaggagaacggcggcgtctgagatcgcgaggccgaggcttgtcccgtctccgctccgctccgcccacccacggtttctggaggacaattcttcgctgtctagccttcctcaaaagtaaaaagggtaaatgggatcagaagggccttcagttgtcactgtccatgttactggatttaagaagttccatggggttgctgagaacccaaccgagaaaattgtgaccaatcttaaatctttcttggaaaaaccaagggtt

SEQ ID NO: 1667 - DNA, 253 bp, Zea mays
  Clone ID: LIB143-043-Q1-E1-H4
accggcccgctgacaaactgatagacgagaaccatccagcactatacaagaaggtgaaagtcaaagaatatactgctggactctacgaacatttctctcgagggaaattggttaaagagactgcaaagatatagcttgttcgctttggattaaatccatggactaatccttagagacaaaaacactgtataagtagtaaaagtcggtacgaattaaagctcaagctagtcgtatctaggatcgcaaaggtttc

SEQ ID NO: 1668 - DNA, 402 bp, Zea mays
  Clone ID: LIB143-043-Q1-E1-H5
aaactgcagcttgcagcgagggttatcgttgccatcgagaacccgcaggacatcatcgtccagtccgcccgcccctatggccagcgtgctgtcctcaagttcgctcagtacactggcgctcatgccatcgctgggaggcacacccctggtaccttcactaaccagctccagacctccttcagcgagcctcggctgctcatccttaccgacccaaggactgaccatcagccaattaaggagtctgctctggggaacatccccaccattgccttctgtgatactgactctcccatgcggtatgtcgatatcggcatcccagcgaacaacaaggggaggaacagcattggatgcctgttctggcttttggccaggatggttctgcagatgaggggcactatcctc

SEQ ID NO: 1669 - DNA, 422 bp, Zea mays
  Clone ID: LIB143-043-Q1-E1-H6
gacccacgcaatcactcatgctctagccaaagttgcagctggtacgtggtagttcatgtatccatgctggtagtagctcttctcctcagccaccagtgcagtttacccttgttcatcacagccaactcctgtgtttggtgaccacaacagcaatccttcaacctcaccatggccagggttcgtggagattgtctcggtattgttgtgcccgttccttgttcctcacagaacacctagaagaagtggtgtttgaaggaggagtctactccagtggctactgatcagttggaggagccatctaaccgggtattgggtggaaaggtctttagcctcttctctacaacaaagaacacctagaagaagtggtgtttgaaggaggagtctactccagtggctactgatcaattggaggagccatctaa

SEQ ID NO: 1670 - DNA, 403 bp, Zea mays
  unsure at all n locations
  Clone ID: LIB143-043-Q1-E1-H7
aagttactttatctatggagtttcattcctagttcattgcacattggttatcgtgacaaatgggggtgtcgctagcaggtctctcttctctggataaccacaccaccaatcatgagggaatcaccttcaacacagggggggccatctacatcttctgcggttgatgatagttactcagctgacggtgttgaagattcacaactattcctctccgtgccagctttaaaccaagctgcatcttatcttgcccagacagcttcattcctcactcaatgcctccctgtacctggttttgtgggtctatctgangagggccaagagttattaacactgccacctgcatcggcttcaggcagactttctgttcagacttcttcagtagagccttccggtaccaattcat

SEQ ID NO: 1671 - DNA, 270 bp, Zea mays
  Clone ID: LIB143-043-Q1-E1-H8
tcacgggccgacccacgcttccaccggcccgctgacaaactgatagacgagaaccatccagcactatataagaaggtgaaagtcaaagaatatactgctggactctacgaacatttctctcgagggaaattggttaaagagactgcaaagatatagcttgtgggctttggattaaatccatggactaatccttagagacagggacactgtataagtagtaaaagtcggtacgaattaaagctcaagctagtcgtatctaggatcgcaaag

SEQ ID NO: 1672 - DNA, 415 bp, Zea mays
  unsure at all n locations
  Clone ID: LIB143-044-Q1-E1-A1
atacgaagggcattgaaccttggtgttagtgtaaaaatgatcacaggtgatcagctagcaattgggaaggaaacaggacgtcgcttaggcatgggtactaacatgtacccttcctctgctttgctgggacagaataaggatgagtctattgctgctttacctgttgacgatttaattgagaaagcggatggttttgctggcgtattccctgagcacaaatatgagattgtaaaacgtttgcaagcacgaaaacacatttgtgggatgactggtgatggagtaaatgatgcncctgccctaaagaaagctgatattggtatagcagttgctgatgccactgatgcagccaggagtgcttctgacattgtcctgacagaacctggcttgagtgtgataattagtgccgtttcttaac

SEQ ID NO: 1673 - DNA, 421 bp, Zea mays
  Clone ID: LIB143-044-Q1-E1-A11
ttctctaaactgagtcgtaataagctctggcgagaagaacgtgctcatctttgaccttggtggtggcacgtttgatgtgtccctcctcaccatcgaggagggcatcttcgaggtgaaggccaccgcgggtgatactcaccttggaggcgaggatttcgacaatcgaatggtgaaccacttcgtccaggagttcaagcgcaagcataagaaggacatcagcggcaaccctcgtgcactgcgccggctgcgcacggcgtgcgagcgcgccaagcgcacgctgtcatcgaccgcccagacgaccattgagatcgactccttgttcgagggcatcgacttctactctacaatcaccagtgctcgctttgaggagctcaacatggacttgttccgcaagtgcatgaaacctgtggagaagtgcctg

SEQ ID NO: 1674 - DNA, 401 bp, Zea mays
  Clone ID: LIB143-043-Q1-E1-G3
acccacgcgtccgctacctccccggcgtcgcgcccaatgacttcgagaagaaagatccacttcctgtgaaagtcaacaagctgacctcaatcaagacacaacttccctactcctactattctctcccattctgcaagccggataccatagttgacagtgcagaaaatctcggtgaagttcttcgtggagatcgcattgaaaactctccctatacgtttgaaatgagggagcctcagatgtgtcaagtagtctgcaagatatctgttggggagaaagaagcaaagcttctcaaggagaagattgaagatgaataccgtgttaacatgattcttgacaacctacctttagtcgttcctattcaaagagtggatcaagaaggtgcatatttctatcaacatgga

SEQ ID NO: 1675 - DNA, 417 bp, Zea mays
  Clone ID: LIB143-043-Q1-E1-E6
ctcgcgggccgacacacgcctctacggtcactcgggccaattctccgtggacctcttcgaccccttcgacagcgtgttccgctccatcgtgccgtcgtcgtcgtcggcggcggcggcctccgagaccgccgccttcgccagcgcccgcatcgactggaaggagacgcccgaggcgcacgtgttcaaggccgacctccccggcgtgaagaaggaggaggtgaaggtggaggtggaggacggcaacgtgctgctcatcagcgggcagcgcagcagggagaaggaggacaagggcgacaagtggcaccgcgtggagcgcagcagcggccagttcgtgcggcgcttccgcctccccgagaacgccaagaccgaggaggtgagggccgcgctggagaacggcgtgctcacggtcaccgtgcc

SEQ ID NO: 1676 - DNA, 403 bp, Zea mays
  Clone ID: LIB143-043-Q1-E1-E7
acgcgttgtctgatacaaccccctagactgagtcgtactaactcgatcatcaattaagcgaacctcgccgcgatcgtatcagccatggcgaccgccgcgcacgagggcgtgacccagcgcgtcgctgccagtggcagcagggacgacggcgccagcggcggcatcgcggcggtctcgggtcccaacaagaagccgggcggcggcaggaggcggcgcggcctccgttcggtcgccgccgcggtgtccatccccgcggcgctcgtggctctgtccttcttcgccgcgggccactccacgccgccgccgagttccgccacggtggcggtggtgcgggccgggtcggtggcgtcggaggcagtgctggcgctggcggtgttgatggcgtgggcagagggcgggctgc

SEQ ID NO: 1677 - DNA, 430 bp, Zea mays
  Clone ID: LIB143-043-Q1-E1-E9
gcccgggtcgatacacgactctacatcgcgtcctaggatgccctgctcatactgcttgccctcgccgtatcgtccacccgcaacgcacaggaggattccatggccgacaacaccgggacgttggcgggcggcatcaaggacgtgccggggaacgagaacgaccttcacctccaggaactcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtgaagaagctctacgaagctaaggtctgggagaagccatgggagaacttcaaggagctgcaggaattcaagcctgttgaagagggtgctagcgcctaaggatctctccttctccatg

SEQ ID NO: 1678 - DNA, 404 bp, Zea mays
  unsure at all n locations
  Clone ID: LIB143-043-Q1-E1-F1
agaaaagccacttttggcacgttcaaccttcatacaggcagcccgtaataatgtacttctagctgttcctgctcttctatatgcaatcaacaattacctaaaattcatcatgcagttgtacttcaatcctgcaactgtgaaaatgctaagtaacctaaaggtactggttatagcttttcttctgaaatttataatgagaaggagattctcagttattcagtgggaagctcttgctctattgcttattggaatcagcatcaatcaactccgaactgtacctgtgggcaacacggcatttggtcttcctgtcactgctattgcgtacatatatacattgatttttgtaactgttccttcagtggcttctgtctacaatgaatatgccttganaagtcaatatgaca

SEQ ID NO: 1679 - DNA, 405 bp, Zea mays
  Clone ID: LIB143-043-Q1-E1-F10
acacggagacttacgagctcagcatcatggacggcttccccaagagcgtcggcggtggcggccctaacattccggcgggatcccaccccgcaggcgggagccaggcggcggcaggaggaggcgcgacgcagcggacgcagtatccgtatgtgactggtaattcagtcattgccttgaaatacaaggatggtgtgatcatggcatgtgacactggagcctcttatggatcaactttgagatacaagagtgtggaacgcattaaggcagttggcaagcatagcatcattggagcaagcggagagttcagtgacttccaggagattttgcgctatttggatgaactaactctgtctgatcatatgtgggatgatggaaactcgctgggccccaaagagatccacagct

SEQ ID NO: 1680 - DNA, 394 bp, Zea mays
  Clone ID: LIB143-043-Q1-E1-F11
taggataagcaggagatatgctgggtttcctcggttgtttgtccccgcgcacaggaaagtgttcgtcctcatggagccgccgcagccgaagtcgggcctcatcgtgggcatcaacatgggccatgtcgtcaccaagcgcgagctgcctctgcgcccgtccgagcgcacggggaaagcaacgaagagggtgtccatggtcatgggcctgatcacagaggttgctggctttgctccttatgagaagcgtatcatcgagcttctgaaggttggcaacgacaagcgcgctctgaagcttgccattagaaagcttgggactcacaagagggcaaagaaggagatataggacattcatgggcgtcatcaggtagatgagatcggctggtaaccacactga

SEQ ID NO: 1681 - DNA, 428 bp, Zea mays
  Clone ID: LIB143-043-Q1-E1-F2
ccgggcggccacacgcgtccaaaataagtctatcttattagcttaacgagtagaaccgagagcctaaactaaagcagtctggctgtgcctacacgcttgccttatcttctcccgttcaccccgccgtgcgcgcgcgcccccgcggcgacaaccgggcgaccgccgccgacctacgccaggtgccaagccgttcctcagtcccatcacgaggccttcaacgaacccttcgccggcgacgagaaaatctaattttcccaaacccgcttcctcgacttcctgtctcgactctcccaagtcacaaccctcgacctcccccctactccaactactggaagtgccgacccatcaggttctgattgattcttctgccccgaaccgcagcggcaagcggagatgaactgcgagacctgtcagctgaaagagctgga

SEQ ID NO: 1682 - DNA, 402 bp, Zea mays
  Clone ID: LIB143-043-Q1-E1-F4
acggacgcgtggggcgccggtcgtgtctgccgcggcggccctttctccgcctcccccgccgctggcgccgccgcggggcggccgttcccgccgctcaccgcgtcctcctcatctccttcatcggccccttctgagacagcgtccacgtcggtcaccaagacggtgaacggctcccaccacttcaagatcgcgggctactccctctccaaggggatcggcgtggggaagttcatcgcctccgagtccttcaacgtggggggattcgactgggcgatctacttctaccccgacgggaagagcggcgaggatggcgctgcctacgtctcgctcttcatagccctggccagcgaaggcaccgatgtgcgcgcgctgttcgagctcacgctcgtcgaccagagcggc

SEQ ID NO: 1683 - DNA, 393 bp, Zea mays
  Clone ID: LIB143-043-Q1-E1-F5
gagagatctagagcgagggagggagggaaatgggccacgaggctgcggcgccggggtcgtcggtgctcggccgcgcggtggaggaggtgcgctcggccctcaacgagcacgccgacgtggttgccgacctcttcggtcgcgtctcctccgaagtgcgcaccggcttcgcgcccgccgtcgactccttcgttggcttcttccacgccgtcgactggaaggagccttggctgatcagcatactatctttccatgccattctgctactggttaccatcatctcgaggaggaatatcaatttccagctcatcttgtcagctctaacattttctggtgtattccttgctgagagattaaatacgttcctggcgcaaaactggaagagcttctctaccc

SEQ ID NO: 1684 - DNA, 401 bp, Zea mays
  Clone ID: LIB143-043-Q1-E1-F7
agagcaatcggcggcgatgggcggcggcggcgcacatggcggcaccacctacaagggctacaccatcccgcacaacaagcgctggcacaccgtcgccggcaagggcctctgcgccgtgatgtggttctgggttttctacagggctaagcaggatggtgctacgctcttgggtttgcgtcatccttgggagggacatgatgaccactctcatggtcatggacacgggcatgaggcatcatcatcgtcatcttcacattaagttccttactggctgcggacgatgtttggcatgttccaacaactaaagtttgagttaataaattctatcaccctgcatgggactcatgttgtttgcaactggtttagcacgaactggtcttgttactattgtgctaatgtat

SEQ ID NO: 1685 - DNA, 412 bp, Zea mays
  Clone ID: LIB143-043-Q1-E1-F8
atcagcaggattcaggacgcggcgaggccaccatgagcactctcaagttctgccgggaatgcaacaacatgctgtacccgcgggaggacaaggagacgcgcaccctcctgtacgcgtgccaaacgtgcgagcatgaggagattgccactgatacttgtgtgtacaaaagggttatccgtaagcctggtggtgagcccaaagatgtcctgaaggatgcagcaactgatcctagcctgcctcgcaccagaagcgtcagatgttacaactgcaaccatccagaagctgccttttttcaggccccgactaagggagaacaagccatgacgctgtacttcatctgctgcaacccaagctgcgggcacaggtggagggactgagaaggatctggcttggtcttcgctgcaaacctgcc

SEQ ID NO: 1686 - DNA, 380 bp, Zea mays
  Clone ID: LIB143-043-Q1-E1-G10
acgttcgtcttcgccatcgtcactcaacaactcgtctcatcgcgccgcatcgtttacctcaaggttgttttgttgcttccttgtcccgctctcaccagcaatcccgtcgatcacccagacctccacggcactgctccgtctcctccgttccgttccgaaccgcaagctcccaacccttccgcgatggacctcacctcgccgtcgcccgcggcgcgccgcgccgccgccatcgcgcgccacctcgccgcagccgcagccgccgctcccatcccggcgagcagccccctggaaccttcctgctgcgtcagctacatcccgccggagtctacggatcagccggcggcatttgcgccggacgaactcaagcttctgctggacgg

SEQ ID NO: 1687 - DNA, 398 bp, Zea mays
  Clone ID: LIB143-043-Q1-E1-G12
tagtgcggctgaacgtaccggcggggcaggagatggtcaccgaggacaacctccccggcatgacctacctcaaggccgtcatcaaggagacgctccgcctgcacccgccggtcccgctcctcctcccgcactactccctggacgcctgcgaggtcgccggctacaccatcccggccaacacccgcgtcgtcgtcaacgcctgggcgctcggccgccacagcggctactgggagcgcgagaacgagttcgtcccggagaggttcctcagcggggacgtggccggcggcgtcgacctcaagcccaacgagttccagttcctggcgttcgggtccggccggaggatgtgccccggggtccactcggcgtccgcgaccatcgaggcgatgctgtccaacctc

SEQ ID NO: 1688 - DNA, 417 bp, Zea mays
  Clone ID: LIB143-043-Q1-E1-G2
acacgcgtctaaaattttacatttcatatatataaacgcgcgtggtcgtccacgtcggtataaaaaaaactgtgcacacgatttctcatcgacgggcgcggtttcttcttctgtgtcgtctcccaaagggccactcaaagggctgccgtctgcagcgctgacgaccgcggcgtcggagactagcgtgcatcccgtctcctcgtctgctccgttcgtctccacagcttgtacaggtcgctgaaacacttggaacaaacagagcttgcttctgaagccctacacctctgaaggatcaggtatcatcaacgaatgtatcaagtaaatttacctgacactcctcgacatcgacgaaacatcttctgatcagttcattcctaactattaaaggaagtttacgctcttccatctactgcaaaa

SEQ ID NO: 1689 - DNA, 402 bp, Zea mays
  Clone ID: LIB143-043-Q1-E1-E5
agcaacagccaagtgcaagtgatcgagctcccccctcctcatcagtcgctaggcacagcgcacttgcaggatggcgcaggtctctaagacgcttctccttgtggccctggtgttcgtgtcgtcggcggcggtggagctgtgccgcgcgatcgacttcgacgagcgggacctggcgtcggacgaggcgctgtgggacctgtacgagcggtggcagacgcaccaccgggtgcaccggcaccacggcgagaagggccggcggttcgggacgttcaaggagaacgtgcgcttcatccacgcgcacaacaagcgcggcgaccggccctaccgcctccgcctgaaccggttcggcgacatggggcgggaggagttccggtccacgttcgccgactcccgcatcaacga

SEQ ID NO: 1690 - DNA, 428 bp, Zea mays
  Clone ID: LIB143-043-Q1-E1-C9
acgccggcgacgagcactccaccagacgagaggggattccaagatgccgagggccaccagcgacgcgaagctcctgatccagtccctcggcaaggcgtacgctgccacaccaacaaatctcaagattattgacctctacgtgggttttgcggttgccactgcccttattcaggttgcttacatgggattggttgggtcgtttcccttcaactccttcctctcaggagttctttcatgcataggaactgcagttcttgctgtttgcctccgcattcaagtgaacaaagacaacaaagaattcaaggaccttcccccagaaagggcctttgctgattttgtcctatgcaatctggtgctccacctggtgatcatgaatttcctcggataagcaactgctgcaccatgttggttaaaggttttgtagcccc

SEQ ID NO: 1691 - DNA, 434 bp, Zea mays
  Clone ID: LIB143-043-Q1-E1-D10
acactccctgacatcgagaccggctgcccgaccccggtccggcgatccctctgcacccctttctttgcgctgccagccccaatctctcgcatccctgtcaaccatggcggcgtcagcaggcggaggcgcggtgcgcgcgctgtcccagaaggagcaggacatacagatgatgctcgcggccgacgtccacctcggcaccaagaactgcgatttccagatggagcggtatgtctttaagcgtcgcaccgacggcatctacatcatcaacctgggcaagacatgggataagctccagctcgcggcgagggttattgttgccattgagaacccacaagacatcatcgtccagtcggcccgcccctacggccagcgtgctgtcctcaagttcgcgcagtacactggcgcccatggcatcgctgggaggcaaaccctgg

SEQ ID NO: 1692 - DNA, 381 bp, Zea mays
  Clone ID: LIB143-043-Q1-E1-D11
gataaaaccctagctcgtaccgggcagcacgctgttatttggggatgtaaagttcttgagagtagacggaggagtctaatcaagacacatcaaggtgacacagcactgcgcaggtgtacgcatgaaccgcatgcaccagtagtcttgtagctaggcgaaggagaacttaaagagcatgtcatggctatacaccttgcccggcctcacgatctgcgacgggaagctcgggtggttgacggcatcggggaacccctgcgtctcgaggcacagcgcggcgtaccgccggtacacgctaccgcccttgcccctgacgccagcgagcccgttgctggtgtagaactgcaccccgggctggtccgcccacagctccatggcccgccc

SEQ ID NO: 1693 - DNA, 401 bp, Zea mays
  unsure at all n locations
  Clone ID: LIB143-043-Q1-E1-D2
acaacacactatcgagaaccaaggttttataccaaggtatttaaagagggccattcatttgatcaagatggaggttcgtttgaactttctctagtgacctgtaaatgtattggggcttatgtcaaaaacaagaagaatcaaaaccagatatgctggttatgggaaaaggtaaaatcaacagaagacagagattttcaaagattcctggacaacgtgcaatacaaaacaagtgggatattacgttatgagcgtgtctttggtgaaggttttgtgagcactggtggaatcgagactacaaaggaatttgtgggcatgctcgatcttaaaccgggccagaaagtacttgatgtcngatgtggaattggaggcggcgacttttacatggctgcaaactatgatgt

SEQ ID NO: 1694 - DNA, 404 bp, Zea mays
  Clone ID: LIB143-043-Q1-E1-D3
acaggatgtcccagtatctgctccattcttatctacatgctaaggcccctgcgtatggattcaaagagaggatgaaggctgacaacattttccccaacagtgccgtggcaactctgattgccgctactgatccgttcgtcaagaagaaatcagtatcggacttgctcgattagattatggagtagtgtgaggtactgaggtccatcatgttgctatgcgcatgtgctgtttcgataagactatggagtagtgtgagaatatatggtgagataataacgtcttagtcttgtaatgaactaccattgactttgcatttagactcatgcgctttgctgaacttgagtcatagaaacaggataaagtgcacgagagagagagaacttgtgctaattcctgatataata

SEQ ID NO: 1695 - DNA, 405 bp, Zea mays
  Clone ID: LIB143-043-Q1-E1-D4
accaacgcgtccggggttttgctgctctccgaccccgagctccgaaggccgcagcatcaggcgcggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacg

SEQ ID NO: 1696 - DNA, 395 bp, Zea mays
  Clone ID: LIB143-043-Q1-E1-D5
gaagtttgcaagagctcaagctcaaaagcaggcagctaatcttcatcacccacttgtttgtattgatgtcattgaagaaggtatagttgcaggaccacgggctggactctggaaggaagcaacttctttccaggaactgcttttctcagatacttgtaaaagcttagttcatgtgttcttttctcagcgggcaacgtctaagattccaggtgctacagacttggggttgatgcctaggaaaataactaaagttgccattctaggtggtgggcttatgggttcaggaattgcaactgcgatggtattaagtaactatcctgtgctacttaaagaagtaaatgagaagttcctaactgctggaatcaacagaatccaagccaatttgcagagtcgag

SEQ ID NO: 1697 - DNA, 408 bp, Zea mays
  Clone ID: LIB143-043-Q1-E1-D6
atcacacatctggacaacaggcagcttctgatcaaatcaaaccccggcgaagttgttaaacctgaccaattcaaggcgataaacgacgaggggatgcctatttaccagaggcccttcatgaaggggaagctctacattcatttcacagtggagttccccgactcgctggcgccagagcagtgcaaggctctcgagtcggtacttccgccaaagccttcgtccaagctgacagacatggagatcgatgaatgcgaggagacgaccatgcatgatgtgaacaacatcgaggaagagatgcgcaggaagcaggctcatgctgctcaggaggcctacgaggaggatgacgagatgcctggcggagcccaaagagtgcagtgcgctcaacagtaagcagactaccataatggg

SEQ ID NO: 1698 - DNA, 403 bp, Zea mays
  Clone ID: LIB143-043-Q1-E1-D7
agtcatatcaagccacagtatgcatcttggtgttcttgcaacagcatggcatgcagtgaacactgggagtatgttcactgtctactacaaaccaaggactagtccagctgaatttgtggtctcgcgagctaggtactgtgaatcactgaaacgaaattattcaatagggatgaggtttaggatgagatttgaaggtgaagaagcggcagagcaaagattcactggcacaatagttggaatatgtgtttctgatccatctggctgggctgactcaaaatggcgttcccttaaggtgagatgggatgaagcttcttctgttcctcgtcctgaaagagtttctccttggcaaatagaacctgctgttagcccatctcctgtgaaccctcttccagtcagattcaag

SEQ ID NO: 1699 - DNA, 436 bp, Zea mays
  unsure at all n locations
  Clone ID: LIB143-043-Q1-E1-E1
accggtctagtattcccgggcccgcaaggacgacgtgatccccaccttccgctccaacttctcctcgctcctcgccaccgtggaggcggagctggccaagggcggcaaggccgagttcaacaagctcaacgacgtcacctccttcgacttcatcggcgaggcctacttcggcgtgcgcccctcggcgaccgagctcggcaagggcgggccgagcaaggcggccaagtggctcatctggcagctccacccgctggtcacgctcggcctccccatggtcctggaggagccgctgctccacacgttccacctcccgcctttcctcgtcaagggcgactacagggcgctgtacaagtacttctccacggtggcgaagcaggcgctggacaccgccgagggcctgngcctgtcgcgcgaagaggcctgccacaacctcctc

SEQ ID NO: 1700 - DNA, 432 bp, Zea mays
  unsure at all n locations
  Clone ID: LIB143-043-Q1-E1-E11
aggggacatgcctgcgacaacaggaagcggatgcttcgaatgcaacatctgccttgattttgcatcagaaccagtggttactttctgtggtcatctctactgctggccttgtatctacgagtggctgcgccctggggtggagtcagctgccagcgacaacagcagttcggcaaggcggcaatgtcctgtatgcaaggcaacactctcaacggacacccttgtgccactatacggccgtggaggcaactcaaagaagtcacttgatggcatggccatcncgcgccgccccatggtacaccgggagactgttgangagcaacagaatgcacagagcaatgtcaatgaccagcactaccaacagagcatggaagacaactctcagcgccagccattgctgcaagcgcaccancatcccattcccactgggtttga

SEQ ID NO: 1701 - DNA, 87 bp, Zea mays
  Clone ID: LIB143-043-Q1-E1-E12
ctcccaggtcaatacaagactctagacttagtcatcacaaggtgtggcatgttctgtattttatgtctgtataatgcatccaactac

SEQ ID NO: 1702 - DNA, 108 bp, Zea mays
  Clone ID: LIB143-043-Q1-E1-E2
gagtcgtattaaccatcttctcctcgctcctcgccatcgtcgaggccgctctggtcatcggccccaacgtccccttcagcaacctgcactaggtcacccccttcggct

SEQ ID NO: 1703 - DNA, 406 bp, Zea mays
  Clone ID: LIB143-043-Q1-E1-E4
agcagcctccaaagccactcccaaacccccgcttccagaaccttctcgaagctccccgccgcctcctccactcgcaccgatggcgaaggaaccaatgcgcgtgctcgtcactggcgccgcaggacaaattggatatgccctggttcccatgattgctaggggtgttatgcttggtgcagaccagcctgttattctgcacatgcttgacattccgccagcagctgaagcccttaatggtgttaagatggagttggttgatgctgcgtttcctcttctgaagggagttgttgctacaactgatgttgtggaagcctgcactggggtcaatgtggccgtcatggttggtggattcaccaggaaggagggaatggaaaggaaagatgttatgtcgaaaaatgtttcaatc

SEQ ID NO: 1704 - DNA, 401 bp, Zea mays
  Clone ID: LIB143-043-Q1-E1-C8
agagcagcgatccgaagctcaatcaattcactcaaacctcttccccaaatcttcgattagattctcgttgacaagaagactagaaccgaacctgaccatgtcgctgatccgccgcagcaacgtgttcgatcccttctccctcgacctctgggacccctttgagggcttccccttcggctccggcagcagcagcagtctcttcccctcgttcccgcggaccagctcggagaccgcggccttcgctggcgcgcggatcgactggaaggagactccagaggcgcacgtgttcaaggccgacgtaccggggctgaagaaggaggaggtcaaggtggaggtcgaggacggcaacgtccttcagatcagcggcgaacgcaacaaggagcaggaggagaagacggaca

SEQ ID NO: 1705 - DNA, 397 bp, Zea mays
  Clone ID: LIB143-043-Q1-E1-A6
agtgttgggcagatcattgcgcaactcctgtcagagcggttaattccttttgttgcccttgatgttagaagtgatcgggttgcagttgggcgtgcacttgaccttccggtatattttggggatgctggaagcagagaggtactgcacaaagttggagctgaaagagcttgtgctgctgcaattactttggatacccctggtgcaaactatagagctgtctgggcattgaacaaatatttcccaaatgtgaagacatttgttagagcacatgatgttgatcatggtgttaatttggagaaagctggtgcaacagcggttgtccctgagaccttggagccaagtcttcagctagctgctgctgttcttgcacaagcaaaactcccaatgtcagagattc

SEQ ID NO: 1706 - DNA, 430 bp, Zea mays
  Clone ID: LIB143-043-Q1-E1-A8
ctcgcgggccgacccacgcctctaaggtaagtaataagagagctgctgaaagttccgtgctgaaaactcctctatctgataagaaagcaaaggttgccacaccgtcatctcagaagacaggtggcaagaagggcgccgcggtccatgtggcaactccacacccagcaaaaggcaagaccattgtaaacaatgacaaatcggtcaagtctccaaaatctgcgccaaaatctggtggctcggtcccttgcaaatcgtgcagcaagtcattcatcagtgagacggcacttcaggctcactcgaaggcgaagcatgggggcaagtgagtcgcaggtccaatagagtccgcaacaaatgcgaaacatgggagaggagggtaagcgagagtctcgaaagagtgtcggtggaagtaggcctaaccttattttgttta

SEQ ID NO: 1707 - DNA, 421 bp, Zea mays
  Clone ID: LIB143-043-Q1-E1-B1
acgggccgacacacgcgtccaccaaaaattccgaggttttcacctcttggagcgcaccaacaccacccggagaccggagcgactcgccaccggcgcggaaaaggagggcggaggctcgatggcggatgagaatcaggctggaaagaaagaggaggaggaatttagcacaggccctctgtcagtcctaatgatgagtgttaagaacaacacccaggtcctcatcaattgccgcaacaacaagaagctgcttggccgtgttcgtgcttttgatcgccactgtaacatggtgctcgagaacgtgcgtgagatgtggacagagatccccaagactggcaagggcaaaaagaaggctctgcctgtgaacaaggatagattcatcagtaagatgttcctcaagggcgactcggtcatcatagtgctg

SEQ ID NO: 1708 - DNA, 391 bp, Zea mays
  Clone ID: LIB143-043-Q1-E1-B10
tatccaaacgtaagcaaaccagtccggcaaagccttcgcctccgctccccagtcccacccgcaccctagccctcagcaaaccctaaccgctcgtcgccatgaaggacacctcgttcaaggccaccggcgccaagcgcaagaaggtcggcggcgccaagcgcgggctcacccccttcttcgcgtttttggctgagtttaggccgcagtacctggagaagcaccctgagctcaagggcgtagaggaggtgagcaaggccgctggggagaagtggcgctctatgtcggatgaggagaaggccaagtatggcggtagcaagaatcatgatggcaaagcaagcaagaaggagaacactagctccaagaaggccaaagctgatgttccggagggaga

SEQ ID NO: 1709 - DNA, 413 bp, Zea mays
  Clone ID: LIB143-043-Q1-E1-B11
agcgccgtggctggaacgcgaaggaggacgaggaggcgctgcacctgagggtggacatgccgggcctggggaaggagcacgtcaaggtgtgggcggagcagaacagcctggtgatcaagggcgagggcgagaaggaggatagcgaggacgaggccgccccgcctccgagatacagcggtcgcatcgagctcgcgccagaggtttacaggatggacaagatcaaggcggagatgaagaacggcgtgctcaaggtggtcgtgccgaaggtgaaggagcagcagcgcaaggacgtgttccaagtcaacgtcgagtagatgtttccaaatagaagcaagtgccggtacgggatggaggattggagcctggaggggcactgccaaactaagattcctctctctcaatctgatctggat

SEQ ID NO: 1710 - DNA, 374 bp, Zea mays
  Clone ID: LIB143-043-Q1-E1-B3
caattccctagaatgagtcgtctcacttactacttttcttggttcatccatggtataggatgtgactgtcagcctgggccctaacggcgagctccggtacccaccatacccgccggggaaccagggcgccgatggctacgccggcatcggcgagttacagtgctacgacaagtacatgctggcccggctgaagcggcacgccgagttgtcggggcagccactgtggggcctgtcaggcccacacgacgggccgcggtacgacgagtcgccggagacgtccgccttctttacggagccggggggctcgtggaactcggcctacggcgagttcttcctgtcctggtactccggggagctgctgggcgcacggcgac

SEQ ID NO: 1711 - DNA, 271 bp, Zea mays
  Clone ID: LIB143-043-Q1-E1-B4
acgagctcttccagtgaggagtacccattggggcgggcttcaccaccgccgggcatggccggggcgccacatctacgggccacgcagccgcccccgcggatcctggccgagccgctgctgggcttggtcgcggcgcctccgcagccgcccccgcggatcctggccaaggcatcgccgccgcggagcttggtcgcggcgccactgcatccgaccccgcgtatcctggtcgaggcgtcgccgccgctgggcttggtcgtggcgcctcgccgcc

SEQ ID NO: 1712 - DNA, 264 bp, Zea mays
  Clone ID: LIB143-043-Q1-E1-B6
acgccattgcagcaagtctgtatgatctgtgacagctgtcgatagagttatcacacacattcgttattcgttgaactacaaccatggcgaggccgtccgaccaaagcgtccacgtcctccttctcccattccccacgcagggccacatcaacccgctgctccagttcggcaagcggctcgccggccgcgctggcgtccggttcaagctccccgccaaccgcctcctccgtaactccacgaaacccaaccccaactccgttcaag

SEQ ID NO: 1713 - DNA, 429 bp, Zea mays
  Clone ID: LIB143-043-Q1-E1-B7
ctcgcgggccgacccacgcctctacccacacgtctggaacggctccgctaccggcggcggagccggcaacggggcgggcgccgcgtcgaacggaggaggtgttgagaggaggctgaggtcctcggctgcgcccgcgtcgtgggcagcccagcttcccctggaggtgggcacacgcgtgatgtgccggtggcgcgaccagaagctccaccctgtcaaggtcatcgagcgccgcaagggctccgcttcctcttcccccgctgactacgagtactacgtccattacaccgagttcaatagaagacttgacgagtgggttaagcttgagcagcttgatcttgctactgtcgagaccgatgttgatgagaaagtcgaagataaggcaacaagcttaaagatgacacggcaccagaagcgtaaaattgatgaaac

SEQ ID NO: 1714 - DNA, 396 bp, Zea mays
  unsure at all n locations
  Clone ID: LIB143-043-Q1-E1-C1
gaaagcggagggaaaagcgagggaggcagccttctattttctgtcaaaacaagggcgatactcctcctactccagcgcacacgcagatcagcgtcgaaatccgtcgcatcgtgcccgcctcgctgtctccgctgggcgctggtggtcatggcccgcagggcgctggagctcgcggcggttctgctcgcgctggcggcgctggcggccgtggcggccggaggggacatcgtgcaccaggacgacgaggcgcccaagatccccggctgctccaacgacttcgtgctggtaaaagtgcagacctggattaacanaaaagataaagatgagtttgttggtgttggtgctcgatttggccccaagatagagtcaaaggaaaagcatgccaactggacaaac

SEQ ID NO: 1715 - DNA, 405 bp, Zea mays
  Clone ID: LIB143-043-Q1-E1-C10
accacgcgtccggccaaaaaaaaccgtatcgtctcgcctgttcagtttccttctcctcttcccgcagcccggtttgccgaccaggttccaccgttccagagtagccaagcgaatcccgtgtctggttcgcgcgatggcggaggagcagtccaacccccagcaccagcaagcggaggagagggaggttatggtggagcagcagcagccgaggagggccccgaagctgaggtacctggacttcgtccaggtggcggctgcccaggccgcggtgtgcctcgctgggctctacggcctcgccaaggaccacgccggcccgctccgccccagcgttgacgccgtcgagtctgccgtcaagggcgtcgttagcccccgtctacgaccgcttcggcggcctgccgctcgacg

SEQ ID NO: 1716 - DNA, 341 bp, Zea mays
  Clone ID: LIB143-043-Q1-E1-C11
agaacatttctgtgaaaactcttcctgctaatacttttcctgaagatgtgttactatatatttgtactgttgcgtaacattctctatgtggagaattgctagctgcttgtgtcgagcagttttagtttaggaaacactatgaggtctggtaaacagttgagtctgcattttgaataagtagatggccagatatctgcctgggatccttaaatgtcttcttctattctatctgaaattgccttcgccttgctgccgtctatgattgctcaaatgtaagatggtgcacctgtgttgccttggggtgtgaaagcattattgggtaattgtatgtacctttttcc

SEQ ID NO: 1717 - DNA, 431 bp, Zea mays
  Clone ID: LIB143-043-Q1-E1-C3
tcgcgggtcgacacaagcctctacacagattcactatgatgcaagatgagtttgagcaaccattagttgatgctagctatgatgggcaagaaaactctgatagcccagtttctcatccagcattagatacaaaggggctgttgcacacagaagatcagcacaatgtggtacaggtagatgaaagtgaattcaagaactcaacatctgggatcacaaaggaagaggtccatgcagccgatttcaggcatgaacaaggaattaacaccacaatggcgatcagcagtcgaactttaaaagctcagcagaagaaagatgacaacctattctggcttgtccttaaggcatttgttgttgctatatcgaaaatttgggcaaaatgaacagtgcagaaaggcaccttacgtggaactgaagatcgagtgtgatacctt

SEQ ID NO: 1718 - DNA, 375 bp, Zea mays
  Clone ID: LIB143-042-Q1-E1-G9
tagactgagtcgtattaggcgacaccatcacgggctacggcgtcgcgcgcgtggtcgactcctccgacccgcgcctcgcgcccggggacctcgtctggggcatcaccggctgggaggactacagcgtcgtgacgccgcccgccaccaggctcctctccaagatctcccaccacggggccggggagggggcgggcgtgccgctgtcctactacaccggcatcctcggcatgccggggctcaccgcgtacgtgggcttccacgagatctgcgcgccgaagaagggcgagaccgtgttcgtgtccgccgcgtccggcgccgtcggccagctggtgggccagttcgccaggctcgccggctgccacgtcgtcggcagcg

SEQ ID NO: 1719 - DNA, 291 bp, Zea mays
  Clone ID: LIB143-042-Q1-E1-H1
ctctagaagtatggttttaagaagagatgaccgagaagatggagctgtgtgtggttcactttggctgtgtggtctgttctatggcactgaatactgagagtaggcagctgagacagcagctttgtattcctgttatggtttgataattgatactcgcatggaaatacagctgtgatatgcgttgtaataactaagtccaactgtatgatgcaagagactgcttatgtaatctgtgcttgatggtaatggttatgaatggacttgaaatattggcacgatagctgtcatcat

SEQ ID NO: 1720 - DNA, 129 bp, Zea mays
  Clone ID: LIB143-042-Q1-E1-H2
tctgcgcacggacagtgcaccagcctgcttaagtatgctgggcatgatggacctggttagcactggccttgaatgatcggcacgatagctgtcatcagagaaagttgccgcagagtccaaagaaatagc

SEQ ID NO: 1721 - DNA, 445 bp, Zea mays
  Clone ID: LIB143-042-Q1-E1-H3
gggtcgatacaagcctctaaagtgcgtcgtaccacctcaacccttcggacctccgcctcccaccgcttccgtagcctcgcgccctcgcctcgcctcgcctcgtccttctcctccgtcccaaccatgagggagatcctgcacatccagggcgggcagtgcgggaaccagatcggtgccaagttctgggaggtgatctgcgacgagcacggcatcgaccacacgggcaagtacgccggcgactccgacctccagctcgagcgcatcaacgtctactacaatgaggccggcgggggccggttcgtcccgcgcgccgtgctcatggacctcgagcccggcaccatggactccgtgcgctccggcccctacggccagatcttccgccccgacaacttcgtcttcggccagtccggcgccggcaacaactgggccaagggccactacaccg

SEQ ID NO: 1722 - DNA, 398 bp, Zea mays
  Clone ID: LIB143-042-Q1-E1-H4
tccaaatctactgaggcagccgccccttgtagaagcttcgaggctgctgctgctgcgcccatggccgcggaaggcaagacgccgtccctcgccgaggagtattcacttccaccacaggaagttccagtggaaaaggcagctgaggagaagccctctagtggtactgagtctgaagctgctccctcaaccaatgatgaaactcctccatctgtagaagacaagaatggaacttctgaagtacaagatgctgctgaaaatccagaggcagaagaaactaacactgctgcagaggaaacacctgctgtagaggaagcaagtgagactaccgatgaggaagaggctgagaaacctgagatcaagatcgaaacagctccagcagattttcgtttcccaacaac

SEQ ID NO: 1723 - DNA, 407 bp, Zea mays
  Clone ID: LIB143-042-Q1-E1-H5
taccattgctcatggtatggcgtttggcacgggtagtgccatggcacacagggctgttgatgctgtattaggtccccggaccattcagcatgagactgttgcctcagaagctgctgctgctgcccctgcccctccagtgatgaatgctgatgcttgcagcatccattctaaggctttccaagattgtctcaacaactatggcagcgagatcagcaattgccagttctacctagacatgctgaacgagtgccgccgtggtggtgtgtctgcctaagctgcctctgggattattcatggattttctttcggtgatgttatctcattaataagataccgtgaaacttttgtctccacagcttgaagctaaacttcctgggattaatacattttgttatcctatgctgttg

SEQ ID NO: 1724 - DNA, 407 bp, Zea mays
  Clone ID: LIB143-042-Q1-E1-H6
aaagcaacatcgcatcagcacaagcaagaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgaggcggccaccgatggcggcggctgcgactgcaacacctgcaagtgcggcaccagctgcggctgctcctgctgcagctgcaactgagctggcccggcccggcgatggcgcacgagagtcgagaggacgacgacgacgacgacgcgtataaatataatagcggcgtccagtaaataagatcctgt

SEQ ID NO: 1725 - DNA, 433 bp, Zea mays
  Clone ID: LIB143-042-Q1-E1-H7
agctcatccttgcttaattaccaaggtacctttgcagctgcaggtaggtaggtagctagccgccatagcaagctaggccgaagcagaggagtgatggccaaggtccaccccaacgccgcggagtccgtcgtcgccccagcagtagcaccagtaggctccgcccaggcagaggccgagggagagctgcccacggtgctgacggtgtggcgcaagtcgctgctcttcaactgcgacggcttcaccgtctacgacgcccgcggcgacctggccttccgcgtggactgctacgccggctcgttccgccgccggcgccgcgccgacgtcgtgctcatggacgccacggggaagccgctgctcaccgtgcgccgcaagacgcggctcggcttagcggagcgctgggtcatctacgacggcgacgccgacgccgacgacg

SEQ ID NO: 1726 - DNA, 428 bp, Zea mays
  Clone ID: LIB143-042-Q1-E1-H8
catattattctgaagattcggcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaacaaaaatgaatggggatggtgcaagcaaaagcttggtgctaatgcgattctggctgtgtcattagctgtttgcaaagctggggctagcatcaagaggattcct

SEQ ID NO: 1727 - DNA, 249 bp, Zea mays
  Clone ID: LIB143-042-Q1-E1-H9
tgagtcgtattatcgtagtcaggcgggtgtgcaggtcgcccgcgctccaacagcatggagacggtcaacgttgtcatcctctcgttcttcttcatctttgctgtcgagcgtttctttaaacgcctcgatatcaggagcgggaaggtgaagcctctgccagtgggcggtctagccagcgcggtcctctgccacctgtaagtcctcgtctataggaatattcagcacatgttcacgcgcctctctgtgcgc

SEQ ID NO: 1728 - DNA, 366 bp, Zea mays
  Clone ID: LIB143-043-Q1-E1-A1
taagttacccctttaaagactgcacttttaaaggacttctatgtaatggatgggagtaatcttcagattttattttatttcatgtttatattatgttagttattttgcatgatggcttattgttcagtacaatttgttcttgtttcattgttttcaacaagactcaacttttattctggctattgaactgtgagggtactggtagattgcttgaaccttttattgttttgttatttgactacatgtcaacatcaatcatagaaatgcatactatgcattgttgggaaggatcagaattaacagagagtgaatgtaagcataaactgaaaagtaaatataaatgcttcaagtgcagatcataataca

SEQ ID NO: 1729 - DNA, 423 bp, Zea mays
  unsure at all n locations
  Clone ID: LIB143-043-Q1-E1-A10
gggtcgacacacgcctctaaccacacgtctgcccacgcgtccgggaaccctgaggagatcccgtggggttcggttggtgctgaatatgttgttgagtctactggtgttttcactgaccaggagaaggctgcagctcacttgaagggtggtgccaagaaggttgtcatctctgctcctagcaaggatgcccccatgtttgtcgttggtgtcaacgagaaggagtacaagtctgacattaacattgtctccaatgctagctgcacaaccaactgccttgctcctcttgctaaggtcatcaatgacaagttcggtatcgttgagggtctgatgaccactgtccatgccatcactgctacccagaagactgttgatgggccctcgtctaaggactggangggtggaagggctgctantttcaacatc

SEQ ID NO: 1730 - DNA, 412 bp, Zea mays
  Clone ID: LIB143-043-Q1-E1-A11
ctctacactgagtcgtcatcatctcgcgtatcctaccaggagggtgggagacccagggagcggaggtgtgcgaagctcgcctcgcaccacgcgctgcggcctgcggggcgagagatcggggcctgagctagggtctggtggcggagatgtcgacgccggcgaggaagcgcctgatgcgggacttcaagcgcctgcagcaggacccgcccgccggcatcagcggcgcgccgtacgacaacaatatcatgctctggaacgccgtcatattcgggccggatgacacgccgtgggatggaggcacgttcaagctgactctgcaatgtacagaagattaccccaacaaacctccaactgttcggtttgtttcgatgatgtttcatccagacatctatgcggatggaagcctcggttt

SEQ ID NO: 1731 - DNA, 282 bp, Zea mays
  Clone ID: LIB143-043-Q1-E1-A12
acacacgcatctaaaatcagtctctatatggtgctccgtctcaggggtggtatgcagatctttgtgaagacactcactggcaagacaatcacccttgaagtggagtcttcggataccattgacaatgttcaggccaagattcaggaccaggaagggatcccaacccaacaacaaggcctaaacctcgccgggcacccatctaaaagaggcgcgcaccctggcagattacaagacccagagggagaacactctaccccgggcgctcccccacaggtgtgacat

SEQ ID NO: 1732 - DNA, 427 bp, Zea mays
  Clone ID: LIB143-043-Q1-E1-A2
tcgcgggtcgacacaagcctctacaatacatcataccaagcaacaattgagcgatcgatccttcgcctctctctcactctctctcagcaatctatccgcaacaactaagcattcgattctccgacaacaacaagcagggcaatggcgtctgcggacgtgcacatggctggcggtgcggagacggagaccttcgcattccaggccgagatcaaccagctgctctccctcatcatcaataccttctactcgaacaaggagatcttcctcagagagctcatctccaacgcatcggatgcgcttgacaagatccgcttcgagagcctgacggacaagtcgaagctggacgcgcagccggagctcttcatccggctcgtctcggacaaggccagcaagacgctgtccatcatcgactccggcgtgggcatga

SEQ ID NO: 1733 - DNA, 380 bp, Zea mays
  Clone ID: LIB143-043-Q1-E1-A3
cgcctctacacatgagtcatattaagaaggccagcgagtgaggccgtgcgcacgcagcggcggcggccagggcccaggccccaggggatcggcgtgcgcgcgtggcggggtagtctctcgcgcgcgtacatggcagtatgacacgggattgtgctgttcagtacgctacggttactggcgtctctctgtgtgtgtgtgtgtgtgtgtcgtacgtagcccggtacgtagctagcagtgactgtcgcgtggacgtgtccggtgcgggctgcgagtgacgtgggctaaataaagtgtgcgtcgggtggtaatggtggtggggcccggtgtcagtgcgcgcggtgccccatgcctgccgcggctgcagcttgttgtgtcctgtg

SEQ ID NO: 1734 - DNA, 405 bp, Zea mays
  Clone ID: LIB143-043-Q1-E1-A4
agccgccgtcgccgcagccgtgacggaaggaagaggaggagcaaggagcacgacgcgatgggccactccaacgtgtggaactcgcaccctaagaactacggccctggctcccgcgtctgccgggtctgcgcgaaccctcacggtctgatcaggaagtacgggctcatgtgctgcaggcagtgcttccgcagcaacgccaaggacattggtttcatcaagtaccgttgaagaggccactgtgctgctgtggagaacttcctacatcaaagaaatgggtccttcattagaaggcctaatttatgcgctttagctttttgttcagaacttgagactcatgtgttaaactcgacttgttaaagttttgatggctactttgtgcttgttggaccagctataatcagaaga

SEQ ID NO: 1735 - DNA, 451 bp, Zea mays
  Clone ID: LIB143-042-Q1-E1-G8
gatacacgcatctacacacactctcctcaagctcagggtccggcggcgaagggaaggcaagatgtacaccgcgaggaagaagatccagaaggagaagggtcttgagccctccgagttcgaggactccgttgcccaggctttctttgatctggagaacgggaaccaggagctcaagagcgacctcaaggacctgtacatcaacaatgctatccagatggatgttaccgggagtaggaaggctgttgtcattcacgtcccataccgcctgcgcaaggccttcaggaagatccatgtcagactcgtcagggagctggagaagaaattcagcggcaaggatgtggtaattgttgctacacggaggattgtgaggccacccaagaagggttcagctgttctgcgccctcgcaccaggactctgactgctgttcacgatggcatcttggaggatgtt

SEQ ID NO: 1736 - DNA, 435 bp, Zea mays
  Clone ID: LIB143-042-Q1-E1-F6
agaagtgctcatatggaggtgctccaaaaggccctcagctaagagagctggagcgtggtgctgacattcttgtcgcaactcctgggagattaaatgacattttggaaatgaatagagtgagcctgcaccaagtatcatatctggtccttgatgaagctgaccgtatgctcagcaaatatcattagtacaagtatattagacccctccagctaccttaccgacgcatgaacgagaagacgggttagactttgtcgaagccctcttcgccagtggaggtatcgaccatcactcgtcactgtaacccgatggtgatcggcgatcgtgagcttccatgttattgtgttatgatacttgagacttttattatgactatgtataagatactgtctcttattagtattggatgacatgtgtattattatgactatggatgag

SEQ ID NO: 1737 - DNA, 448 bp, Zea mays
  Clone ID: LIB143-042-Q1-E1-F8
gtcgatgcaagcctctacagtgagtcggatcattcctgttcctgggtccgactggcgtggggaaaactgagctagccaaggccctagccgaacagctgttcgacgacgagaaccttcttgtccgcatcgacatgtcggagtacatggagcagcactcggttgctcgcctcatcggagcaccgcctggctacgtcggccatgaagagggtgggcagctgactgaacaagtgaggaggaggccgtacagcgtgatcctgttcgacgaggtcgagaaggcccatgtcgccgtgttcaacaccctgctccaggtcctcgacgacggcaggctgacggatgggcaaggcaggacggtggacttcaggaacactgtgatcatcatgacatcgaacctcggcgccgagcacctcctcgctgggatggtgggcaagaactccatgaaggtcgctcg

SEQ ID NO: 1738 - DNA, 384 bp, Zea mays
  Clone ID: LIB143-042-Q1-E1-F9
atctggttggaaggtttggagaaactccccggctcgaggagatcgtgacattgagaggacgatgggagggcgcgcgctcctcctcctcctcctggtctcggcgttggtctttcagatccacgcctccgacccgctgctgtacgagccgttcgatgaggactttgaggggagatgggtcgtctccaagaaggatgaataccaaggtgtgtggaggcatgccaagagtgatggtcatgaggactatggcctccttgttagtgagaaggcaaggaaatacgccataatcaaggagcttgatgagccagttaccttgaaggatgggacagtggtcctgcagtttgaagtgagacttcagaatggccttgaatgcggaggtgcctacat

SEQ ID NO: 1739 - DNA, 428 bp, Zea mays
  Clone ID: LIB143-042-Q1-E1-G1
aaaagcttgctgatgaacgacttctacgcgggtgaaggcacggaccacagcggcgttccaacaaaattggtcacaacaaactgttctctgcacatagctgtctacaaccctgccacaatgtttggaattcatgtcacttctggccccatccacctgatgtattcagagatcccaatagcagtcggtcaggttcggaggtattaccaaccgaggaagagccaccggatggtgacggcggtcatccacggcgagaaggtgccgctgtacggcgccgggggcagcctgatgctgtcgacgagcacgggcggggcggtgcccctgacgctggacttggacctgacctcgcggggctacgtgatcggcaagctcgtgcgggtgacgcacaaggtgcacgtgacgtgccccgtcgtcgtggacgccaagaagac

SEQ ID NO: 1740 - DNA, 415 bp, Zea mays
  Clone ID: LIB143-042-Q1-E1-G10
tcgatacaagcctctagattcagtcagattattcagagagtgcagcggagcattttgcactctgacattcaatcgaaggcagacaagactcctgttacagttgcggattatggatcacaggtactggtatgtctggtcctgaagaaggaattgccttctcactctttctcaatcatagctgaagaggattcaaaagacttgagagaagatggtgcccaagaaattatagaacacattaccaccctcattaatgaaaccatcgtaaatgatggttcatacaacatgtcgttatctaaggaagatgtgctttctgcaattgatggtggtaaatctgagggaggtccatctgggcgacattggatattagacccaatagatggcactaaagggttctgcaaaactaagcctgccaaat

SEQ ID NO: 1741 - DNA, 440 bp, Zea mays
  Clone ID: LIB143-042-Q1-E1-G2
attaatctcactggacgatctgctaacacaaacagcagcagctcctcctcactagctagccttctctatttttgctactgcaagtgtccaagtctgcgacgacgtccgagatgtcgacggtgagccgtgcatcccttgaccagaagcttgccctcgccaagcgctgctcccgagaggcgactcttgccggagctaaggcggcagcagtggcgactatcgcctccgcgattcccaccctcgcgagcgtgcggatgctgccgtgggccaaggccaacatcaaccccaccgggcaggcgctcatcgtctccacggtggccgggatggcctacttcatcgccgccgacaagaagatcctgtctctggcgatgcgccactcgttcgaggaagctccggagcacctcaagaacacctcctttcacggcaccggacgcccccatccg

SEQ ID NO: 1742 - DNA, 435 bp, Zea mays
  Clone ID: LIB143-042-Q1-E1-G4
ctctataaccggcaccaaccaacgccgcgccacggggaaccgttaccccctccccccgggaaagcgaattggcgacgggagctgacggccgcgcagctgcgcgcgtacgacggcaccgacccgtccaagcccatctacgtctccgtccggggcaaggtctacgacgtcacctccggccgcggcttctacggccccggcggcgcctacgccgtcttcgcgggccgcgaggccagccgcgccctcggcaagatgtccaaggacgaggccgacgtctccggggacctctccgggctcaccgacaaggagctcggcgtcctcgccgactgggagaccaagttccaggccaagtaccccgtcgtcgcccgactcgccgccgacgcctgaactcggcagtctcggtgtaaatttactctgtcctgcctcttgcggtgttca

SEQ ID NO: 1743 - DNA, 426 bp, Zea mays
  unsure at all n locations
  Clone ID: LIB143-042-Q1-E1-G5
atcactaatggagaagtggcagatttgccactggaattcccagatggtacaacccctgttacttgtcgggtttgtatatatgatagctcgacagatagcaaggttggggttggatctttgatggacaaagcaatggtacctgcactgcctgcaggcagcctgtatatggaggaggtgcacgcgaagcttggtgaagaactttggttcacaataggggggcaacatattccttttggtgcatcaccacaggatgtctggactgacttgggtcgtccttgtggtatccatcagaagcaggtggaccaaatggtcatacactccgcatcagaagccaggcctcggacgaccctttgtggagattacttttacaactacttctcgcgtggaattgatatcttatttaatggacagacacatangataaag

SEQ ID NO: 1744 - DNA, 426 bp, Zea mays
  Clone ID: LIB143-042-Q1-E1-G7
atccgcacctctctccatctccctgctcctccgccttcttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggtcatgccaaatgccactttgttgccatagatatattcaacgggaaaaagctcgaagatattgttccttcgtcacacaactgtgatattccgcatgtgaaccgtactgagtatcagctgattgatatatcagaggatggatttgtgagccttcttacttcagatggcaacactaaggatgaatctagactcccaac

SEQ ID NO: 1745 - DNA, 442 bp, Zea mays
  Clone ID: LIB143-042-Q1-E1-F4
ctctacactaaatccgttgcagagaataacgatcagggagatcaggaaccacccctggttcctgaagaacctgcccagagagctcacggaggctgcgcaggccatgtactacaagaaagacaacagcgccccgacctactccgtccagtccgtggaggagatcatgaagatcgtggagaaggcgcggacgccgcctccttcctccacccccgtggctggcttcggttgggcggaggaggacgagcaggaggacagcaaggaaccagacgaggaacacgaggacggcgaggacgagtacgagaagcaggtgaagcaagtccacgccagcggggagtttcatctcagctgctgagggttttcgccggcctgctagtctgtggtaccagccgatgatggacctgctagtctgtggtcttgttttcaagttttctttcattttttt

SEQ ID NO: 1746 - DNA, 444 bp, Zea mays
  Clone ID: LIB143-042-Q1-E1-E1
cgggtcgagacaagcctctacagtaagtcgtaccattccgcaagaccagatcgcccgcttttctcctccggtcctctcctccctcccctctcccctgagccctgatcgaatcgatccacggtgccggcggacgcctcgacccctccagttccatccaatccacgagtgaacagatggcgtcgcagtgggctgctccgccgccgggctactcggccgggcacgggcaggcgtacggcgaccagcagctggccacgccgccgcctcaggcagcgacggccgtggccgtgacggcggcgagcaacggcgtgggcaacccctacgtcgtcgtcacccccgcgtctgccgcaccgtccacctgccagaccgtcaggaatgcgctgggccgctacggcaagctgctcgaggacggaacccgcaaagccgccgacgccaccgggaacatct

SEQ ID NO: 1747 - DNA, 148 bp, Zea mays
  Clone ID: LIB143-042-Q1-E1-E10
atacaagcctctaaaatgagtcattgtaggaagttgaatggaatgccgtcaatgtcggacaactctcaactaggagaagaaaaaaaaaacatggttgccagcaccatgcatgtgcaccaccattcgttttttaatgtcgtcctcattg

SEQ ID NO: 1748 - DNA, 313 bp, Zea mays
  Clone ID: LIB143-042-Q1-E1-E12
tcgatacaggcctctaaacatagtagacatcaacccagttgtactaaatgatccttgtgaggatggtgtgttagcacttagctctggtaattagcttcggtgttattacttgacatctgttgtccagttgtgatatctgtgaatttcatctattaaatatatgtagataagatttaatagatgaaattcacagatatcacaactggacaacagatgtcaagtaataacaccgaagctaattaccagagctaagtgctaacacaccatcctcacaaggatcatttagtacaactgggttgatgtcgtttgtgag

SEQ ID NO: 1749 - DNA, 436 bp, Zea mays
  Clone ID: LIB143-042-Q1-E1-E3
acaacaccctaaagtatgtcgtattatcagcagcccgtgctgctgcaaaccttgcacaactgcgcatttcagacctgaagaagaattccaaggtttatagcaattacggtgatagcgtccaaaaggaaagccatcatcagactgaggcgacacagaaaccggtatttgatcaccaggactccttcaccaatgatacacatgactatgtgtcatcccatgtgccgcagaggtcgtcatctttggaggacgatccatatttctcgtatcccaacttgttctcagcgccaaagccctgaaggcggaaactagtggtctgcaagtagttgttcagaatagtctgaaacatgagatatcactttttcagctctgtccggtcctcttatgtttggtcttttctgctgcctccgaaaattctgtgtatgttgagttggtacat

SEQ ID NO: 1750 - DNA, 407 bp, Zea mays
  Clone ID: LIB143-042-Q1-E1-E4
cttacaacactctgacgtgagtcgtattatcagtgagtacagcagcagcagctgagagcgtgcgaagcaggagggaggacaagaagaagccgatggcggttgtgagcggcagcggcgggaagctgaacccctgggcggagcccttcgttccttccggggcgcggtaccgcggcctgcggaccatggaggcgacgccggagcaggaggtggaggacttctcccccgagtggtggcgcctggtgtccgcctccccggccttccgcgaccgctggctgcgcgagtactgcgcgctcggcctactcgacgccgaggacgacctggacgacgacgtcgacagcttcctccccgacgacttcttctcgcccccggccccgcgccacgagagcgagcgggaggacgccgcgggc

SEQ ID NO: 1751 - DNA, 350 bp, Zea mays
  Clone ID: LIB143-042-Q1-E1-E6
cgcgggtcgatacaagcatctagagtgagtcataatacgttaataggagatactcggagtcgccagtacgacacattcctaatctgcactcgtgagtcagaactcgaccaacaatgtcgcggatacgccgtggatgcgcattcgacgccttcacacgtgagctctgggacaccttctagggctttcacgtcggatcaggtagcaggagtagcagcagacagtgctcctcgttcggatgcagcaccagctctgagacagtggtcttaggtggggttcgcgtataatggtacgatacgactgaagcgcaagtgtgcaagagtgaagtgccggtgctaaataaggaggatgtg

SEQ ID NO: 1752 - DNA, 450 bp, Zea mays
  Clone ID: LIB143-042-Q1-E1-E7
tcgcgggtcgatacacgcctctacaggcagtccaaataccgatcaaggacgatgcggcggcgaacgaggcggcactggagctggtgcgcaaggacaagctgagggaggtgcgcgcgggccacgacggcacgtgggcggcgcacccggggctcatcccggcgatacgggaggtcttcgagggccacctcggcgggaggccgaaccagatcggcgacgccgcagggcacgagggtgccagcgtgaaggaggaggacctcatccagccgccgcggggcgcgcgcactgtggacggtctgcggctcaacgtccgcgtgggcgtgcagtacctcgcggcgtggctggccggctccggctccgtcccgctgtacaacctgatggaggacgcggctacggcggagatcagccgcgtccagaactggcagtggctgcgccacggagcggcgctggacg

SEQ ID NO: 1753 - DNA, 436 bp, Zea mays
  Clone ID: LIB143-042-Q1-E1-E8
atccaccgaatatctgccaactgctggtgataagctagaggatatgactaatcaactgagaaaacggataatgaagaagcgcagagtcaaaactctttcatttgcgattaccaatgatgtgtgcatagaagtcaatacatatgcgctggtccgtcctactactacagggacaatcacatggcttgattcactaagtaacctcccattaaaggttgagaggtctttcatatgcaatgatactggggctctacttcaggatgcacagacacgtttccagatgtacaatgacacaattgtcaaattttctgtacgtgaactctctgaggttaaaagggttgcaagccatcatcttcgccttataggtttcaagccattggattgcttgaaagattaccataacttaagaccatcgacatttatttatccgagtgatgag

SEQ ID NO: 1754 - DNA, 416 bp, Zea mays
  Clone ID: LIB143-042-Q1-E1-F1
cgggtcgatacaagactctagattcactcctcactcaccggttcgggttcgggttcgtgaggttctccggggttcggtttcgtgggtgggcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggcta

SEQ ID NO: 1755 - DNA, 426 bp, Zea mays
  Clone ID: LIB143-042-Q1-E1-F10
tcgatacaagcctctagactgggtcgtatcaactccaatccaatcctggggcgggcgactgcctccttccctcgatctattctccatcttgtcctccctttgctaaaaataacgaggcagaggcatcttcgatttgacgtgcgcttcctcttcctcgctcgctctcggtcgcagtgatggctgatgtcgacgagtaccgttgcttcattgggaacctgtcctggtcaacgactgatgaaagcctcaaggatgcgttcagcaaattcggcaacctcactgaggcaaaggtggttcttgacaaattttcaggacgttctcgtggtttcggctttgtaacttttgatgagaagcaagccatggaggatgctattgagggaatgaatggactggacttggaccggaagaacatcactgttgaataagctc

SEQ ID NO: 1756 - DNA, 400 bp, Zea mays
  Clone ID: LIB143-042-Q1-E1-F11
tacaagcctctaaacagacgtcctgaggatcctatctggtataggacggagctgagcttctagcaacgtacagtgtatccgccatgagtcctttcggggcggtgatcacgccagaaaccctcaagtacatgtccaagtaccagggacgtgagatcacgcaggtggactgcgcacgggaggcgatgaggctgatccacgcggaagacaagaacctcaaggccgaggactcagcgtgggagctgaagaagaagttcggcaacggcgtgagcaccatggtcctcgtctacaacgccaccggggccagcctgagcctggtggacgacgggaaagactggatgggctccgtctacagctcgccgattccggacaccttccacaacgggcagtggatcgccttcct

SEQ ID NO: 1757 - DNA, 401 bp, Zea mays
  Clone ID: LIB143-042-Q1-E1-F12
ctcgctagtcgacacaagcctctagagacattcgcattagaccaaccccgtcgatccggctgcggcccggcgtgctagatcgctaccgatcatggtggtggaggagatcgccgagggggtgaagaacctcaccgttaccggagacgcggcggcttcaggcggagaggggcagaggaggggcggcggcggcagcagcaaccgcatccaggtgtccaacaccaagaaacccctcttcttctacgtcaacctcgccaagaggtatatgcaacagcacgaagatgtagagctatccgctcttggaatggccatagcaacagttgtgaccgtggcagaaattctgaagaacaatggatttgctgttgaaaagaaaattaggacctctactgttgaaataaacgacg

SEQ ID NO: 1758 - DNA, 431 bp, Zea mays
  unsure at all n locations
  Clone ID: LIB143-042-Q1-E1-F2
gagtcgtagtacgatctgctaacacanacagcagcagctcctcctcactagctagccttctctatttgtgctactgcaagtggtcaagtctgcgacgacgtccgagatgtcgacggtgagccgtgcatcgcttgaccagaagcttgccctcgccaagcgctgctcccgagaggcgactcttgccggagctaaggcggcagcagtggcgactatcgcctccgcgattcccaccctcgcgagcgtgcggatgctgccgtgggccaaggccaacatcaaccccagcggccaggcgctcatcgtctccacggtggccgggatggcctacttcatcgccgccgacaagaagatcctgtcgctggcgaggcgccactcgttcgaggaagctccggagcacctcaagaacacctccttccagggcaccggacgccccc

SEQ ID NO: 1759 - DNA, 424 bp, Zea mays
  Clone ID: LIB143-042-Q1-E1-F3
aggccggtggccgggagttccagctctacaaatcgggtgtcttcagcggaagctgcaccacgaaccttgaccatggtgtcgtcgcggtcggctacggcgccgagaacgggaaggactactggatcgtccgcaactcgtggggcccgaagtggggcgaggctggttacatccgtatggagaggaacgtcaacgccagcactgggaagtgcgggatcgcgatgatggcgtcctacccgacgaagaagggcgcgaaccctcccaggccgtctccaaccccgccgacaccgccggctgcccctgacaatgtctgcgacgagaacttctcgtgctccgcgggcagcacctgctgctgcgcgtttggcttcaggaacgtctgcttggtctggggctgctgcccggtcgaaggcgccacctgctgcaagga

SEQ ID NO: 1760 - DNA, 400 bp, Zea mays
  Clone ID: LIB143-042-Q1-E1-D9
tcgatacaagcctctaaaatgagccgcatcagctagccccaagtttagtcggccgatcattcactgaagtagtaatggcctccgtcaacagctggaccctcgagatcgcgtcgccggtggctccgcagcgcctgttccgcgccgccgtgatggactggcacaccctggcgcccaaggtcgcctcccacgtcgtcgccagcgcgcagcccgtggagggcgacggcggcgttggcagcgtcaggcagttcaacttcacctcagtcatgccgttcagcttcatgaaggagcgtctcgagttcctggacgcggacaagtgcgagtgcaagaacacgctcatcgagggcggcggcatcggcgtcgccatcgaaacggcgacgtcgcacatcaaggtggagcccgc

SEQ ID NO: 1761 - DNA, 446 bp, Zea mays
  Clone ID: LIB143-042-Q1-E1-C2
tcgatccaagcctctacagtgagtcattttatctacaccatcgacgacgactgcttcgttgccaaggacccatctggcaaggatatcaatgctcttgagcagcacatcaagaacctcctcagcccatccaccccgttcttcttcaacaccctgtacgacccctaccgtgagggtgctgactttgtgcgtggataccccttcagcctcagggagggtgctcacaccgccgtctcccacggcctgtggctgaacatccctgactatgatgctcccacacagctggtcaagcccaaggagaggaatgagaggtatgttgatgctgtcatgacaatccccaagggaaccttgttccccatgtgtggcatgaaccttgccttcgacagggatctcattggccctgctatgtactttggtctcatgggtgatggccagcccatcggtcgcta

SEQ ID NO: 1762 - DNA, 178 bp, Zea mays
  Clone ID: LIB143-042-Q1-E1-C3
gtattacgtgttaacttcgtttcctgtcattgctctatccatttttggcagtttggctgatgtgtatatatatagctgtaaacacacgcaaatataaagtggtggctgtggacacgccaatgtgttgtttgagtaaaaaataaattcaaaattaacgaacaagtgtaaaaaatgaaac

SEQ ID NO: 1763 - DNA, 439 bp, Zea mays
  Clone ID: LIB143-042-Q1-E1-C4
aagcctctaaattaagtcatatgaaggaattccaaggatacaaaccctcctgatctatatgcaaagtttatgagtgcgctttacaacttgctcgatggttcttctgacaacacaaaatttgaggacgactgccgagctattattgggactcaatcatatgttctctttactttagataaattgatttataaagttgtgaagcagcttcaagcaatagcaacagatgaaatggacaataagcttctgcagctatatttatatgaaaaatcaagatctcccgggaggttttttgacctagtttatcatgaaaatgcccgtgttctactgcatgatgagagcatataccgatttgaatgttgctcaagtccgacaaggttgtctattcagctgatggaatatggtcacgaaaagccagaagttaccgcagtatcaattgatc

SEQ ID NO: 1764 - DNA, 445 bp, Zea mays
  Clone ID: LIB143-042-Q1-E1-C7
ctcgcgggtcgacacacgcctctagactgcgtcctacaacctctcctccaagcgggcgccgcgggattactacaagggcaagaactgcaagcccaccgggttccacacccgcaaaggtggatatgtgattgttgatgaaaagttgccaagatttgtggtccctgacttgactgatttcaagctgaaggcatacgtgtcacaatgcgccagggacctcacagcgtcgacagcatcctctacttcagcagaaagtactgaaagcaagagctgatctgatctttgcttgcggggaggcagcccaactctgaagttatgtttccctagactgcccatgttccgaggattagcatcagcattctagctacaaacatttcagatatctttcttgtaagggcaaacattatggcatacctagattcacttttcctgcttgtaattttgattc

SEQ ID NO: 1765 - DNA, 430 bp, Zea mays
  Clone ID: LIB143-042-Q1-E1-C9
tcgacgcaggcctctaaacgaagcaagcagcctaaaaaaaccgtatcgtctcgcctgttcagtttccttctcctcttcccgcagcccggtttgccgaccaggttccaccgttccagagtagccaagcgaatcccgtgtctggttcgcgcgatggcggaggagcagtccaacccccagcaccagcaagcggaggagagggaggttatggtggagcagcagcagccgaggagggccccgaagctgaggtacctggacttcgtccaggtggcggctgcccaggccgcggtgtgcctcgctgggctctacggcctcgccaaggaccacgccggcccgctccgccccagcgttgacgccgtcgagtctgccgtcaagggcgtcgttagccccgtctacgaccgcttcggcggcctgccgctcgacgtcctcgcct

SEQ ID NO: 1766 - DNA, 413 bp, Zea mays
  Clone ID: LIB143-042-Q1-E1-D10
cctccgctccgcacacggttccactccaactctccgatctccaggaatccgcggctgaggcgccggcgatggcggctcccatggtcgacgccgaatacctgcgccaggtcgacagggcgcgccgccacctccgcgccctcatctccaacaagggatgcgccccgatcatgctccgcctcgcatggcatgatgctggaacttatgacctgaagacaaaaactggtggtgcaaatggttcgattagatatgaagaagagtacacccatggttcaaatgctggtttaaagattgctatcgatctccttgagcctatcaaagcaaagaatccaaagataacatatgcagacctgtatcagcttgctggagtggttgcagtcgaagtgactggggggccaactgttgaatttattcct

SEQ ID NO: 1767 - DNA, 431 bp, Zea mays
  Clone ID: LIB143-042-Q1-E1-D11
tcgatacaggcctctaggaagttcacaaagagatactagctagtccctaccaaagcatacttcctgaaacactcttgcaatccactgagttctgtttgttgagacgcatagagctagagtcgacaatgtcgctcgtgaggcgcagcaacgtgttcgaccccttctccatggacctctgggaccccttcgacaccatgttccgctccatcgtcccgtcggcgacctccaccaactccgagactgccgccttcgccagcgcccgcatcgactggaaggagacgcccgaggcgcacgtgttcaaggccgacctccccggcgtcaagaaggaagaggtcaaggtcgaggtcgaggacggcaacatgctggtcatcagcgggcagcgcagcagggagaaggaggacaaggacgacaagtggcaccgcgttcagcgc

SEQ ID NO: 1768 - DNA, 426 bp, Zea mays
  Clone ID: LIB143-042-Q1-E1-D12
aggcctctaaaatgaggtatcctattgacctcttcgacaccaggaagaaactgaacaacatcaagctctatgtgcgccgtgtcttcatcatggacaactgtgaggagctgatcccagagtggctgagctttgtcaagggcattgttgactctgaggaccttcccctcaacatctcccgtgagaccctccagcagaacaagatcctcaaggtcatccggaagaacctggtgaagaagtgcattgagctgttctttgagattgctgagaacaaggaggactacaacaagttctatgaggccttctcgaagaacctgaagcttggcatccacgaggactccacgaacaggaacaagattgcggagctgctgaggtatcactccaccaagagcggagatgagctgacaagcctcaaagactatgtgacta

SEQ ID NO: 1769 - DNA, 451 bp, Zea mays
  unsure at all n locations
  Clone ID: LIB143-042-Q1-E1-D3
gggtcgagacaagcgtctacactaattcgtcatatacacacttcncggctgcctcnctaggtagcagcttctacaatggaggcatccaacaagctcgcagtcttgctcctgtggctggtcatggcagctgccactgccgtgcacccttcctactctgagaattcgcctcaagactacctcactccccaaaacagcgcccgtgccgccgtcggtgttggcccggtgacctggagcacgaagctgcagcagttcgcagagaagtacgccgcacagagggccggcgactgccgtctccagcactcgggcgggccctacggggagaacatcttctgggggtccgccggcttcgattggaaggcggtggacgcagtgcgatcgtgggtagacgagaaacagtggtacaactacgccaccaacagctgcgccgccggcaaggtgtgtggccactaca

SEQ ID NO: 1770 - DNA, 423 bp, Zea mays
  Clone ID: LIB143-042-Q1-E1-D4
agtcgtattatcacacttcccggctgcctccctatgtagcagcttctacaatggaggcatccaacaagctcgcagtcttgctcgtgtggctggtcatggcagctgccactgccgtgcaaccttcctactctgagaattcgcctcaagactacctcagtccccaaaatagcgcccgtgccgccgtcggtgttggcccggtgacctggagcacgaacctgcagcagttcgcagagaagtacgccgcacagagggccggccactgccgtctccagcactccggcgggccctacggggagaacatcttctgggggtccgccggcttcgattgaaatgcagtggacgcagtacgatcgtgggtagacgagacacagtggtataacgacgccaccaagaactgcggcgcgggaaaggtgtgtgccacta

SEQ ID NO: 1771 - DNA, 438 bp, Zea mays
  Clone ID: LIB143-042-Q1-E1-D5
tcgcgtttcgatgcacgcctctacagtgagtcggattcacttcgtgatccttacctgccgcacccaagagcagaaaagcagcgtcgcaaatggagcaggaagcgagcccgagtggaacgagaccttcgtcttcaccgtctccgacgacaccccgcagctccacctcaagatcatggacagcgacctcaccaacgacgatttcgtcggcgaagcaaccatccccctggaggccgtgtttcaggaaggcagccttcccccggcggttcacccggtcgtcaaggaggagaagtactgcggagaggtcaagctcgcgctcaccttcactccagcagcggaaactcgccaccgccctgatgacaacgaggaggggccgccttacagcagctggagttgatctatctgccatgggatgcatgcatcatatatatccaccaagag

SEQ ID NO: 1772 - DNA, 439 bp, Zea mays
  Clone ID: LIB143-042-Q1-E1-D6
ctcgcgggtcgacacacgcctctagactgattcatctgaccccctgactgcgggtgcccatgcgactgctgcaatttgtaccctgaagtggagaccgccgccgccagcggcatcctcgctgcgccgaccaccaaggccagcgccggcggctgcaacacctgcaagtgcggcggcaccagctgcaactgcaactgcagctgagccggcccaatggtggcgcacgagaggacgactacgacgaggcgtagtatatatgtatgtagcagcgtctaaataagatcctgtcaagagtcaactgcacccgccattgtatggtcgcctgcctcgccttcgtctcctggtcctggggttcgttcatctgaacgttctcgcggtcctgtcagcctcgtgccggattcaatatttatatatacacatacacacgtatgtttctgtgttg

SEQ ID NO: 1773 - DNA, 435 bp, Zea mays
  unsure at all n locations
  Clone ID: LIB143-042-Q1-E1-D7
acgcgcgggtcgatacaagcctctagagtgagtcgtcttaactccaacgggcgcgggcaccgcgacacgggggccgacttcgccgccgcgcccgacatcgaccacctcaacccgcgcgtgcagcaggagctctcggactggctcaactggctcaagtccgacctcggcttcgacggctggcgcctcgacttcgccaagggctactccgccgccgtcgccaaggtgtacgtcgacagcaccgcccccaccttcgtcgtcgccgagatatggagctccctccactacgacggcaacggcgagccgtccagcaaccaggacgccgacaggcaggagctggtcaactgggcgcaggcggtgggcggccccgccgcggcgttcgacttcaccaccaagggcgtgctgcaggcggccgtccnaggcgagctgtggcgcatg

SEQ ID NO: 1774 - DNA, 437 bp, Zea mays
  Clone ID: LIB143-042-Q1-E1-D8
tcgccggtcgatacaagcctctagcatgagtcgtcttacctaaactaaagaacagtagtagtccctgtgtacgtctagcaacgatccgcaccgagctcgccagttttgctcgttagtttggggacggcgatggcgtccggtcaggaaagcagggaggagctggcgcgcatggccgaggaggggcagaccgtcgtccccggcggcaccggcggcaagaccctcgaggcgcaggagcacctcgccgaagggcgcagtcacggcgggcagacccggagtgagcagctgggccatgaggggtacagcgagatgggcagcaagggcgggcagacccgcaaatagcagctgggccacgaagggtacagcgagatggggaggaagggcggcctgagcaccatgcaggagtccggcggcgagcgcgccgcccgggaaggcatcga

SEQ ID NO: 1775 - DNA, 415 bp, Zea mays
  unsure at all n locations
  Clone ID: LIB143-042-Q1-E1-C12
ttacaagcctctaaactgagtcgtattaagcttctcctctcgcgtatcctaccaggagggtgggagacccagggagcggaggtgtgcgaagctcgcctcgcaccacgcgctgcggcctgcggggcgagagatcggggcctgagctagggtctggtggcggagatgtcgacgccggcgaggaagcgcctgatgcgggacttcaagcgcctgcagcaggacccgcccgccggcatcagcggcgcgccgtacgacaacaatatcatgctctggaacgccgtcatattcgggccggatgacacgccgtgggatggaggcacgttcaagctgactctgcaatgtacagaagattaccccaacaaacctccaactgttcggtttgtttcgaggatgtttcatccanacatctatgcggatg

SEQ ID NO: 1776 - DNA, 401 bp, Zea mays
  Clone ID: LIB143-042-Q1-E1-A5
ggcccgacgactacgacgacggggaggtaggggacgaatcgttgcaagcaacgaggtcagaactaaggaggccgatccatcctccagcctccgatcccatccgacgacatggtctgcgtcgcgtgcctgctgccgctcttcctgatcccggtggtcaacgccctcccttacctcatcgacctcatcatcagcaaggtgtatcggctatttggatgggagtaccggagacctgaaagagtcccacctgcatgtccatacaagcctgcagctcagaagaacgatgagggtgcgagtgaatcaaaacccctggccgaaccgcacggtgctggtgctgcggcggcagaagataagaaagtggaatgatgcagcaggcgcttaaaatggaggccacggctctgtgt

SEQ ID NO: 1777 - DNA, 292 bp, Zea mays
  Clone ID: LIB143-042-Q1-E1-A6
cgtctccttccccacttcggcctcggcagttccgcgtgccggccggagcctcgtctcgcttcgcatctcgcacttcgcgccttcgccgctgcgattcctcagcagctcctcgaccgctccacccacccctgcgccggcgagatggagctcaagcccggcatgtcggcgctcgtcaccggcggcgcctccggcatcgggaaagcactttgtattgcttttgcaaggaggggtttatttgtgactgtcgttgatttctcagaggaaaatggaagagaagttgctacattagttc

SEQ ID NO: 1778 - DNA, 397 bp, Zea mays
  Clone ID: LIB143-042-Q1-E1-A7
gggtcgacacaagagtctaatctatctactggtcactcctggggttcatgttcatctgtaacgtgctcgcggtcatgtccgtctcgtgccggatttaatatttatatgcatgtatttgtgttttttctgcgttaaaaaaaaaaaaaaaaaaaaaaaaaaaaaaaaaaaaaaaaaaaaaaaaaaaaaaaaaaaaaaaaaaaaaaggaagacaaaaaaaaagattaaaaaaaaaaaaaaaaatgggggggaagttcaaaaagattcaatttaatgtccaaatttaaataaattggcgaccgttaaaaacctcacgaaagggaaaataatggcctttcataaaataacccctttgcaagaaaaacccctttttaaagaagggtaatacgattaaaaggcc

SEQ ID NO: 1779 - DNA, 433 bp, Zea mays
  Clone ID: LIB143-042-Q1-E1-A8
agaggaggagggcaggatgtcgcaccgtaagttcgagcacccgaggcacggctccctcggcttccttcccaggaagcgctcctcccgtcaccgcggcaaggtgaagtcattccctagggatgaccccaagaagccttgccatctcactgccttccttggctacaaggctggcatgactcacattgtccgtgaggttgagaagccaggatccaaactccataagaaggaaacttgtgaggctgttaccatcattgaaacccctcctcttgtcattgttgggctcgtggcatatgtgaagactcctcgtggcctccgcacactcaactctgtttgggcccaacatcttagcgaagaagtgaggagaaggttctacaagaactggtgcaagagcaagaagaaggctttcacaaagtatgctctcaaatatgaaaat

SEQ ID NO: 1780 - DNA, 361 bp, Zea mays
  Clone ID: LIB143-042-Q1-E1-B11
caggcctccgacttgcataaagataccgtgattccactacgaatcgccatattccttacagagaaaataagagcttgactggtacagcgcgctatgcaagttgcaacaccaaccttggaatagaacaaagccgcagagatgatttggtatctctaggctatgtgcttttgtattttctccgaggaagccttccttggcagggactaaaagccgcaacaaaggcacagaagtatgacaagatatgtgagaaaaagatatcgactcctatcgaggtcttatgcaaatcctgtccggtcaagttttcaccttacttccattattgccattcattggcatttgatcagcgacctgactatgcatt

SEQ ID NO: 1781 - DNA, 434 bp, Zea mays
  Clone ID: LIB143-042-Q1-E1-B12
ctcgctagtcgatacaagcctctaaagtgagtcataataaaggaggtttctcatgagtggcaattggttaacaagcagaagcctatctggatgagaaagcctgaggagattaccaaagaagagtatgctgctttctacaagagcttgaccaacgactgggaggagcatctcgccgttaagcacttctctgttgagggtcagcttgagttcaaggctgtcctgtttgtgccgaagagggccccctttgacctcttcgacaccaggaagaaactgaacaacatcaagctctatgtgcgccgtgtcttcatcatggacaactgtgaggagctgatcccagagtggctgagctttgtcaagggcattgttgactctgaggaccttcccctcaacatctcccgtgagaccctccagcagaacaagatcctcaaggtcat

SEQ ID NO: 1782 - DNA, 203 bp, Zea mays
  Clone ID: LIB143-042-Q1-E1-B2
gtcccagatcgattacgatccctcttttccacagctggacgctgaccgcgagccgtccgagctcatcaccgttatcacttctggactcttctccgtcgcactctacagacaatttgtcacgtaaatatctcggcagccatcattacagacaccatctctgtgtcctgcaagacgacagcaccgctcgctatcgcctcgcccta

SEQ ID NO: 1783 - DNA, 419 bp, Zea mays
  Clone ID: LIB143-042-Q1-E1-B3
acgcgtccaaccagacgttcgccacgcgtccgcccacgcgtccgcgaaggacaaggtgttctgcctgttcaagggggtgctggacaacctgggtcgtctgagccagcagcacgggctgtcaagcaagggcgccaacgaggtgctcctcgtcatcgaggcctacaagacgctgcgcgaccgcgcgccctacccggccagcttcatgctcgcccagctcaccggctcctacgccttcgtcctcttcgacaagtccaccaactccctgctcgtcgcatccgaccccgagggcagggtgccgctcttctgggggatcaccgccgacggctgcgtcgccttctccgacgacatcgacatgctcaaaggctcatgcggcaagtcgctcgcgccgttcccgcaaggctgcttctactccaacgccc

SEQ ID NO: 1784 - DNA, 453 bp, Zea mays
  Clone ID: LIB143-042-Q1-E1-B4
gggtcgatacaagcctctaaaatgattcgcaacattaggtatggtgttgacggtggagctacccttgtgacgggtggtgataggttgggtgacaagggtttctacatccagccaacgattttctcagatgtccaggacggcatgaagattgctcaggaggagatatttgggcctgtgcagtcgatcctcaagttcaaagacctcaatgaggttatcaagagggcaaacgcgagccagtatggattggccgccggcgtgttcaccaacagcctggacacggccaacaccctgacgcgcgcgctcagggccgggaccgtctgggtgaactgcttcgacgtcttcgatgctgcgattccgtttggtgggtacaagatgagcggcatcgggagggagaagggcgttgacagcctgaagaactacctgcaggtgaaggcggtcgtcaccccaatcaag

SEQ ID NO: 1785 - DNA, 399 bp, Zea mays
  Clone ID: LIB143-042-Q1-E1-B5
agctagacacaagtcagtctccttcccctctctagtgctcaccggctccttccgtcgccatggacgtcctcttctgctgctgcctgctgcttctcctggcctccgccgcgtccgccggcagcgagcggtgcgtgcggcaggggaaggcggcctactctccctcgctctccccggcccctcacggtagcagcggagcgtgcgggtacggcgccatggccgccgagatcaatgggggcttcctcgccgccggcgggcccaggcagcaccgcgggggcctcggctgtggccgctgtttccagatgagatgccgagacgcaaggctgtgcagcgccgggggagtgcgggtggtgctgaccgacttccacaggagcaaccgtacggacttcctgctcgccgggg

SEQ ID NO: 1786 - DNA, 390 bp, Zea mays
  Clone ID: LIB143-042-Q1-E1-B7
accgtcggtccgaccaacaatgtcgctgattcgccgtggaaacgcattcgaccccttctccctcgacctctgggaccccttcgagggcttcttccccttcggctccggcgacgtccgcagcctcgttccctcgttgccgcgcaccagctcggagaccgcggcatttgccggcgcgcggatcgactggaaggagacccccgaagcgcacgtgttcaaggcggacgtgccggggctgaggaaggaggaggtcaaggtggaggtcgaggacggcaacgtcctgcagatcagcggcgagcgcaacaaggagcacgaggagaagaacgacaggtggcaccgggtggagcgcagcagcggcaagttccttcgcaggttcagactgccggacaacgc

SEQ ID NO: 1787 - DNA, 429 bp, Zea mays
  Clone ID: LIB143-042-Q1-E1-B8
cccacgcgtccgagtatatccatatttgagctactgaacaagatgttgctttctatgtcacaagagcagaatagtccgtttctttctgcattaactcaagacacccatgtgcttccggattttcatggaaatcggtctcctgttcctgatccaaaatccaaaggagtgatttatggcttgacacttgatacaagtgagaagcatttagctcttctatacctagcaacaattcagggtattgcttatggtactcgtcatattgtggagcattgtaatgctcatggccacaagatagacacacttcttgcttgtgggggacttgcaaagaattctgtgtatatccaagagcatgcagatattacaggatgtcctataatacttcctagagagagtgagtctgtgcttttgggtgccgctgttctgggcgct

SEQ ID NO: 1788 - DNA, 371 bp, Zea mays
  Clone ID: LIB143-042-Q1-E1-B9
cttcagccccacgctatggccctcgcactgcgcctccgtcgggtcctcgcggcggcctccaccgcggcacccctgctccgcccgtccacctcggtcgcccggccttgcccgctcgttcccctcgcctccccggtcgcgccgctcccgctgccgccgtggcgattcctgcccggcggcggcgccgggttcaggtccacggcggcggcggctgcgcggggcgggaccgactatgggacggacgacagcaagatctcccccgacgagatcctcttcgagggctgcgactacaaccactggctcatcaccatggacttcccggaccccaagccgtcgcgcgaagagatgatcgagacatacctccagactctcgc

SEQ ID NO: 1789 - DNA, 100 bp, Zea mays
  Clone ID: LIB143-042-Q1-E1-C1
cggtcgagacacgcgtccgaaataaatcatattaaaaaaaaaaaaaaaaaaaaaaaaaaagaaaaaaaaaaaaaaaagggaggcagctcaaaaggaataa

SEQ ID NO: 1790 - DNA, 427 bp, Zea mays
  Clone ID: LIB143-042-Q1-E1-C10
cccaggcctccaatgaagggacgtcttcatcaactcctgttgctgccagtacagctgttccagcctccgaagctaacctgactgcatatactagcacattcttgagccagcgagctgataccccatcattgcctccgaagggtgatcctcctccatcagaggatgatgatctggaactgactgtcgctccaccatcccaacagaatatgaccaatatgtcctcccagaatgcggtaggcgtgattcaagtcatctaagctaattttttttctctctctagaagttactgtgggtatttacagttcaccgaataagtactaacattctatcagcaaatacatcagtataataagatcatgagtgacaagacacagtagatgttaagcgcgttaatgtggggggtctgttgtgcatctgcatccccttt

SEQ ID NO: 1791 - DNA, 383 bp, Zea mays
  Clone ID: LIB143-041-Q1-E1-H10
taaaatgagtcgtattgagctgatcgtcatggagttccccaaggaccccgcgcccacccgcgagcagatgatcgacacctacctcaacacactcgccaccgtcctcggcagcatggaggaagccaagaataacatgtacgcattcagcacgaccacctacaccgggttccagtgcaccgtggacgacgagacgtcggagaagttcaagggtctgcctggggtgctgtgggtgctccctgattcctacatcgacgtgaagaacaaggactacggaggtgacaagtacgtgaacggcgagataatcccctgcacgtacccgacgtaccagccgaaggagcggaggacgtccaagtacgagagcaggcggtacgagaggctgagag

SEQ ID NO: 1792 - DNA, 380 bp, Zea mays
  Clone ID: LIB143-041-Q1-E1-H11
atcgtcaccaacacgcacgcggcctctgcctccgcgtctccatcctgaggctccgaatcgatctcccttccccaccaaaccggagcacttcggaggccggacccggcgagaagcgaccgaccgcagccagctcacgtctccctcttcatccaccatgctgagggtcgcgggcaggcgcctctcgtccgctctcgcctggcgccccgccgccgccgcctcaggctcccggggccctctcgccggtacactacccggccgcgacgacgacgacacacgcgactgcagggcgcgtttcgccatcgaatctcccttcttcgccgctgccagagggttttcagcagagactcttgctccaagaaaccaggatgtgggcttatctg

SEQ ID NO: 1793 - DNA, 385 bp, Zea mays
  Clone ID: LIB143-041-Q1-E1-H12
actctaaagtaacatcgtatacacctcttcctcctcttcctcctcctagcacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcgaggcggccaccgagggcggcggctgcgactgcaacacctgcaactgcggcaccagctgcggctgctcctgctgcagctgcaactgagccggcccgcccggcccggcgatggcgcacgagagtcgagaggacgacgacgacgaggc

SEQ ID NO: 1794 - DNA, 368 bp, Zea mays
  Clone ID: LIB143-041-Q1-E1-H2
ctctagagtatctcgtactagcggtgggtcgggctatggttctggcaccagttccaccgcagcctctggccccagcagtggcaactacgccaacgctgagggcaagggcgccggtgggggcatgggcggtggtgccgacggcgcctacggttctggtgccggtggaggcgttggcaagggccagggcgagagtggcgtggcattggcaccgtcgtccggtggctactacaatggcggcgccgctgatgctaccggtggtggttccggcgctggcggtggacatggcggtggcgcagccggagctccaagctacgggactggaggtggccttggcggaggcaagggcgaagccggcagcgacgggtcct

SEQ ID NO: 1795 - DNA, 316 bp, Zea mays
  Clone ID: LIB143-041-Q1-E1-H3
acagttctgcaccaaactacatgaatcaatggcggagaccttggtagaattagctttgatggcagcttgtttattttctatataaataaggccatgtttggtttcaattagtcttaagactaaactttagtcctaagactaaactttaatccctacttgtttggttctagggactaaatagactcaaatgctcttggaatacactcatgtgggcttttaatcaaaaaaaaaaaacccaaaaaaaaaaaagggagcattccaaaaaaagataatgaaaatgaaagtggtaaaaaaaaaaaaggggggccgcccaaaa

SEQ ID NO: 1796 - DNA, 393 bp, Zea mays
  Clone ID: LIB143-041-Q1-E1-H6
gacccacgcatccacggacgcgtgggcggacgcgtgggcggcgcacgagctcgcccgagatggcgaacgcgagatcgggtgtcgctgtgaacgatgagtgcatgctgaagtttggcgagctgcagtcgaagaggctgcaccgcttcataactttcaagatggacgacaagttcaaggagatagttgtggaccaggtcggggatcgcgctaccagctacgatgacttcacaaacagcctccctgagaatgactgccgatacgcgatctatgatttcgactttgttactgcagaggatgtccagaagagcaggatcttctatatcctatggtccccatcctccgccaaggtgaagagcaagatgctttacgcaagctcaaaccagaaattcaaga

SEQ ID NO: 1797 - DNA, 379 bp, Zea mays
  unsure at all n locations
  Clone ID: LIB143-041-Q1-E1-H7
atccagagcaacgcaattgtgatagccaagaacaactgcatgctgggaatgggcagtggtcagccgaacaggcgagagagcgttcgaatcgccttcaggaaggcaggagaggaggccaagggagccgcattggccagcgacgccttctttccctttgcctggaatgatgccgtcgaggaggcgtgccagaacggcatcggcatcatcgcccagccaggaggcagtaagaaggacgaggacgccgtcgcgtgctgcaacaagtatggtgtgtcgctcgtcctcaccggcgtcaggcacttcaagcattagccgtcatgccccatggctggtcatcttagcttanggagttacggaaaatacaacaagcttcgaaagctgc

SEQ ID NO: 1798 - DNA, 401 bp, Zea mays
  Clone ID: LIB143-041-Q1-E1-H9
tcgcgggtcgatacaagcctctagactgagtcggatcacgtcggactcggatccgcccgaccacgaccaccccgcgccgccgccgcgcagcagcagcagatcagagaagatggccggactcgacaccttcctcttcacctcggagtccgtgaacgagggacaccctgacaagctctgcgaccaggtctcagatgctgttctggacgcttgccttgctgaggaccctgacagcaaggttgcttgcgagacctgcaccaagaccaacatggtcatggtctttggtgagatcaccaccaaggccaatgtcgactacgagaagattgtcagggagacatgccgcaacattggtttcgtgtcgaacgatgtcgggcttgacgctgaccactgcaaggtgcttgtga

SEQ ID NO: 1799 - DNA, 404 bp, Zea mays
  Clone ID: LIB143-042-Q1-E1-A10
cctctaaagcgtctactcggatccccgatttccgcttgctgctgcgcttccaacaccatggacggcgggggatccggcaatgcctccggcggcagcggcggcgcatcgacgtgctgctactacgcgctcctcggcatccgcaagaacgcctccgccaccgacatacgcgccgcttaccggaggctcgcgatgaagtggcacccggaccggtgggccagcgaccccggcgcggccggcgaggccaatcagcggttccagcggatccaggaggcatactccgttctgtcggacaaggggaagaaggccatgtacgacgccgggctcttcgaccccctcgacgacgacgaccaggatttctccgacttcatgcaggagatgctggtgatgatggatagcgtgaaaaa

SEQ ID NO: 1800 - DNA, 406 bp, Zea mays
  Clone ID: LIB143-042-Q1-E1-A12
gacacaggcgtctaaactctatagtccgagaccccaagcaccagcgcggcggcggcgaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggtatgaattttaccactgataaactgagattcctagtgaaga

SEQ ID NO: 1801 - DNA, 419 bp, Zea mays
  Clone ID: LIB143-042-Q1-E1-A2
tacagcgatccgtagcacatccaattcactcaaacctcttccccaaatcttcgattagattctcgttgacaagaagacaagaaccgaacctgaccatgtcgctgatccgccgcagcaacgtgttcgatcccttctccctcgacctctgggacccctttgagggcttccccttcggctccggcaacagcagcagtctcttcccctcgttcccgcggaccagctcggagaccgcggccttcgctggcgcgcggatcgactggaaggagactccagaggcgcacgtgttcaaggccgacgtaccggggctgaagaaggaggaggtcaaggtggaggtcgaggacggcaacgtccttcagatcagcggcgagcgcaacaaggagcaggaggagaagacggacacctggcaccgcgtggagcgg

SEQ ID NO: 1802 - DNA, 424 bp, Zea mays
  Clone ID: LIB143-042-Q1-E1-A3
gggtcgaggcccgcgtccacacatatatagtatgagatgccgcataagagctccttgctgcaatgaaatttttgattgccgacactgccacaatgaaactaagaattccattaaaattgataaaatgaagaggcatgaacttccacgccatgaagtgcagcaggttgtatgctcattgtgtggcactgaacaggaggtgcgacaagtatgtatcaattgcggtgtttgcatggggaaatacttctgtggtttgtgcaaactcttcgacgatgatgtctctaaacagcagtatcactgcaacggatgtggaatatgtagaatcggagggagggagaatttcttccactgttcaaaatgtggatgttgctattcaattgcgctgaagaatagtcatgcatgtgttgaaggggcgatgcatcatgac

SEQ ID NO: 1803 - DNA, 434 bp, Zea mays
  Clone ID: LIB143-042-Q1-E1-A4
cagacgcttgggcggacgcgtgggcggacgcgctgggcaacagccaagtgcaagtgatcgagctcccgcctcctcatcagtcgctatgcacagcgcacttgcaggatggcgcaggtctctaatacgcttcaccttgtggacctggtgttcgtgtcgtcggctgcggtggagctgtgcctcgcgatcgacttcgacgagcgggacctgtggtcggacaaagcgctgtgtggacctgtacgagccgtggcagacgcaccaccgggtgcaccggtatcactgcgagaagggtcggcggttcgggaccttcagggagaacgtgcgcttcaaccacgcgcacaataagcgcggcgaccggccctaccgcctccgcctgaaccggttcggcgacatggggcgggatgagttccggtcaacgttcgccgactcacgcatca

SEQ ID NO: 1804 - DNA, 375 bp, Zea mays
  Clone ID: LIB143-041-Q1-E1-F2
acttctctttctctcccagccgccagccgccgccgcactctcccagccgccagccgccgccgccgccgccgcaaaaaaccctaacccccaatccaccaatggcgtcgagcagccccgaccttgccgacgacggcttcgcggcgccgcgcctcttctcgcagggtgtctcctacacatacgacgacgtcatctttctcccgggctacatcggcttccccgccgacgccgtcgacctctccactcgcctctcccgccgcgtcccgctatccatcccctgcgtcgcgtccccgatggacactgtctccgaggccgctatggccgcggccatggcatcactcggcgccgccgccgtcgtgcactgcaacaccgagcccc

SEQ ID NO: 1805 - DNA, 367 bp, Zea mays
  Clone ID: LIB143-041-Q1-E1-F3
aaatgaggttggagcaactattggaatagctgattatactaactatgaagatatgaaacacgcgataaggaagctagatgattctgagttccgtaatgctttttcaaggacatatgtccgggtgagggagtatgatgctaggcgcagccgttctcgctccagaggcagaaaccgctctaagtcaagaagcagaagccacagccattcgtactcaagaagcagaagccgcagttatagcaagagcatgagcccaaagatttaaaatctgcttcagagtcaaaatcacctgttaaggcaagattaccatccagattccctcctatttctcaccggcgtgacaagtctgcaagcatgagtcctgccagga

SEQ ID NO: 1806 - DNA, 399 bp, Zea mays
  unsure at all n locations
  Clone ID: LIB143-041-Q1-E1-F4
caacggcaacaacaaatttccccaaattccaatcaaccctccgcaataaagcagcccaaggcggcggccggcggcggtcaaccaacaatccagaacgaaaaccgaacccgccgttgccaataaggcggggctggtcaagttcaagggcggacttctccggcggaagcgccggtaagcctcctccggcaaaccgggaacggaaggtggcaacctgggcgcctgcggcggcatcgggcagccgctctccctcctcatgaagctcaacccgctcgtctcctccctctccctctatgatatcgccgggacccccggcgtcgcggccgacgtctcncacatcaactcncccgccctggtgaaggggttcatgggggacgaccagctccgggaaggcgctcaagg

SEQ ID NO: 1807 - DNA, 359 bp, Zea mays
  Clone ID: LIB143-041-Q1-E1-F7
agcagcttctgcttgctctggggggaaggagagagagagagcgagagagatctagtaaagaggctagctaggtggtcctcgaacgaagatgttggcggtgttcagcgggcaggtggtggaggtgccggcggagctggtggcggcgggcagccggacgccgtcgcccaagacgaatgcgtcgcagctggtggggcgcttcctgaccgcctccgagccggccgtgtccgtgcagctcggcgaccacggccacctcgcctactcccacaccaaccaggcgctcctcagccccaggtcgttcgcggcgaacgacgaggtgttctgcctgttcgagggggtgctggacaacctgggtcgtctga

SEQ ID NO: 1808 - DNA, 400 bp, Zea mays
  Clone ID: LIB143-041-Q1-E1-F8
ctcgccggccgacacaagcctctaaattcactcagtttacccagccgaatgattgggagtactacagaaaaggaattggatcaaaagtggtggagatgtacaaagaggcttttgaaagcatcgagatcccgaagtacgtcgacacagttactccccagtacaagccaaagtttgatgctgtgattgctgaattaaaggaggctgagaaagagcatcagaaggagtcagaaaggatagagaaggaacttgctgaaatggaggaaatgaggaaaaagatcagtacaatgacagcagatgattactttgagaagtaccctgaactcaggaagaagtttgacgatgaaatccgtaacgataactggggatattgaagagattggagagaactcttatgatgcca

SEQ ID NO: 1809 - DNA, 376 bp, Zea mays
  Clone ID: LIB143-041-Q1-E1-G1
ctctagccagagtcatctgatgagttcaaaaagggtgtcgagggtgcaaccaagtttctccttagcaagctgaaggacctccaattttttgttggtgagtccatgaaggatgatgcgtctgtggtattcgcctattacaaggatggtgccactaatccgacattcctctatttctctcatggtcttaaggagatcaagtgctaggcgtgcggcgaaattagttacccatgttgggtactatctatgtactattattatatccaaaactatagttgtcctggctgaattgaactcaaaagggtttgtttgagaaaaaattgtcccaagattggattgcttgttaaagctcaatattgttattgaagtgttattgctt

SEQ ID NO: 1810 - DNA, 393 bp, Zea mays
  Clone ID: LIB143-041-Q1-E1-G2
cgggccgacccacgcgtctaccaagcgtccgataatatctcaaaaaaaagtcttgagtcccccctctccttccccttcccaacgctctcgctgcagaggaaaggcgaagatggcgatgaccgtcgaagtgcttgctgcactcgcgttcatgttttccacgagtattctactgcagatactggcatgcgctttgtacaacaactggtggcccatgttagcagctctcatgtacgtccttgtaccaatgccatgcctgttttttggtggtggatccacacacttcttgaccagcagagaaggtggagggtggattaatgctgcaaaattcttgactggtgcgtcggccatgggaagccttgctattccagcaattctgaggcacgctggcttaat

SEQ ID NO: 1811 - DNA, 392 bp, Zea mays
  unsure at all n locations
  Clone ID: LIB143-041-Q1-E1-G3
aggcgcgggcaccgcgacacgggggccgacttcgccgccgcgcccgacatcgaccacctcaacccgcgcgtgcagcaggagctctcggactggctcaactggctcaagtccgacctcggcttcgacggctggcgcctcgacttcgccaagggctactccgccgccgtcgccaaggtgtacgtcgacagcaccgcccccaccttcgtcgtcgccgagatatggagctccctccactacgacggcaacggcgagccgtccagcaaccaggacgccgacaggcaagagctggtcaactgggcccaagcngtgggcggccccgccgcggcgttcgacttcaccaccaagggcgtgctgcaggcggccgtccagggcgagctgtggcgcatgaagga

SEQ ID NO: 1812 - DNA, 395 bp, Zea mays
  Clone ID: LIB143-041-Q1-E1-G4
cgggtcgaccacccttcgagacaggcgcctcgtcggggtcaatggccgcggtcttcaaccgcggaaaggacggcggcggaaccaaccccaacttcccaatggcctgaacaacccccgggggccccccaaaaacaagggccaacggcaaaatcggaaactccggtcccttcaattcccattggaacaatctcaacaaaaaactcaacaaggccggatacactaccaacgcaattggtacaagctcgtcaatttccgccgcaactgccaagggcagctcccccgacttcaaagcatatgtgaagatcccttacagcgcatgatgtcaaatcggatccgtcatccacatcgtatcgcgtcgttctgcttgtactctgcttcttcctctatgtattaat

SEQ ID NO: 1813 - DNA, 370 bp, Zea mays
  Clone ID: LIB143-041-Q1-E1-G7
aggagaagattgataatgaaatgtacctggcacgagagaaagcactagcagatgcaaactactacaggattttgaaggaagcagaggcaaataggctcaaactgacacctgagtatctggagctgaggttcattgaatcaattgccaacaactcaaagattttctttggtgaaaagattcctaacatgatcatggatcaaaggttgctcaagaattaccttgatgctgttcctaggaaggaccattatgaaatgtagccgcgggttccgtgggttggaagcagaagtctttcttttttgtgtgatcccacgcagtagataggattaccgtgtagccgtccagtatactagtaagccagaaaggagtcatc

SEQ ID NO: 1814 - DNA, 410 bp, Zea mays
  unsure at all n locations
  Clone ID: LIB143-041-Q1-E1-G8
gacacacgaatctagccgctatcataagagctcggcgattcccaggtcccgcgagaatatgccgaagcagatccatgagattaaggacttcctcctcaccgcgaggaggaaggatgcccgctcagtgaagatcaagaggagtaaggatgttgtcaagttcaaggtgcgctgctccaagtacttgtacacgctctgcgtcttcgatgctgagaaggcaaacaagttgaagcaatctcttcccccaggtttgaccgtcgaggaggtctgattggatacatggcaacgccgagttgaactacccaagcttctttatcagtagcagagcatgctactctatgtacttttggaacctaagctattagacctgtcagtgttggatgtctggatcntgcatttttggagaaatacaa

SEQ ID NO: 1815 - DNA, 403 bp, Zea mays
  Clone ID: LIB143-041-Q1-E1-G9
tcgcgggtcgacacacgcctctaaacatcatacgcgaacgagggacccggggcggaagaagagagagaagacgtctctctcctctcggcgtccccgttccccaacctctcgtctgctgcctgcctgcctgcctgcctgcaaaaaggagtttgtcatggcgtctaagcgcatcctcaaggagctgaaggacctgcagaaggacccccccacatcatgcagtgcaggtcctgctggtgaggacatgtttcattggcaagcaacaattatgggaccacctgacagtccctatgctggtggtgtttttttagtgaacattcatttcccgccagattaccccttcaaacctccaaaggtttctttcaagacaaaggtcttccatcctaatatcaacagcaatggaagt

SEQ ID NO: 1816 - DNA, 401 bp, Zea mays
  Clone ID: LIB143-041-Q1-E1-F12
gcgcgggtcgacacaacactctagagtgagtctcactaccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaagcagcggcggcggcgggtacg

SEQ ID NO: 1817 - DNA, 386 bp, Zea mays
  Clone ID: LIB143-041-Q1-E1-D5
ctacattgagtcgtatgattcacccctccaccacctccatggggtcgtcggaggccgacgaggaccagctcctcaagagcttcctcgcggaggtcagcgaggccgagcgggacaacgaagtgctcaggatacttggttgcttcaagttaaaccccttcgagcatcttaagttgtcttttgattcatcaccagatgaggtgaaaaagcaatataggaagttgtcattgctggtccatcctgataaatgcaagcatcctcaggcacaagaagcttttgcagctctggcgaaagcacaacagctcctgcttgatccacaggaaagaggctacattcttgaccaagttactgctgcaaaagaagaattgagggcaaagcggaaaaaggag

SEQ ID NO: 1818 - DNA, 381 bp, Zea mays
  Clone ID: LIB143-041-Q1-E1-E10
agttccgctccttcctccccctatctagctagccttcccgttcctgcatcgcggcggagatgggcgcctccaccacgccgctcgcgtcggcggcggcgctgcttctgctgctgctcgcgccgctcgccgcggcggcggacagcatgtcgatcgtctcctacggcgagcggagcgaggaggaggcgcggcggatgtacgccgagtggatggcggcgcacggccggacctacaacgccgtcggcgaggaggagcgcaggttcgaggtgttcagggacaacctccgctacgtcgacgcccacaacgccgccgccgacgcgggcgtccactccttccgcctcgggctcaaccgcttcgccgacctcaccaacgacgagtaccgcg

SEQ ID NO: 1819 - DNA, 375 bp, Zea mays
  Clone ID: LIB143-041-Q1-E1-E11
agccagccatcctacagtcacacacacacacacacacagacaagtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggag

SEQ ID NO: 1820 - DNA, 376 bp, Zea mays
  Clone ID: LIB143-041-Q1-E1-E2
atgccccgcagcaacaaacacgaaccttggcagaacgaagctgaagtagttcgttgtgaaaccaagttagggcaaacgcccccaaggatccgggccctccggccggcggcaaccgcccctgtgcgctgccgccgggccggccgccgcgcagaactgcggctgccagcctaacttctgctgcagcaagttcggctactgcggcacgaccgacgactactgcggcgacgggtgccagtcgggcccgtgccgctcgggcggcggcggcggcggcggcggaggcggaggcagtggcggtgcgaacgtggctaacgtggtcagcgacgcgttcttcaacggcatcaagaaccaggccgggagcgggtgcgaaggcaagaac

SEQ ID NO: 1821 - DNA, 408 bp, Zea mays
  Clone ID: LIB143-041-Q1-E1-E3
gggccgacccaagcctctacattaagtcactagaggagtcactcatccaggaggttaagaaggtgactaacaagcccgttgctgttggcttcggcatatccaagcccgagcacgtgaagcagattgcgcagtggggcgctgacggggtgatcatcggcagcgccatggtgaggcagctgggcgaagcggcttctcccaagcaaggcctgaggaggctggaggagtatgccaggggcatgaagaacgcgctgccatgagtccatgacaaagtaaaacgtacagagacacttgataatatctatctatcatctccgagaagaagaacaacgaacgaacaataaaaataagccaagtggaagtgaagcttatagctgtatatacaccgtacgtcgtcgtcgtcgttccgga

SEQ ID NO: 1822 - DNA, 374 bp, Zea mays
  unsure at all n locations
  Clone ID: LIB143-041-Q1-E1-E5
acggacgcgtgggcggacgcgtgggaaccaggcccgccccgacccgaagatgcagcggtggctcccggcgctcctccgccgcgccgcgcccggcggcggggcggcgcggctcttcgcctcgtcctccctcctcttcgacgacacgcaggagcagttcaaggagagcgtgcgcaagttcgcgcaggagaacatcgcgccgcgcgccgcggccatcgacgcctccaaccacttcccgcgggacgtggacctgtggaggctcatgggggacttcaacctccacggcctcaccgcgccggaggagtacggcggcatgggcctcggctacatgtaccactgcatctccatggaggagatcaccanggcctccggcgccg

SEQ ID NO: 1823 - DNA, 411 bp, Zea mays
  Clone ID: LIB143-041-Q1-E1-E6
ctcgcgggtcgacacacgcatctagcatgattcgaattagcagtactatcggttcatctggaatctcttctatgctgaatatatcttcttcccgttaatatagagaggtgagtttcctgattagcattcagcatccatgaccctttgcttctgacatttgtctgcacaaaaaaatgtcagatcttgtagttcatcttgatcttgggctacagcctaattcatggtgaaaagagggagaagttggcaaagtgaggtctgtcgtgcatattttcaacggaaacaatggagtagcaatattgctatgctagggttctgaagttgtaggagcttttctaagcttttacgatgttgaaggcgttgttggagctgtggaagctgttttccttttttttccttttgtatcaacagtgt

SEQ ID NO: 1824 - DNA, 373 bp, Zea mays
  unsure at all n locations
  Clone ID: LIB143-041-Q1-E1-E7
acaaaaggtcctcttgtttttctaagagtctatccttttcattcaaggcatcaatcaattcattaattttatctactttagttctatccaatcccttgaacaaactagagtaatctatttcatcatcactagactcatcatcgctggaagaatcataagtgacattgttttgattacataccttcttctcccttgccataaggcatgtgtgacgctcgttggggaagagggatgacttgttgaaggcagtggcggcgagtccttcattgtcggagtcggaggaggagcaatccgaatcncactcctttccgatatgtgcctcgcccttggccttcttgtaatgcttcttcttttccctcttgctcccgtgttc

SEQ ID NO: 1825 - DNA, 366 bp, Zea mays
  Clone ID: LIB143-041-Q1-E1-E8
atctaggctgcggcggtgggccgcctgccggttccggcgccccgatgatgggcggcatggcaatgccagcgcctcggccgccgctgccgcagcagcaacagccgggcccgggcatgatgatgaggccgccgaacatgatgggcggcgccggtttccccggtggtggcatggggccgggcatgggccagatgggcggcgcgccgatgggccaccctcaccacccgcacccgcaccagcacatgggtgcgggtggcaatggcatgcagatgcagcctggcggtggcggtggcggtgccgtgcatggcatgccagccggcgccatgccgggacatgctgctgggttctaccaaggcggtggtagtgcag

SEQ ID NO: 1826 - DNA, 375 bp, Zea mays
  Clone ID: LIB143-041-Q1-E1-F1
agcatcacacgcaagaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgaggcggccaccgagggcggcggctgcgactgcaacacctgcaagtgcggcaccagctgcggctgctcctgctgcagctgcaactgagctgggccggcccggcgaatggccaacaaaatcaaaaggaggaggacgacgacgaggcgtataaatataatagcggcgt

SEQ ID NO: 1827 - DNA, 401 bp, Zea mays
  Clone ID: LIB143-041-Q1-E1-F11
cgcgggtcgacacaagcctctagcatgagtcatcataacgagagagcccggagccgagagaccagccagccatggcgctgcgtgccctgtacaacgagatccggagcatgaaggtccgcgacgtgccggcttacctgaagccgcgcttgacctgggacaacgtcaagaagagcgccgaccaggccgtcgaccgctacatcgagaagtacatcgacacgagctcgccggaccctctctaccacgtctgcatcggagggatgatcttcgcctacttcgtcaatctgccctgggagcgcgcccacctcgcccacctcgaggagatggagaggaccggtgggaagcactagatccgctgccccgtccctcgccggcagcgcgggaggacgggtgactttcatggg

SEQ ID NO: 1828 - DNA, 416 bp, Zea mays
  Clone ID: LIB143-022-Q1-E1-D8
acagagcgtcagagcccgatcccgatccagcgaggcggcgaccctccctcctccccttgcttcgctcgtccagccctgaccacccgcatccccgtcagtcatggcagcggcagcaggcggaggcgcggtgcgtgcgctgtcccagaaggagcaggacatacagatgatgctcgccgccgacgtccaccttggcaccaagaactgcgatttccagatggagcgctatgcctttaagcgccgcaccgacggcatctacatcatcaaccttggcaagacatgggagaaactgcagcttgcagcgagggttatcgttgccatcgagaacccgcaggacatcatcgtccagtccgcccgcccctatggccagcgtgctgtcctcaagttcgctcagtacactggcgctcatgccatcgctg

SEQ ID NO: 1829 - DNA, 429 bp, Zea mays
  Clone ID: LIB143-022-Q1-E1-D9
caatacggcgagcatcggcggcggcgacccaagcaggttgacctcgccccttcaccgaccagcgggtcgtacagcaagccgatccaattcctccggtgagttctcctgttactacaccccttccggctttggttctcggcgctgtgttatgtgatgtcggtctgctcgagagcagggatagatacaccatccgcccatacgcctgaaatcgaacttgctactaaattgccagtaacactgagcgcgattatcgcacccacctacgtacatagaaattgatttcacgtactgttcagggcctcggcgtttcacttcgccatttcgttgaactgctggaagacacgtcggtgcacactagatttggattggggagaggagaagcgacagctttcggatgtgcaaatgtgcctaagttggtttcaaacatag

SEQ ID NO: 1830 - DNA, 391 bp, Zea mays
  Clone ID: LIB143-022-Q1-E1-E1
aagagacgccggcccgtccgcctcactctccgcctcacgtcaccaaggccaatagttttcaagtggcaatggctgaccatggcaaccaagccaacgtccttcaaaagcccggtggccaattccaactgcgcccgattatccccgaaagtgttcgggcccgtaacatatgcccatctgtctcatcttatgaaaggagatttgccacaaggaactacattacccagagcctttggggcccttcaatgtctgttagcggtggcatcaatgtcccagtgatgcagaccccgctctgtgctaatgctcctgctgataaaggaggcaagaacttcatgattgatttcatgatgggcggtgtttcaactgctgtttcaaagactgctgctgctcccat

SEQ ID NO: 1831 - DNA, 419 bp, Zea mays
  Clone ID: LIB143-022-Q1-E1-E10
aaaaactggcaaccctgaatttaatcaatagagagaatgaaatacatggtagtgagaagcaatcgctctctgtggcaccaccaagtgcagattcagtccatatcttgctgaagcaagctcttcgtgctgatgatagtgtagcactgttaacttgcttgtataatagagatgagaaggttattacgaagtctatatcactcctaacaccagcagatgttgtgaagcttctcaagttctttgtcttgcaaatacaatctaggggtgcagtgttggtttgtttactcccgtggctgcaaactttattgaatcgacacatgagcagcatagtgtctcaggagtcttctctgtcattgctcaactcgctctaccagcttattgatgcaagaacgtcaacatttaagtcagcattgcaactctct

SEQ ID NO: 1832 - DNA, 414 bp, Zea mays
  Clone ID: LIB143-022-Q1-E1-E11
gaagggtttgatactacgactggcatccactggcagaaataataagagaattttccactgaacgcaatcatacatggagcatatatgctgttagctggagtcctgacaataaacaggttcgaatagtttctgctgataaatctgcagaagtatgggatatcatcggaagatgcaagtgggaaattgactcgaactttgtcttgccctggtacaggacgtgtgtatgatatgcttgttggttgtctctggaagaataaccacctcatgacactctctcttggtgggacatttaatgtgtactctgcacgcaacccagaccagagaaccagttacatttgcaggacatttgaatactgttacttctttggtctactatcctcaaagtagcccaacaactatacgatctactagcta

SEQ ID NO: 1833 - DNA, 434 bp, Zea mays
  unsure at all n locations
  Clone ID: LIB143-022-Q1-E1-E12
cactccttttgctcggaacgcacacaccgcccgtccccgatctccgatcccctcgtcgatccaaagatgcagatcttcgtcaagaccctcactggaaagactatcaccctcgaggtggagtcttctgacaccattgacaacgtcaaggccaagatccaggacaaggagggcatccccccggaccagcagcggctcatctttgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggccaagattcaggacaagganggcatccctccagaccagcagcggctcatttttgccgg

SEQ ID NO: 1834 - DNA, 363 bp, Zea mays
  Clone ID: LIB143-022-Q1-E1-E2
agggaacgccggagcctcatgctccctctcgtcctcaatgccgcagtgctatgagtctacaagttgcactggatgaccatgctagtcacatcagtgtctttcatgagcgaggtggtcaattccacctgagctcgatcagctcataatgtatatcggactgtaatatatgccgttctctcacatcttatgatgagagatgtgctacacggattcagatgacccaaagcctttgcggcccttcaataatgcttagcgataggatcaatgtaccagtcatacagagacctctctgtgctaatgtgcatactgagaaacgcggcgggaacttcatgactgaattcatgatgggctgtgttgcagctg

SEQ ID NO: 1835 - DNA, 412 bp, Zea mays
  unsure at all n locations
  Clone ID: LIB143-022-Q1-E1-E3
gccagtacccacagtcctacgagcagtcgcacgcaagtgtcaagagacanaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgccagcaccgccgccgacaggcgcgccgcctgcaactgcctcaagaacgccgccaggggcgtcagcggcctcaacgccggcaacgccgccagcatctcctccaagtgcggcgtcagcatcccctacaccatcagcacctccaccgactgct

SEQ ID NO: 1836 - DNA, 365 bp, Zea mays
  Clone ID: LIB143-022-Q1-E1-E4
acgcgtccaaacagaatccacagtcatacgagcaatcgcacgcaagtgtcacgtcacatatcggtcgacatggatcacacgcagtctgccgtagcggtcgccgtgatggccccggtgctgctgctggaagcggtggtgatgacctctgatggcggcatcaactgcgtgcaggtgaactccgccatcaagcgctacgtcacctaggcgtacgtcatggggtccggaccctccgcgtcttgcagtacctgcgtcatgaacgtgatgatcgccggcaggatcgccgctgacaggtgcgctgcctgcatctgcctctcgaacgccgccatgggcgtcaacggtctcaaggcctgcaacacggccagcat

SEQ ID NO: 1837 - DNA, 415 bp, Zea mays
  Clone ID: LIB143-022-Q1-E1-E5
aaaaattttagtggagactccagtgaggcttcatgggctcggcagcggtagagggtgttgagtttgtgatctaaattctgcatatggagccccccgtggtatatattagtgaccctaattagggtttgctgtgcatcgtctttttttactcctcttgtaagccatcgtctatgaacaacgttctgtaaacactccacatatagtggaggtttcgcttggctggtaccgtggtttttcccttcacattgaagggttttccacgtaaatctatgtgtcgtgctctgtgaaatgttggttgatctacttcgtttttcctgtcatttctgctaacagagggggctcaagccccacccaccccaccattggctccgtccctgcctcaacatttttttttaaaaaaataatagggtgacta

SEQ ID NO: 1838 - DNA, 418 bp, Zea mays
  Clone ID: LIB143-022-Q1-E1-E6
acaagactactacaagagacagcaactgcgagaacttgcaatgctaaattcgccactccgagaggagagtccacatccaggtggtgctcctcctagtcccttcagtaacggcggcatgaaaagagtgaaacaatgacaccgccgaggctcgttcctccatcttgactccccagcaaccccaatgcagtccataccttcacaccctatttttcaatgagcaagctttcatgacggtgttggtagtgtgtgacattcttcactgtactagcaggtgaattttgatctcccatcccatgttacattaaccttgagtgacagatgactatgcgtagtgtatcctctatggcagtataactagaacatttgatttatttgttactggtaatgctgagatatagtactgtgcagattctgagtt

SEQ ID NO: 1839 - DNA, 412 bp, Zea mays
  Clone ID: LIB143-022-Q1-E1-E7
acctgcagccacgaactcccgttctccatttccagccatggcggtgtcgatcgagctcaccaaggagtacggctacgtcgtgctggtgctggtggcctatgtcttcctcaacctttggatgggcttccaggtcggcaaggcccgcagaaactacaaggtgttctaccccaccatgtacgccatcgagtcggagaacaaggacgccaagctcttcaactgcgtgcagagggggcaccagaactctctagagtggatgcccgttttcttcgtcatactgctgctgggcggtctgcagcacccgaccatcgccgccggtctgggcggcatctacatcgtcgcgaggttcttctacttcaagggatacgccaccggcgttccggacaaccgtctcaagattggggggctcaactac

SEQ ID NO: 1840 - DNA, 430 bp, Zea mays
  unsure at all n locations
  Clone ID: LIB143-022-Q1-E1-E8
aggagtttccgcaccaccaccaccaccacggccatcgccgcgacgacgacgaagacgaccgcagaggcccgcctcccccggtctacggcggctacggccagccaccgccacccgacccgtacggccgcgcgcccgtcgaccccgattcgtacggtcgacctccgccccagtccgcgtacggtggggccggggacgcctacggccacagcggccaaggctacgcgcccccgccggcctacggcgccgggggcgggtacggcaacgtcgtccacgtcgcgcacgaggtcggcgacgagaggccttactacggcggcggcggcggcggtcttggtggcgcctacggaggcngtggctccgagtacggccacgagggccgaccgcaccacggccgcggcggatcccagtacggccaccagacacgcccgcacca

SEQ ID NO: 1841 - DNA, 427 bp, Zea mays
  Clone ID: LIB143-022-Q1-E1-E9
ggcacccagacccagcagctattgtggtcgtccctcagccgcgtcgcaccgcatcgcattctacgattcgaagctctctctgctcgcagccatggcgaagaattacccaaccgtgagcgccgagtacagcgaggccgtcgagaaggccaggcgcaagctccgcgccctcatcgccgagaagagctgcgcgcccctcatgctccgcctcgcgtggcactccgcggggacgttcgacgtgtcgtcgaggaccggcggtcccttcggtactatgaagtgcccggcggaactggctcacggcgccaacgcggggctggacatcgcggtgcggctgctcgagcccatcaaggaggagttccccaccctctcctatgccgatttctaccagcttgccggagttgtggccgtcgaggtcaccggtgggcctgag

SEQ ID NO: 1842 - DNA, 353 bp, Zea mays
  Clone ID: LIB143-022-Q1-E1-F1
accaaagtcacgtttcctcctcaacaaaaaccctcgcaaaaatctgggatctatctagaagcaccactcaacaaaccctaggttgcctgatcggctgatcgctccatggcgatcatctccgacttcaaggacgacgaggcaccggagcagcagctggcggccggccacggcgtcgaggaggccctcgtggcggcgttggagaggagcggctgcgcgctccccttcctacaggcggctatcgatgtcgcccaccgcaggtccggcctgttccgcgacccttcggcggtgagcaaggtcaccgcgatggcggcggcagccagggcgcagatcgaagccgacgacatggtgaccag

SEQ ID NO: 1843 - DNA, 416 bp, Zea mays
  Clone ID: LIB143-022-Q1-E1-D7
aaggaatcattggcagaccatggatactaaattttcacttacaaaaggtgtggtctattggccgttgcaatagatttatgcatggttctgaagggatggtacaccttgaagatatttgttcatatgttccatataacaaaaagggttacctcgtgaaaatttggagcattcttctagattcatgtgttgatgcctcacctttgcttgtcataaacaatggaatgatgtccatctttattggttctcattcatatttgtttctttgcattgatggttatagtggttcagtgaggtggagtgtcaaattggaaggccgtatcgagtgttctgccgctataactggtgatttctcagaggttgttgttggatgctataaagggaaaatttacttccttgatatgtctacgggaaaatta

SEQ ID NO: 1844 - DNA, 346 bp, Zea mays
  Clone ID: LIB143-022-Q1-E1-C1
ggtcgaggcccgcgtccgagacgaacgaccaatagaaagaagccaagtggaagtgaagcttaactgtatatacacggtacgtcgtcgtcgtcgttccggatcgatctcggccggctagctagcagaacgtgtacgtactactatgtagtgcatggagtgtggagctactaactagctggccgttcattcgattataattcttcgctctgctgtggtaacagatgtacctagtcgatcttgtacgactaagacactggctagctagccgtctcgatcgtatatgtaccgattaatctgcagattgaagaacaactacagtacgcatatgatgcgtaagtgcgtgtgt

SEQ ID NO: 1845 - DNA, 379 bp, Zea mays
  Clone ID: LIB143-022-Q1-E1-C10
gtagagtatgagaactgcaagcttctccttgtggacaagaaaattaacaatgccagagatcttatcactatcctggaggatgctattagaagtggatatccaattctaatagtggcagaggacattgagcaggaagctcttgcaacccttgtggttaataggcttagaggtgcattgaagattgctgctattaaggcccctggttttggagagcgcaaaagtcaatatcttgatgacattgctactctcactggaggcactgtcatcagagaagaagttggattatccttagacaaggcagacaatgcggtcctaggaactgctgctaaggttgtagttaccaaggattcaacaacaatagtgggagatggcactacac

SEQ ID NO: 1846 - DNA, 431 bp, Zea mays
  Clone ID: LIB143-022-Q1-E1-C2
aaccacatcaagaagcgtagtcgtcgccggaaggaactgcgcggagcaagatgtcgtggcaggcgtacgtcgatgagcacctgatgtgcgagatcgaaggacaacatctcagcgccgccgccatcgtctgtcacgacagcagcgcttgggcgcagtccgagagcttccccgagttaaagcctgaggacgttgctggtatcataaaggactttgatgaacctggtactcttgcaccaactggtcttttcgttggaggtacaaagtacatggtgatccaacgtgaacctggagttgtcatccgatgaaagaagggcactgggggcattactatcaagaaaaccggcatgtccttgattactggtgtctacgacgagccaatgactccagggcaatgcaacatggtggtggagaagctcggcgataacctgatc

SEQ ID NO: 1847 - DNA, 155 bp, Zea mays
  Clone ID: LIB143-022-Q1-E1-C4
agcggcacacgcggaggacagcccaagcctacacatggtaatcgtcagcagatcagcagcgaagtactatggtctgatctccgccatggtgtcaacaaaggagcagtacacacagtgggatgatgtgatggtgtccacagatctccgcagcctcc

SEQ ID NO: 1848 - DNA, 418 bp, Zea mays
  Clone ID: LIB143-022-Q1-E1-C5
actcactgctcgttgccggctgcccccgcggccccggccagtccatcccctcgctcgctccccaactccagcaggcagatcagatacatccatccattcgcggaccggaagtaatcatcaggaaaggaaagggttgaactatgagcgccgtggcggtttcgtcgtcgctgaacccggacgcgccgctcttcatcccggcggcgctgctgcaggtggaggacttctcgccgcagtggtgggacctcatcaccaccactgcctggttccgcgaccactggtcccgcgagcgcgcccatctggacgagatggccgagcagatcgacgcggccggcctcctccccgacgacgaggacctcttctacgacgaccagctcgagcatggccccgtcgccgccgcccttaagacagattcggtgct

SEQ ID NO: 1849 - DNA, 376 bp, Zea mays
  Clone ID: LIB143-022-Q1-E1-C6
aaggacgccgagcttctcgccgcgggaggtgtccttcctcctgaggctcattcccgagctagtgcaatagcgcgttcttgctgctttgctggtggaatctcgcgacgagatcctctgtatccgtagagttaggtcactaacgtgtgaatccggcctttttgtttgtcaactgaaatcgaaaaaggttatgggttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacacaaaaaaaaaaaaaaaaaaaaaaaaaaaaaaaaaaaaaaaaaaaaaaaaaaaaagggggcgcccc

SEQ ID NO: 1850 - DNA, 403 bp, Zea mays
  Clone ID: LIB143-022-Q1-E1-C7
agaccgcctcgtcgccgacggctacgcggaggcgtccgacctcgagttccgcgacaggctcgccgcccatttcggccggctcccgcacagctatcagctggatatcaatgttgacaaagcatccgatgtcttggtccaccagaacgtcttagcggaagcaaaggatcctgataggcgccctgcattctatgtccgtttcttgaggattgaagatatggattcagcatacgactccgatgcatctgaagaaggggatgatgatggtgatgatctctctgtaaggcaggacacaccatatactcacattcatgagatagttttctccacaatcgataagccaaagctccttagtcagctatctgcattgctatctgacattggattgaacatcagagaagcacat

SEQ ID NO: 1851 - DNA, 263 bp, Zea mays
  Clone ID: LIB143-022-Q1-E1-C9
acgcatccggaggatagacgctctacagacctcatgcctgacggccagatctaagccttctcgtcctcgcccaaggataacgatgaacatctaataatcaaagatcacagagcaggatgatcggtctctaagctagacgcgcatcacgccgggcgctacacgcaggtatgctagcagagcgcgcatggggcttctggaccagctgtgggacgacactgtggccgggccgcacccggactccggcctcgggaagctccgcaagc

SEQ ID NO: 1852 - DNA, 388 bp, Zea mays
  unsure at all n locations
  Clone ID: LIB143-022-Q1-E1-D1
aatttatttttttttttcagattacagagttttattctgggtgtacaaagtttagagatatgacgcacatgtgcactacacgatgtctgtgtcntgcagttgtagtaacaggtagctcttgttacttagtaggcgtcaacgtgatatgaggtggtattattggtggtgcttaagattgtgtttccgaatgggctctggtcgtagcagtccaagttgtcgccgtagctgagaccaaacatgtcgcagtagcgtttgtagaagccgatccggctggcaacacgagcgtcagcgccgtggccgcactcgaggccgccgttgatgatgttggtgaggacgccataccccggcagcctccctgcggccacgtcgtcgggcgaaggcgcccact

SEQ ID NO: 1853 - DNA, 407 bp, Zea mays
  Clone ID: LIB143-022-Q1-E1-D10
ccaacctcagcacatcgaggagaagaggagtggccaatggcttcgtcggtggccgccgcggcgagcacattcctgggcacccgcctggcggacccggtgccgcagaacgggcgcatcgtggcccggttcgggttcggcggcggaaagcccaaggctgccgtcccgaagaaggtggcgaagacgtcgatctcctctgaccggccgctgtggttccccggcgccgtggcgcccgactacctcgacggctcgctggtcggcgactacgggttcgacccgttcgggctcgggaagcccgtggagtacctgcagttcgaactggactcgctggaccagaacctggccaagaacgaggccggcggcatcatcggcacccggttcgagtcctccgacgtcaagtccaacccgct

SEQ ID NO: 1854 - DNA, 418 bp, Zea mays
  Clone ID: LIB143-022-Q1-E1-D11
tccttctctccgcttccaagatgtcgaagcgagggcgtggaggttcggctggtaacaagttccggatgtcactgggtctaccagtggcagctactgtgaactgtgccgataacactggagccaagaacctgtacatcatttctgtgaagggaatcaagggtcgccttaacaggcttccttctgcctgtgttggtgacatggttatggcaaccgtgaagaagggaaagcctgaccttagaaagaaggtgatgccagctgttattgtgaggcagcgcaagccatggcgccgaaaggatggtgtctacatgtactttgaagacaatgctggagtgattgtgaacccaaagggagagatgaaaggttctgccatcactgggcccatcggaaaggagtgtgctgatctctggcccaggattgc

SEQ ID NO: 1855 - DNA, 284 bp, Zea mays
  Clone ID: LIB143-022-Q1-E1-D12
cggacgcatgggctctggttgagcatccaatccaatatggacgtggatggaaggtgtactgctgctggtccgtggctgtcgctgtcctgtgtggatgtttcctgtgtcttctacgatatataatgtacttccgtctgtttcgtttcctgtgtacaatctcaatcttgcgggtatcgttcatgtatccctttgaataataacaaataaaatcgggtttgtcacggtaaaaaaattaaaagattcaaaaatcaaaaaaggaagaaaaaataaaaaaaagatatcgt

SEQ ID NO: 1856 - DNA, 409 bp, Zea mays
  Clone ID: LIB143-022-Q1-E1-D3
accacacgtccgcccagtcgtccgaactgcgctggactcagccgcgctccgtctgcctcctgcctctcgctgtgcttccgcatcctgcgcatccaggctccacttctccgctcggcagtcggcactggaatgacagcatgtctgtctcggcgtcgtcatcggcggcagcggcgggcgatgataagcatgaggcggcgcccgtcaggcgctgcaacggcgtcaacgacctcgataacgtcgttctccgcgaggtccggtgcagctccgcacaggtgtacttgtatggtgggcatgtgacatcatggaaagatgaccatggagatgaattactttttgttagcaataacgctagtttcaagcctccaaaagctatacctggaggaataccaataggccttccgcagttctc

SEQ ID NO: 1857 - DNA, 314 bp, Zea mays
  Clone ID: LIB143-022-Q1-E1-D4
aacagaacacgcagacatcagcccaagcgcatccaaggttagcgtcccacttcggccgccatggactacgcaccgacagccgtcctggtcgccgcgatggcgccgttgatgcagtgggaggacgtggtggtgtccaccgatggcggcagccgcctcgtgcacgtctacctcggcggcaagagctaggagatgcagctgtccgtcattgggtcggagccgatctcgtctcacaagtcgttcgtcgtgcatgggctgttcctctgcacgctcgccgtctgccacctgagcggtcaccgtctccccgtcgacatcag

SEQ ID NO: 1858 - DNA, 420 bp, Zea mays
  Clone ID: LIB143-022-Q1-E1-D5
aaccgacctccgccaacaagaagccgccgcccgcgagccaggacgagccggccagggggaagggcgaggcgaagaggaggaagagcggcaagaagaagaagatcgggaggttcctctccaggctcgtcggcgcggagaggcggcggcacaccggggacggggacggcgacggcgacggcgccgagctcttccactccaaaaccatgaaggagaagacggcgtccaagtgggtgttcttctgaatcccctcgtcagatcagatgccagcaccatgctgcacacacacgcgcgcttgagggccggtttcctcgatcggtcggtatggagttttttcccccccacttcaagtactcctgtgcttcaatccgctgcagttagttagcatggtttctctttccgactgtgtagtgtacacgagac

SEQ ID NO: 1859 - DNA, 428 bp, Zea mays
  Clone ID: LIB143-022-Q1-E1-D6
agcccccaaggccccaactacccccagtctcggaagagaactatccagaagcgcaagactccaaagccgtcgccttcctatccatcccttcctcgccgcgggggtcgcctgagatcacataaacaatggtgaaggctgttgctgtgcttggtagcagcgatggtgtcaagggcaccatcttcttcacccaagagggagatggccctaccactgtcaccggaagtgtctctggcctcaagcctggcctccatgggttccatgtgcatgcacttggtgacaccaccaatggctgcatgtcaactggaccacactacaatcctgcgagcaaggaacatggagcaccagaagatgagaaccgccatgccggtgatcttggaaatgtgacagctggagcagatggtaatggtctctgcccttctttttctgat

SEQ ID NO: 1860 - DNA, 164 bp, Zea mays
  Clone ID: LIB143-022-Q1-E1-A11
aatggtggtgagcctctcagctgcatcggggaggcgcagaggctctatatgtgtcatgatcttgttccgaactgtcaggttgctgtaatgtagccaaatggaaacctttgtatccctggaacttgaaaggcatgtacctggtatctgcagccagtaagtttggc

SEQ ID NO: 1861 - DNA, 409 bp, Zea mays
  Clone ID: LIB143-022-Q1-E1-A12
gcgtactgtctgtgcgaaggcgaccattccttcttcgctccttcgccgccgctatggttaagtactcgcaggagccgggcaaccctaccaaatcggccaaggccatgggaagggacctgagggtccacttcaagaacacaagggagacagcttttgcgcttcgcaagctgcctttgaccaaggctaagcgataccttgaggatgttattgctcacaagcaggcaattcccttccggagatactgtggaggtgttggtcgcaccgcacaagcaaagtctcgccactccaatgggcagggtcgctggcctgttaagtcagccaggttcatattggatttgctgaagaatgctgagagtaacgctgatgtgaaaggcttggacgtggacaacctctatgtttcacacatcca

SEQ ID NO: 1862 - DNA, 341 bp, Zea mays
  Clone ID: LIB143-022-Q1-E1-A3
tgactcaactcctccccaaacttctccctctccatcgactccctactccgcgccacgttttgcaccaaaccctcctatcatggccatggccgccgacggaggcgattgataccttcatcagcataacgggggcggacaagagcgtcgccgtacgcagacccgagcaagatggtcgtgatcgtaagccatcaatatattcacatttcaatgacggacatagcatattgaacggcatcactcaaaacgccatgcatgctactcgtgatgatatgacggagctttatggaccacctgatcattcatttcaaagatctttggtgccagagagtttccgtgcccct

SEQ ID NO: 1863 - DNA, 411 bp, Zea mays
  Clone ID: LIB143-022-Q1-E1-A4
acgacatcgtctcttcgtccccacgagcaaccgataatccgccggcgctgagatgttggtttatcaagacctcctatctggcgacgagctcctgtcggattcattcacctacaaggagctcgagaacggcgtcctgtgggaggtcgagggaaagtgggtcacccaaggtcctgttgatgtagacattggtgccaatccatccgccgagggtggtgaggatgaaagcgttgatgacacagccgtgaaggtggttgatattgttgacacattccgtctacaggagcaacctccttttgacaagaaatcatttgtctcttacataaaaaaatacatcaagaatctcactgctgtgttggagccagagaaagcggatgagttcaaaaagggtgtcgagggtgcaaccaagtttct

SEQ ID NO: 1864 - DNA, 420 bp, Zea mays
  Clone ID: LIB143-022-Q1-E1-A6
acagcctccaaagccactctcaaacccccgcttccagaaccttctcgaagctccccgccgcctcctccactcgcaccgatggcgaaagaaccaatgcgcgtgctcgtcactggcgccgcacgataaattggatatgccctgattcccatgattgctaggggtgttatgcttggtgcagactaacctgttactctgcacatgcttgacattccgccatcagctgaagcacttaatggtgttaagatggacttggatgatgctgcgtttcctcttctgaagggagttgttgctacaagtgatgttgtggaagcctgcactgaggtcaatgtggccctcatggttggtggattctcaggaaggacagaatggacaggatagatgttatgtcgaaaaatgtttcaatcgacatatcccaagcat

SEQ ID NO: 1865 - DNA, 422 bp, Zea mays
  unsure at all n locations
  Clone ID: LIB143-022-Q1-E1-A7
gtcatatcagtcactacacgcacgagtgagtacacggtagccaaaccacattatcatggagaactactgcgaaagcatcgactactatcagaagccttcccatgctcccaacaagccaacgaccatggacgaagccaaggacgacaacaatgacacgggcaagggcaaggccgtcctgngcgccggtccttaccaccaccaccaccatgctaccgccgctgaccagcaggaacccgaaagccaggaggagttcttcagcgactccgagtcgggctccgagtccatcgagatcgccgacctcaagaagcgcatgtggaaggaccagctgctgctcatgaagctcgagggccgctcgggccgcgaccgcgaggcccagctcncgctccatctccatccctttgctgacgaacacccgccggcga

SEQ ID NO: 1866 - DNA, 421 bp, Zea mays
  Clone ID: LIB143-022-Q1-E1-A8
gccaagaggaggaaaggaaggagagagatggcttgccctgcgcagtccatgctctccgccagcggctgcatcttcctgaggagcaagcctcaggcggcatcccaagtgcgagggggcatcatcggcggtggccgcagcagcaggccgttcctgctcacctgcaacgcttcctcttctccgtccccttcctcgccggcgccggcgcaggaagaccccgactgcaacgaggaggagtgcgccccggagaaggaggtcgggagcctgagcgctgagtggctggccgaggagatgacccaggtcgtcggcactttccctcccaagaagagaaggtggaccggcttaatggagaaggacaccgccggccagaccaacatctactccgtcgagccgatggtgtacgtggccgagagcgccatcagct

SEQ ID NO: 1867 - DNA, 165 bp, Zea mays
  Clone ID: LIB143-022-Q1-E1-A9
acaagactctatactcagtcgtgctatggttttgcccgtggtgctccacacagtgcccctcattctatcagtagaacacgatgctcaagtgggcgctctcatccgcgctcctcctcgtctttctcatgactacagtccacgttgtagctatctaagctgggggtc

SEQ ID NO: 1868 - DNA, 258 bp, Zea mays
  Clone ID: LIB143-022-Q1-E1-B10
gacttctcatcgccctcgggttcggcttcgggttcatgaggttctccggagttcggttacatgcgtggatggctcgtgatggctgtctccgacgctgcttatcgccgcttccttggcggcagcgcctgagccagcgacgaaggttcgcttcatagcagctgcaacaactaatgagatgtcatcgagtccaagattatacgcgatctgtagagtcatcggtcatgcagtgtccacttcctcagatgctgcacagaggaa

SEQ ID NO: 1869 - DNA, 368 bp, Zea mays
  unsure at all n locations
  Clone ID: LIB143-022-Q1-E1-B11
cccacgcgtccgcccacgcgtccgacatgaagctcagggacgacctcgagaggctcaagaagatcaggaaccaccgtggtctgcgtcactactggggcctccgtgttcgtggccagcacaccaagaccactggcaggcgtggaaaaactgttggtgtctccaagaagcgataagctacatatctatcgacaaatctcagatgtactagtgttggttcatgttcanactgtcttgatgaagggtttctgttgggacagtttcctgaaattatgttttgccctaagataatcctgcagttatggaaccttaatataatgtatcctgcaatttgtttttttgcaacttataagagtaattttatttgatga

SEQ ID NO: 1870 - DNA, 432 bp, Zea mays
  unsure at all n locations
  Clone ID: LIB143-022-Q1-E1-B2
agtggagtcaccacagaatcaaagaaaagctttcccccgatcctctcgcggacaccagcgatgggttcccgctacgaggtggaggtcaccgtcggctccgcccgggacctcaagaacgtcaactggcgcaacggcgacctcaagccctacgccgtggtgtggatcgactccggcagcaagtgctcgacccgcgtcgacctcgacaacggcgagagcccggcgtgggacgagaagctgctcgtcccgctcccccccgaacctcccaaccgaaggatggagtgggttgtacagcggcctcaagccctctctcatcggcactgccgcgtcgcagggaatctattactacttctaccagatcctcaagaacaaggtggaagatatagcggttgctcgtancaagaaggccttggggatggtactgtcgggatgctt

SEQ ID NO: 1871 - DNA, 407 bp, Zea mays
  Clone ID: LIB143-022-Q1-E1-B4
gcgcgcccacgtcgctgccgtggtcggcggacccgcggagcgccttgtccacctcttctgcgtcgtccccaggcagcagctcgtccacgacgacctgctcttccactactccgaccaggacctcgccgacgacctagccagctccgaggagtcggtccgggacgcccggcgcggcgtgttcgacgacgcccagccgtggcggcgcaagatccagcgcctcctcccggcggacggcatcacggtcaagcacatcaggacaggggaggatgtgtcactgtccaggcgcatcgcagcgacgttcctcctgatgaccatagccgacttcagcgaccagctgttcgactggcaggaccgcctcttcgacaacagcaacggccgcctcgagttcagcggcaacacctggacct

SEQ ID NO: 1872 - DNA, 106 bp, Zea mays
  Clone ID: LIB143-022-Q1-E1-B5
aaaccgctgacgtcgctgctgtggtcggcagatgcccggagcactcagacgacctcttcagcgtcgtcacgaagcagcagttagtccacatccacctgctcttcgt

SEQ ID NO: 1873 - DNA, 426 bp, Zea mays
  unsure at all n locations
  Clone ID: LIB143-022-Q1-E1-B6
accttctccaacctccgtttctaatccgcgctgctaatcccactcccagtcccagctcgtccgctgagatggacagtagcagcctcaaatccgcgcagctcctggagctgatgcgccagcacctggccaccgatgccggcaaggaggtcaccaagaaggtcggcctcgtctaccagctcaacatcgcccccaagaagatcggcgttgatgaggagatcttcgtggtcgacctcaagaagggcgaggtcaccaaagggccgtaccagggaaagccggatgccactttctccttcacggacaacgatttccttggaatcgccaccggcaagacgaatccgcagattgcattcatccgaggggcgattaanatcaaggggagcatcagtgcggcgcagaagtgtacccctgacatcttccccaagcctg

SEQ ID NO: 1874 - DNA, 420 bp, Zea mays
  Clone ID: LIB143-022-Q1-E1-B7
caaatattcaagagttttctccgggagaaggcgcaatattacatattaaggagcttgatgatgttgcttcagttgctaagacaatgaaaaatattgcttcaaaccctgatgccttcaatcaatctttgaggtggaagtatgatggtccatccgattctttcaaagctcttattgacatggcagcggttcattcatcttgtcgtctttgtatacatattgctaccaagatccatttaaaggaggaaaggactccaaaatttacaaatcgtccttgtagctgttccaccaaaaagggaacaatttaccacttatttatccgagagagagggcggtttaagtcagagagcatttacatgagatcaggccagttaactctgggagccttggaatccgcagtgctcggtaaatttaggtccctca

SEQ ID NO: 1875 - DNA, 416 bp, Zea mays
  Clone ID: LIB143-022-Q1-E1-B8
accacgcgtccgcccacgcgtccggagagcacgagacgcccctctgcttccttttctctgtcgctcaaaagttgctggagccctcttctctctctcctctccgagccccaaccatggatgaggcgcaagttgtggagtcaaaggatggaaccatctcagttgcttctgcatttgttgctcatcaggaagctgtacaagacagggatcacaaattcttgacaaaagcagtggaagaagcataccgaggagtcgattgcggcgatggaggtccatttggagcagttgtcgtccgtaatgatgaagtggttgttagctgccataacatggttctgaagcacactgaccctactgcgcatgctgaagtaactgcaattagagaggcttgcaaaaagctcgggaaaatcgagctctctgac

SEQ ID NO: 1876 - DNA, 172 bp, Zea mays
  Clone ID: LIB143-022-Q1-E1-A10
cacgcgtccgttagtaacatcgtacaactatgaagtgaggattgttcttattaagctgaatatttctcagacgctaagatgttgatgtaggcgttctcatccgcgcatctcctagtctttctcctggatgaagtccacgttgtggcttcaaaggatggagtcatcgcagttg

SEQ ID NO: 1877 - DNA, 379 bp, Zea mays
  Clone ID: LIB143-041-Q1-E1-B9
agcggcacggacctggaccacggcgtggcggcggtcggctacggcgtcagcgacgacggcacgccctactggatcgtcaagaactcgtggggcccttcctggggagagggcggctacatccggatgcagcgcggcaccggcaacggcggcctctgcggcatcgccatggaggcgtcctttcccatcaagacctcgcccaacccgtcgcgcaagccccgccgcgcgctcatcaccagggacgcctcttcccagtgacaggctgatccatctcggcgtcgaactcgtactactggcacgtaagtaggagtacgttgacaggatgacatcctgctgctgctgtttgcttgtactattttcgattgtgtttgtaggtttgatt

SEQ ID NO: 1878 - DNA, 339 bp, Zea mays
  Clone ID: LIB143-041-Q1-E1-C1
agtcccggttctggcacccctccccatcggcttcgccgtgttcatggtgcacctggccaccatccccgtcaccggcaccggcatcaacccggccaggagcctgggcgccgccgtcatctacaacaaggacaagccctgggacgaccactggatcttctgggtgggccctctcgtgggcgctgccatcgccggcctccaacaacaattcaacctccgggctggcgccatcaaaggcctccggtccttcaagagcaacgcctgatgaacggggcttggctgttgagcaatggcgggcgacctacaggcgggggaagtcctgagcgaggagaatgacatcat

SEQ ID NO: 1879 - DNA, 408 bp, Zea mays
  Clone ID: LIB143-041-Q1-E1-C2
cgtaggtcgttccaagcctctaaaatgagtcatactacttccctctctctttcctctcttgcctccgtcgccatgacccaccgcctccttctcctgctcctgctgctccctttgctagcgccgcctgctgcgtctgcacgccagggcgcggggcacgatttgggacagtgccccgggctggagtacggcctgccgccgttcgccgccgctctccgggcaagctgccccgtctcgacggatgggtactcgccccccgaggaggttgttaatggggaagaacttctcacgttgttggatggcaaggaagagcacacagctgtccttttctatgcatcatggtgccctttctcagaaagaatcagatcagtctttgatgatctgagctcaatgtgtccacgggttaagcac

SEQ ID NO: 1880 - DNA, 385 bp, Zea mays
  Clone ID: LIB143-041-Q1-E1-C3
taaccacacgtctgctaacgcgtccgcccacgcgtccgcccacgcgtccgcaaatatatctccccgcgtccgctagccctagccgccgtccgccgacttcatcgtcgccgtcgtctagacctcttcacgcactggaaaggttaaagtccgacatcaatggcgaagcatcatcctgatctcatcatgtgccggaagcagcctggcatcgcgattggccgcctttgcgagaaatgtgatggcaagtgtgttgtctgcgactcgtacgtgcgcccatgtacgcttgtccgggtctgcgacgagtgcaattatggttcgttccagggaaggtgtgtgatctgtggaggagtcggcatctcagacgcttactactgcaaggagtgcaccc

SEQ ID NO: 1881 - DNA, 166 bp, Zea mays
  Clone ID: LIB143-041-Q1-E1-C4
cttcctttcccttcggcaatggcaacttcccaacccaattccccggaaggaccggcggcggcggcggcggcaaggtctttcccaaaatcgggaaccggggggggaacccccggaggcaaaggccaaaatttcggggccccccccaaaaaaaacgaaaaaccccatt

SEQ ID NO: 1882 - DNA, 296 bp, Zea mays
  Clone ID: LIB143-041-Q1-E1-C6
acccacgcgtccggttaaaaaagaacatacacaatcatatcaccaggccagggcacgcacaagcgagctgatctgcagcattatttggctgattttttaatcgttgacggtgggcgaacatatggcggatgactcgttcgacctccccagcgctagcgaggaggatgtgatgggaggcctggatgaggacgaggccatgaaggacctcgagaccgggatggacgatgaggactatttgccaccgacgatgaaggttggggaagagaaggagattcgggaacgagggctcaagaaga

SEQ ID NO: 1883 - DNA, 371 bp, Zea mays
  Clone ID: LIB143-041-Q1-E1-C7
agcacgcagtattgcagcagcactgaagcactacttcctgcactcactgtgctagctgctcaaaccgtagtagtaacagtccatcaccatcaccatcaccaccaatggctcccaaggttgcgctcttccttgccctaagcctcctgttcgctgccaccgcgcatggctgcgaaccctactgttccggcccaatcgtcccaacaccaccagtcgtgccgactccgtcgtcgcatagccacgggcgctgcccgatcgacgcgctcaagctcaaggtgtgcgccaatgtgctgggcctcgtcaaggtcggcctaccgcaatacgagcaatgctgcccattgctggacgggctggtggaccttgacgccgcattg

SEQ ID NO: 1884 - DNA, 365 bp, Zea mays
  Clone ID: LIB143-041-Q1-E1-C8
aacacactgcaacagccaagtgcaagtgatcgagctcccgcctcctcatcagtcgctaggcacagcgcacttgcaggatggcgcaggtctctaagacgcttctccttgtggccctggtgttcgtgtcgtcggcggcggtggagctgtgccgcgcgatcgacttcgactagcgggacctggcgtcggacgaggcgctgtgggacctgtacgagcggtggcagacgcaccaccgggtgcaccggcaccacggcgagaagggccggcggttcgggacgttcaaggagaacgtgcgcttcatccacgcgcacaacaagcgcggcgaccggccctaccgcctccgcctgaaccggttcggcgacatgggg

SEQ ID NO: 1885 - DNA, 335 bp, Zea mays
  Clone ID: LIB143-041-Q1-E1-D1
agccggttccgctacagagtagggtaggccggggggcacccgcgatggggccggacggcggaggggtgatcggggccgtggtctacggggcgctggcggtgctggcggtgcggctggtgctgtcgtacaagtcggcggcgcacgcgctgcggcgggcgtggcggtgggcggacgagcgggcgcaggcgtaccagcactacgaggtgccgcgcctcgccgcggacggcgcggagaacccgctgttccggaaggcggcggcgtacgtggcgtcgctgccgtcgctcgaggacgcggacgccgcctgcgtgctctcgtcggcggccaagagcaacggc

SEQ ID NO: 1886 - DNA, 380 bp, Zea mays
  Clone ID: LIB143-041-Q1-E1-D10
aggcaccacacctcttcttcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactgagccggtcaggcgatggcgcacgagagtcgagaggacgacgacgagtcgtataaatataatagcg

SEQ ID NO: 1887 - DNA, 379 bp, Zea mays
  Clone ID: LIB143-041-Q1-E1-D11
aggcactggagaggatgagagagatggtgaatatgttgtctccaaactattttttcagcaacagtttaaacctggggacaagaatgctcaagagctaactacatccgatgatctggaatcaatggctgctgaatcaaatctcccagattttactacattgcccactgacaaacatgttggtacagtccaagaagttgttcataatcctgagcataatctttaccagcttaatagaaactgtgaaataagcattgaagagactgttgtcctcccaccctctgtaaaaacaacaaaggacggagataatctccaatcacaagatcagaagttgtgggaaggcgattcccagtttgaattgttagactctcagcagctggca

SEQ ID NO: 1888 - DNA, 383 bp, Zea mays
  Clone ID: LIB143-041-Q1-E1-D12
ctctagcacaagtgcgtttgagacttgtcaagtgttcttccggaaaaaaaaaaagaaacacaaatggacgctcctgcggcggcggcccagggttgcggcggcaagcacatcgtgctcgtccacggcgcgtgcctgggcggctggtcctggttcaaggtggccccggcgctgcgggaggtgcccacgttccgggactacacggggccgctgctggagctcctggcgtcgctgccggacggggatcgcgtggtgctcgtgggccacagcctcggcggcttgagcgtcgcgctggccgccgagacgttcccggacaaggtcgccgccgtggtgttcctctgcgccttcatgcccgactgcgcggcgcggccgtcgcacgtgctgga

SEQ ID NO: 1889 - DNA, 345 bp, Zea mays
  unsure at all n locations
  Clone ID: LIB143-041-Q1-E1-D2
agcaaagttcccgaagcactcttgcaatccactgagttctgtttgttgagacgcatagagctagctgctagcgacgacaatgtcgctcgtgaggcgcagcaacgtgttcgaccccttctcgatggacctctgggaccccttcgacaccatgttccgctccatcgtcccgtcggcgacctccaccaactccgagactgccgccttcgccagcgcccgcatcgactggaaggagacgcccggggcgcacgtgttcaaggccgaccccccggcgtcaagaaggangaggtcaaggtcgaggtcgaagacggcaacgtgctggtcatcagcggccagcgcagcagggag

SEQ ID NO: 1890 - DNA, 341 bp, Zea mays
  Clone ID: LIB143-041-Q1-E1-B7
tgagtcgaagtacttgtgatacatccagtcataatttttgacgcgaatgtcaatgcttcagataatggttgagctttgtaaagtgttccattttagatatctgtctacgtccgttaaactggttctgggttatatgggcgcgtatcaattattatgtataaccattgttgctactggtccttatccacaatcgcataaggagacaacttcatgggctacgaggcttaactgacggtttcgaccttgggatgaacatgctgttgaaaggagacaaggaagatgatggctgttcaagcaagtcgcatggcaagagcggaaacccacagaagcacctgaagaac

SEQ ID NO: 1891 - DNA, 350 bp, Zea mays
  Clone ID: LIB143-041-Q1-E1-A1
taaacacgcgtccgcgagggtgctgaagcgcatgtccttgacctgggtgctgaagcgcatgtcaaggacgaggagggcaaccctgcgttcgccctcgtcaacaaggccactgggctcgccatcaagcactccctcggccagtcccacccggtgaagctggtgccgttcaacccggagtaccaggacgagtcggtgctgtggacggagagcggcgacgtgggcaagggcttccgctgcatccgcatggtgaacaacatccgcctcaacttcgacgccttccacggcgacaagggccacggcggcgtgcacgacggcaccaccgtggtgctgtgggagtgggccaagggcga

SEQ ID NO: 1892 - DNA, 374 bp, Zea mays
  Clone ID: LIB143-041-Q1-E1-A2
acgcacatttctgcatccccctcccgccgcgccgcctcaccgccgccggagaagatgggtcgcgtgatccgcgcgcagcgtaagggtgcggggtccgtgttcaagtcccacacccaccaccgcaagggccccgcccgcttccgctccctcgacttcggcgagcgcaacgggtacctcaagggcgtcgtcaccgacgtcatccacgaccccggccgtggcgcgccgctcgccaaggtcactttccgccacccattcaggtacaagcaccagaaggagctctttgtcgcagccgagggcatgtacacgggccagttcgtctactgcggtcgccgcgccaccctctccatcggcaacgtgctgcccctccgcgggat

SEQ ID NO: 1893 - DNA, 354 bp, Zea mays
  Clone ID: LIB143-041-Q1-E1-A3
tctacagtaagtcctcataggcaatggctaccattatcaagctcgtggcccttggcttggccgtcctcgtgagcgttgggttctccgatgcagcgacggtagttaggcttgggagctatgcatctgccggacgatgcggcagccgtggacgctgcggctccggatctaccggggctgctgggtacagcagtgggtctggcggtggcagtggctacagcataggcaagggtggcggggactggtggaacaatttcgtctccagcgtagcgggcagtggtcgtgggggacagggccgacggggtggcaccaacagtggatacgggtccggcggtggatcgggctatggttctggca

SEQ ID NO: 1894 - DNA, 277 bp, Zea mays
  Clone ID: LIB143-041-Q1-E1-A5
gccgacccacgaatccgcccacgcgtccgtgcctctcctcctccagagctcgtcgccaccggccaccgccaccctcgatcacgccgtccgtcgaggtaaggtcagcatggtgagggtcagtgtgctcaacgatgcgctcaagtccatgtacaacgctgagaagatcggcaagaggcaggtcatgatcaggccgtcgtccaaggtcatcatcaagttcctgacggtcatgcagcgccacggctacattggagagttcgagtacgttgatgaccaccga

SEQ ID NO: 1895 - DNA, 377 bp, Zea mays
  Clone ID: LIB143-041-Q1-E1-A7
accgccgccagcatcatcaagaccatggtcctcgctgcgccgaccaccaaggccaacgccagtggcttctatgctgccaccgagggcagcggctgcgactgcaacacctgcaactgcggcaccatctgccgctgctcctgctgcagctgcaactgagccggcccgcccggcccggcgatggcgcatgacagtcgatacgacgactacgacgaggcgtataaatataatatcaccgtctaaataacatcctgtcaactgcacccgccattatcgatccatggtcactcctgaggttcatgttcatctgtctaacctgctcgctgtcatgtccgtctcgtacctgaattaatatttatattcatgtacttgtgtttttc

SEQ ID NO: 1896 - DNA, 373 bp, Zea mays
  Clone ID: LIB143-041-Q1-E1-A8
acccacaccgggcacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtcggtgggcgcgaacatctccggcgggcacgtgaacccggccgtgaccttcggcgc

SEQ ID NO: 1897 - DNA, 304 bp, Zea mays
  Clone ID: LIB143-041-Q1-E1-B1
acacaacgtcttcagatccagatacatcgcgaacgtcaggctggtccacaggctcagtgtacgcgggttcaccttatcacgggagacgtaacgatatggcgacgtcgatccggcttgcgctgatcgagatgaaccgcgccaccaactgcggaactgcgtatacgacgacgacagctgctgagctcgtgcgctcacagagcaattaccatgtgcgatcacgttacctcaagcagtctgcgtgtacgacgcacaactgggaccgcgctgtgtccagcttgtgagaagctcactgggaagacgatca

SEQ ID NO: 1898 - DNA, 374 bp, Zea mays
  Clone ID: LIB143-041-Q1-E1-B11
agaaagatgtacaattcttgccaatttctggtcttgtgggaaccaatatgaagaccaggatggataaaagcatttgtagttggtgggatggaccttgtctttttgaagttctggaccgtattgaaattcctttacgcgaccccaaaggtccagtaaggatgccgattattgataaatataaggatatgggcactgttgtaatgggcaaaatagaggctggcactatcagagagggtgacagtttattgattatgccaaacaagtctcatgtgaaagtcattggtttgaacttggacgagagcaaagtacgtcgtgctggacctgctgagaatgttcgtgtcaaattgtccggagttgaggaggaggatgtaatg

SEQ ID NO: 1899 - DNA, 399 bp, Zea mays
  Clone ID: LIB143-041-Q1-E1-B12
ctcgcgggtcgacacacgcctctacacagattcctcagtctcggaagataactatccataagcgcaagactccaaagccgtcgccttcctatccatcccttcctcgccacaggggtcgcctgatatcacatatccaatggtgaatgctgttgctgtgcttggtaccagcgatggtgtcaagggcaccatctttttcacccaagtgggagatggcactaccactgtcaccggaagtgtctctggcctcaagcctgacctccatgggtttcatgtgcatgcgcttggtgacaccactcaatggctgcatgtcaactggaccacactacaatcctgctagcaacgaacatggagcaccatgttcatgataaccgtcatgccggtgatcttggaaatgtgaca

SEQ ID NO: 1900 - DNA, 386 bp, Zea mays
  Clone ID: LIB143-041-Q1-E1-B2
acgcagctctagagcctccatgggcagctacgcgtacaagtactgcatgtgcttcacgcgcaagttccgatccccggacgcccagccgccgccggacgtccgcgccgcccacctctccttcgcctctgacgcccatgccctccgccgcttcgtcgccggcgtccagggcgagtcccccgccgacgtcgaccgcatcctcgccatgctctccgggggccacagccatggaatcgcccgcctcgtcacaaggtcgccggcggcatccacgcccacgctcgaagacttcttggccttcctcttctcccccgacctcaacccacccatcgcgcaccaggttcaccaggacatgtcagcgccgttctctcactatttcgtgttcaccgggc

SEQ ID NO: 1901 - DNA, 80 bp, Zea mays
  Clone ID: LIB143-041-Q1-E1-B3
ccaagcctctaaacagagtcgtattatctatgggcagtcacgcatattgctaccgcggatgcttcaagcactggttacga

SEQ ID NO: 1902 - DNA, 347 bp, Zea mays
  Clone ID: LIB143-041-Q1-E1-B6
atccaatctgatcctatgtacttgtgacacttccagtcataatttttgagccaatgacaatgcttcagataatggctgagctttgttaagtgttccattttagttatctgtctacttcctttaaactggttctggttatatgcgcgcgtatctattattatgtataagcattgttgctactggtccttatcgagaatcgcataaggagacaacttcatgggctacgaggcttaactgacggtttcgaccttgggatgaacatgctgttggaacgagacaaggaacatgatggcggttcaagcaagtcgcatggcaagagcggaaaccgacagaagcacctgaagaac

SEQ ID NO: 1903 - DNA, 411 bp, Zea mays
  Clone ID: LIB143-040-Q1-E1-H9
gccgacccacccgtccacagtctctctcgagtgatccccctgtagtccccggccccgtctttccgccgcctcctgcaaccgcttcacgtgcccctcgcaggtcccctttccgaccccaaatggagccgaagaagtcctccgcccagcgccagccccacgccatggagcccaacaagtcctctctatgcggcgccaccgctcctgccgccaccgccgaagccgagtccccgttgtgcagcttgttctacccgccggcgccggcgccggcgccgaccgcggcaaatgggaaagattcggacttgtacagcattctttacaaagggcagagcgggagcgcacaagctggcgtcacaggtaatggtaaaacgcaatgggctccttcttccagaagtcgtttgccgcgaatgcaaa

SEQ ID NO: 1904 - DNA, 390 bp, Zea mays
  Clone ID: LIB143-040-Q1-E1-F9
gacccgcgcgtcaacggacgcatgggctcctcctccttctcctggcactggcagcgaagatccaaagatagcacaatcgcatctcacacgccgagctatttctactttgagagaatccccttctcccacaaggagcgagtaatttgaggcagagaccgacacagatggcagcggttatggtgtctcgccaaggccgggagctgcagcggtacagcgcgagcacgggcgggcgcgtggtggtgggctgcgtcccgtaccgcgtgcgcgggggcgacggcgaggtggaggtcctggtgatcagctcgcagaagaagggccccgcggggggcgtgctgatccccaagggcgggtgggagctggacgagtccatggacgaggcggccccggcgc

SEQ ID NO: 1905 - DNA, 321 bp, Zea mays
  Clone ID: LIB143-040-Q1-E1-G1
gaacagccaagaacagagatacccaagtcaccgaagcaaccgctcacaatcccaatctcccgcgtcactcaaaacccgaagtaacaaccgtcggtccgaccaacaatgtcgctgattcgccgtggaaacgcattcgaccccttctccctcgacctctgggaccccttcgagggcttcttccccttcggctccggcggcgtccgcagcctcgttccctcgttgccgcgcaccagctcggagaccgcggcatttgccggcgcgcggatcgactggaaggagacccccgaagcgcacgtgttcaaggcggacgtgccggggctg

SEQ ID NO: 1906 - DNA, 437 bp, Zea mays
  Clone ID: LIB143-040-Q1-E1-G2
ccgggccggcccacgcgtccagtcaaccctgccaccgccgacgccgcgccgccgcagcaattgtcaccgtcgctatggcccgtatcaaggtgcacgagctccgggggaagagcaagacggacctgcaggcgcagctcaaggagctgaagtctgagctctccctcctccgcgtagccaaggtcaccggcggcgcacccaacaagctctccaagatcaaggtggtgcgcacctcgatcgcgcgcgtgctcacagtgatctcgcagaagcagaagtcggcgttgcgggaggcgtacaagaagaagaacctgctccccctcgacctccgccctaagaagacccgtgccatccgccgccgtctgaccaagcaccagctctctctgaagaccgagagggaaaagaagcgtgagaagtacttccccatgaggaagtatgctatc

SEQ ID NO: 1907 - DNA, 311 bp, Zea mays
  Clone ID: LIB143-040-Q1-E1-G3
aatcacagctttcgtgaataaaacctgaatcacccacaacaatgttctaagtactcagccagtggtatttactggttgacctactgtagtttgcgtcggaatagatatgtttttttactcttcgtggggcagttttgtactggtggattcataaggactctgattatggtgcgttcggaacttataatagtaagcacatgaaattttgcttcaggtgcagtgatgctgtctcattaagttatcagttattaggttgctgtcgtagtaaatgatcaggtcgcaactgggttgaagcggagcacctgtcctga

SEQ ID NO: 1908 - DNA, 449 bp, Zea mays
  Clone ID: LIB143-040-Q1-E1-G4
cgtgggccgacccaagcctctacacgtgagtcggacatatccctccctctcccctcaacccagcgcccccctcccgccgccactagggtttctcctccccgcccacccccaaaccatccccgaagcttccagtgcgtcgcgccgcaaccatgagcgacggtaaggactccctcgacctctccgccctcggcgccgccatccccaactcggccgagctcagcgcggaagacaaggctaaccttgtggcgtcgatcaagaacacgctcgagggattggcgtcgcggcataccgacgtgctcgagaacctcgagcccaaggtcaggaagcgcgttgagaagctcagggagatccagggcgaacacgatgaacttgaggcgaagtttttcgaagagagagctgctctagaagctaagtatcagaagttgtatgaaccactttactcaaagcgt

SEQ ID NO: 1909 - DNA, 424 bp, Zea mays
  unsure at all n locations
  Clone ID: LIB143-040-Q1-E1-G6
aggatggagggcaatagggcaggtgaagccacccaaaaaggattttacaagtatgagggcaagaggaaagcgactcctgatcctgaaattatgaaatatattgaaaaatctaggagcatggcaggagttacaccagatcctgagctgatgaagctaagtgagaaagacatagtcgagatggtgtttttcccggtgataaatgaagcctgccgagtccttgatgagggtatcgccgtcaaggcttctgacctagacatcgcttcaatctttggcatggggttcccaccttatangggaggtgtcatgcactgggcagattccatcggcgcaaagtacatccatggaaagttggaggagtggacaaagcggtatgggggcttcttcaagccctgctcttacctcgctgaaagagctgcaaaaggga

SEQ ID NO: 1910 - DNA, 371 bp, Zea mays
  Clone ID: LIB143-040-Q1-E1-G9
ctcaacagtcggacatatcacagaaaagctaaacccgacctccgctcgccggcgcccggcaggatggcttcgtcggcggcgtaccctgatgcggacgagaacctggaggccatcatcacccgcatagagcagaagtcccgaaagatcgagacccttctcaagcagtcgaagccggtggaggccctaaagacggcgctcgaggggtcaccgctcaagacccgcgacgagcgatgcaagtcggcgaactggatcgtggtgcaccgcgcgttgatggcgattagggacgtagacggcatgttcaactccctggatcccgagtactacgacatcctcatgaaagtacctttatagagggttacctacagggggat

SEQ ID NO: 1911 - DNA, 289 bp, Zea mays
  Clone ID: LIB143-040-Q1-E1-H1
cataataatgcaaaacgaaccgtgaaaaaagaactaagtcggtagaacatgaaagaagcggaacacaaagaagtcggaaacaacaggacataaggctaggcctgcggtgaaagtttacaggtggagcaatcgcaccgttcagtcatcgcgggaacaacagggggggcccccatgagggtgttcgcttttagctcgtggggatgagccgccaggaccgccacaagcggcgccacggattcatttttcgggggagtcttttttaaaacgttccggtggggaaacatcgggg

SEQ ID NO: 1912 - DNA, 417 bp, Zea mays
  Clone ID: LIB143-040-Q1-E1-H10
ccgaccgacccgtccggcttcaatatgctcatgttcgggatggccaactccaaccttgctgacatctatagcttcctcaagacctgcccgtgtcctcagttagagcgcctctttgtgcagctcccgacaaacaccggtgatgcattcacggagaacttcttgaaggtggaggaggaggacccgccaaaaggtggattagaaaaccttcgcttagccaagctgacaaatttcaaggggcaccgtaatgagatgcagctagtagcatttctgcttagacagtctagtagtctgaagaaactatttctgattgctcccaaggaggatcaccctcaaggactgcgcaaggttcagtcagatatgctggctgattttccttaaaaaagaaatatcgcatcctggggaaagagcttcagcaaa

SEQ ID NO: 1913 - DNA, 363 bp, Zea mays
  Clone ID: LIB143-040-Q1-E1-H11
gacccgcccgtcaacagtcggagagagattcagatccactcgtcacacatccgcgttaccccctctcccttggtttcctctcccaccaccaacccccatcccggttatctccgccgccgcccgctttgggaaggcgcgacgaaggcaggcgagaggctccagccggacgaggaggaaagaggagcagcagggccggaggagagatgttcctgtgggactggttctacggggtgctggcctccctcggcctgtggcagaaggaggcgaagatcctcttcctcggcctcgacaacgccggcaagaccacgctgctccacatgctcaaggacgagcggttggtgcagcaccagccgacgcagcacc

SEQ ID NO: 1914 - DNA, 341 bp, Zea mays
  Clone ID: LIB143-040-Q1-E1-H12
ccgtcaaagccacttacaaacaagaaagaaaatgatgaagttttcattaagctgggttctgacaaggataagaagaaggaaaatgctgagcgtgatgagcgtgccaagaagtcggtgagcatcaacgagttcctgaaacctgctgaaggagaaaggtactacggcggccgtggccgtggaaggggccgtggggatcgtggtggttttagaggcggatacggagggggatacagtcgtggcccagctgctgctgctccatccattgaagatcaagctcagttcccaagcctcggtgggaagtgaagggcgcccagctgctgctgtcaccgagcgttgtgttg

SEQ ID NO: 1915 - DNA, 239 bp, Zea mays
  Clone ID: LIB143-040-Q1-E1-H2
caagcctctaaagagagtcatattacctcaataatttgcccgcgcaattcttgattttgatgcatgtaattctttgtcagttgcatgtgctgcagtccctgcgtgcagactcatttcgtgtctttcgttctgcccacaaaataaattctttctgcgttaaaaaaaaaaaagaaaaaaaaaaaaagaaaaaaaaaaaaaaaaaaagaaaggaaaacaaaaaaaaaaaaaagtagagtaac

SEQ ID NO: 1916 - DNA, 353 bp, Zea mays
  Clone ID: LIB143-040-Q1-E1-H3
agcgaaactgagtggaatgtcagcaatcaaagaacatccggtagcggcctttcatctcaccagattagagctgcaacccttcaatgttgtacttgtcctgaatgtggtaaggttgaattacgcccgctgggaaacagaacggaacagagcagattttacccgtattgctagctagaatgatttggtttgatgtactcatcatcagtctgaagattttactgggaaaaaaaagtacaaacttttccgttggaaaagaacctactgaagtgaatgttgacaggccgtctaaaaaaaaaaaaaaaaaaaaaaaagacaaatgaaggaacgaaaaaaccaaacgaagcgagggagag

SEQ ID NO: 1917 - DNA, 102 bp, Zea mays
  Clone ID: LIB143-040-Q1-E1-H5
aaaataagtcaaaataaaaaaaaaaaaaaaaaaaaaaaaaaaaaaaagaaaaagaaaaaaaaaagggcggatgctcaataaagataaatgcgtaggtcttcc

SEQ ID NO: 1918 - DNA, 421 bp, Zea mays
  unsure at all n locations
  Clone ID: LIB143-040-Q1-E1-H6
ctctcccttccggttccttcatctccgcctccacggctccacctccaccgctgctccacacgggcacacctttgcctcgcccaaccgctgccttgctcgcgttcgccattccccagaccttgagagctaccgtctggtccgatcggacggatcccttcgcgcgccccagagatttcaggtaaggtgctgtaacagaagatgcaagggggaagaggtgggaggcagggcttattcggtttcggggacccttctggtggttccggtggctttggacaaccagggagccttatgcctggtttttttggtggcgcanatccctttgacgaccctttcttcacaaacccctttggtagcatgatgcagactagtttctcagcccctttcagcggcatgatgcaacctagcttcatgaaccccttcg

SEQ ID NO: 1919 - DNA, 422 bp, Zea mays
  Clone ID: LIB143-040-Q1-E1-F6
aggtacgatctgacgctcatcccacatcagtagtcgaccaagcacaagcagcagagccggccggaatatgtggacgatcaggaaggtggcgacgccgcaggtggccgtcctcctgctgctcctcatcgtcgttgcgcaggaggcggcgccgttggcggaggcgcgcgtgtgccggcgccggagcgcgggcttcaagggggtctgcatgtccgaccacaactgcgcgcaggtgtgcttgcaggaaggctacggcggcggcaactgcgacggcatcatgcgccagtgcaagtgcatcagggagtgctagctagctagcagctataccggcctttaattaaattaataaggatcgacgtcgcggtcggtcgctaaatatgtactactatacgtctacactacatgcaataatgcaccacatgtac

SEQ ID NO: 1920 - DNA, 406 bp, Zea mays
  Clone ID: LIB143-021-Q1-E1-G3
agctacctagcaacgcgcagtaagcagcgtgggcaaagctacgagcgcccggctagcttcgccatgaacatgggtggggtgtccccgtcgacagtccggtgcaagcactgcagcacgcagctcaccgtgtgccccggcgagcgcgccatccagtgcacgcaatgctgcggcgtgacgcgtatccggcggcggcgggtccagcggccggcggcggcgccgcccaccacgggcttcccgcgcgcccgcggcaagaagcgggccctcctgatcggcatcacgtacgccggcacgcgccggggctgcggccagctgaaggggggcctcaacgacgtcaagtgcatgaggcaactcctctggcagcgcttcgcccttcccagcgactgcatcatcatgcctcactgatgac

SEQ ID NO: 1921 - DNA, 393 bp, Zea mays
  unsure at all n locations
  Clone ID: LIB143-021-Q1-E1-G4
tcgacccacgcgcccgggaactggcagaggttttggaggaggtgctggtggaggaggtggactaggcggtggtgccggtggcgggtttggcggtggcgcaggangaggtgttggtggaggtggtggccttggtggcggtgcgggaggcggtgctggcggtggtgcgggagctggcggtggtctcggtggtggtgtaggcagtggtgtcngtggtgggtttggaggaggcaaaggcggaggctttggtggtgggattggtgggggcggcggcgcaggtggtggtgccggtggtgggttcggangaggcaaaggtggcggttttggtggtggcaagggaggtggtttcggcngaggcgccggtggtgggttcggangaaggcaaagtggtggttt

SEQ ID NO: 1922 - DNA, 459 bp, Zea mays
  Clone ID: LIB143-021-Q1-E1-G7
cggacgcgtgggctctgctaagcgaagcgaagcttcaagctagtctcggcggctctagaagacgatgggcaaggacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgacgcggcgtgcggcggcgtgggcgtgctgggcatcgcctgggccttcggcggcatgatcttcgtcctcgtctactgcaccgccggcatctcggggggccacatcaaccccgccgtcaccttcggcctcttcctggcgcgcaaggtctccctggtgcgcgcgctgct

SEQ ID NO: 1923 - DNA, 453 bp, Zea mays
  Clone ID: LIB143-021-Q1-E1-G8
accacgtgcgctccacgcctcctccaggaaagcgagagcttctgcataagaacaacaaatcaaaagcgtgatcagctcggtgccaacaaaacctcaacaaccaagtttcatgtctgatctcgacgtccagcttccatctgcctttgatccgtttgctgaggcaaatgctgaggactctggtgctggtcctggaacgaaggattatgtgcatgtgcgcatccagcagcgcaacggcagaaagagtctgactacagtccagggtctgaagaaggagttcagctataacaagatcctcaaggatctgaagaaggaattctgctgcaatggtactgtagttcaggacccagagctaggccaggtcattcagctccaagggtgacagcgcaagaatgttgctactttcctagttcaggctgggattgcgaagaaagagaacatcaagaatcacgggtt

SEQ ID NO: 1924 - DNA, 416 bp, Zea mays
  Clone ID: LIB143-021-Q1-E1-G9
tgactggggcggtagcatcagaaggactgaagggttcaagatgagcaacagcctgaatgcgtcgagatttccgttttgtgctgtggtcatggcttctacaaaccagagaatcgtgctattgcagcaggttgaacggcccaaatcacctgaagagatgataacagttcttcaacgtgttgttgaagaatgtgctacatcacttgttgctgctaggattgaagctgaagagagactaaacaaccagcgattgcgtgaggaacaagatgctgcttacagagctgcacttgaagctgatcaagccagggaacgtgaaatgttagatgaactggatagacgtgaaagagatgctgcagacgctgaaaaaaagcgtaaagaagaagaggaagctgtagcaagggcatcccaagaagcaactg

SEQ ID NO: 1925 - DNA, 442 bp, Zea mays
  unsure at all n locations
  Clone ID: LIB143-021-Q1-E1-H1
aaggcagcagcacaagcaagaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgaggcggccaccgagggcggcggctgcgactgcaacacctgcaagtgcggcaccagctgcggctgctcctgctgcagctgcaactgagctggcccggcccggcgatggcgcacgagagtcgagaggangangacgacgacgaggcgtataaatataatagcggcgtccagtaaatangatcctgtccactgcaaccgccattatccatggtcgctcgctcctcgcctg

SEQ ID NO: 1926 - DNA, 427 bp, Zea mays
  Clone ID: LIB143-021-Q1-E1-H10
taacattatctggttcttattcatttcaagttgttctttcaaaaaaattggaatataagtcattttggaatcgtgtggttctattgctgctagcttagtaaggtaaaatagcctgacctcgtcaacaattagtttttttaggagaaaaagatgcaacaaatgaggattgatgcttcccgcaagagtacatgatgtacaatatatatctttagatggtttcattgttgactgttgtagctgatactaagaatgtagcttttttctttattcaaggtggtcgcagcgatctgtgattgtttatgcccaaagcgtagggttacccgtcttgttagcgctaccttagtgccgcttttttgaaccctagacatctcagaagaggtaccagctgtactttcacgggctttaacaaattatttagaaagccata

SEQ ID NO: 1927 - DNA, 382 bp, Zea mays
  Clone ID: LIB143-021-Q1-E1-H11
ggagaaccgctccttcgaccacatgctggggtggatgaagcggctgaacccggagatcgacggcgtgacggggcgggagtggaacccggccaacgcgtcggacccggcggcggggcgcgtctacttccgcgacggcgccgcgtacgtggacccggacccgggccactcgttccaggagatccggcagcaggtcttcggctccgacgacgacgccgcggacaacccgccccgcatggacggcttcgcgcagcaggcgcgctccatcggcggcggcgccatgtccgacgccgtcatgcgcggcttcaaccccgccgacgtcgccgtctaccgcgagctcgtctcgcagttcgccgtctgcgaccgatggttcgcgtccgtgccg

SEQ ID NO: 1928 - DNA, 313 bp, Zea mays
  Clone ID: LIB143-021-Q1-E1-H12
ccggaatcaaaagcaggggtgctcgacgcggctgaagacatcgatccaccgggtcaccgcgccggagtgaaacccggttaacgcgtctgacgcggcggtggggcgcatctacttccgcaaccgcgccgcgtacgtggacgcggacgcgttcgactcggaccatgagatccggcagcacgtcatcggctccgacgactacaccgcagacaagactctccgcatggacggcatcactcagaaggcgcgcgccatctgtggcgatgccatgtccgacaccgtcatgcgcagcctgaagccctccgaggtcgacgtc

SEQ ID NO: 1929 - DNA, 443 bp, Zea mays
  Clone ID: LIB143-021-Q1-E1-H2
agcaaacttatgccttctacttcatcaaggtccgctcatttgaggatcctaaactgagggcaaaactcgagcaagctgacaaagaattccagaagaagatccaagctcgttctaaacttatcgaggcagtaagagccaagaaggcagagcgctccagtattatcgcggagctgaagccattgagcgctgagaacaagcaatataatggagttgtgaatgagaagataaaggagatggagcctcttcggaacagcttgggcaagtttcgtgaggaaaacaatgccatgagagcacagagtgcacgtttatgctcttctatcgaagaacttgacctaacgattaagatgctgaatgatcgcatcgtacatgagagcatacctttatctgaagagaagcgttcggtgaaagaaattaaagaccttgaaaaaaccagattgaaagtc

SEQ ID NO: 1930 - DNA, 373 bp, Zea mays
  unsure at all n locations
  Clone ID: LIB143-021-Q1-E1-H4
agcatcagcagagatcgcagcggcactccatggtccaggcccagcagcctcttcggctcttcgttgggggtgcgtggacaccggaaattgcctcggggattgcgttcctgatctaagcccggcatgaagggctgctcagagcgtttgctgctcctgctgctgctggcatcgtcgttgttactgtccgtcgtggttgccgcgcagcagacttgccctgccgacctcgacagcaaatgcgacggtggcgcgcctgatgactgggagggggaattcttccccggcgtcncgaaaatcaagtatgagggtccaacaagcaagaaccctcttgcttataagtggtataacaaggaggaagtcattctcggaaagaaga

SEQ ID NO: 1931 - DNA, 415 bp, Zea mays
  Clone ID: LIB143-021-Q1-E1-H6
caaaggtcttgatgtcattcagcaagcacaatctggtacaggaaagacagcaaccttctgttctgggatcttgcagcagctggactatggcctggttgaatgccaggccctggtccttgctcccacccgtgagcttgcacagcaaatcgagaaagtcatgcgcgcgcttggtgattaccttggtgttaaggtccatgcatgtgtgggaggaacatccgtccgtgaggaccaaaggattcttggcagtggtgtgcatgttgttgttggtacacctggtcgtgtgtttgatatgctgcgcagacagtccctccgccctgataacatcaagatgtttgttctagatgaagctgatgaaatgctttctcgtggtttcaaggatcagatttacgacatcttccagcttctcccagcaaag

SEQ ID NO: 1932 - DNA, 237 bp, Zea mays
  unsure at all n locations
  Clone ID: LIB143-021-Q1-E1-H7
acactcaacagcaacagctaagcctctcccacaagacagcaacatggctgangangaggccaagaaggtggaggtggaggtcaccaaggagcccgaggcggcggcgaangaagacgtanccgatgacaaggccgtcatccccgcgaccgacccgccgccgccgccgccgccggccgacgactccaaggccctggcatcgtcgagaaagtgcagatgaactgctccgagaagcctgcc

SEQ ID NO: 1933 - DNA, 409 bp, Zea mays
  Clone ID: LIB143-021-Q1-E1-H8
cagagatcatgaaagttgcagatttcatcaacgaaattcgtcaggctggcagaaatggagaactttcaggtgagactttcatattcttcaacaagcagatcaaaggaaacaagagggagatcatacagcttggtgtaccgttatttcaacctaccacagaggatgctaattgtcacacagaaccaatcccccttgtcctgcaggctgtcattgaccaccttgttctttggcgtttaataccagaaagcaggaaaccaaatagtgtcgtcatcaacttcttcgatgaggatgaacattcgcagccctacttcaagcctccccatcttgacaaccccatttgcactcttctgctgtctgaaaccacgatggcatttgggaagtcacttgtcactgacagcaacggtaacta

SEQ ID NO: 1934 - DNA, 423 bp, Zea mays
  Clone ID: LIB143-021-Q1-E1-H9
ccatcagctcacactccggcagccgagcgatcgagctccccggtcgctagcacagccggccactgcacacgacggtgctggtaggttgcaagcacttgcaggatggcgcaggtcgctaagacgcttctccttgtggccctggtggtcgtgtcggcggtggagctgtgccgcgccatcgagttcgacgagcgggacctggcatcggacgaggcgctgtgggacctgtacgagcggtggcagacgcaccaccgggtgcaccggcaccacggcgagaagggccgccggttcgggaccttcaaggagaacgcgcgcttcatccacgcgcacaacaagcgcggcgaccgaccctaccgcctccgcctgaaccggctcggcgacatgggccgtgaggaattcggttccgggttcgccgactcccgcatc

SEQ ID NO: 1935 - DNA, 315 bp, Zea mays
  Clone ID: LIB143-022-Q1-E1-A1
acgaagccctgactccaagctggcacctgcattcctcgcgctcactgtcgcacccgccctatgtactaccgcccacagctgcagctgctgcgcccataggcgctgttcgcaagacaccgtcactcccctaggactaatcatctctgaccaaacgaacttccagtggacttggcatctgacgataatctatctaatgctaatgattcagaatctgcgccctcaagctatgagtatatcccaccttctgtagtcgacaggaatgaaacttctgagatataagatcctgctgaacatccagaagaacgtcaactagca

SEQ ID NO: 1936 - DNA, 417 bp, Zea mays
  Clone ID: LIB143-021-Q1-E1-G2
cgcaccacaagcgagcgagggacccggggcggaagaagagagagaagacgtctctctcctctcggcgtccccgttccccaacctctcgtctgctgcctgcctgcctgcctgcctgcaaaaaggagtttgtcatggcgtctaagcgcatcctcaaggagctgaaggacctgcagaaggacccccccacatcatgcagtgcaggtcctgctggtgaggacatgtttcattggcaagcaacaattatgggaccacctgacagtccctatgctggtggtgtttttttagtgaacattcatttcccgccagattaccccttcaaacctccaaaggtttctttcaagacaaaagtcttccatcctaatatcaacagcaatggaagtttatgccttgacattctcaaagagcagtggagccctg

SEQ ID NO: 1937 - DNA, 123 bp, Zea mays
  Clone ID: LIB143-021-Q1-E1-E5
aaccgcgcagcggcacgcgtctcgcttctggtttgcttgcctgttgccccccagatcttgccaactaagtggacgcagcccagctgatctcccaatccgcaacgcggccgtcccgacggcgga

SEQ ID NO: 1938 - DNA, 457 bp, Zea mays
  Clone ID: LIB143-021-Q1-E1-E6
attatccccgccgctgccatggccaccggcggcgccgcccccaccgctttcgatgccgggtccaagaagaagttgctcatctttgactccgaggaggatctctcggtttctctggcgaagtacactgcggagctgtcggagaagttcgcggccgagaggggtgcctttaccgccgtgctctctggcggatccctcatcgaggcactcaggaagctgacggagccgccgtacctggattcagtggactggagcaagtggcacgtcttctgggtggatgagagggtcgtgcccaaggaccatgtggatagcaactacaagctcgcctatgatgggtttctctccaaggtgccgattcctcctggacaagtttatgctataaacgatgcgttgtcagctgaaggagccgcagacgactacgaagcctgcctgaagcagcttgttaagaacggtgtgattt

SEQ ID NO: 1939 - DNA, 408 bp, Zea mays
  Clone ID: LIB143-021-Q1-E1-E9
cggacgcgtggcgactgcatctctggtctcccacgcctataatcccattcccctccttcaaatccctgcggcgatttcgattcttcccttctatctccaggtatacccatcggagcagcactgacaaaaattctccagatatggcaagcaaaaggattcagaaggaactcatggatctccaaaaggacccaccgacatcatgcagtgcagggcctgctggagaggatctattccactggcaggccacaatcatgggtcctagtgacagcccctatgcaggcggggttttctttattaatatccattttcctcctgactacccctttaagcctccaaaagtgaacttccaaacaaaagtttatcacccaaacatcaactctaatgggagcatttgccttgatatcctca

SEQ ID NO: 1940 - DNA, 435 bp, Zea mays
  unsure at all n locations
  Clone ID: LIB143-021-Q1-E1-F1
acgccggattccgagtcgaccacgcgtccgcggcgagatctgcatccgcggggagcagatcatgaaaggttacctgaacgaccccgagtcgacgaagaacaccatcgacaaggacggctggctgcacaccggagacatcggctacgtggacgacgacgacgagatcttcatcgtcgacaggctcaaggagatcatcaagtacaagggcttccaggtgccgccggcggagctggaggcgctcctcatcacgcacccggagatcaaggacgccgccgtcgtatcaatgaacgatgaccttgctggtgaaatcccggtcgccttcatcgtgcggaccgaaggttctcaagtcaccgaggatgagatcaagcaattcctcgccaaggaggtggttttctacaagaagatccacaaaggcntcttcaccgaatccatccc

SEQ ID NO: 1941 - DNA, 408 bp, Zea mays
  Clone ID: LIB143-021-Q1-E1-F11
gcagcggtggccgctgccggcgccgtccatccccaccgcacaccaccgcctccaccacgccaccgactccgcctctcgctcccccctcgccgcgccgcccgaacgccacgatgcgtcacctcctcctctcccgcttcctccgccgcggtggcggcagcggcatccccaacggccactaccaccacctccccctcctccgcgccctctcctcctccccctccccggtctcctcggacgcagagctccgcaagtacgcgggctacgcgctgcttcttctcggctgcggcgccgcgacctactactccttcccgttccccgccgacgcgctgcacaagaaggccgtgccattccggtacgcgccgctgccggaggacctccacgccgtctccaactggagcggcacgcacg

SEQ ID NO: 1942 - DNA, 354 bp, Zea mays
  Clone ID: LIB143-021-Q1-E1-F12
gtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccg

SEQ ID NO: 1943 - DNA, 413 bp, Zea mays
  Clone ID: LIB143-021-Q1-E1-F2
cagcattgctgaggcctgggcgtcttgatcagcttatctatattcctctgcccgatgagcagtccaggcttcagatcttcaaagcctgtctcaggaagtctcctgtggccaaggatgttgacttgaatgctctcgccaaatacacccagggtttcagcggtgcagatatcacagagatctgccagcgcgcgtgcaagtatgccatcagggagaacatcgagaaggatatcgagagggagaggcgcaggaaagacaaccccgaggctatggaggaagacgaggtagacgacatcgctgaaatcaaggctgctcacttcgaggagtccatgaagtacgcccgtcgcagcgtgagtgacgccgacatccgcaagtaccaggccttcgcccagaaactccagcagtcccggcgggtt

SEQ ID NO: 1944 - DNA, 310 bp, Zea mays
  Clone ID: LIB143-021-Q1-E1-F3
cgacacgcctcagacaattcggacccgctggcccgtccgccactctctcggcctcacgtcactaaagcgcatcagttctcaagtgccagtcgcagagaagtctcaagaagccactgtccttcacatgcacggtcgccagttccacatgcactggatcatcggtgaaggtgtacaggccagtaacatacgcgcatccgtctcagcatacgaggaagagaatctgccacgagaactacatggacacagacctgtggggcccttcaatgtcagttagcagtagcatgtatatcacagtgatgcagaccccgct

SEQ ID NO: 1945 - DNA, 396 bp, Zea mays
  unsure at all n locations
  Clone ID: LIB143-021-Q1-E1-F4
cgaccacgcgtccgcaaaatcctgagatatgaaatgaatttgagggcagcagagttccgctcacgtgatggcggatgatgatggacgtgcaggaagcacttggaactggttggaccattactgtacaagcagtttgaggatcatgtgtgggttttctgttctactctcttggaggaaggtggtcncggaacatgcatctgatggagcctcaaaggttccacttagtctcatggagatgcttangttcgatgtgtaacatattcatggagacgcaaaattcagaaagttgacttccctgcccttttccttaatcagtggggttctggttgtgtcactctggtaaatagccgataattgaataggtgatatctggtctggctacatgtccattactgt

SEQ ID NO: 1946 - DNA, 124 bp, Zea mays
  Clone ID: LIB143-021-Q1-E1-F6
acgcgaccggccaatctagcccccagtcctcgaattgttcccatggccgccgccattcgcggaagccctagccgcgccgccgcgccgacgcagcgtcgagcggtgatgcgggtggtgtcatggg

SEQ ID NO: 1947 - DNA, 415 bp, Zea mays
  Clone ID: LIB143-021-Q1-E1-F7
ggtcgaccacgcgaccgcattaatccagagctggcttatggagcatctggttcacctccaactatcccacccaatgcaaccctgcagtttgatgttgagctgctttcatggaccagtgtcaaagacatttgcaaagatggcggcatattcaagaagatccttaaagagggagagaaatgggagaacccaaaggatcctgatgaagtacttgtgaaatatgaggcccgtctggaagatggtactgttgtatccaagtctgagggggttgagtttacggtgaaagatggctacttttgtcctgccctggccaaagctgtcagaaccatgagaaaagcagataaggtgctccttacagttaaaccacaatatggagttggtgagaagggttgaacagcagccgggagaggaaggtgct

SEQ ID NO: 1948 - DNA, 427 bp, Zea mays
  Clone ID: LIB143-021-Q1-E1-F8
ggcagcggcggcggcggcagcaacaacatacaccgctggccgtggcgccatgggcatcctggaccacatgtcgcatgtgtgcagcatcacggagacgaaggaggcgctcaagctcaggaagaagcgaccgctgcagacggtgaacatcaaggtgaagatggactgcgaaggttgcgagcgtcgcgtgaagagcgcggtgaagtcgatgcgcggcgtgacgagcgtgacggtgaacgcgaagcagagcaagtgcacggtgaccgggtacgtggagcccgccaaggtgctggagcgcgtcaaggccaccggcaagaacgccgagatgtggccctacgtgccctacacgctcaccacctacccctacgtcggcggcgcctacgacaagaaggctcccgcgggcttcgtccgcagcgcgccgcaggccatg

SEQ ID NO: 1949 - DNA, 238 bp, Zea mays
  Clone ID: LIB143-021-Q1-E1-F9
cgcttgccgtagcggtccgttattctagggtgcccccacgcgtccgaaattgtttccaataaacagggctgtgcccgccgttctgttgtactccgtctgtggttaggttagtagttttcttgatctcgcccccacgcggtacctgttttactactctctgtttggtggtttctgaggaagttgcccgtgtacttgtatcgtaaaaaccgagtgggacatctgcatcgtttcatctgcc

SEQ ID NO: 1950 - DNA, 313 bp, Zea mays
  Clone ID: LIB143-021-Q1-E1-G1
ccacgcgcccgcggaaagatctacatccgcggggagcagatcatgaaatgttacctgatcgactccgagtccacgaggagcaccatcgactacgactgctggctgcacaccggagacatccggctacgtgtacgactaggaccagatcttcatcatcgacaggctcaacgagatcatcaagtacgacggcttccaggtgccgccggcggagctggacgcgcgcctcatcacgcacccggagatcaacgacgccgccgtcgtaacaatgaactatcaccttgctggtgaaatcccggtcgccttcagcgtgcgg

SEQ ID NO: 1951 - DNA, 429 bp, Zea mays
  Clone ID: LIB143-021-Q1-E1-G10
caaacgcgtccgcaaacactcaagtcctcgtcccttccgcaccctcctcttcaactccagccgctttcaccgccaatcagaggtccaccaccacatctcttcgcatccaaccgccccgtaggatcacagaaaacggggatggcgagcggcggggcggtgagggaggtgggctcggcggccgagctgcaggcggcggtggccggggcgcgggcggcggcggtgcacttctgggcgtcctggtgcgaggcgtccaagcagatggacgaggtcttcgcgcacctcgccgtcgacttcccccacgcggccttcctccgggttgaagctgaagaacaacctgaaatatcagaggcgtatggagttacagcggtgccatattttgttttctgcaaggaaggcaaaactgtcgatactttggagggagcaaaccca

SEQ ID NO: 1952 - DNA, 389 bp, Zea mays
  Clone ID: LIB143-021-Q1-E1-G12
catagctacctactactcaagtatccatccttattgagtacagtgttgatccatggactcggaaggagttgtagcagcaaaggtggcagatgagactactaaaccggcaatccaagaagacggcgccgagagcaaggccgggatgactgatctgctgatgctgaccgacaagtcgcagctgcaggcgctggcgatgctgctgcggaacaacgaggagctcatgatgagccaggcgatcaagtcggagacggagcgcattgagtacctcaagacggtgagcgactgctacacgcggacgatgaagctcctcgacgattccatggcggccaggaccacgtacgagcgttcgggcggaacgaagagcctcgtcgcccgggacatggacgact

SEQ ID NO: 1953 - DNA, 415 bp, Zea mays
  Clone ID: LIB143-021-Q1-E1-E4
gccactgcccaatgccacctcaaatccccgcgaacctatctttcccttcccccgatccaggcggttctcttcccagaagccagcccagaatggtgggatccgacgcgctgcagtccatcgtttacagccgtgggtcactccgcctcctcgatcagaggaagctgccgctcgagatggagtacatcgacgtcaagagttccgccgatggctggaatgcaataagagacatggttgtccgtggtgctccagcaatagccatagcagcggcactagcattagccgttgaagtttctgatttagattttattggtacgcctgaagaagcagcttcttttgtttcaaagaaattggaataacttggtaccagccgaacaactgcagtgaacctatctgatgctgcaacaaaactccaaac

SEQ ID NO: 1954 - DNA, 450 bp, Zea mays
  unsure at all n locations
  Clone ID: LIB143-021-Q1-E1-C8
ccaagttcactcctgagcaggctaaactggtgaagggctcggcagactacatcggtatcaacgagtacacatccagctacatgaaggggcagaagctggtccagctggcgcccagtagctactctgccgattggcaggttcaatatgtttttgcacgcaatggcaaaccgattggaccacaggcgaattctaagtggctctacatcgccccgacggggatgtacgggtgcgtgaactacctcaaggagaagtatgggaatccaacgatctacataacggagaacggaatggaccagcctggaaacttgacccgagaccagtacctgcgcgacgccacgagggtgcggttctacaggagctacatcggccagctgaagaaggccatanaccaaggagcgaacgtggctggctacttcgcctggtccctcctccacaacttcgagtggctgg

SEQ ID NO: 1955 - DNA, 275 bp, Zea mays
  Clone ID: LIB143-021-Q1-E1-C9
cgtccggaagagtatgagtactgcatgcttcgccatgtggaccctcaagttccttatgccagagatcttatcactatcctgtacgatgctattaacattggatatccacatctaatagtggcacacgacattgagcacgaaactcttgcaatccttgtggatatcatgcttagacgttcattgttcattgtcgctactaccgtccctgtctcttggagagcacaacttcaagtgcctcattacattcctactctcattggaggcattgtcatcat

SEQ ID NO: 1956 - DNA, 358 bp, Zea mays
  Clone ID: LIB143-021-Q1-E1-D1
tgcacaaagcgcctagcataagcatacttcccgaagcactcttgcaatccactgagttctgtttgttgagacgcatagagctagctgctagcgtcgacaatgtcgctcgtgaggcgcagcaacgtgttcgaccccttctcgatggacctctgggatcccttcgacaccatgtgccgctccatcgtcccgtcggcgacctccaccaactccgagactgccgccttcgccagcgcccgcatcgactggaacgagacgcccgaggcgcacgtcttcaaggccgacctccccggcgtcaagaacgacgaggtcaaaggtcaggtcgaagaccgcaacctgctgggtcacagccgccagcgca

SEQ ID NO: 1957 - DNA, 421 bp, Zea mays
  Clone ID: LIB143-021-Q1-E1-D10
gttcgacgtcatgggcgtggagaccgtcctcgtcgcgcgcaccgacgccgtcgccgccacgctcatccagaccaacgtcgacgcgcgcgaccaccagttcatagtcggcgccaccaacccgggcctcaggggccagagcctcgcggccgtgctctcggccggcatgtcggcgggcaagagcggaagggagctccaggccatcgaggacgagtggctggccgcggcgcagctcaagaccttctccgagtgcgtcagggacgccatcgcgggcctcggcgtcgcggcccaggagaagcagcgcaggctccaggagtgggaccgcgccacgggcggctacgacaggtgcgtgtccaacgaccaggcgcgcgacatcgccgccagcctcggcgtcacgtccgtgttctgggactgggacctgccg

SEQ ID NO: 1958 - DNA, 404 bp, Zea mays
  Clone ID: LIB143-021-Q1-E1-D11
gacaagaacagatacccgagtcgacgaagcaaccgctcacaatcccaatctcccgcgtcactcataacccgaagtaacaaccgtcggtccgaccaacaatgtcgctgattcgccgtggaaacgcattcgaccccttctccctcgacctctgggaccccttcgagggcttcttccccttcggctccggcgacgtccgcagcctcgttccctcgttgccgcgcaccagctcggagaccgcggcatttgccggcgcgcggatcgactggaaggagacccccgaagcgcacgtgttcaaggcggacgtgccggggctgaggaaggaggaggtcaaggtggaggtcgaggacggcaacgtcctgcagatcagcggcgagcgcaacaaggagcacgaggagaagaacgac

SEQ ID NO: 1959 - DNA, 429 bp, Zea mays
  Clone ID: LIB143-021-Q1-E1-D12
gcacaatgtttgttcctgaaattacatccctccagaactcccaaaatcagttcaccgtaccttcgagtttcaagcgccggagaagagagtattgaggtgacgacaagatcactagacgtccactgtccagtttaggccatcttgagagaaaggtttcttgctgtaccaaatgacggagaaaggatatccaggactgggttatcattcaaacttcaactgaactatccaagtagctaggtttgaagtgtgctgcaatgcttcaatgatgttcattttccaaagatctgagcttcgctagtgttggggtctttttctccgccgaaggtcctctaggcaaaaacaccttcggcaagacagtacaaaggcaggtgcaacatgaagatataagtcgaagctacgatcgaaagagcttcggcttggtgtcatgct

SEQ ID NO: 1960 - DNA, 453 bp, Zea mays
  Clone ID: LIB143-021-Q1-E1-D2
cagagaagcaaatgacacctgacgcatgtgctccattgattgccaccctgccattggaggtccgcacaaagataggtggtttcattagagctgtattttctgttttccaagacttggatttctcatttcttgagatgaacccattcaccttggtaaatggtgaaccgtatcctctggatatgagaggagaactagatgacacagctgctttcaaaaacttcaataagtggggcaatattgtgtttcccctaccatttggaagagttctcagtccctccgaaagttttatccatgaactggatgagaagacaagtgcttctctgaaattcacggtactgaacccaaaaggacgcatctggacaatggttgcaagtggtggtgctagtgtcatatacgcagacactgttggtgaattgggatatgcttcggagctaggaaattatgcagagtaca

SEQ ID NO: 1961 - DNA, 460 bp, Zea mays
  Clone ID: LIB143-021-Q1-E1-D3
acggctcggattccgagtcgaccacgcgtccgggcgaagtcatgcctggacaggtagtagtagtacttgatgcatgctgctgatctgaactgctggttctgttctgaaccaccggccgggttccttccttgtcaaacagtgggagttccaagtcgggccgtccgttgggatctctgccggcgacgagatatgggtcgcccgctacattctcgagaggatcactgagatggccgggatcgttctctccctcgacccgaagccgatcaagggtgactggaacggcgccggcgctcacaccaactacagcaccaagtcgatgagggaggccggtggctacgaagtgatcaaggaggcgatcgagaagctggggaggaggcacagggagcacatcgccgcgtacggcgaggggcacgagcgccgcctcacgggccgccacgagaccgcccaaatcaacaccttc

SEQ ID NO: 1962 - DNA, 359 bp, Zea mays
  Clone ID: LIB143-021-Q1-E1-D6
ttgaattgtcattgacataatatcaccagagaaaccaaaacgcactatacaatctcaaagaacgccaggaaaaggccttgtgcttctaaaaaatttctttttaaggaaaacaacatctgactcgttgtctctccctgataaggataattatcctgagccagatttagaggaggtctttgaggacggatgcccatccctttcaaggaggcttaattctgagtatcctgtccgagacatgttcaaactttttgcatgtgcaatttgtcaaattgacttggaatctggccaaggcatatccatacacgagggtttgtcaaggccagggaagctgcgtccctgggattgccctttcctttgtc

SEQ ID NO: 1963 - DNA, 438 bp, Zea mays
  Clone ID: LIB143-021-Q1-E1-D7
cgaagcacgatggactcggttatttcttaaaattgggaagaatataatggatatggtgagattacattttcaggcaaactatatatatatagtatttagagccctgagctctctctaactattggaagacccgaccagcaaaccactatgtgcgcggaccgcaccgtactgaccatgtgcgcagactttttggctcactgtaccacctacttaattataactacgtgttatgctcaattgtggtttacacacttttttggtatgcgcatgttgtacacaagtttacgcttattttgtcatactgtctgaaagcacttcctgtactatcatataaaatcgaccgcgactactgctttgcccgaaaggactacggtttcagcggcagcggctgccgagccccattccccgatctgaagcacctcaaaccacggctctgcc

SEQ ID NO: 1964 - DNA, 449 bp, Zea mays
  Clone ID: LIB143-021-Q1-E1-D8
acgcacgcaggtcgtaggctatcctcaatccccgatcccgtgcggcggcggttccatagcaacacagtacggcaagacggcaagtccaagtttgcagcgattgcagctccactgctccccaccttctcgccgtgcacgcctgcgcagcgcgcggcgaacggttcgtcggtgccgtggtcgtggtcgtgcgcgagcgcctgtccacggcgggcccacggcgaggtgcgaagccgctacagggcccacggcgagcactgaccgccgagcgggcgaggccgtgacaagcacccactacgtgtccagcacaacagcacgccaggaacagtggtccagctcccactatggttctaaccagcaatatttcggttcagaagaacttgtaacaggttttatctgttagtgaagacgctacatacgatgagattcgcgcaccatacaggtctgccgct

SEQ ID NO: 1965 - DNA, 415 bp, Zea mays
  Clone ID: LIB143-021-Q1-E1-D9
gaagaggaaggcatgccggcgttcgcgctcgtcaacaaggccacggggctcgccatcaagcactccctcggccagtcccacccggtcaagctcgcgcctttcaacccggaccaggaggacgcgtcggtgctgtggacggagagcaaggacgtgggcaagggcttccgctgcatccgcatggtcaacaacacccgcctcaacttcgacgccttccacggcgacaaggaccacggcggcgtgcacgacggcaccgccgtcgtgctctgggagtggtgcaagggcgacaaccagagctggaagatcctgccgtggggtcccgaggccaactcctccgcggcccacgcgggaggcccgcacgccgtgcgcgtcttctgcaaggccggcggcgaggactacagcctcacggtgcgcaacg

SEQ ID NO: 1966 - DNA, 97 bp, Zea mays
  Clone ID: LIB143-021-Q1-E1-E1
agcactcgttgcaatccactagagttcagtttgttgagacgcagacagctaggtgcgatcgtcgacaatgtcactcgtgaggcacatcaacgttttc

SEQ ID NO: 1967 - DNA, 380 bp, Zea mays
  unsure at all n locations
  Clone ID: LIB143-021-Q1-E1-E10
ggcaccacacctcttcctcctcttcctcctcctagcacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcgaggcggccaccganggcggcggctgcgactgcaacacctgcaactgcggcaccagctgcggctgctcctgctgcagctgcaactgagccggcccgcccgggccggcgatggggcacgagagttcagaggacgacgacgacgaagccgtataata

SEQ ID NO: 1968 - DNA, 414 bp, Zea mays
  Clone ID: LIB143-021-Q1-E1-E11
ctagcccacggacccaaccaaatcctcctccacctcctccatctccagccccgtccctacccagctcgtgtaacctcccgatgtccgggggcggaggcggcgcaggcgcgggctcgtcgtccggcggcggcggcggaggtggagggggcggcagggagggcgactgggactgcggcagctgcggcaaccggaactacgccttccgctcgctctgcaaccgttgcaagcagccgcgcctcctcgtcgaccctaacaccccgcgcgactccaagtggctaccccgtgccggggactggatctgcaccgaaagaactgcaaaaagtgtggcctatccaaggaggaagcagcaatgccagcattgcaaatggcacggatggctatgccagcttatgcaacttatatcgcaagactaca

SEQ ID NO: 1969 - DNA, 132 bp, Zea mays
  Clone ID: LIB143-021-Q1-E1-E2
gacccacgggcgcgctcaagaactcaatttcgatctcagttgaaagcaacccatcctcgtttcctccgtctagcagcctctcagcctcatggccaggatcaagatcgggatcaatgggtttggcaggatcgg

SEQ ID NO: 1970 - DNA, 281 bp, Zea mays
  Clone ID: LIB143-021-Q1-E1-E3
ggcgctactgcaactgcggctcatcaatccgtgcagtcccagagcaccccgtcttcccgctactcccgcaagggcgctcgtcgcttccttctccggggcgtggcaggcaccttctggtagagcgagagcgagagcagcgccgccggcagttcgcgctatggcgtcgcagcaggtgttccgggctcagcagcagcagcagcagcagttcccggctcagcagcaggagtcccagccggggaatgagcacgccatggaccccggcccgaggccatcgtccagga

SEQ ID NO: 1971 - DNA, 180 bp, Zea mays
  Clone ID: LIB143-021-Q1-E1-C7
gcgaacggccgcccttttatttgttttgtgaattaacatgttcatcggataaacaacttcggcaatgaagagtcttagcaattacagttctcaaaattttaaattgcaatttttcagaaccctcggcagccaactttttgttttcatgtaacaaaatcggacgcgtgggttctagatcgc

SEQ ID NO: 1972 - DNA, 126 bp, Zea mays
  Clone ID: LIB143-040-Q1-E1-D2
cgcgtcaacacacacaacctgcctctctcgtcccctggcggcgtctgcagcaggatggcggattcaacggcgaggaccgttaccgcggccaagccgtgccattcccgcgtgggcgagtccccacac

SEQ ID NO: 1973 - DNA, 392 bp, Zea mays
  Clone ID: LIB143-040-Q1-E1-D5
aagcctccgatccccaattcctccttcggatctcgcattcagcgcagcgcaggtgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaggacaagatcagacctctttggaggcattacttccagaacacccagggtcttatctttgttgtggacagcaatgaccgtgaccgtgttgttgaagccaga

SEQ ID NO: 1974 - DNA, 365 bp, Zea mays
  Clone ID: LIB143-040-Q1-E1-D6
tgaaataagtcaaaaataaaaaaaaaaaaaaaaaaaaaaaaagaaaaaaaaaaaaaaagataaaaaaaaaaaataaacgaaaaaaaaacgaaaaaaatacttcataaaagacagggggggcccccctaaaggttcgtcgcttaagtacgtttgaatgcaacataatatcccttttatggtgcttcctcactttgcttcacggcccgtttttttaaactgtcgtaatgggaaaaacgctggctttcctcaccttacccaccttttaccaaacccccttttcgcaaggtgcggtacctgtaacggggccttaaccgttgccgcttccgaagttttgcgcagcgtgactgccaaaggggccaccccct

SEQ ID NO: 1975 - DNA, 364 bp, Zea mays
  Clone ID: LIB143-040-Q1-E1-D7
cccgggtcgatacaagactctagacgcattcccatcaagaaacatccctgctcaacaacttctccgttgctcaacatggcgtcgtaattgttgccgggaccattgccaacagatagtcacggcctcttcgtaacttcactccgtccaggttcgtcgccgctcgtgccaacctcccgcggctgtaactccctctcccttcctcctctcagcgcatgcctcatcacgccctcatcacccatcgttgctggttctgcccgctgttgctggagatcgtgaccatggaactcacgtcgtcgtcctagcgctcctcgcgatgttgctgctccagggcgtcatcctcatgtcaacggtggaaggccttgtg

SEQ ID NO: 1976 - DNA, 373 bp, Zea mays
  Clone ID: LIB143-040-Q1-E1-D8
aactggagtccaagtgcaactgtataatcatgtaagtaacttcacgtccaaggtcgaaggagttgtgatattggttgggacgaaaatccatgctttctggtttcatgtcacatgcaacttgaagcatgcctacctgcttggttaacccgctgtcagcagcaacgatggagttcaaggcagtggatcttccactagattattttgcagaggtgcatttgctgtgttttttaggtgacagaatgcactgcgagctattcttttgtaaagtcttttcttctctgttgtggaaattttctgcttgtcgtgaggtctattgcggtttgtccaaagtgtgaaagactactagagttgtgctgatagcgtatttacttgc

SEQ ID NO: 1977 - DNA, 395 bp, Zea mays
  Clone ID: LIB143-040-Q1-E1-E12
aactatagtacggcgtagagagcatatcggaagttctagtcgaaggtctctctagagtgaagaggtgcaccgatgaagggcgtgctctgatgtcactcgacctccaggtactaattaatgggctgcagcacatcgtggcatcaaatgtgaggccgaagctgcagaccgtggacactttcataaaggcttactatctaccggagaccgagtacgtccactgggcgcggtctcatccagaattcagtacaagtcaggtagtcgggttggttaacctggtggccaccatgaaagggtggagacggaagacgagactagaaaccgtggagaagatcgaggcggggccatagactcggtgtcaggtttttttttgcctgtgttgtttttgcttcagctgc

SEQ ID NO: 1978 - DNA, 385 bp, Zea mays
  Clone ID: LIB143-040-Q1-E1-E3
gaagaagggtgagaacgcaatcttcactattccgccgggtcttgcctacggcgagatgggttcaccgcctaccatcccgcccaatgccacactccagttccatgttgagctcctttcttgggccagcgtcaaagacatatgcaaggacggtgggatttttaagaagatcatcgttgaaggggagaagtgggagaaccccaaggaccttgatgaagtttttgtcaagtacgaggtaaggctcgaggatggaactgttgtgtccaagtctgatggtgttgagtttgctgtcagagatggttatttctgcccggcactttcaaaggctgtgaagacaatgaagaagggcgaaaaggttctcctcaatgtcaagccacaatatggcttc

SEQ ID NO: 1979 - DNA, 398 bp, Zea mays
  Clone ID: LIB143-040-Q1-E1-E4
aatcccccttgcaagtatagtctcggcggctctagaagacgatgggcaaggacgacgtgatcgagagcggcgctggcggcggcgagttcgctgccaaggactacacggaccctcccccggcgccgctgatcgacgcggctgagctggggtcctggtcgctgtaccgcgccgtgatcgccgagttcatcgccacgctgctgttcctgtacatcacggtggccaccgtgatcgggtacaagcaccagacggacgcgtcggcgtcgggtgccgacgcggcgtgcggcggcgtgggggtgctgggcatcgcctgggccttcggcggcatgatcttcgtcctcgtctactgcaccgccggcatctcggggggccacatcaaccccgccgtcaccttcggcctc

SEQ ID NO: 1980 - DNA, 398 bp, Zea mays
  Clone ID: LIB143-040-Q1-E1-E5
atcaggcttgaggctcttgaccagatcaccgagcccaagaggccttcggacaagcccctgcgtctgcccctccaggatgtgtacaagattggtggtattggaactgtaccggttggtcgtgtggagactggtgtcatcaagcctggtatggtagtcacctttggtccaactggcctgactactgaggtgaagtctgttgagatgcaccacgaggcgcttcaggaggctcttccgggcgacaatgttggcttcaacgtgaagaacgttgctgtcaaggatctcaagcgtgggttcgtggcctccaactccaaggatgaccctgccaaggaggctgccagcttcacctcgcaggtcatcatcatgaaccaccctgggcagattggcaacggctatgcccc

SEQ ID NO: 1981 - DNA, 306 bp, Zea mays
  Clone ID: LIB143-040-Q1-E1-E7
aagcagcaacgcactcacaaaggaaaaaaacatcatgctcctgcccacaacatgatcgatactaatctcaatacaccagcatcgcaaactagacaggggtcgaagctctcgcgggtccttccattgcttgagcctgcgcgttatgtcagtgcgcttggaaattctcacatcgttttacatttaatgcgcatctttttagagctccctgtcggtaaaacgcgtggcgttagctacttcaacccctttgcggtatacccccctttcggcaacttctgttggcgctgtcaggccccccctttttgccca

SEQ ID NO: 1982 - DNA, 357 bp, Zea mays
  Clone ID: LIB143-040-Q1-E1-F1
gcaagaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgaggcggccaccgagggcggcggctgcgactgcaacacctgcaagtgcggcaccagctgcggctgctcctgctgcagctgcaactgagctggcccggcccggcgatggcgcacgagagtcgagaggaggaggacgacgacgaggcgtataaatataat

SEQ ID NO: 1983 - DNA, 399 bp, Zea mays
  Clone ID: LIB143-040-Q1-E1-F11
acaaccctctagagtgagtcatatcaatagctcgagtattgcttgctctccacaagaaacaaggcagagcaccaacaatggccgccgcctcctcgtcctcggtcctcctgctgctcctggccgccgccttggctggcatgagcgccaacgccgccaccttcaccatcaccaacaactgcgggttcaccgtgtggcccgcggccaccccggtgggcgggggcacgcagctgaacccgggcgggacgtggaccgtcaacgtgccggctggcaccagctccggccgcgtgtggggccgcaccggctgctccttcaacggcaacagcgggagctgccagacaggcgactgcggcggcgcgctggcctgcaagctgtcggggcagccgcccgctggaacgctgg

SEQ ID NO: 1984 - DNA, 409 bp, Zea mays
  unsure at all n locations
  Clone ID: LIB143-040-Q1-E1-F2
taaaccgcttcgctgggatttggtgcacagcaacaggcattcgctcaacccaatgcaatgcttgccatgatagcggcaatgcagaacccagctgcactagggatgacaccagccatgtttgctgctatgaacccagccttcgccgctgctgctttaggtgcaggcgggcagcaggcacagacagctggtcttacgggctttggagctcagggttttgggacgcangcatttggagctggaggtgcagctttcccaaatgcagcaggtgttcaagcagcaacagctgcatatcaaggaggtggggctcctcctggttttcaagggccacctggatttcaggttggccaagcaactacccagacaagcactgcagtggcagcagctggttatcaggctggggcagctgggc

SEQ ID NO: 1985 - DNA, 402 bp, Zea mays
  Clone ID: LIB143-040-Q1-E1-F3
ctcgtgggtcgacccaagcctctacaatatctcgtatcatcacagatcatccacagagaccatcttccgtgtaagagacaagagagtgggagagaggggggatatatggcagacatcgcgttgctggtgacggagcagttcgacaagaagctgaagcgaggcgcccccggcgaggacatcggcggcggcgccggcgaatataggaggaacttcggggccgtggccaaggtgtggagctcgtgggtggagtccgccgccgccgcgtccggggtgaggttcagcgtcgcggtgcacctggagcccaagaccgcgctcgccctggccgccgccgacggcctcttctccgcctagctagctagctagctactagtgtcgcctagctgcttccaggcccttctcctg

SEQ ID NO: 1986 - DNA, 405 bp, Zea mays
  Clone ID: LIB143-040-Q1-E1-F5
acaatattcggtccaccaggcatggattctcccatggaaccaaacgggaggggcacacatatgcacacagtttcatctggtgatccaatgattccctaacctgcagtgctgtttgtcctcggcaaatttctgaactaaatcagcatgcaaacgcctggatgatgtggctccagctggataacctgctcatttttagccaggtttctgctttctcaatcgtgggcaagcggtttgtagaaatccaccagagtttctagttgtaaaatagtattccacggactttaacaaaggtcccatgtactaagggctcatcatcagacaccgggaaagtttttttctggagaaattgcaccttgcggctggatgcccaggttggtagagcaaagtgcggccttctcttgtggc

SEQ ID NO: 1987 - DNA, 393 bp, Zea mays
  Clone ID: LIB143-040-Q1-E1-D12
cttaatctaagacgatgccatgtcatccggtggcatggtattcctgcttgctataggtgcccaaacgggcggcccggcacggcccggcacgggcccgttaggcacgacagttaaacgggccgtgcccggtcggcccacgtgccgcagatgcggcccaggcacggcacgccggcctggtagccgtgccgggccggcccgtttaatttgcccacgttgtccatttaatcagaaaaactgcaaaaaaattgggcgcagtggggttttgaacccaggaccttcctcttctaagctgggagcactaaatgtaagaggctaaccagtagaactctagcgtatttgttgtaaatagcaaatataaaatctaaatatatattatacccgatgttttataaa

SEQ ID NO: 1988 - DNA, 390 bp, Zea mays
  Clone ID: LIB143-040-Q1-E1-B2
tgggtcgttccaagactctacactgagtcggattatcttctcccctcctctgcccccatctcgcttctcgcacacggcagccggattccgaagcgcaccccctcggccccagccaaaagcatcgcagtttctaatcgtttggagagcacacaagaatgtcgttcgtgcagctctctggtgctggagtcgctgcagtggccttcacgaacaagagcctagtctctcggcacgcagcgctacgggtctgctcgtcgaggcgctcgatccgtagcctggtcgttaaggctgcaactgtcgtcaccccaaagtacacttcactgaagcctctgggagatagggtgcttgtgaagcttggtgccgcagaggagaagacagtttgtggcattttgc

SEQ ID NO: 1989 - DNA, 370 bp, Zea mays
  Clone ID: LIB143-040-Q1-E1-B3
acttgagcttcctatgtgctttttctggaaaataaaggcaaagtggatgccattctttgttgtatgtttctcaagtatcatggccttcatcgtgcctgattccattaacttcctgccaactttggtgtccgggatgtacgttagctggctttacctgaggtacttccaaaggaacccactgactggacttaagggtgatcccagtgatgacttctccttccccagtttattcccagctgccatgagaccagttacagaccctgtggccaacctgtttgataggatgttgtgtgcaaggtccagacctttggaagtagctctcccaatttcagatcctaccaaggcttcaagaagaagggagcgtggtgag

SEQ ID NO: 1990 - DNA, 380 bp, Zea mays
  Clone ID: LIB143-040-Q1-E1-B5
acacgactctaaagtaagtcatatcatcctcctcttcctcctcctagcacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcgaggcggccaccgagggcggcggctgcgactgcaacacctgcaactgcggcaccagctgcggctgctcctgctgcagctgcaactgagccggcccgcccggcccggcgattgcacacgagagtcgagaggacgacgacgacga

SEQ ID NO: 1991 - DNA, 413 bp, Zea mays
  Clone ID: LIB143-040-Q1-E1-B6
agttgggcaagaatggtgttgagtccgtcatttctgccgacctccagggaatgactgagtatgaggccaaggcacttgaggcgctgaaggccgagttgaaggcaagcattgagaagggtattgctttcgtgaacaaacagcgggaagctgctgcatctgtttgaggcgaagcaagtgaaacagaaggaacaatcgtcttgaatggcttttaagttttgcagcctagagttttttgttgtcggcatgtaggaagatgttccagatggttgctgtttgtttctaattgctacatgggggctgaacatccatcccccaagttatcgccggtttctgaaccaggccttatttacacataaattttgccccttctgtatcgtggttctgtttgtaccttgttggagtctacaaactac

SEQ ID NO: 1992 - DNA, 391 bp, Zea mays
  Clone ID: LIB143-040-Q1-E1-B7
agagagagcactgactcgtctcccttctcgtctccagcgacggcgaaggcgaagcggaggagcgggagcagaaacagaagaggcagccatggccgtgatggagaagctcaagatcttcgttgtgaaggagcctgttgtcgcagcttcctgtctcatcgccggattcggtctctttcttccagcagttgtccggccaatcctggattcatgggagaccgcagaaaaagttcctccaccacctctaaatgatgtggttgcgggtgtcaccggcaagaaaaagtagtgaacttgcattgttttctcatgtcgatgctgtcccacattttcttccccatgtttttctggcgtccagattggaaggctctccaaagtcacggtctccaaagtgaca

SEQ ID NO: 1993 - DNA, 94 bp, Zea mays
  unsure at all n locations
  Clone ID: LIB143-040-Q1-E1-B8
agaaaaaaaacaaaaaaaaaaaaaaaaaaaaaaaaaagaaagaagaacaaaaagataaaaaaattaaataagggggggcgngcacaatcaggtt

SEQ ID NO: 1994 - DNA, 410 bp, Zea mays
  Clone ID: LIB143-040-Q1-E1-B9
gacacacccctctaaaatcactcctgatatctcgtccctctcattcgtaacactactacagcaagaacacaagctaggcgcggtgggtacggtgcaagtgagctagcagctctaccgccatgaggccagcagcagagttcccgaccatgagccacggcgcgcccatgggtgcgaacgcgaacgtgcctcactccccgtggcagtcgccggtgccgtacctgttcggcgggctggcggcgatgctggggctcatagccttggcgctgctcatcctggcctgctcctactggaagctgtccgggtacctcgacgccgaccgcggccagcgggccggctcgtccggagaagcgggcgccgacggggataaagggctcggcggccggcgcggccaaggccccggcggcggggtt

SEQ ID NO: 1995 - DNA, 392 bp, Zea mays
  Clone ID: LIB143-040-Q1-E1-C10
taaccgcagtcgccgcacgctcgctcgcctccgctccggcagcgagctctatcccccgcgacgagcagcagctgccaccgacgcacgcagaccggggaataaatattggtattggtagtgtgatatctataagaagtcaagatggtgaagttcacagctgaagagctccgtgctatcatggacaaaaagaacaacattcgtaacatgtctgtcattgctcatgtggaccatggcaagtctacgcttacagattcccttgtggcagctgctgggattattgcccaggaagttgctggtgatgttcgcatgactgatactcgtgcagatgaagcagagcgtggcattacaatcaaatctactggtatctctcctttactagtggagatgactga

SEQ ID NO: 1996 - DNA, 381 bp, Zea mays
  Clone ID: LIB143-040-Q1-E1-C12
aaccccaaccccgtctctccactgcggcgcaggcttcgcttcggctccgctcggctcgagcagaagaaaatgcaacgggcagtgcaggccgtcaggtcacacggcaatgttcttaaatatgctgttctacaacacatcagcgctcccaagccagcaatgcttcctgctgccttttctcgtttcatgtcagtttcatctgctcgcctagaggatcgtggatttgaaactgccactgtagcagatgtcttgaagtctaaagggaagagtgctgatggatcttggctctggtgcaccacagaggatagcgtctatgacgctgtcaaatctgctacctttcgggtacctaaaactttttgccagataaactcagcacaacgtggg

SEQ ID NO: 1997 - DNA, 386 bp, Zea mays
  Clone ID: LIB143-040-Q1-E1-C2
cggatacgtctggcagttcatcacgctcgccgggttccacgccgacgcgctcgtcaccgacacgttcgcgcgggacttcgcacgccgcggcatgctggcctacgtggagaggatccagagggaggagaggatcaacggcgtggagacgctggagcatcagaagtggtcgggcgccaatttctacgacagggtgctcaaggctgtgcagggtggcatctcctcgactgcagccatgggcaaaggagttactgaagagcagttcaaggatccacggcccgcaactgggagcagtggcctgcaagttatggccaaatccaggatttgatgaagactcagaagaagaagaatgatttggagaaggctctaaataaattccaaagagaaat

SEQ ID NO: 1998 - DNA, 384 bp, Zea mays
  Clone ID: LIB143-040-Q1-E1-C4
acggacgcgtgggcaaagaatgctcctcctcctcttgtaaggttgtctgggaaaagtctggtatctgccatctggaaaggggacagttcaatagttgctgaactcattcagtcgatggaacctcatgttgaagaagaggtacttagtgatctgaaggccaaaatccgtgctcatgatccgtcagagtctgaagatattgagggaggcatccggaattctctcttgtggctgcgtgatgaattgcgaactctttcatgcacttacaagtgccgtcatgatgctgctgcagatttgattcatttgtatgcttatacaaagtgcttcttccgagtccgggattataagacagtaaaatctccaccagttcatatcaatccgcttgac

SEQ ID NO: 1999 - DNA, 379 bp, Zea mays
  Clone ID: LIB143-040-Q1-E1-C5
acggacgcgtgggcgagtatgaccctgaagagatggtgtacacactagcagtggcatccttgtgcatccaccacagctcaacctcgaggcctagtatgaaatcggtaggtggatctttcctgctaatcaaagtgcaaatgaggaaattgacccttgagttttttttgttgttgctgcaggtagtctgtttcttgaagggtgaccgggagtcacttgagctggtgagaaggcctaaaatcgtgaagcccctgatgtctgactcgggcgattcagaagattacacgcgctcgagctacctcagcgatctcaaccggcacaagcagctcgcgctggagcagtgaacatcgaattgagtttgaacagattcactgtaattttg

SEQ ID NO: 2000 - DNA, 396 bp, Zea mays
  Clone ID: LIB143-040-Q1-E1-C7
aagacgacttcttgccccggacggctactcctcttgaagacattttcaagtcgatcctctgcttgccttgcctcctaggtttgagatgtttgagggatacatgtatacctgaagacgctatgcttaaggatccaaggaggctttatgcaccaggccggatttatcacatagtcgaaagaagaacgtgcaggtgcggaagatatccaccggtagtcaaaacagctgtgccggtggatggtagatttgagcacatagttctttcctgcaatgccacagcggaccatgccattatttggattgagagggaggcccagaaggctttggatctgatgctggaggaggagaacacgctggcagtgccgtcggagcagcggatggagcggaacgaaaccctgc

SEQ ID NO: 2001 - DNA, 414 bp, Zea mays
  unsure at all n locations
  Clone ID: LIB143-040-Q1-E1-C8
gtcccgagcgacacaacagacagaggaggaaggagaaggatatgggaggcgaggcgggaatggggctccgcgtccgcgcctcctccctcctgctgtcactggtcctcgagctcgccgtcgcgctcgtctcagtgtcggcgcagcacaagttcgggatcaactacgggcagatcgcgaacgacctcccggacccggcgcaggtggcgacgctcctgcagtcgatgggcgtgaacaaggtgaagctgtacgacgcggacccccgggtgctgacggcgttcgccaacacgggcgtcggcttcaccatcgccgtgggcaacgaggacctgcaggcgatggcggccagcccggacgcggcgcgccgttgggtggcggcgaacgtgcagccctacgtcncggccacgcgcatcacctgcg

SEQ ID NO: 2002 - DNA, 326 bp, Zea mays
  Clone ID: LIB143-040-Q1-E1-C9
cgtcaacccacgcatccgctacacttctgttgcctgttcatctatcaaagcaacacctgctttggtacggttatgatcgcaagaatggtgtccattcactctgtccagctatatggtcaaaacataggagatggttgatgatgtcaatgatgtgtctcaatccaatagcttgttcgtttatggatttgcaattccctaatgggcaactaacatatgttgctggtgaggggatatcagccagtggttttcttccgttatttggtgggttgcttcaagctcaaggaaaatatcctggagaaacaagagtgagcttttcttgcaagaat

SEQ ID NO: 2003 - DNA, 394 bp, Zea mays
  Clone ID: LIB143-040-Q1-E1-B12
ctctcacacactgcaacagccaagtgcaagtgatcgagctcccccctcctcatcagtcgctaggcacagcgcacttgcaggatggcgcaggtctctaagacgcttctccttgtggccctggtgttcgtgtcgtcggcggcggtggagctgtgccgcgcgatcgacttcgacgagcgggacctggcgtcggacgaggcgctgtgggacctgtacgagcggtggcagacgcaccaccgggtgcaccggcaccacggcgagaagggccggcggttcgggacgttcaaggagaacgtgcgcttcatccacgcgcacaacaagcgcggcgaccggccctaccgcctccgcctgaaacggttcggcgacatgggggcggggggggagttccggtccacgt

SEQ ID NO: 2004 - DNA, 98 bp, Zea mays
  Clone ID: LIB143-040-Q1-E1-D1
attcaccgcacctcacgtgtgaaggaaaggggacgcagatgccgattgggctcgcgttctggaacctcttcagccgggtcttcgacaggaaggagatg

SEQ ID NO: 2005 - DNA, 407 bp, Zea mays
  Clone ID: LIB143-039-Q1-E1-H9
ctcgcaggccgacacacgcctctagaccctgtccaatgatggcaagggctgtggctcgtgctaccagatacgttgtgtcaaccacccggcatgctctggcaacccggagactgtgatgatcaccgacatgaattactacccagtcgccaagtaccactttgatctcagtggcacggcgtttggtggcatggcacagcccggccgcgacaatgagctccgccacgccggcatcatcgacatccagtttaggagggtgccctgcatctaccccgggcagacagtgaccttccacatcgagcacggctcaaaccccaactacttagcagtgctcgtcgagttcgaagatggcgatggcgatgtggtccaggtggacataatggaggccaactctgggtggtggatgccga

SEQ ID NO: 2006 - DNA, 397 bp, Zea mays
  Clone ID: LIB143-040-Q1-E1-A10
acccacgcatccgcccacgcgtccgccacgcgtccgcggccacctcaagatgtccgacttcctgggctactccatcaaggccatcacgcagggcatcatcccggcggtgcgcacgtacgtggacaccaccccgggcgagttcgactccttccaggacatcatcaacctgtacgagggcgggatcaagctgcccaagatccaggcgctcgaggacatgcgcaagctcttcccgctccagctcgtcaaggacctcctccccgccggcggggactacctgctcaagctccccatcccacagatcatccaagaggacaagaacgcgtggaggaccgacgaagagttcgcgcgggaggtgctcgccggcgtcaaccccgatggtgtgatcacgcgcctcacg

SEQ ID NO: 2007 - DNA, 356 bp, Zea mays
  Clone ID: LIB143-040-Q1-E1-A11
catcacaccgccactgatctgctctgttgctggtgactaggagcagtagcgagagggattctggatggccaagtcgaagaaccacacggcgcataaccaatcgttcaaggcgcacaagaacggcatcaagaagcccaagcgccaccgccagacctccaccaaggggatggacccgaagtttctgaggaacttgaggtactcaaggaagggcaacaagaagagtggcgaggctgagtccgaggagtaagatgatggtgattgagtttgtggcgacaaatgcatctcttgtatcgctaagagtcttagctgtgaacttagttctcacttctgtgtgactgtgatcaagggagatccat

SEQ ID NO: 2008 - DNA, 394 bp, Zea mays
  Clone ID: LIB143-040-Q1-E1-A12
tacccacgcgtctgccaacgcgtccgcggacgcgtgggtccggtgattccacaaaatttcaactgactgttttctgaagcattgcaaaattatgttattactatgaagtccagtgaagaaactacttttgtgatgactactcatgtcacttttgaattgttacacgtggttaggggaggaaacctcttggaggttgtagttctgatgggtggtatggtagggtgatgggctttgttgctggcaactcgtgatggtttttccagccttggtgaacattggcagtggctacagcttgggcaggggctggtggcagcgcaaaggagagtgagagggaactttaaggcaaaaacacttttccgggttaatccaatatgggataaacatccaaaagatg

SEQ ID NO: 2009 - DNA, 379 bp, Zea mays
  Clone ID: LIB143-040-Q1-E1-A2
tagtctgtgtcaatacagaggcatcatacagggaaaggatccttaaagcacagacacgcaagtataagctgcacaagaacgtttctctcttgtcagttgcgcagcgttgtccaccaaacttcactggtgctgatatttacgcgctgtgtgcggatgcatggtttcatgcagcaaagcgatcagttgaaacattcgaaatcgatccttcaagaagtaatgaagccagtgccgaagaagtcatcgtcgagatcgacgattttatcacggtgttaggagatatcgcaccgtcgctctctctggacgagctacaaaactacgaacagttgaggcagaagatcgaaggaccttctagatgaatgccagcagcgatgcctccttg

SEQ ID NO: 2010 - DNA, 384 bp, Zea mays
  Clone ID: LIB143-040-Q1-E1-A3
acgcgggtcctcgtcagccggccccttcaccggtggcgagcatccaccagaccaccagtggatgcgcccctgccccccatgccccaggtcgagtcggccactgcctcggaggcgccgccgccgcaggacgcatggctcgtcgagctcggcagtcgcctcccgcagtgggagtcgctgcgggattcctccaaggtcattatcccgatttcaatatctagggtgaaccagtttgatgctgcaaggctagatgttgagatgtcggccatgttgaaagagcagctagtcaaagtgttctctttgatgaagttttgatgccttcttttcatatcagccaggactcttattccaatatgagcctgaacttgatgctttccttgagttcct

SEQ ID NO: 2011 - DNA, 373 bp, Zea mays
  Clone ID: LIB143-040-Q1-E1-A4
aggaaggctctcgtgaccaccgggatgtccgccatggagaccgacatcaacgcgccgccgccgcccgccccagctggcgagggatcctctgcggccggtccgtcctcctcccgcaagcccaacaagcgcttcgagatcaagaagtggaacgccgtcgcgctctgggcatgggatatcgtcgtcgacaactgcgctatctgccgcaaccacatcatggatctatgcatcgagtgccaggcgaaccaagccagcgcgaccagcgaggagtgcactgttgcttggggagtctgtaatcatgcttttcacttccactgcatcagcaggtggcttaagactcgtcaagtgtgcccattagataacagtgagtgggagt

SEQ ID NO: 2012 - DNA, 286 bp, Zea mays
  Clone ID: LIB143-040-Q1-E1-A5
aggccagcatgatctccatggtcgcgaatccgaagttcatcccggggcagacgcttcgccggaaggagaagcttctccttgttccaaggattgcttcctgataatcctacatctgtaaaacttgtgtcttgctagctgtaccgggaacaagattaaataatgcaaggaataaagtgactctgttcttcgtcagtaaaaaaaaaaaaaaaaaaaaaaaaaaaaaaaaaaaaaaaagaaagaaaaaaaatgaaaaaaaaagtaaatcaaaataaaaactgccaatgaa

SEQ ID NO: 2013 - DNA, 374 bp, Zea mays
  Clone ID: LIB143-040-Q1-E1-A6
acggacgcgtgggcgcagacaagaactcgcctgttcgcgtcaacgggttcccttgcaaggacccgatggcggtcaccccggacgacttcttcaacacggcgatgatcatcgacaagcggagggacacgaacaacaaggtggggtccaacgtcaccaacgtgaacgtggagagcttcccggggctgaacacgctgggcatctcgctggcgcgcatcgactacgcgccgctcggggtgaacccgccgcacatccacccacgcgctaccgagctgctcaccgtgctcgagggcaccctctacctcggcttcgtcacgtccaaccccaaccgcctcttctccaaggtggtcaagaagggcgacgtcttcgtcttcccc

SEQ ID NO: 2014 - DNA, 408 bp, Zea mays
  Clone ID: LIB143-040-Q1-E1-A7
ctagttctagatcgcacgctcccgcagacggtaccagccgccgcgatggggtcctcgtcctcgccaccgccaccaccgccgctgccactgcccatgattgggcgggccgggaacctcaccatcttcatcacgccgccatcccccgctagcacgccccggggcgctgggcgcacgccgccgctcgagtccccgcgctcggatatctccacacccatcccgcagagggcagccccgtcgccctccctttctccctctccgcggaaccacgagagccgggccgtggcgcctgcggtggtgttcaccccgcccccgccgcctgcttctgtgaatgtcgcgctgccgccggtgcaggtgccgccgccgcagtacgagaaggcgtccgcggggggcaagcatgacgtatcggcg

SEQ ID NO: 2015 - DNA, 397 bp, Zea mays
  Clone ID: LIB143-040-Q1-E1-A8
gatcaggtgagcaaggcagcaggggaaaagtggcgctctatgtcagagcaagagaagcaaccctatgtggaccaagctgggcagaagaagcaggactatgagaagactaaggcaaatattgagaaggagagcacaagctcaaagaaggctaagactgatgacgacgatggctcgaagtccgaggtcgatgatgaggatggcggtagtgacgaggataacgacgacgacgagtaaatagtatttccgctgttgtgaggtagcaaatcgattgttaggtccccaattagctcactggtttgctatctttaatgttaagttgtttggaacaggtgtttatgaaggggatctattagtttcgtgaggttgttagtttagtgcattagcaaagaaaaagccg

SEQ ID NO: 2016 - DNA, 360 bp, Zea mays
  Clone ID: LIB143-040-Q1-E1-A9
ctcgtgggtcgatacaatcctctagactcactcctctcaagttttcatcttcgggtgcccttcaccggcgaccagcacccaacaggctttgatgattgctgtacaaggatgatatggcctcccgcccaaagctgtctggtattcagaagcaggttttggcgctgtacaggggattccttcggacagcacgccttaaggcccctgaagaacgccgcaggatcgagtctgttgtctttgcagagttccgtgacaacgcaaggagtgttgaccgtaggaactttgtacacatagaatacttgttgaggagagggaagaagcagcttgagcagctcaagaatcctgatattactggactcgcta

SEQ ID NO: 2017 - DNA, 396 bp, Zea mays
  Clone ID: LIB143-040-Q1-E1-B1
gcacaccgcacacccaatacggaaagaccaccgcaaacgccaccacgcccacgcctcgccgcgcaccacatctgaaacctccagcccgacgccggcgccggcgccgctgctcgcctgctcgtcacatttcctggtgcccgccaagccccgcgacctgggctccccagctccatccatcaaccgcctgcagccgcggaaatggcagcgccgacgacgctgcgctcggcggcggcgcgggcgcgcgcgcgcgcagcggagctcgtgagagggcggtcgacgcagcggcgtctgaggacgacgtccgcggcggcgacggacagcaagaagaatgaggaggaggaggaggaggcggcctggtaggagctctcggcggcgcaggagtactacgactaccgg

SEQ ID NO: 2018 - DNA, 409 bp, Zea mays
  Clone ID: LIB143-040-Q1-E1-B10
gacacacgcgtctacccacgcgtctgccaacgcgtccgccacagcgtcgtcgtcttcgtctccagtccaagcaagcgaagagcacccctcgagatctctccctccccgcgccgccatggacgcagttgactcggtagtcgacccgctccgggagttcgccaaggacagcatccgcctcgtcaagcgctgccacaagccggaccgcaaggagttcaccaaggtcgccgcgcgtactgcgatcggcttcgtcgtcatgggattcgtcggcttctttgtcaagctcatcttcatccctatcaacaacatcatcgtcggctccggctgatccgttcacctcaggctagtggctgcaggagtggacaatggcgtcactaccttggaggcaggcaccgggtttccagctctgatt

SEQ ID NO: 2019 - DNA, 353 bp, Zea mays
  Clone ID: LIB143-039-Q1-E1-H7
gtacgtactgcatggccgcgttgacatctgcgaagggcgctctccttccgtcgtgggctcgcagcagcagcagcggccatggcggcgacttgtggagggtcctggggaaggcgttggctacggtgcgtgcgcgattctcgccgtgtgtgtgtgtgtgtgcctgtgcgcaccgttcacatcacatcccaatcccatgcgttaacctctcgccgtgtggaagctggactgtgcggcccgcttttactcgtttccgtaaccgatcgtttcttcttaattcggccgtggccgccgccgcgtccaggacgatcgatgcctctccccgccgcgatgagatcatccatgctcagaggtcg

SEQ ID NO: 2020 - DNA, 245 bp, Zea mays
  unsure at all n locations
  Clone ID: LIB143-021-Q1-E1-B1
gtgccgagaccacgtggggtctgggaaggaaaggctactgccacttcagaggtcggcctgngaggctgcatcgcatccacatggggtaccagcccatgcacggcaacggcgggacagccggtgccgggacatcaggctccggcggcggcngcggcggagaccacttgcgccaccaccagcagcagcgcctgcacagcccccgcatggccggcggaggctccatgacgcgccgggccagctcgttc

SEQ ID NO: 2021 - DNA, 379 bp, Zea mays
  Clone ID: LIB143-021-Q1-E1-B11
ccacgcgtccgcagacgcgtgggtggccgctgggcggctaccctggccctcagggaccttactactgcgccgtcggagcggacaagtcctacgggcgggacatcgtggacgcgcactacaaggcctgcctctacgccggcatcgacatcagtggcatcaacggggaggtcatgccggggcagtgggagttccaggtcggccctgccgtcggcgtctcggccggcgaccagctctgggtggctcgctacattcttgagaggatcaccgagatcgccggcgtggttgtctccttcgaccccaagccaattccgggggactggaatggcgctggtgcacacaccaactacagcaccaagtcgatgaggagtgacggcgggta

SEQ ID NO: 2022 - DNA, 282 bp, Zea mays
  Clone ID: LIB143-021-Q1-E1-B12
ccgcctcatagtctaaaatcttgtgaggatacgtatcatctgaagagcaagctggtacttggaatctcaagtcccaggtcaagaacaggtaccgcaggatgaggcgcatggaggatgccatgacgagttcgtgagagatctaggccgtcgtctcccagtcaactttgggttgctggaccgttgtctccttattttgtatttatttatttattttgtatagaactcatgttatgtagtaaagatgtgacattcgatcttgtgccatgattcatcatatgtgtg

SEQ ID NO: 2023 - DNA, 401 bp, Zea mays
  Clone ID: LIB143-021-Q1-E1-B2
cagaagagccaattccttacttgatttcaaaggatggccctgaacacgttggcaagtttttgtatctagaacgagtggaatacatcatgtggaacacatatgatgtgcatttctacgcatcttttgctctccttgatttgttcccaaaaatagagttgagtatccaacgtgattttgccaatgctgtgctgtatgaagatcggcgcaaagtaaaatttttggctgatggtacatccggaatccgcaacgctaaaggtgcagtgcctcatgacctcggtacgcatgatccgtggcatgaaatgaatgcatataacatacacgatacaagcaaatggaaagatttgaaccccaaatttgtgctccaaatatacagagactttgctgcaacaagtgatatgcaa

SEQ ID NO: 2024 - DNA, 357 bp, Zea mays
  Clone ID: LIB143-021-Q1-E1-B3
ccccatcgccccataccacagcgcgacagtgagtacagcatcagcagctgagagcgtgagagcgtgcgaagcaggatggatgacacgaataagccgatggcggttgtgagcggcagcggcgggatgctgaacccctgggcggagcccttcgtgccttccggggcgcggtaccgctgcctgcggaccgtggaggcgacgcctgagcacgaggtggaggacttctcccccgagtggtggcgcctggtgtccgcctcaccggccttccgcgaccgctggctgcgcgagtactgcgcgctcggcctactcgacgccgaggacgacctgtacgacgacgtcgacagcttcctccccgacgac

SEQ ID NO: 2025 - DNA, 297 bp, Zea mays
  unsure at all n locations
  Clone ID: LIB143-021-Q1-E1-B4
ccggatcgaccacgcgtccgcgctacggcacacgtcncgcttctggtttgcttgcctgttgccccccagatcttgccaactaattggaggcagccgagctgatctcccatcccgcaacgcgccgtctcgacggcggatcggtttcttctgcttctacctcgtgatctttgggcaatacgataagacacgtccaagcgtcgccacaatcaagggcggcttggttgcagtcatgatggggaaggacggagagtctgccaagctgaaggaagacaaggagtccaatgatgagatccatat

SEQ ID NO: 2026 - DNA, 444 bp, Zea mays
  Clone ID: LIB143-021-Q1-E1-B5
ctcacgaagagtcgctctcctgcgtccacgcctcgcttgcggcgactagggcgactgccgccgccgcccttcgcccagctgcccaggtcttcgtcgggcgctttaccggtgaagagcgcccaccataccagattggccaccagaggattgctacatttgggaaggatgagcaaaggccctgttccattcgccaacattgggaagagagcaaaagatctcttgtacaaggactacaactttgaccaaaagttttctttgtcgacatgttctaactctggtttgaatctcacagccactggtgtgaagatcaatgaagacttcattggtgatatacggacacagcataaaagcggcagaaccactgttgatgtcataatcgatagtgattctaaagtgtcaaccacagtcactgttgatgaagcactaactggtttgaagacttca

SEQ ID NO: 2027 - DNA, 253 bp, Zea mays
  Clone ID: LIB143-021-Q1-E1-B6
gacagtatgagaagatcaagaagttcatatcgaatgccacaagccaaggtgctactattctgactggacgtgttagacctgcgcatcttgacaacgggttctttattgatccagctattagtactgatatcaccacatcaatggagatctggagggaggaagtcgttggtccagtcctgtgcgtaaacgactttagcactgaagatgaagccatctaccttgccaacgattcacactatggtttggctggtgc

SEQ ID NO: 2028 - DNA, 362 bp, Zea mays
  Clone ID: LIB143-021-Q1-E1-B7
ctcaacaacatcacggctcgctgtcccatctctctcgagccactcttcgcgttctgcatggcgtcaacatggggctcgcccctgcaacctcgcctggctgggttaccgcagggcgccgggatgctgcttcctatacatcgtgcgactccttggtgcttgctctcactggagtcgatgtatcagtagcagccatgacactccttcgtgtcgcgccctcgacgtgttcgatgaaatactgcagcgagctcgaagactatgtgcacaacccctgcgcgacgtcacatactccgctcgttgtccatgtcatgcttctggcatcgcgtgttcgacgaaaatcccatgttcacggacatcacatgcac

SEQ ID NO: 2029 - DNA, 440 bp, Zea mays
  Clone ID: LIB143-021-Q1-E1-B8
cccacgcgtccgcggacgcgtgggcgcacgcaccatcgtcctgccgatcgatcgcagccagccagtcttgctgagagacgaactgaagcctgaagtgaaccgatcgatcgatcgatcgagcgagcgagctcccatgaaggcgttgattctggcggcggtgctgctgctgcagcacgggggagccgcgagcgccggcggcaacttctaccaggacgtggacatcacctggggcgacggccgcggcaagatcctcgacaacggccagctcctgacgctgtccatggacaggtcctccggctcgggcttccagtccaaggcccagtacctctacggccgcttcgagatgcagctcaagctcgtcccgggggactccgccgggcacgtcgccaccgtctatccttcgtcgccagggtcgcagcaggacgagattgacgtcgagt

SEQ ID NO: 2030 - DNA, 134 bp, Zea mays
  Clone ID: LIB143-021-Q1-E1-B9
gaattatcaacgcattggcatatcggcgtcgacatcaagcacatcagcgacattgtatatggacgcgaggatgttcaggttggagactccctcgctcgccgcggcgcctttttcgtgggaagtgtcccagggcc

SEQ ID NO: 2031 - DNA, 57 bp, Zea mays
  Clone ID: LIB143-021-Q1-E1-C1
accacgcgcccgaatacatcgagacgaccaccgagcacggttagggcggctgggctc

SEQ ID NO: 2032 - DNA, 388 bp, Zea mays
  unsure at all n locations
  Clone ID: LIB143-021-Q1-E1-C10
catcgtcgacgctgcttctgggaagacgttcccgacgctggacccgcgcaccggcgaggtcatcgcgcgcgtcgccgagggcgacagcgaggacatcgaccgcgccgtggccgccgcccgcagggccttcgacgagggcccgtggccgaggatgaccgcctacgagcggtgccgcgtgctgctgcgcttcgcggacctgatcgagcggcacgcggaggaggtcgcggcgctggagacgtgggacaacggcaagacgctggcgcaggcggcgggggccgaggtgcccatggtggcgcggtgcgtccggtactacgccgggtgggcggacaagatccacggcctggtggcgccggccgacggcgcgcancacgtgcaggtgctgcacgag

SEQ ID NO: 2033 - DNA, 431 bp, Zea mays
  Clone ID: LIB143-021-Q1-E1-C11
ataatccgcgcctctacatttcttctctctctgctcctccgcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttaga

SEQ ID NO: 2034 - DNA, 438 bp, Zea mays
  Clone ID: LIB143-021-Q1-E1-C12
ctacgcgagcgggccgcttctcccatccagccgcgcgcggcgtcgccggaaccggagaagggaggggaaggagcgcgagatggacaaggccaataagctcagcaccggagcgggggagaaggcgaccaagagcaggagccacgggtccacggcgctgttcgtcgcggtggactacgcgttcctgctcgtcttcgccggcttcctcgcctacctcgtcgggtcgcggatcctcccctccgccgccggctccgcctagaccggcccgcgttcgtggatctctcttctttcttccacgtttttttggagtcgatggctgcgggagcaccgggatcttgccgggtggttctcgtctcgatctgatgccgctcccgcgatgtaatctggcgacaatttgacgagaagagaagtagcggcgtgtttcttggcaactcgcctggt

SEQ ID NO: 2035 - DNA, 277 bp, Zea mays
  Clone ID: LIB143-021-Q1-E1-C2
accacgcgcccgccacggcgccgagaacggcacggtcaactgcaaggacgtcgcagtcgcgatcgcggtctgacgagagtacgtgctcgcgcacctccctgctagcttctaccgggctgcagcctgcagcatgcactgtgcgagcacagccgatcagcgccaataaactggaggataagaacgactggtaggtgtgtgtgtgtgtcgtgcgtgcccagcggccatatcccggtgcggcagcacgtgctattgttacgtgttgtactgccgccagcgt

SEQ ID NO: 2036 - DNA, 372 bp, Zea mays
  Clone ID: LIB143-021-Q1-E1-C3
atgcgatgctgaagcgcgcgctcgtgaagctccgagcgaagcaccctggcgcgaggatcatctatggcgattacttcacgccaatcatccagttcatactccagcccaagaaattcgggttttacaaacaaccaccaagggcatgttgtggcgcgcctgggaggggtccttacaatttcaacctgacagcgaagtgcggtgagcctggtgcctccgcttgcgctgatcctaagacgcactggagctgggatggtattcacttgacagaagccgcgtatctgcacattgccagaagctggcttcatggaccgttcgcagaccagcctgttgtacaagcaccttgagttgagtacagtacacccagcctctcct

SEQ ID NO: 2037 - DNA, 126 bp, Zea mays
  Clone ID: LIB143-021-Q1-E1-C4
cgaccacgcgcccggagaaggaccaatatccccaaaccctagctcccgatctcgatggcgaagcctcgcgtcttcttcgacatgaccgtcggcggcgccccggcgggccggatcgtgatggagctg

SEQ ID NO: 2038 - DNA, 354 bp, Zea mays
  Clone ID: LIB143-021-Q1-E1-A9
ccgaaaaaaaggagagagaacacacacacacaaaccccaatcccctgcggcggcgatggacccgtcatcggcgggctccggcggcaactccctcccgtccgtcggccccgacgggcagaagcggcgcgtgtgctacttctacgagccggatgtgggcaactactactacgggcatggccatccgatgaagccgcagcgcatccggatgacgcactcgctgcaggcgcgctacggcctcctcaaccagatgcaggtgtaacgccccaacccggcccgcgaccgcgacctctgccgcttccacgccgactactacatcaacttcctgcgctccgtcacgccggagactcagcagga

SEQ ID NO: 2039 - DNA, 443 bp, Zea mays
  Clone ID: LIB143-021-Q1-E1-C6
ctcaacgaaggaggaacgaacggacaggttgttgcacagaagcgacatggctttcgcgcccaaaacgtcctcctcctcctcgctctcctcggcgttgcaggcagctcagtcgccgccgctgctcctgaggcggatgtcgtcgaccgcaacaccgagacggaggtacgacgcggccgtcgtcgtcactaccaccaccactgctagagctgctgcggctgctgtcacggttcccgccgccccgccgcaggcgccggcgccggcgccggtgccgccaaagcaagcggcggcacccgccgagaggaggagccgtccggtgtcggacaccatggcggcgctcatggccaagggcaagacggcgttcatcccgtacatcaccgcgggcgaacccgacctagcgacgacgggcgaggcgctgcggctgctggacggctgtggcgccgacg

SEQ ID NO: 2040 - DNA, 388 bp, Zea mays
  Clone ID: LIB143-020-Q1-E1-H1
catcgaagtccactcagtactcacctcaaggaagtgaaagtagtaatctacaagttggtcaaggcaacttgaaacttcaatataatgaagctggaaaattatccctgtactccgatagtaagactatggttcaagcaaactttgagcagaaatacaagtattatattggacaggatggaaatggaagtgatcctcaggcttctggagcatacatattccgccctaatggcacagttccaatcagtactgatgggcaggtttctctcacagttctgcgtgggcccatattggatgaagtgcaccagcagataaattcatggatttttcagattaccaggctttacaaggagaaggactttttggaaactgaatttatagttgggcccat

SEQ ID NO: 2041 - DNA, 424 bp, Zea mays
  Clone ID: LIB143-020-Q1-E1-H10
atccgatccgccgagtgcacaccacctttccccactccgatcgaatcgatggccgccgagggcgagaagaagatgataaccctcaaaagctccgatggcgaggagttcgaggtggaagacgcggtggcgatggagtcgcagaccatccgccacatgatcgaggatgactgcgccgacaacggcatccctcttcctaacgtcaactccaagatcctatccaaggtaatcgagtactgcaacaagcacgtacatgccgccgcagccgcagccgccgcctcgaatgccggttccgacgacgtgggtgccgcctccgccaacagcaccgccgcctccggtgaggacctcaagaactgggatgcggacttcgtcaaggtcgaccatgccacgcttttcgacctcatcttggctgcaaactatctgaaca

SEQ ID NO: 2042 - DNA, 434 bp, Zea mays
  Clone ID: LIB143-020-Q1-E1-H12
cccacgcatccggccgatgctggccgtggtccgcttcaccgctgagctcgcctgggccgacgcgggcccggaagtcgccgaccccgaggtcgcccgcctatgtctcgaggcgcaggagcatatcctcgcggggcggtggctcgacatggcctcccttatgctcgcctccgccgacctcctcctcacctccccgtcgcgcgtctcggacaaagacctggagtgcgttctctccgtcatctgcagcctcgtcaccaaggccggatccgaggaccaggcgctgcagatcaccgaactcatctgcgctaagctcacccagcaacacggtgacaagccagcgctgcgcctcaaagttcttttcagcttgtacaatctgctcccgagcccgtacggcaaggcatttgtttacaagaaggctcttgagctcgccacggctg

SEQ ID NO: 2043 - DNA, 359 bp, Zea mays
  Clone ID: LIB143-020-Q1-E1-H2
gcgtccgcacacacgtccgcggacgcgtgggtcaccagctgccattgccatctactgacctgtgacctccgcattcccaaacagcccgagcgagcgagctagcagatcggcggcaggcacctccctcctcaaggaacatggcccgcacgcagcagttggcagtagtggcgagcgccgtggtggccttggtgctgctggcggcggcgacctcggaggcggccatcagctgcgggcatgtggcgtcggccatcgcgccctgcatctcctacgcgcgcggccagagctcggggccctccgccggctgctgcagcggcgtcaggagcctcaacaacgccgcgcgcaccaccgccgaccgccgc

SEQ ID NO: 2044 - DNA, 395 bp, Zea mays
  Clone ID: LIB143-020-Q1-E1-H4
ggttttgttaccatggccgctgttaaagatgcagatcgctgcataaaatatctggaccgttctgtgttgcaagggcgggtcataactgttgagaaggcaaagagaagacgaggtagaaccccaacacctgggaagtatcttggcacaaaatcatcccgtggacggaggtactccacaagctactcacctgatcggaggggccgttacagttcccgctactcacctgatcggagggactgtcatggtagagaccggtcatactctccatatgacagaaggcgatcatactctccctacagcagggatggatcatactccccttactatggccggcgatcatactcaccttactacagcagacggtatcgttcaaagtcccatactgctacagaaga

SEQ ID NO: 2045 - DNA, 195 bp, Zea mays
  Clone ID: LIB143-020-Q1-E1-H5
gcctgccggtaccgatcctaaattcgcgggcaagtctttcagttgagtatctcagtatctgtatataggtcatatattttttcccctgtattgcaatcattttcgtaaaataattcactcattatctacacgtgattatagatgtaacatgagactatattagattttggactatcaactccgaagtttacctgt

SEQ ID NO: 2046 - DNA, 321 bp, Zea mays
  Clone ID: LIB143-020-Q1-E1-H6
ggtccatccacgcgatccgataacacaataacagtaaaaaaagtcaaataaataaatcaaatgtattgcaatgaatttcgctcaaataagtcaggcagtagctcaacgtgattacaaatgtatcctgctgctagagtatcattgggactcacatcgcgggacttaacttgaaatcaccgggcttgggattgccgggccctcaaggggatcaaccggtatttacccaaggaagccaccttaaagcagttctatattgtaaaagctggtgtatttacgacttgtcctttttggatcacctttccgagaaaatgctagggttaa

SEQ ID NO: 2047 - DNA, 379 bp, Zea mays
  Clone ID: LIB143-020-Q1-E1-H7
gctcgccttctcagccacgccgccggtcagccacgccgccgcttccctcggtgggcacccccctcccccatctggaacccactcccgccaacgggtatctccattcccccctgcctaccttcgaaccgacgtgctcggattggctgacccgccgcgggcgctccctccgtcgatcaaattgaccgccgcggcgcgcccgtccccatctccgccaatctccggtttcattatgattaataaattgtgtattaatgtagtggaggagccaggccatctagtgacaagtaagtagcattatcggcgaagaaaacatccacagctgagttgccaaagaaaggcggataaatatgtcccaaggaactttctcgctgccaaaaga

SEQ ID NO: 2048 - DNA, 349 bp, Zea mays
  unsure at all n locations
  Clone ID: LIB143-020-Q1-E1-H8
gggtcgtggttttggatccttttgctggagatgtgcatagtgtgagcagagagagagagagacgggtggaggatggtcagagccttcataagggcttcaggtggggcactgctggagacgacgaccgccgccgccgccgccaccaccatcgccaggcatctgagctcccccaaattctctgctggagcgcccctagcttcccaccgccgacgatgatggcggcctcttccaccatgagcaaggangaatcagcagcaagctacgacatggcggaatttgaccagtcagcaatcttcctctacctcgaggatggccacgatcaagaacaacaacgacagactctgaacat

SEQ ID NO: 2049 - DNA, 339 bp, Zea mays
  unsure at all n locations
  Clone ID: LIB143-020-Q1-E1-H9
actgaagataagacgtgcaatggtagcgctaaccaagaacaacggacaaagctaacaggaattaacaggccaaccagtatcgcttccaaattcatatcatacaaagatgtggctgtttcgccccctggcacagtattgaaacccattttggagaagaaggaagcaaatgagaaagatagtggacgtgatattgacctagcactgtcatccgaggaagaagataaaaagtttacagaanaagagaaagaaaagccaagtgaggacagtagcanagagattctttcaattcagcgagatttagagagtcatgcagaaatacctcctgacagcaacagtgat

SEQ ID NO: 2050 - DNA, 248 bp, Zea mays
  Clone ID: LIB143-021-Q1-E1-A11
aactcatcactgcactggtggtgcgcgtggagctcaagagagtgaagcgatagctaggagaggcgacgatgctcaagtaggcgttctcttccgcgctcctcctcgactttctcctcaataaagtccacgttgcagctataaaggatggaatgaatgccgttgatagcaccgatgatttggctaacgcaccgtatgtagaagagagatttggtgctgtcgctcatggcacgtgtaagagaatctgaggt

SEQ ID NO: 2051 - DNA, 305 bp, Zea mays
  Clone ID: LIB143-021-Q1-E1-A2
cgacccatgggcccggaaacttcaataaccgctttgatggtgttaagtgcacgttcatgtacatagatgtttagtacggaatcatacttctcaacatcttcaaagttcagaatatgacagttttactcatgtatgcaatggagctgcgtaacattacagtaagagtacagggcaagaatccttactaaacaggcacattcatacagattgcaacatagacatttatgtgtttatccagatgtcgaatttgtgtactctcgtcatattgataaacagaactatacaattttctgttgatgtttgta

SEQ ID NO: 2052 - DNA, 282 bp, Zea mays
  Clone ID: LIB143-021-Q1-E1-A3
tcagaagacagtttgatggtgttaagtgcaagttcatgtacttatatgtttagtacggattcatatttctcaacatcgtcaaagttcagaataagacagttttactcaaatatggaagggagctgcgtaacattatagtaagaaaaaagggcaagaacccttacgaaacaggcacattcacacagattgcaacatagacatttatgtgtttatccagatttcgagtttgtttagtctcgtcatattgataaacacaacgagaaaattttctgttgaagtttg

SEQ ID NO: 2053 - DNA, 313 bp, Zea mays
  Clone ID: LIB143-021-Q1-E1-A5
ccccgagcagtgacattttgggaaatgatgaaaattcagacaccgagaagactcctgctgccttgcatggacggctgaacaccgaacttgctcctagtggcagaagtgcagaatttagtgaagctgacactggaaaacaagagacacccgtgtctgctgaggctatggtagaatcatcgagcgagcctcgcatccatgaggcaaaggaagctccagtccctgacctgtctggggatgatggactagcgatgtcagccagggcctgctgttgttgcggaactttctggagatgctacacagggtggttcggatg

SEQ ID NO: 2054 - DNA, 101 bp, Zea mays
  Clone ID: LIB143-021-Q1-E1-A6
gacaatgccaccagctgtgaaagttcaggacatgatgaacattccgacgtctagagaactcgagctgacgtgcttggactgctcatcgtcgaacttgctcc

SEQ ID NO: 2055 - DNA, 297 bp, Zea mays
  Clone ID: LIB143-021-Q1-E1-A7
gagagagaacccacacggagagatacaatctagagagatggcaacctgttttggtgacgtcgtggacaattacatgctatacacgaatgccaagatatatcgggttaaacaagactcgagaggaccgggcacgagaggcctcctatctcagtagtgagaatgagaagtacaagaaagctaaagactatgtgaacatgctgaacgactggtacggcaatggagcgtctacgctgtgcgtgatctacaaccagacgggcggaatcctgcggtacgtcgacaactaggactggctgggct

SEQ ID NO: 2056 - DNA, 265 bp, Zea mays
  Clone ID: LIB143-021-Q1-E1-A8
cgaatatgcaggcttcctcgccgtcgtcttcggcgtcctcggcgtcatgctccgctacaaggtgtgctcgtggatcgcaatcatcttctgcgctcagtcgttggcaaacatgaagaactttgagaacgatctgaagcagctttctatggccttcatgtttgctgttatgggtctggtgacgaactattttggccccgctcgtccaggcagtacaaagcgctaagctgtggaagaacaccatgcgcttcattcttcataggatatc

SEQ ID NO: 2057 - DNA, 111 bp, Zea mays
  Clone ID: LIB143-020-Q1-E1-G8
aggatagcatataacgagtccatgtacaccatgtacaaggtcgtcgagctggacactgaaagtcggttcatcaggtgtctctgtacaaggctgtgagtgcgagttttcggt

SEQ ID NO: 2058 - DNA, 432 bp, Zea mays
  Clone ID: LIB143-020-Q1-E1-F12
gcaccacacctcttcttcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactgagccggtcaggcgatggcgcacgagagtcgagaggacgacgacgagtcgtataaatataatagcggcgtctaaataagatcctgtcaactgcacccgccattatcgattcatggtcgct

SEQ ID NO: 2059 - DNA, 193 bp, Zea mays
  Clone ID: LIB143-020-Q1-E1-F2
cgtccgagcacatctagcatcttccatgccaaggccgggatcgctctgatagaccacttcgtcaagctcgtcacgtggtaggacaactattggggctacagcaactgcgtcatcgacctgatgcgccacatgttcaagacgcagtataggggtgttttccccatgcttctgcatgatgggagctgcaggtgta

SEQ ID NO: 2060 - DNA, 402 bp, Zea mays
  Clone ID: LIB143-020-Q1-E1-F3
taccaggctattgtgaagaacactataggcattggtgttgatgatgaggatcggaagcgcacgtgggttcctgatgctgaggaatgcaagaagcgtggttcaattgaaacagcacgcgccatctatgcacatgcgcttactgtgttccttactaagaagagtatttggctgaaagcagcacaacttgagaagagccatgggactagggagtcacttgatgcgctcctcaagaaggctgttaactacaatccacgagctgaagtattgtggcttatggctgcaaaggagaaatggttggctggagatgtgcctgctgctcgtgcaattcttcaggaagcttatgctgctatccccaattcagaagagatctggctggctgcattcaagctcgagtttgagaac

SEQ ID NO: 2061 - DNA, 409 bp, Zea mays
  Clone ID: LIB143-020-Q1-E1-F4
gcgtccgtaccaagctattgtgaagaacactataggcattggtgttgatgatgaggatctgaagcgcacgtgggttcctgatgctgaggaatgcaagaagcgtggttcaattgaaacagcacgcgccatctatgcacatgcgcttactgtgttccttactaagaagagtatttggctgaaagcagcacaacttgagaagagccatgggactagggagtcacttgatgcgctcctcaagaaggctgttaactacaatccacgagctgaagtattgtggcttatggctgcaaaggagaaatggttggctggagatgtgcctgctgctcgtgcaattcttcaggaagcttatgctgctatccccaattcagaagagatctggctggctgcattcaagctcgagtttgagaac

SEQ ID NO: 2062 - DNA, 366 bp, Zea mays
  Clone ID: LIB143-020-Q1-E1-F5
agtgaccctccctcagccgcgtcgcgtcgcatcctacgatccaacgctctctctgctcgcagccatggcgatgaactacccgaccgtgagcgccgagtacagcgaggctgtggagaacgccaggcgcaagctccgagccctcatcgccgagaagagctgcgccgcgctcatgctcagcctcgcgtggcactccgcggggacgttcgaagtgtcatccaggatcggccgtccattctgaacgatgaacctctcgtcggacatggctcacggcacttccactgggctagacttctgcagttccgcgagccggagacggtcaggggagcactccagcactatctgcctgcgggtagggtttctcccggt

SEQ ID NO: 2063 - DNA, 430 bp, Zea mays
  Clone ID: LIB143-020-Q1-E1-F6
gggcaccggacagctactacgacgagctgaagagggactacagcgcgaagaaggctatcctgctggaaggactcgaagccgcagggttcatcgtctacccatcgagtgggacatactacatcatggtcgaccacaccccgttcggtttcgacagcgacgtagagttctgcgagtacttgatccgcgaagtcggcgtctgcgctataccgcccagcgtgttctacctcgaccccgaagagggaaagaaattggtgaggttcaccttcagcaaggacgaaggcacgctgcgggccgcggtcgagaggttgaaggcgaagctcaagaggaaatgaatgaatgggggattacatgtttgtggctggtgattgttgaataatctgtgctgggtttcaactgcgcccggatgcctgtactgtctcttttttttttt

SEQ ID NO: 2064 - DNA, 423 bp, Zea mays
  Clone ID: LIB143-020-Q1-E1-F7
cagccatcgacttcatctcggattgaagcaatgtcgtcggacgatgaggtcagggaggagaaggagctcgacctctcctccaacgacgttgtcaccaagtacaaggctgccgccgaaatcctcaacaacgctctgaagattgttgtgtctcagtgcaagccaaaagtcaagattgttgacctttgcgagaagggcgactctttcataagagagcaaactgggaatgtttacaagaacgcatagaggaagattgaaaggggtattgctttcccaacctgtgtatccgtcaatgacacagtttgccactttccaacgcttggcaaccgatgaagccgttctggaagaaaatgacatggttaaaattgatatggggcggtcatattgagggctttattgctgtggtggcacatacacatgtaatta

SEQ ID NO: 2065 - DNA, 397 bp, Zea mays
  Clone ID: LIB143-020-Q1-E1-F8
gccgccgtcgccgcctcctctccccagcacccggagctcgaccgaacgccgctcaccatgatcatccccaagaagaaccgcaatgagatctgcaagtacctcttcaaggagggcgtgctgtatgccaagaaggactacaacctggcgaagcacccgcagatcgatgtgcccaacctccaggtgatcaagctcatgcagagctttaagtccaaggagtatgttagggagaccttctcctggcagtactactactggtatctcaccaacgatggcattgagcacctacgcaactacctgaacctcccgtctgagatcgtgcctgccacgctcaagaagtctgccaagccacctggccgcccatttggctctggccctcctggtgaccgcccaaggggcc

SEQ ID NO: 2066 - DNA, 234 bp, Zea mays
  Clone ID: LIB143-020-Q1-E1-F9
agtagataaataaacagctggtttgtactactatgcaaggtttaggttcaagatcgtttcaaggaaacgacctgaggtccaggtaaccggagtccgcccagcacctcgcgtgctattgtctgattctgtagctgtacagtgctctgctaccttattatccgtgatgtgaaacaatttgtgtcgtccagtcttgctgtaaaatcatcatcgcgtatattgtaaacctgagtcggt

SEQ ID NO: 2067 - DNA, 162 bp, Zea mays
  Clone ID: LIB143-020-Q1-E1-G1
gcgtccggactcatacgacaaacgataacgtgccagactataagtctggattatctgttatgtttacacgttttaagcatcttgtcgttattattcatactggcacaacagtgtcatacatttgtaccattacgagtaagaacgagactgatgttgaatatg

SEQ ID NO: 2068 - DNA, 426 bp, Zea mays
  Clone ID: LIB143-020-Q1-E1-G11
gtttcttgcaactagaactgactttacctactgtttgcttttagcacatgttggtctatgattgtaaggctatcttctgcagttacccatccttatcccgatattcaaacttcactttgcgaacagtgcggcctacagtgcaaaacagtgttttgggtgaccatatgggtgaaccgctcgagacggtctaagataaaagaaagaagaaaagcaggtaacgactattgtgtaatcaggccttatgtgcaagcgagccttatggtctgttagatcatgatccaaccgtatgtcacctttaacacttatatctatagttggatcataatctaacggactaagatgttttgtttgcacgcttgcacacaaggtttgattgaacaatagtcattgtcagaaaagcatgggagagaattgatatactctgtt

SEQ ID NO: 2069 - DNA, 168 bp, Zea mays
  Clone ID: LIB143-020-Q1-E1-G12
ggccagcaggacaaccgataacgtgccaggctataagtctggtttatctgttatgtttactctttttaacatcttgtcgttattattcgtaatggcacaacatgtactacatttttaccattacgaataataacgacaagatgttaaaaatgtagtacatgttgtgcc

SEQ ID NO: 2070 - DNA, 441 bp, Zea mays
  unsure at all n locations
  Clone ID: LIB143-020-Q1-E1-G2
gggtccacgcacgcgtccgcacacgcgtccgcccacgcgtccgcccacgcgtccgggccaattgggaaagaatatattgaccctgaatgatgcgaatttctgtcagttgcttgttccgtctgggacagccgtgccataattttgagggtcttccgtctttaattggttgctagtatatcaaggttttcctcctacctatgcatggaaacatggatttaattgttctctgtacgtatatccatctcttgctaacggaacctgtggatcaaaatcatctcatgttcgattggtatactactttgtcatctcacttctatgtgtagattttagctttttttcatanggctgccgtctagttttacttctgtacgtatttcattcactagataggtatctagatacttggatggcgcaattgtcctgattcccaacccaacagca

SEQ ID NO: 2071 - DNA, 395 bp, Zea mays
  Clone ID: LIB143-020-Q1-E1-G3
gggtccaattgacagaacagcagaatgaaaacaaagcgacagagggagcaagcaaaagaggcggacgaaagaaggcgtcatcatccttggcgacgataccatctgatgttgatgaggaagtcctagaggtccaagctcagaagaaaggtacaggaatgaagcctgctgccgttgtgaagcccaaggctcctgccgccgccaggaaaagggcgccggctcagggcaaggtaacgcataagaaaatagatgagatgctcaaggccactgatgataacaacaccagtgcatcttcccctgagaagaaggtccggaagatgaggtcctctcccttcaacaagaagagcggctcaatcttacagagaggctcgaccgcttctgcaagctctggaacaact

SEQ ID NO: 2072 - DNA, 275 bp, Zea mays
  Clone ID: LIB143-020-Q1-E1-G4
ttgctgcaactgacgatgaccagcaccggcgcatcgtccgcggcgcggcggaagatgatcgacttggcgatctgcgccacctcgcaccccagccccgccgcggcttccgccgaggtcttgccggtctgcggcaggaccaacaccggcttgtcgtggcccagatcggccagcaggccggcgacgcgctgggcggactcgggaagatcggctggcgtggctacggacatccggcgactccgttcacgacctgtgagatcaggttaccacttgatcag

SEQ ID NO: 2073 - DNA, 379 bp, Zea mays
  Clone ID: LIB143-020-Q1-E1-G5
caccacgcgtccgccacgcgtccgcggacgcgtgggagcgtgtgaagctgcttattcagaaccaagatgagatgattaagtctggtaggctatcagagccgtacaagggtattgttgactgcttcaaacgtaccattaaggatgaaggtttctcttccttgtggaggggtaacactgctaatgttattcgttacttccctactcaggctttgaactttgcatttaaggactacttcaagaggttgttcaacttcaagaatgatatggatggctattggaagtggtttgctggcaacctggcctctggtggtgctgctggtgcttcctctttgttttttgtgtactccctggaccacgcgagaacaatgttggctaatga

SEQ ID NO: 2074 - DNA, 406 bp, Zea mays
  Clone ID: LIB143-020-Q1-E1-G6
caaacggagagagacaatggagagagatggcaaactgttttggtgacgtcgtggacaattacaagctagacacaatgccaagatatatcggcaaaaagaagactcgagaagaccgggcacgagaggcctcctatctcagtaatgagaatgagaagtacaagaaagctaaagactatgtgaacatgctgaaggactggtacggcaatggagcgtcgaagctgtgcgtgatctacaaccagacgggcggaaccctgcggtacgtcgacgacaaggactggctgggctacccggggccgacgccctacccgacggagatcggcaacgggcagtgggcgtccttcctccacgtccacaagaccggcgcctcgtcggggtccatggccgctgtcgtctaccgcggcaagga

SEQ ID NO: 2075 - DNA, 295 bp, Zea mays
  Clone ID: LIB143-020-Q1-E1-G7
ggaggagcataatagcatatagcgagtcatggtgcaccctgtacagggtggctgagctgcatcctgaaggctggttgttcaggtgcgtccgtgactgtctgttggttcttgttttcgggctattattattgggccggatatttctagccttactctttggcccattgagcaaaaaaaaaaaaaaaaaaaaaaagaaaaaaaaaaaaaaaaatcaaaaaaaaacaatatcaacaaacaaacaagaaggaacaataaagcaaaatcaactaacaaagaatggctaggtccatccggg

SEQ ID NO: 2076 - DNA, 427 bp, Zea mays
  Clone ID: LIB143-020-Q1-E1-F11
agggagcggcagctcccaaccatacgtccatatccccctcccaacaaaaaaaaaactcccatcaatggcgatctgaatcaaccaaggcatctggaagcttggacatggagcggatcctcaagtccgccagggagtcgggctccctgaacctctccaatcgctccctcagggagatacccaaggaggtttacaacaacttggacactggcagccaggatgagaaatggtgggagggagtggacctccaaaagctcattctggctcacaataatcttgaggtgttaagagaagaccttaggaacttgtcttcgcttgttgttctaaatataagtcacaacaagatatcttcccttccagcagctatcggagatctcccgttgctaaaatcactggacatgtctttcaatcaaataaacactctgcccga

SEQ ID NO: 2077 - DNA, 381 bp, Zea mays
  Clone ID: LIB143-039-Q1-E1-F8
gactcgtgggtcgatgcaagactctaaactgagtcggatgaacgaacggacaggttgttgcacagaagcgacatggctttcgcgcccaaaacgtcctcctcctcctcgctctcctcggcgttgcaggcagctcagtcgccgccgctgctcctgaggcggatgtcgtcgaccgcaacaccgagacggaggtacgacgcggccgtcgtcgtcactaccaccaccactgctagagctgctgcggctgctgtcacggttcccgccgccccgccgcaggcgccggcgccggcgccggtgccgccaaagcaagcggcggcacccgccgagaggaggagccgtccggtgtcggacaccatggcggcgctcatggccaagggcaagacg

SEQ ID NO: 2078 - DNA, 356 bp, Zea mays
  Clone ID: LIB143-039-Q1-E1-G1
agagttttcatctgcactttgtatctacagaattatcatcacttattggaggattgcgtgtgtgacatcaaaaacaatgtatcatctgtgtatttgctatgttgataagtgtgttactgcgttgttggcaaggatgaatatgatgagcttgctttggctgaggtgatctttgcaattacatcagcagtcaaggatgtttgtgcgaaacctcctaccgagcgcctcttccttgacaaatacgggaggatctgcttgtgccttgatgagattgtttggaaggggttgcttgaaaacacggagaaagacagagtgaggaggttgattagactaaagccccctgtggagccataatttgc

SEQ ID NO: 2079 - DNA, 428 bp, Zea mays
  unsure at all n locations
  Clone ID: LIB143-039-Q1-E1-G11
tcgatacaagcctctatattgagtcataagatatcgtgttattatacggttccgttgcaacgcacgggcactcacttagtataatattaagtatgcaagctcgaataaaacctgccactgtcgtcaacgcagcagcggctgaggcgagatttgtgtgagcctctggagcagcatgtcgttccacgtgtcgacagggccgggcaggcaccagtgcaggcagtcgctggcgttcctgacccagcgtttgtcgtagtgccagcccgggtggccgtcggcgcgcagcatcatcgccttggtgacgtccagcagctcaaacttggtgctgccgctggtctccctcaccctcgccacctcttggctctgcaccctcctcagctcncacccgatgctcctcggatcgaggtcgccttcctccagcggccgctcta

SEQ ID NO: 2080 - DNA, 359 bp, Zea mays
  Clone ID: LIB143-039-Q1-E1-G2
gagaaactgcacatcgtgtatcaagcccaggagtctcagttggccttgtctggacttcggttggcggggaagttcagtttgtggaggctacagccatggtgggtaacggtgacttgcatttgactgggcagcttggtgatgttactaaggagtcagcgcatctagctttgacatgggtgagagcaagagctgccgacctcaatttgtcacctacttctgatatcaacttattggagagccgtgatatccacatacattttcctgctggtgctgtgccacaggatggcccttctgcacgtgtcacattggtaacggcactagtgtcgctttttagcaacagaaaagtcacagcagatact

SEQ ID NO: 2081 - DNA, 323 bp, Zea mays
  Clone ID: LIB143-039-Q1-E1-G3
cttggtccatacaatgcatatcaattggctgcaatcttaccatgcagatcaggaccaagaggagaaaatccgaatggctgcacgtgacacacatgacgaactacgtgctataaaagctgatccaactgagggatttgagaatggagcaatcctttcaatcgcagccagagaactacacagtgagcatgaggcgacacgaactgaaccattgcattagctcttcactttgctggatcagtatcgtgctgagttcgtggcgtaactgaacgatatttttgatccactccttagtgcactttcagatccttcagacgcagttgtcc

SEQ ID NO: 2082 - DNA, 355 bp, Zea mays
  Clone ID: LIB143-039-Q1-E1-G6
cgacctggggggttcagatcggatcggaagcttccataagtttccatcgggcttcgccggtatggcgatccgcaaggggtcttcgtacgccgtcgcggcacttctcgcgctcgcctctgtcgccgccgttgcaggggaggtcttcttccaggagaagttcgaagatggctgggaaagtcggtgggtcaagtccgagtggaagaaggatgagaacatggctggtgaatggaaccacacctcgggaaaatggaatggagatgccgaagacaaaggtattcaaacctccgaggattacaggttctatgccatttcagccgaataccctgagttcagcaacaaggataagaccctggtg

SEQ ID NO: 2083 - DNA, 400 bp, Zea mays
  Clone ID: LIB143-039-Q1-E1-G9
tcgacacaagcctctagatcgagtcgtcctacttccaaccctctcctctccgcaggctgtagcatttgtcgggttggattgggttgttccgcttgggtagcctggtgggatcgaaatctgtgtgggatccatggcggcggtcgaggggacgacgaagaagaaggtaatcatcgacaccgaccccggaattgatgacgcgatggccatcttcgtggcactgcggtcgccggagctggaggtgctgggcctcaccactaccttcggcaacgtccacaccgccctcgccacgcgcaatgcgctccacctgttggaggctgttggaaggactgacatccccgtggcagagggatcccatgtaacaatcaagaaagccaccaagctgaggatcgcaagctttgtc

SEQ ID NO: 2084 - DNA, 360 bp, Zea mays
  Clone ID: LIB143-039-Q1-E1-H1
ggctcaggaaaaacaacggcggacagcccgcctccaccgccgtggcgccgttcaccccgccccgcgttctctctccctcggcgacggctcgacgaccgccgcgccgccctacgctccagcctccatgtgcttcgcggggcccttcgccgtcgactaacacaccaccaccaccatgtacgaccgccccatctcttcccttcctgctctacgaagcctagcaccaaaccctaactgtttgttttattcggatttgttccaaactacaaatgtggtgtatgtagtattgtgtccactaactttgctctcttttttttccctttttctttttgcaaaaaaacatcgggtgtacatgtgttcacc

SEQ ID NO: 2085 - DNA, 384 bp, Zea mays
  Clone ID: LIB143-039-Q1-E1-H10
acaggcctctacaatgagtagtcgtatgcccgattacaatcagccatcgccaccacctccctccgcggctccgccttccgccgcgaacacgccgctgtctcgaccccttgtcctcctccttcagcaagatggcggagattgagataaaaacagcacctgctgacttccgcttccctacaacaaaccaaacaaggcattgttttactcgctatgtcgagtaccacaggtgtttgaatgccaaaggggatgatgctggtgtttgcgaaaaatttgccaagtactacaggtccctttgccctggagaatgggttgagaaatggaacgagcagagggagcatgggacgtttccaggacctctctgaatgtaccgcccgagacctccag

SEQ ID NO: 2086 - DNA, 382 bp, Zea mays
  Clone ID: LIB143-039-Q1-E1-H11
taaactcagtcaattcactcaaacctcttccccaaatcttcgattagattctcgttgacaagaagactagaaccgaacctgaccatgtcgctgatccgccgcagcaacgtgttcgatcccttctccctcgacctctgggacccctttgagggcttccccttcggctccggcagcagcagcagtctcttcccctcgttcccgcggaccagctcggagaccgcggccttcgctggcgcgcggatcgactggaaggagactccagaggcgcacgtgttcaaggccgacgtaccggggctgaagaaggaggaggtcaaggtggaggtcgaggacggcaacgtccttcagatcagcggcgaacgcaacaaggagcaagaggagaaga

SEQ ID NO: 2087 - DNA, 408 bp, Zea mays
  Clone ID: LIB143-039-Q1-E1-H12
cgatacaatcctctacagggagtctcatcatccgcgccgctgccttcggcctcgccgccgccggtgcgggttccctgcatgccatgtcgaattggatgcctccctcggagatctctcccttcagccggatagtgaagctgaagcccacgctcttggaatccgcgaacgtccttctggccgccctgctccgcgcgcacccgctctccagtgcgaacctgcgtgacgtccgcgcccgcgctgagctcgacctcgcgcgtgctgacatggagattggccatggcggcgacccagccgccgccgtggacctccgcctcctcctggcgctcctcgccacgcgcgacggtcgcgcgtacgacgcgttgcggctctacgcggaagcggcccgcgacgcgcctttccgaccccggg

SEQ ID NO: 2088 - DNA, 362 bp, Zea mays
  Clone ID: LIB143-039-Q1-E1-H2
cggacgcatgggcggacgcgtgggcggacgcgtgggcggacgcgtgggggccaaaaggtctgatataccactttacaaaggagacgagctttttaaaaagctgccccaacagttgggttcaaggcctgcaagtgacatcagctaacaacagcttcacacagttattttgtcaattctaaatttgaggctgtgttgattcatttgttgagctgatttttgtcgaattttgattatacgctgaggacaaacttcggtaaggtgtacaaatttggctcgtggaagaggcttcagaatgcaatggagcggctgacaaagggaactgactactggtggtgatgaaaacggcttgggtcttcgggggc

SEQ ID NO: 2089 - DNA, 353 bp, Zea mays
  unsure at all n locations
  Clone ID: LIB143-039-Q1-E1-H4
aactttgaagatctctcaacttcctttggcttcaggcaagcaaaagaggattgctgtgattactcaaggtgctgatccagtggttgttgctgaggatgggaaggtgaaaacgttccctgtgatcctattgcccaaggagaagcttgttgacaccaacggcgcaggtgatgctttcgttggaggcttcctctcacagttggttctaggcaagggcattgaagactgcgtgagggcaggttgctatgccgcaaacgttatcatccagcgcccgggctgtacttacccggagaagcctgacttcaactagtgcanaaactgaggcacgtcatgagagggactgttataggcacact

SEQ ID NO: 2090 - DNA, 380 bp, Zea mays
  Clone ID: LIB143-039-Q1-E1-F7
gcgcgggtcgatacaacaccctagagtgaagtcgctaatacttgcgttcttgtagtagaggtcggcagcaagcggtagagcgagaggtcgagaagatgaagagcagcactctgttggcgatcctagttctccaggcccttctggtctctacggccgtggccaaaggacctgcagggccgaagaagcagtgctggtgcggcgagtgcaccagctggtcgggcgtgtggacctgcgacgacctcctcaccaagtgcgccgccacctgcaagaactgcgtccccgtctccacggacaagggcgccaccaagtacagatgccgcgacttcctccccgaaaactgcggctgcaagatccactagactcatccacagcggcacagg

SEQ ID NO: 2091 - DNA, 380 bp, Zea mays
  Clone ID: LIB143-039-Q1-E1-D5
gactcgcgggtcgatacaagcctctacatcgtgtcatgggagagagagagagagaagagagagagaagagagagagagagagaggagtgggagacccgcgagaggctgccgtgtagggaccgtagactcagcgactgcgaaggagggataaggggatggccgggatcggaccgatcaggcaggactgggagccggtcgttgtgcggaagaaggcacccaccgccgccgccaagaaggatgagaaggccgtcaacgccgcgcgccgcgccggtgcggagatcgataccatgaagaagtacaacgctggtacgaacaaggcggcatccagcggtacatccctcaacaccaagcgcctcgacgacgacaccgaaaacctcgcg

SEQ ID NO: 2092 - DNA, 375 bp, Zea mays
  Clone ID: LIB143-039-Q1-E1-D7
gtcgcgttggtcgttgcaactccctatagtgtgtcgcactaacacggtgtctccttctctgattgcagttgtggagcagcagctgtcgttgtcttccctggcttctcccatggccgcctatcccccatcccctccaccgtgccctctcatctcctagcccctctgctcgccaccatcccctatacccttgctagcagcatggcgctcatcccttcctgatgtgagctgcacatgacgtctccagctctccattgatggcagctagctgcgccctcacttcctcccatggtgagatcgcccatggtggctcctcctgctcggcgtactcccctctgcaggagctcgcccagcccctctctgctaggaacagcagca

SEQ ID NO: 2093 - DNA, 420 bp, Zea mays
  Clone ID: LIB143-039-Q1-E1-E12
ctcgtaggtcgatacaagactctacacagacgtcgtactaacgcgtccgcctgacttccctgctacttggggggcaatggaaaagttatatgatgctggcaaagctcgcgctattggtgtgagtaacttctcctcaaagaaattgggtgatttgcttgctgtagctcgtgtacctccagctgttgatcaggtggaatgtcatcctggttggcagcaaactaagctccatagcttttgtcagtcaactggtgttcatctaactgcttactcaccactaggttcacctggtacaacttggatgaatggtaatgtccttaaagaaccaataatcatctcaatagctgagaaactcgggaaaacttctgcacaagtggctctgcgctggaacattcagatgggtcacagtgttcttcaaagagc

SEQ ID NO: 2094 - DNA, 358 bp, Zea mays
  Clone ID: LIB143-039-Q1-E1-E2
ggcctccaacgcgaaccccttggtggccgcctccagctgcgcgaatgtgaactctccatggggtccttgaacgatgacgatccgctccgcttccgcgtcatcacacgcgacagctgccatcggaataggatgcgcgcccgcgacccgtacggtttgtgacttcaaaaataatagcaagaagcctcgaagacattcttttggataaagttaggaaagtaccatgcatcccactttcagatggttcatttacctctatttcagatggtcgtatatggttgccatatgatgttgccaattccattcctgaatgcagtagcattccgaattttctagctctatatggtaatcttcgaactgt

SEQ ID NO: 2095 - DNA, 358 bp, Zea mays
  Clone ID: LIB143-039-Q1-E1-F1
aaaaccctctagcttcccactccgctcggccaccagctttgaccgcctcccctcccctccgctcctgttcctccataccccacccccccgcaggagcggcgcggcggcggcggcggcaaagccaaaggcaagatgttcgggcgcgcgccgaagaagagcgacaacaccaagtactacgagatcctcggggtgcccaagtcggcgtcccaggacgacctcaagaaggcctaccgcaaggcagctatcaagaaccaccccgacaagggcggtgaccccgagaagttcaaggagctcgcacaagcctatgaggttttgagtgatccagagaaacgtgagatttatgatcagtatggtgaag

SEQ ID NO: 2096 - DNA, 414 bp, Zea mays
  Clone ID: LIB143-039-Q1-E1-F10
gactcgcaggtcgatacaagcctctagactaaatcgtagtagatgatgatgacgacgacactgaagctctaatggcagagcttgagaggattaagaaagaaagagccgaggagaagcttagaaaggagcggcaacaagcagaagaggaggccaagatgaaggaggctgaactgatgcggggaaacccgttgattaatatcaacaatgctggctccttcagtgttaagagaaggtgggacgacgacgtggtattcaagaatcaagcacgaggagagaccaagacaccgaaacggttcatcaacgacaccatcaggagtgatttccaccgtaaatttcttcagaggtacatgaagtgacgcttccgtcgttcacaattcagcctggagcccctcatcgttatcatgtttgtgtatg

SEQ ID NO: 2097 - DNA, 342 bp, Zea mays
  Clone ID: LIB143-039-Q1-E1-F2
cacacgcgtccgcccacgcgtccgacgcgccatcctgtgaaccagacacctaacgcggagcggcgcgggccggccgccgggagaggtgcgcatacctgccgtcgatcgtcgccgggtccatccaccaggggcagtggcaaccgccagaagtccaagatggaccgcgagcgcaacttggagatgaccaagggggccaaggggagccagctcgagaccatcaagaaggccatgagcatcgcagtgcacagtgtgcatgcagacattcatgtgtgacacgactgaagtgaagtgcccggagcacgccgaggcgatgcatcccaatacagacgtgtatcagtgctt

SEQ ID NO: 2098 - DNA, 360 bp, Zea mays
  Clone ID: LIB143-039-Q1-E1-D11
ctcgcaggtcgatacaagcctctacacagacgtcctgacgtaacgcgtgggtgctgatggacgaacaggaagatggataatttgaacgagtgccaagccaaaggatgctcgccaagtggtcgccacttaacaacactaacctagtgtttattccaggtcatagttttgtgctgctgatgatggtgttaagtgccggtgggctcaaccttcttataaatctaagtaactcccttatacttcttactgaggatggtcacttgagctagcatatatttcaaacttatacttttgtaatcactctgataaatatagtgtaaaatttttgtaacttgtaaaatttggtaataagatttccgctgc

SEQ ID NO: 2099 - DNA, 359 bp, Zea mays
  Clone ID: LIB143-039-Q1-E1-F3
aaaagacgtgcaggaaacgcctccgatccaccatcatgtgtcccacaaaccaaacgagcaatgacgcggcccagccgactggcgatgtgcacgtacccggcgtcgatcgtcgcaggatccatccaccatgggccgtgacaacagccagaactcgaagatggcccgcgagcgcaacttgggcaagaacacgggggccaaggggagccagctcgagaccaacaagaaggccatgagcatccagtgcaaagtgtgcatgcatacattcatgtgtaccacgactgaagtgaagtgccgggagcacgccgaggccaatcatcccaagacagacgtgtaccagtgcttcccccatctgaagaagt

SEQ ID NO: 2100 - DNA, 365 bp, Zea mays
  Clone ID: LIB143-039-Q1-E1-F4
ggtcgatacacgcctctacacacacgttctgccaaaacctcgctaaagcccgatgaactgagcctcctgaggaggatatgcgacgcgtactacctcccggactggtgctcaccttcagactatgtgaacattgccaagtcactgtctctcgaggatatcaagacagctgactggtcggagaacgtggccccgttttggcccgccgtgataaaatcagcgctaacatggaagggcttcacctctctgctgacgaccggatggaagacgatcagaggcgcgatggtgatgccgctaatgattcaagggctacaagaaaggggctcatcaaattcaacatcatcacctgtcgcaagccttgagccgcg

SEQ ID NO: 2101 - DNA, 149 bp, Zea mays
  Clone ID: LIB143-039-Q1-E1-F5
cgatgcaagtctctagatggattcatattaaaaaaaaaaaaaaaaaaaaaaaaaaaaaaaaaaaaaaaaaaaggaaaaaaaacaaaaggataaaaaacttaaataagaatgcaataaaacgggaggaagcttggagggtttcaccgtga

SEQ ID NO: 2102 - DNA, 358 bp, Zea mays
  Clone ID: LIB143-039-Q1-E1-A4
gagaaagctccagatggcactccagctggtggtggcttgctttatgttgttgttcatgaagcccaagatcttgaggggaagcaccatacaaacccatatgcaaaaataattttcaaaggcgaggagaagaaaactaaggtcatcaagaagaatagggatccaagatgggaggatgagtttgagttcgtgtgtgaggagcctcctgtgaatgataaactgcatgttgaagtcataagtaaagccccgaaggcaaggctgatacatggcaaggaaactttgggctacattgatattagccttgcagacgtgatcagcaacaagcggattaatgaaaagtaccatctcatagactcgaaaa

SEQ ID NO: 2103 - DNA, 104 bp, Zea mays
  Clone ID: LIB143-039-Q1-E1-A6
aaccatgtttacttctcaatcgaatatttatgcgagggatgtttgtcaacgcaaaaaaaaaaaaaaaaaaaaaggcgggcgcacaaaaagataaaaaacttaaa

SEQ ID NO: 2104 - DNA, 356 bp, Zea mays
  Clone ID: LIB143-039-Q1-E1-A8
gcttcacgtccgctacataccggcgaggagacgaaaggagggagttttgagaagcataaatggctcctaaagccgctcctgtcaagaagggtgatgccaaggcccaggccttgaaggtggccaaggctgtgaagtctggggcaggcaagaagaagaccaagaagattcgcacatctgtaacatttcaccagcccaagaccctgaagaaggccagggacccgaagtacccaagaatcagcactactggaagaaacaagcttgatcagtaccaaatcctcaagtaccccctcaccacagaatctgcaatgaagaagattgaagataacaacactctggtctttattgttgacctcaag

SEQ ID NO: 2105 - DNA, 404 bp, Zea mays
  Clone ID: LIB143-039-Q1-E1-A9
ctcgcgggtcgttacaagcctctagactgagtcgtactacgatcccctctcgttcctccctcgtcgcctcatcaattcaagatccaatctttgctgctgccactcggcgatccgatcgttctcgagcaaggtcggtggccatggcacgctgccgccatcacctcctcctcctttccgtcttacttgccttggctgctgctgctgcgcggcaggcgcagagtcatggaaaagcctccgccgtcttcatcgatgcctcgtcgcaccgctaccttcgggaccagcaagccgaccaccaggacgcttcaatgtcgttaaatgaagtttctgcggttgtttctgtcttgcttggtttcgcaccgtcaacatccctaccagctatttcttcttcgaagttgaacaaagtt

SEQ ID NO: 2106 - DNA, 402 bp, Zea mays
  Clone ID: LIB143-039-Q1-E1-B10
ctcgcgggtcgatacaagcctctagagtgagtcgtctgtatccgctcactctcctcgccgacaggacgagatccatcgctaacagaggatcctagcccacccaggccacgtgaccgacggtggtgccggcgatggcaacacgctactggataggctctcgcgacctggaatctcccggcgccaccgggacatcacgtcggtcacgcctacaggatggaatctcccgccagaccttcgacaccccgcagtgccggtgcaacgtcgcgaacgtccgacgtctgcagacgcgagacactccgcgcgcacagcgatgagatcgtcaactcaaacctgttcgtcaacggcttttcgcagatcatgcggaggcacatacatgacctcgatcgcatcggaggcatcgac

SEQ ID NO: 2107 - DNA, 386 bp, Zea mays
  Clone ID: LIB143-039-Q1-E1-B11
tcgttacaagcctctacagtgagtcctactaatccgcccgctctcctctccgcgacctcctcttccccgcaaaccctaaccctagccacgatcccgcagcctccgctctcgtcagcctgccactcctccgcccttccggccgcccacaggggaagatccggatccgcgtcgccatccgcgagcgctcgccgccgcctccggagccgcaataccctccgccttccagctccccgtactactttccaccgcctcctcccgcctactcggccccgcctcagtacggatctgaccagtactatcgccctagtggatactactctgcacctgcacctccaccacatccgtatgagtacaccggagggccctctgcaccggtggactacaac

SEQ ID NO: 2108 - DNA, 358 bp, Zea mays
  unsure at all n locations
  Clone ID: LIB143-039-Q1-E1-B2
agtaagcatgtgtgatgatgggcttccattctttgagatatcagcaattaatgctgataaacctccactatctattgcagaaattaagaggcgtgttgagcaatttagaaaagcagggaagaatgtgattatatctaaccagccatacttctataagaaagcagaacttttcccaggaagcgcttttataattggtgcagacactgcagcaaggcttgttaaccctaagtactatggaggagattacaacagaatgctggagatacttctcgaatgtaagagcatanggactacttttcttgttggtggtcgaaagattgaaggagatttcaaggtccttgagaacttagacattcca

SEQ ID NO: 2109 - DNA, 332 bp, Zea mays
  Clone ID: LIB143-039-Q1-E1-B3
aacagtttcatcgattgcgcggtcgatctccatcagagacagagacgatataatcagaataaagtatagcagcgcgtgtgcgcaacagggtaagattaggcgtgtgatttgatttcaaagctgtgcttgtaacgtaatgtaatacggtgtggcatatgcaccgggatatggtatgtgtattgggaagacgctatgcgtagcgtaagctagcaggtgttgcattgcatttgcatgcttggatcggatatgcatgtgttcttctgcctgcgacatcggtagcgcgtgaggctgtgactctgtgagctgcgatttccgcagttgaatcggtactg

SEQ ID NO: 2110 - DNA, 355 bp, Zea mays
  Clone ID: LIB143-039-Q1-E1-B6
ctcatgatctccggatcctgcgatcaggctgacgccggcaggggcgacttccaggagctcgaccagatcgccgccactaagcccttcgccaagctcgccgtcaaggcaacaaccatcgccgacatcccgcgcctcgtcttccaggccctcgccgccgccgtgtccggccgtcccggagggtgctacctcgatatcccgtccgacgtcctccaccaaaccctccctgaatccgaggccgcggctctcatagcagcagcagccgccgattcggccgcatccgatccttccccgtcaatgcacaagtctcttgacgagggaatcgccaaagctgcggacctgctccggtgtgcggagg

SEQ ID NO: 2111 - DNA, 315 bp, Zea mays
  Clone ID: LIB143-039-Q1-E1-B7
aactacggccctggctcccgcgtctgccgggtctgcgcgaaccctcacggtctgatcaggaagtacgggctcatgtgctgcaggcagtgcttccgcagcaacgccaaggacattggtttcatcaagtaccgttgaagaggccactgtgctgctgtggagaacttcctacatcaaagaaatgggtccttcattagaaggcctaatttatgcgctttagctttttgttcagaacttgagactcatgtgttaaactcgacttgttaaagttttgatggctactttgtgcttgttggaccagctataatcagaagattg

SEQ ID NO: 2112 - DNA, 383 bp, Zea mays
  Clone ID: LIB143-039-Q1-E1-B9
tcgatacaagcctctagatagtgtcatcgaactgattgcttagccgtcgaaactgcacaacccgcagatcgaagtctttgcaaaggtgttctacggcgacccggcaaagaagctgtacgaagcagccgacatggtcccgcttagctgcatggtggtcgggagcagaggactaagcacgctcaagagggctctgatggggagcgtgagcacgtatgttgtgaaccacgcggcctgccccgtgacggttgtgaaggagatggtgtagcgtgttgaacaccgctggttacaagcttcaccctagccagattgaataagcgtgcttgataagcactgatcaggggggatcttgctacttatacgacattttgtgcttgaaatttggg

SEQ ID NO: 2113 - DNA, 357 bp, Zea mays
  Clone ID: LIB143-039-Q1-E1-C1
atcagaactcgggaaaaaaaatgtcagaggccgccgtgcgtgtgatcggcctatggccgagcccgttcgtgatccgcgtcctgatcgccctgaagctgaagggcgtcgagttcgagttcgtggaggaggtggtgggcaggaagagcgagctgctgctgaggtcgaacccggtgcacaagaagatccccgtcctgctccaccacggcaagcccatctccgagtctctgatcatcgtccagtacatcgacgaggtctggtcctccggcgcgccggccttcctccccgccgacgctcacgcccgcgccgtccagcggttctgggcgcagtacgtcgacgacaaggtgaagcaaaaactag

SEQ ID NO: 2114 - DNA, 329 bp, Zea mays
  Clone ID: LIB143-039-Q1-E1-C2
ctttaaattaaccggtgtctcgtgccctggcagggacgccactgctgacatggtacctgatcgagtgagttcctcgggcattcatcggcgcgcataagtcaggagtctactggttgtacgcatcgatcgaggagcgcaggggtcttgggagttgtagcaagacgctcaccgttctgttcatggtcagccgcaaggacgatcaagcagcggtgaggtcgatgacggtgacagcgttcagtgagtgggacgtgaataacggcgccgtgccggacgactccatggacttctccaagatccgccacatgcgcaagcagaacatgctcgagctc

SEQ ID NO: 2115 - DNA, 371 bp, Zea mays
  Clone ID: LIB143-039-Q1-E1-C8
cgatgcaagcctctagggcgtctcgcaccaacacccgcgatgtcatcctcctcgccgccgccgccgcacgtcgtcgaggacatgccccatgtcctccagcttctcagcgacggcacggtggtccgcttcgccgactacgacacgctccctcccccgtccgtgcctcccgcgccgctgcccgtccggtggaaggacgtcgtgtacgacgccacccacggcctcaagctccgcgtgtacagtcccagtccgccggcctcctgcggcaagctgcccgtgctggtctacttccacggcggcgggtacgtcctcggcaccttcgcgctgcccagcttccacgcctgctgcctccgcctggccggcgaggctcccgg

SEQ ID NO: 2116 - DNA, 354 bp, Zea mays
  Clone ID: LIB143-039-Q1-E1-A3
aggacgcatgggtggaggtgcaggttttccttctggtctcaaatggtcctttatgcccaaggtttcagatggacgcccttcttatcttgtcgttaatgctgatgagagtgagcctggaacttgcaaagatagagaaatcatgcgccatgacccccacaagcttctggaaggatgccttattgctggagttggaatgagggcatcagctgcttacatctacattagaggtgaatacgtgaatgagcgtctcaaccttgagaaagctcggcaggaagcgtatgcagctggacttctgggtaagaatgcttgtggctctggttatgattttgatgtgcatattcattttggtgctgg

SEQ ID NO: 2117 - DNA, 356 bp, Zea mays
  Clone ID: LIB143-039-Q1-E1-D1
ctagctcacttaacgccgccgcggagctgctccgcgcccccgacgccggtgattaggagcaggagcaagaggggttcggaatggccaagtctaagaaccacacggcgcataaccagtcgttcaaggcgcacaagaacggcatcaagaagcccaagcgccaccgccagacctccaccaaggggatggaccccaagtttctgaggaacttgaggtactcaaggaagggcaataagaagagttgtgaggctgagtcagaggagtgagatgatgcctgagtttgtggcgacaaatgcatctcttgtatcgttagggtcttagttgtgaacttaattttcacatctgtatgattaaaagag

SEQ ID NO: 2118 - DNA, 402 bp, Zea mays
  Clone ID: LIB143-020-Q1-E1-D5
aggagaagctattggagaaaatgagccatgcactttgttgcctacagcctgtaacctactaccacgccaagctaatctgggtgaggtatcacgtgcccagcgcactattgaagccgtggagaagctgttgttgcaggggatgggttcagttattgaatccaaggacattattggaatctacaggactccattattggatgaccatggacaagtccgttaccataatcacgaaaagcatgtacaggttaccagatgtcatcgtggaaacgcaaatgtccgttatgcatggcttccttgctccaaaagcactgtgcatgaaatgatgctgaatagttctttacaagttcataagccgcccattaagtgtgcagcctatggagagggcacattccttacaccagc

SEQ ID NO: 2119 - DNA, 402 bp, Zea mays
  Clone ID: LIB143-020-Q1-E1-D6
gatcaaggagacccgcctcaagctcttcaaggatttcttcctcgaggagaggaagaagctggcgagcaccaaggccacggacagcaacggcctcaagtgcgccattgatcacatactggaggcacagcagaagggtgagatcaacgaggacaacgtgctcttcatcgtcgagaacattaacgttgcagcgatcgagaccacgctgtggtcgatcgagtgggcggtcgctgagctggtgaaccacccggagatccagcagaagctgcggcaggagctggacacggtgctcgggccgggccaccagatcacggagccggacacgcacaacctcccctacctgcaggcggtgatcaaggagacgctgcggctgcggatggccatcccgctgctggtgccgcacat

SEQ ID NO: 2120 - DNA, 392 bp, Zea mays
  Clone ID: LIB143-020-Q1-E1-D8
atccgttgcgctgcgcccggttccctcgcgcggtgcggaatttaacatggccgtgccggaggtggtggtcgacggcgtcgtcttcccgccggtggcccgcccgccgggctccgccggctcgcacttcctcggcggcgcaggcgtgcgaggcgtcgagatcggaggcaacttcatcaagttcacggccatcggcgtgtacctggaggacgcggccgtgcccgcgctggccaagaagtggggcggcaagacggccgacgagctcgcctccgacgccgccttcttccgcgacgtcgtcacgggcgacttcgagaagttcacgagggtgacgatgatcctcccgctgacgggcgagcagtacgcggagaaagtgacggagaactgcgtggcgttct

SEQ ID NO: 2121 - DNA, 411 bp, Zea mays
  Clone ID: LIB143-020-Q1-E1-D9
acgatccccaattcctccttcggatctcgcattcagcgcagcgcaggtgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaggacaagatcagacctctttggaggcattacttccagaacacccagggtcttatctttgttgtggacagcaatgaccgtgaccgtgttgttgaagccagagatgagctccacaggatgctgaacg

SEQ ID NO: 2122 - DNA, 395 bp, Zea mays
  Clone ID: LIB143-020-Q1-E1-E1
gaaaaaaaaaacacacacacacacacaaagcgcacttttcaaatcgacaaaggggaaaggttcgcttcttgtggcatcttgctttccttcgagtgccatggccgatccggcggaggagaacgttgtctcgccgccaccgacccctgcggccccagccgtgggcgcctcagacccgcccctgcagcctgctgctgacagcgcctcaacggagaaggtgtctgctccggcgccggaggtaaggtcccggggattcaggcttcttggagaggacacttccgtgcacaaatcccttgggggcggtaaaactgctgacgttctcttatggaaagacaagaaaacttctgctgttgtaataggcggcgcaactgtcatctgggttctgttcgaagtgcttg

SEQ ID NO: 2123 - DNA, 420 bp, Zea mays
  Clone ID: LIB143-020-Q1-E1-E11
aatacctactactcaagtatccatccttattgagtacagtgttgatccatggactcggaaggagttgtagcagcaaaggtggcagatgagactactaaaccggcaatccaagaagacggcgccgagagcaaggccgggatgactgatctgctgatgctgaccgacaagtcgcagctgcaggcgctggcgatgctgctgcggaacaacgaggagctcatgatgagccaggcgatcaagtcggagacggagcgcattgagtacctcaagacggtgagcgactgctacacgcggacgatgaagctcctcgacgattccatggcggccaggaccacgtacgagcgttcgggcggaacgaggagcctcgtcgcccgggacatggacgactacgtcgtctacggcctcaacgcgtgcttgcagaac

SEQ ID NO: 2124 - DNA, 402 bp, Zea mays
  Clone ID: LIB143-020-Q1-E1-E12
acaataagctgaggcagaaacatgcatctggtgaaggtgctaattatggtgtagacataaacactggcggaattgctgattcctttgcaaactttgtttgggaacctgctgttgtaaagatcaatgctataaatgctgcaaccgaagcttcctgccttattcttagtgtcgatgagacagtgaaaaacccaaagtcggagagcgcacaaggtgaggctgctgccggtgcgatggctggtcgcggtcgaggtgcaatgcgaggacgtggtggcaggggcatgcgcaggcgataaactgggtcaagtagatcatggtgagatttttttgcatgtttgcgagtgcttttgtgccttactgcacatgtatggacgctgcacttactattgtgcgcttttggttgtg

SEQ ID NO: 2125 - DNA, 306 bp, Zea mays
  Clone ID: LIB143-020-Q1-E1-E2
cagacgcgtgggcggacgcgtggggtacaatgatgatcaaaatgtcatccacttgatggctaaatcattgcttgagaaatttgaagagaagtggctccattttcttcctaaagttgagagtgaggaaaaaagacaaaaggaggaggaatcaaagggtgttgcagccacaaatacttctcgagaagttgcaattgtaaaattagcaaaagacactgatgatgagctaaatcagattaacaggaagctggaggagctccggaaaatggtggttcacagatgcaggaaaatgacgacagatgagaagag

SEQ ID NO: 2126 - DNA, 378 bp, Zea mays
  Clone ID: LIB143-020-Q1-E1-E4
gggtccacgcacgcgtccggaggcagtgggaggtacgatcatttagcgaggcggttgaatgatatcggcatcaaggtgtacgggatggactggactggtcatggtggaagtgatggtctacatggatatgtgcaatctcttgaccacgctgtcaatgacttgaaaatgtacctcaagaaagtatcagccgagaaccctggtcttccatgcttctgcttcggccattcgacgggtgggggtatcattctgaaggctgcacttgatccagacgtagaaacgctcatcagcggtgttgtcctgacatcaccagctgtccgtgttcagcctgcccaaccaatcatagcggccatggcaccgatttttgccctgatcgcgcca

SEQ ID NO: 2127 - DNA, 420 bp, Zea mays
  Clone ID: LIB143-020-Q1-E1-E5
gatttttatttttattttgctagttcttgaaatttcttgcacgagtgtcagtagccaactgctgataacaacatcctatcgttcctgtagcccctttccgtgaccttgccaaagaatttgctcttctctgtgcgtgtgcaatttcttccgctacagctcaaggatccgctactctgctgttttgggagattcgccatgggcggcggggccgttaacgaccacttcccgggggccagcgacccgctgctccccacgaagcgggatggggacggggacgaggacgacgcaggtgcctccgcgttccacgagttcgacggcgcctccttcgccggcgcggtgttcaacctcctcaccaccatcgtcggcgcgggcatcatggcgctaccgggcacatgaaagtgctcggtctcgtccctgggc

SEQ ID NO: 2128 - DNA, 194 bp, Zea mays
  Clone ID: LIB143-020-Q1-E1-E7
actcgatccatctgactctccgctggtcgctcactcttgcaactccatccttcactcagtcttagtctcttattagctctaggctctagctagccgcgcgactccttcatgtagccatcagccttctcatcgccaccaatgggcactgccgaggtccagactccgaccgtcatggcggctgaggaagcgcccgt

SEQ ID NO: 2129 - DNA, 378 bp, Zea mays
  unsure at all n locations
  Clone ID: LIB143-020-Q1-E1-E8
ctcgccgcagacctctgccatggcggaccagctcaccgacgagcagatcgcggagttcaaggaggccttcagcctcttcgataaggatggcgacggctgcatcactaccaaggagcttggaacggtgatgcgctcccttggccagaaccctaccgaggcagagctgcaggacatgatcaacgaggtcgatgcggatggcaatgggaccatcgacttcccggagttcctgaacctgatggcgaggaagatgaaggacacggactcagaggaggagctcaaggaggccttccgcgtcttcgacaaggaccagaacggtttcatctcggctgccgagctccgccatgtcnatgacaaccttggcgagaagctgactgacga

SEQ ID NO: 2130 - DNA, 433 bp, Zea mays
  unsure at all n locations
  Clone ID: LIB143-020-Q1-E1-F1
cagttgctggtgctagcaactgttccagaataaatgacatggtacccacaattattctggaacagttgctggtgctagggaggcattcttatatgggattcctgcaatagctatgtcatatgattgggttgcgggtcggagcagtgttaatgacctcaaggtgtctgcagaggtctgcatgcctctgataaatgctatcgtgactgagatcaagaatgggacttaccctcaaggatcattcttgaatgtagatgtacctacagatgctgcgcaccacaagggctacaaaattacaagacaaggaacatatatggccagaattagttgggagcagacggtttacaagaagcctgcagtagaaagttaccagacagcanacatggatgttgatggtgaaaaggatagcgaactagttacgtcagaaaatgaccta

SEQ ID NO: 2131 - DNA, 415 bp, Zea mays
  Clone ID: LIB143-020-Q1-E1-D3
gggtcgagcacgcgtccgcactcacacactgcaacagccaagtgcaagtgatcgagctcccccctcctcatcagtcgctaggcacagcgcacttgcaggatggcgcaggtctctaagacgcttctccttgtggccctggtgttcgtgtcgtcggcggcggtggagctgtgccgcgcgatcgacttcgacgagcgggacctggcgtcggacgaggcgctgtgggacctgtacgagcggtggcagacgcaccaccgggtgcaccggcaccacggcgagaagggccggcggttcgggacgttcaaggagaacgtgcgcttcatccacgcgcacaacaagcgcggcgaccggccctaccgcctccgcctgaaccggttcggcgacatggggcgggaagagttccgggtcacgttcgccg

SEQ ID NO: 2132 - DNA, 337 bp, Zea mays
  Clone ID: LIB143-020-Q1-E1-B9
ggacgcgtccgagactcaaccgtcctcactcaccgggagacggcgacgtgtcacggttcctgatgcgtttgagtctgcgcgaagaaggcgagctgacgatgcagtcccgtatgcttcatcggagggcttgcctgcgccactagcaccgagtcactggtgaatactctcgccgccgagggcgagatccgcgactccaacgtcatcatcgaccgggagacggggaagtcccgcggcttcggcatcgttgccttctcctccgacatctccatgctcgacactatctactacatcaacggcatcgaccgcgacggccgtagcatcaccgttaaccaggccc

SEQ ID NO: 2133 - DNA, 386 bp, Zea mays
  Clone ID: LIB143-020-Q1-E1-C1
cgtccgcacctcttcttcgcgcagatctaccacgaccgcaagcagcgggaggcgcgcatgtcgctgccccgcgccgagcgcgcgcgggcgccgtacgtcgacttcctcaagcccatcatcgccgacggcgacacgggcttcggcggcgccacggccaccgtcaagctctgcaagctcttcgtcgagcgcggggcggccggggtccacctcgaggaccagtcctccgtcaccaagaagtgcggccacatggcgggcaaggtgctcgtcgccgtctccgagcacgtgaaccgcctcgtcgccgcgcggctccagttcgacgtcatgggcgtggagaccgtcctcgtcgcgcgcaacgacgccggtcgccgcacgctcatcccagacaa

SEQ ID NO: 2134 - DNA, 422 bp, Zea mays
  Clone ID: LIB143-020-Q1-E1-C10
agcgaagcaagcagcctaaaaaaaccgtatcgtctcgcctgttcagtttccttctcttcccgcagcccggtttgccgaccaggttccaccgttccagagtagccaagcgaatcccgtgtctggttcgcgcgatggcggaggagcagtccaacccccagcaccagcaagcggaggagagggaggttatggtggagcagcagcagccgaggagggccccgaagctgacgtacctggacttcgtccaggtggcggctgcccaggccgcggtgtgcctcgctgggctctacggcctcgccaaggaccacgccggcccgctccgccccagcgttgacgccgtcgagtctgccgtgaagggcgtcgttagccccgtctacgaccgcttcggcggcctgccgctcgacgtcctcgccttcgtcgaccgc

SEQ ID NO: 2135 - DNA, 371 bp, Zea mays
  Clone ID: LIB143-020-Q1-E1-C11
cacgttcgagagtctcactgacaagagcaagctcgatgcgcagcctgagcctttcatccaccttgtcccagacaacggcaagaatacgctcttcaacaatcaacagcggaatcggcatgaccaattccgaccttgtcaacaacctcggttaaatcgccagttccggaacgaaggatttcatggaagcccttgctgccggcgctgatgtgtcaataattggccatttcggcgtcggtttctactctgcctacctcgtcgccgatagagttgtcgtgaccaccactcaaaacgatcacgagcaatacgtgtgggagtcccaagcgggcgggtcgtacagtgttactcgtgacacgtcaggggagcagcttggc

SEQ ID NO: 2136 - DNA, 418 bp, Zea mays
  Clone ID: LIB143-020-Q1-E1-C12
gcattggttcttgctccaacccgtgagcttgctcagcaaattgagaaggttatgcgtgctcttggggactatttgggtgtcaaagtgcatgcctgtgttggtggaacatctgttcgtgaggaccaaaggattcttgccagtggtgtgcatgttgttgtgggcacaccaggacgtgtgtttgatatgttgcgcaggcagtctctccgtcccgacaacatcaagatgtttgtgttggatgaggctgatgagatgctctcccgtggattcaaggatcagatctatgatatcttccagcttcttccatccaagattcaggtcggtgtcttctcagctaccatgccccctgaggcccttgagatcacgcgcaagttcatgaacaaacctgtgaggattctcgtcaagagagatgagctcaccc

SEQ ID NO: 2137 - DNA, 370 bp, Zea mays
  Clone ID: LIB143-020-Q1-E1-C2
gggtccaggccgcgtccggagccaccatcggattctggcaaggggacattaggtacctgatggaggatgtgcaagtgatgaaaccgacaatattctgtggtgttcctcgtgtttatgatcgtatatatacaggtataaacatgaaaattcagtctggagggatgataaccatacacctttttcagtatgcctacaactacaaacttgccaatatgaggaaagggctgaaatagcatgaagcatcaccgtttttcgacaagatagttttcagcataataaaggaagggcttggatggcgtatacctctcatgatagctggagcagcaactttgtcagggcaaatcgaataattcatgcgggtaacgacctg

SEQ ID NO: 2138 - DNA, 393 bp, Zea mays
  Clone ID: LIB143-020-Q1-E1-C3
cagggggtccgtggcggcggccgtggtccggggccgcgccttcgcgccgcacgccgacgtgctgtggatggagacgtccagccccaacgtggccgagtgcaccgccttcgccgagggcgtcaaggcggcgtgccccgaggcgatgctcgcctacaacctctcgccgtccttcaactgggacgcgtctgggatgacggacgccgagatggccgccttcatcccgagcgtcgcgcgcctcggctacgtctggcagttcatcacgctcgccgggttccacgccgacgcgctcgtcaccgacacgttcgcgcgggacttcgcacgccgcggcatgctggcctacgtggagaggattccagaggaggagaggatcaacggcgtggagacgctggagca

SEQ ID NO: 2139 - DNA, 407 bp, Zea mays
  Clone ID: LIB143-020-Q1-E1-C4
aaacaaacaagcacacagatgatggggttaatagaagtgttggagcaagtactggagcttcaagtgaagccaataatgtgcctggaaccgagaaggcacaggaagcaggttcacttgattctatatccaagtctaacaggaagaggacagctaaacgaactgcattttctgattcagattcagaagacctagacctatcaaaggaggaccttgtgaagctgcttcttgagaaagacgaatcattgaagtctaaagatgaagagtttaaagatatgaaggataaggtcctacgcagctatgctgagatggagaatgtccttgccagaacaaagcgtgagtcagagaacaccaagaagtatgccatacagagcttctccaagagcttgttagatgttgcagacaatttg

SEQ ID NO: 2140 - DNA, 265 bp, Zea mays
  Clone ID: LIB143-020-Q1-E1-C5
aggagaagctattgtacaaaatgagccatgcactttgattgcctacaacctgtaacctaataccacgctcagctaatctgggtgaggtagcatgtgcccagcgcattagtgaagccgtgaagaatctgttgttgcaggggatcggttcagtcattgacactaaggacatcattggagtctatacgactccattaatggatgactatgcatcaatctgtgacaatcatcacgaaatgcatgtacacgtaaccagatgtcaacgtgg

SEQ ID NO: 2141 - DNA, 306 bp, Zea mays
  Clone ID: LIB143-020-Q1-E1-C6
cccacgcgtccgatcagaccatatttggtagtgtcagccgagctctatatagtctaaaggatgtaacccactatggagcccatctcatcgaggtgaggtatcatgtgcactggacacgattgaagccgtggagaaacggttcttggagggcatgggttcagtaatgggcttcaccgacatcaatagaggcttcacgacctcatgaatgggtgactcctcatgcatccgtgacgacgcatgcacaatatgagtggtcgcacccagatgacaacctctacaatcgtggatgtatccatcatggctccc

SEQ ID NO: 2142 - DNA, 412 bp, Zea mays
  Clone ID: LIB143-020-Q1-E1-C7
acgataggtaaaaagaatatatgtgccactacctgatccaaatgtacgaaggttacttctgaaaaatcagctcaaaggacaatcattcaaactgtcgaaccatgattttgaaagacttgctgtggagaccgaagggtattctggaagtgacctgagagccttgtgtgaagaagctgcaatgatgccaataagagagctcggtccacaaaatattcttactatcaaagcaaatcagctgcgacctttgaggtacgaggacttcaagaacgcgatgacggtgatcaggccaagcttgcagaagagcaaatgggacgagctggagaactggaacgaagaattcggttcgagctgacggagacgcgcgctgcctgatgatgatgatcaagcggccctatttccagatgtacatgat

SEQ ID NO: 2143 - DNA, 387 bp, Zea mays
  Clone ID: LIB143-020-Q1-E1-C8
ccagcttgccggagttgtggccgtcgaggtcaccggtgggcctgagatccccttccaccccggcagggaggacaagcctcagccgccacctgagggccgtcttcctgatgccaccaagggttctgaccacctgaggcaagtctttggcaagcagatgggtttgagtgatcaggacattgttgccctctctggtggccacaccttgggaaggtgccacaaagagcggtctggttttgagggggcctggactacgaaccctttggtctttgacaactcttacttcaaggaacttctgagtggcgacaatgaaggtcttcttcagctcccaagttgacaaaccctgctgagcgaacctggtcttccgccctcttgtggagaaatatgctg

SEQ ID NO: 2144 - DNA, 364 bp, Zea mays
  unsure at all n locations
  Clone ID: LIB143-020-Q1-E1-C9
ttctgagatccatccagaaacgtcgctccatggcgattatctccgacttcaaggaggacgaggccccgcagcagccggcggcggtcggccccggcgtcgatgagaccctggtggcagcgctagagaggaccggcggtgcactcccctttctccaggcggccatcgatgtcgctcaccgcaggtctggcctgttccgcgacccttcggcggtgagcaaggttaccgcgatggcggcggccgtcatggcgcaggtggagaccgaggagagggcagccagagaggtcaagaggaaggcggaggacgccgagaggaatgctgcggccgatgcgcanaaggctgacatggaggcggcgacggcgactgc

SEQ ID NO: 2145 - DNA, 390 bp, Zea mays
  Clone ID: LIB143-020-Q1-E1-D1
gcctcattcatctccattcgaaacaccctcgcacccacactctcccttcgtccccagcctaaatccccgcaaagatggctcgcacgaagcagacggcgcgcaagtccacgggcggcaaggccccgaggaagcagctggcgaccaaggcggcgcgcaagtcggcccctgcgaccggcggcgtgaagaagccgcaccgcttccgcccgggcaccgtggcgctgcgcgagatccgcaagtaccagaagagcacggagctgctcatccgcaagctgcccttccagcgcctggtccgcgagatcgcgcaggacttcaagaccgacctccgcttccagtcctccgccgtcgccgcgctgcaggaggctgccgaggcctacctcgtcggcctgtttg

SEQ ID NO: 2146 - DNA, 163 bp, Zea mays
  Clone ID: LIB143-020-Q1-E1-D10
actgtcaccagttccccattcgaatcgtgccgtctctgctgttcagttgcgttctcatgtggaagtgcagtttgacgaccatagtcctgtgttccacgttaacctcgctattcccgtgtatggatctcgcgatggtcgttgagtagcttcaactcccgacatc

SEQ ID NO: 2147 - DNA, 427 bp, Zea mays
  Clone ID: LIB143-020-Q1-E1-D11
aaaaaaagcctccgcctcctcctcctcctcctcctccgccgccttccgcctgttctcacttcccgcccctccctccggacctagacccctccaagcgccagcgccggtgaacaccgctttcccgtacctgcgccatgggccgcccaaagggcggcgccgcgtcctcctcgaagaagccgaaggcgaagcagaaacagcgaggtggcgtcgacttcaagaagtacaagcacaaggtcgggcgcaagcttccgccgccgaagaatgccaccaacacggaaatcaagtccaaaacgatcgtgctgccggagcagagcatggcgtcggagaggacgggcatggcagtgaacaagcgcgggctcacgctacgggagctcctgcagcagacggggcactacaatgccaatgtgcggcgggctgcactgaatgg

SEQ ID NO: 2148 - DNA, 102 bp, Zea mays
  Clone ID: LIB143-020-Q1-E1-D12
gttaactccgagcaccggggcttcgtgcatcgtcgaattgccaccgccgcagctgcagctcaatcccattccgtcggcatgatgacggagtccatctcgatc

SEQ ID NO: 2149 - DNA, 366 bp, Zea mays
  Clone ID: LIB143-020-Q1-E1-D2
aattcacaaagcgatactagctagtccctaccaaagcatacttcctgaaacactcttgcaatccactgagttctgtttgttgagacgcatagagctagagtcgacaatgtcgctcgtgaggcgcagcaacgtgttcgaccccttctccatggacctctgggaccccttcgacaccatgttccgctccatcgtcccgtcggcgacctccaccaactccgagactgccgccttcgccagcgcccgcatcgactggaaggagacgcccgaggcgcacgtgttcaaggccgacctccccggcgtcaagaaggaagaggtcaaggtcgaggtcgaggacggcaacatgctggtcatcagcggccagcgcag

SEQ ID NO: 2150 - DNA, 333 bp, Zea mays
  unsure at all n locations
  Clone ID: LIB143-020-Q1-E1-B8
gccaagtgcaagtgatcgagctcccccctcctcatcagtcgctaggcacagcgcacttgcaggatggcgcaggtctctaagacgcttctccttgtggccctggtgttcgtgtcgtcggcggcggtggagctgtgccgcgcgatcgacttcgacgagcgggacctggcgtcggacgaggcgctgtgggacctgtacgagcggtggcagacgcaccaccgggtgcaccggcaccacggcgagaagggccggcggttcgggacgttcaaggagaacgtgcgncttcatcacgcgcacaacaagcgcggcgaacggccctaccgcctccgcctgaac

SEQ ID NO: 2151 - DNA, 322 bp, Zea mays
  unsure at all n locations
  Clone ID: LIB143-020-Q1-E1-A2
gggtccagcacgcgtccgcacggatgcctcncgcagccgcccgctgctccggtccttccgaacgctggcctgttcttccctgcctttggcccattcgtcaggcggcccctccgcaggcgacgcaggcgcgggcacgacggcgcgtggccccgactacgtagacagctaaccggtctccgcctccggcccttctcctgtcgcccgattgagtcgctgctgcaactgccaacttcacccccggcgagctcaccacagtcttccggaaaggtgctatcaatttggaagatggcagatgaggagcaggccccaagctctaggaaaa

SEQ ID NO: 2152 - DNA, 376 bp, Zea mays
  Clone ID: LIB143-020-Q1-E1-A4
aatagttctagatcgcgagctagaactagtcctcgtgaatggcatctgctggactgcttacgcgctcatccgcttcgacctctacattactatccccaacgggctgggcgtgctgttcgcggtggcgcagctggtgctgtacgccatctactacaagtccacccaggagatcatcgaggcgcgcaagcgcaaggccgaccagatcgccatgaccggggtggtcgtcgacggcggcaagaccaacaaccaagccggcgcgggccaatactgaccgacgatcaagtgacgatcgacaccaatatgctcaagcaagaagccagcggcaaatcaattatgtcgccgctgggttttatgtattttgtgattctatatgcac

SEQ ID NO: 2153 - DNA, 406 bp, Zea mays
  Clone ID: LIB143-020-Q1-E1-A5
cggacgcgtgggcggacgcgtgggcgtgtgtgggcagcggtggagagagactacttcctgaatggtactctgagaaaggcattgaactgatcctgagtactgagattgtgaaggccgaccttgcttcaaagactctgaccagtgcagctgcggaaaccttcacatatgagaccttgctcattgctacgggctcctcggtcataaagctcactgattttggtgttcaaggagcagaatccaacaacatattgtatctaagggacattgcggatgccgacaagttggttgcagctatgcaggcaaagaagggtggaaaggctgtgattgttggaggtggttacatagggcttgagcttagcgctgccttgaaaatcaacaacttcgatgttgacatggtgtaccctga

SEQ ID NO: 2154 - DNA, 90 bp, Zea mays
  Clone ID: LIB143-020-Q1-E1-A6
acgattctacatcgccagccgcctgcccgtgtgtatgcaacataggaaaaagaccagtcccttatttgcacgcagagataggcatcgatt

SEQ ID NO: 2155 - DNA, 424 bp, Zea mays
  Clone ID: LIB143-020-Q1-E1-A7
aggagaagctattggagaaaatgagccatgcactttgttgcctacagcctgtaacctactaccacgccaagctaatctgggtgaggtatcacgtgcccagcgcactattgaagccgtggagaagctgttgttgcaggggatgggttcagttattgaatccaaggacattattggaatctacaggactccattattggatgaccatggacaagtccgttaccataatcacgaaaagcatgtacaggttaccagatgtcatcgtggaaacgcaaatgtccgttatgcatggcttccttgctccaaaagcactgtgcatgaaatgatgctgaatagttctttacaagttcataagccgcctattaagtgtgcagcctatggagagggcacattccttagagcagcaggtcgttctgatccccgtgtg

SEQ ID NO: 2156 - DNA, 433 bp, Zea mays
  unsure at all n locations
  Clone ID: LIB143-020-Q1-E1-A8
caatgttgcttctcgcctgctagtcgccctattctactccactccgcccttggacccgccgccgccgccgcttgccgggtctatagccatgtcaccagcggttgcctctgcctcatctggcgaccgcatacgaacctacgaagacttcgtgcgggtacacgcgtacctgctggccgcggcgggcatcccgccgtcgctgcaccagaggctgtaccgcaagctcgcggacgaggtcttcgacggcggggaggtctttgccgtcgagccgtgcgaggacgggaggcagcggcgcctcgtgctcaccgccgatcagtctctangaaaagagtccgatgtcctcctcgtcgaccatgcgtggtcctttccgcctccctgatgcgctcaagcatttgcgggaagtacanggattggctgaaaggatggcagcattgat

SEQ ID NO: 2157 - DNA, 398 bp, Zea mays
  Clone ID: LIB143-020-Q1-E1-A9
attctagtgaagatgacgaggagcatgaccacagtgagccctcgcaatgatcgatgtcgatcgcaacgttaatcatcagagctccaacgcgatgaagctccaaagggagctatcggagttcgaaactgaagctgacaactgacctgtgcgatctgaagacgaaggaaaatgatcatattgattgctaacatacgcgaagtgaaggactgaagttgttctaaagatcaaagcttccctggaatgcggcagatctattctatgatttgagacatttttttaaagattggattaggattgtagtcacttgtttctgttgagtttatattgtaatcagattaactcaagttaatacctccagtggagaattgtagaaaggagtaaccatgctatgtacatgt

SEQ ID NO: 2158 - DNA, 424 bp, Zea mays
  Clone ID: LIB143-020-Q1-E1-B1
gggtccacgcccgcgtccgagcgcacccggttccgcgtgcctttccccacctactctcgcggctctcgccagccagtctagggtttcggtcccggcgtgcttatccgcccccgccggccatgtcgaagcaaggagggaaggccaagccgctgaaggcgcccaacgccgacaagaaggagtacgacgagacggatcttgcatatctgcagaagaagaaagatgaggaaaaagcactgaaggagcttaaggccaaggcacagaatggcgcgattgggggctcgggtctgaagaaaagtggaaagaaatgagactggtcacccgtctccaatacctagaggatgataaggcagctgtctatctgtgttgcgcttcactaagtgtgattgtaacagtggtacctcttgtgttctgtgttccgcgatgt

SEQ ID NO: 2159 - DNA, 424 bp, Zea mays
  Clone ID: LIB143-020-Q1-E1-B10
atccttcctccatcttcctcctccactccactcccaagtccccaccacccccaaccccgtctctccactgcggcgcaggcttcgcttcggctccgctcggctcgagcagaagaaaatgcaacgggcagtgcaggccgtcaggtcacacggcaatgttcttaaatatgctgttctacaacacatcagcgctcccaagccagcaatgcttcctgctgccttttctcgtttcatgtcagtttcatctgctcgcctagaggatcgtggatttgaaactgccactgtagcagatgtcttgaagtctaaagggaagagtgctgatggatcttggctctggtgcaccacagaggatagcgtctatgacgctgtcaaatctatgactcagcacaacgtgggagctttggtggttgtcaaacctggacagaat

SEQ ID NO: 2160 - DNA, 389 bp, Zea mays
  Clone ID: LIB143-020-Q1-E1-B11
gagagaagcaggtaatacatacctgcgactgcgacgagtgagtaaagcttcatcttcttcctccttcctccggcctcttcctgagtgctgcacgcagtgcgtaagaaggaactcgcgtacgtacgtgtgctagctagctagctcgaccacgcgcagcacgcaggcgcgtagtagctcgatcgatcgaccgccggccggaaatgtcgaccaactcgaggtccaactccagggccaacttcaacaacgagatccatgacatcggcacggcgcagaactccagcatgccccccacgtactacgaccggtcgctggcggacatcttccctccgcacctcctcaagaaggtggtctcggaggtggtgtccacgttcctgctggtgttcgtcacg

SEQ ID NO: 2161 - DNA, 420 bp, Zea mays
  Clone ID: LIB143-020-Q1-E1-B12
acataccttgcggaggaggtgagggcgcttcagagggcacacccaggcttgttcaagcgggagtttgggatgatcgaagacagcaaggcccgtacactggacgagaggatcaagaagcagaggcgtgcactgatgaacctacatcttcgtcgccacgacctgaccaaggaagtgaccaggacgctcatggacctggctgagtgatgcagtggactgagctgagtatcatctaagaattctattttatggtatttaagtgcactgatgatcgattaccagcaaatgttgtatgacctactcaagcatggtaggtgaatcttgattttgttatctatctggtgtcgagtttttagttgttcatggtgtcagacatgttgcagcgtcagtgttaagtcaggaagtgcctgagtatgcacctgt

SEQ ID NO: 2162 - DNA, 384 bp, Zea mays
  Clone ID: LIB143-020-Q1-E1-B2
agaagaatcgccatcacagcaagctacgcgcactgaaatcctccaatccacaggacacagctctacttccacagttcgcagactcgcacgcaccgagcggctagcgatcaacgagaaatgtcgctggtgaggcgcagcagcgtgttcgacccattctctgtggacctcttcgaccccttcgacagcatgttccgctccatcgtgccgccgtcgttgtcgtcgtcggcggcctccgagaccgccgccttcgccagcgcccgcatcgactggaaggagacgcccgaggcgcacgtgttcaaggccgacctccccggcgtgaagaaggaggaggtcaaggtggaggtggacgaccgcaacgtgctgctcatcagcgggcagcgcaac

SEQ ID NO: 2163 - DNA, 175 bp, Zea mays
  Clone ID: LIB143-020-Q1-E1-B3
acgcgtccgagaaaaaaaaaaaaaaaaaaaaaaaaaaaaaaaaaaaaaaaaaaaaaaaaaaaaagaaggaaggacgaacgagcaaaaaaggggcttacgtacgaatggatgcaagggaaagctgcccttgaaggtgacagcttaattcatctggctggccgattaaattcatttc

SEQ ID NO: 2164 - DNA, 357 bp, Zea mays
  Clone ID: LIB143-020-Q1-E1-B4
gtgaaatgcttgctcgacaatgaagctgtgactgttggaggcacctgccacagccatgcgacgaaggatctatatgattccatcgcagctgggaattaccctgaatggaagctctacatccagactattgatcttgaccatgaggataagtttgactttgacccgctcgatgtcaccaagacctggcctgaggatatcatcccgctgcagcccgttggacggatggtcctgaacaagaacgtcgacaacttctttgcagagaatgaacagattgctttctgcccagcgattattgttcctggaattcactattctgatgataagctgctccagacgagaatcttctcctatgctgat

SEQ ID NO: 2165 - DNA, 346 bp, Zea mays
  Clone ID: LIB143-020-Q1-E1-B6
cccacgcgtacgcgccactccccaaccgtcccaggacccaggctcagcactagcagccatgccgcacctcgtcctgcttctcttcctcggcctcggcgggctcctgcccgcggcgtcggccgccgacgagcagttcgtgttcgacggcttcaagggcgcgaacctcagcctcgacgggatggccacggtcacgccggacgggctgctcatgctcaccaacggcaccagccagctcaagggccacgccttctacccggcgccgctgcggttccacggggcgcccgacggcacggcggcagcgatggagtccttctccactgccttcgtcatcggcatcatcggcgcg

SEQ ID NO: 2166 - DNA, 425 bp, Zea mays
  Clone ID: LIB143-020-Q1-E1-B7
cacgcgtccggatcagatccctcgacaatggcactccaggcagcctacgagtacctgcagcaggccgtcggccatggcgcgttggccttcaagcagaacgcgaagctgccggctcatcgccgtacccaccgtactactgctgctagcgtccctcgccaagagcacgtcgtcgtccggtaggggcaagccgccgctccctccctcgccgccgggcaccctccccatcgtggggcacctacaccagatcgggccccagacccacatctcgctccaggagctggtggccaagtacgggcacaacgggttcctgttcctccgcgccggcgccttgccaaccctgatcgtgtcgtcgcccagcgccgccgaggccgtaatgcgcacccaagaccacatcttcgcttcgcggctgtggtccagggcctccc

SEQ ID NO: 2167 - DNA, 402 bp, Zea mays
  Clone ID: LIB143-020-Q1-E1-A12
ggcggcggcaccggcaggcggcggccctcgggcattgtcccagcgggagcaggacatccagatgatgctcgccgccgatgtccacctcggcaccaagaactgcgacttccaggtggagcgctacgtgtacaagcgccgcactgatggtatctacattattaaccttggaaagacctgggacaagcttcagttggccgccagggtcatcgttgccattgagaatccgcaggacattatcgtgcagtctgctaggccctatggccagagggctgtcctcaagtttgcgcagtacactggtgcccatgccattgctggcaggcacactcctggtacattcaccaaccagttgcaaacctccttcagtgagccacgccttcttatcctgactggaccgaggactga

SEQ ID NO: 2168 - DNA, 411 bp, Zea mays
  Clone ID: LIB143-038-Q1-E1-G3
agagcacggcagtcctccgtttcctcctcgtcgctcgccccggttgtctcctcctcgacctcccccgtcgcgacaccgcccgatctctctagcgcacggcggccggagaagaggaggagggggggacgatctcattcatcggaccggcgtgcctgtgtcgtctgctgttttcgtttttttctttactcttttttttccctcctttgcttgttcaattcaatcagtatattaagatttctgatttgggggcggctcgccatgggattcggaatggggaataataacaacggggcgagctcctcgtcgtcgcgcctggacccggcggcgccgctgctgccgcgccacggcagcagcgggggccgcgaaggtggtggcctgtcctcgcagccgaagacgttcgccaacgtcttc

SEQ ID NO: 2169 - DNA, 301 bp, Zea mays
  Clone ID: LIB143-038-Q1-E1-G4
gaccgacccgtcagaaaaaaaaaaaaaaaaaaaaaaaaaaaaaaaaaaagaaaaaaaaacaaaaaagaaaaaaaaaaaaataaacaaaaaaaaaaaaaaaaaaaaacaacaaaaaaaacaaaaaaaataaaagggagggcccccaaaaggatcaaactttacataggcataaatctaacgtcaaaccccttcaaaagtgtcaccaaaattcatttcatgggccgtctttttaaaacctctgaaggggaaaaaccttggctttcccaaatttaaccccctttaaaaaaatccccctttcccc

SEQ ID NO: 2170 - DNA, 408 bp, Zea mays
  Clone ID: LIB143-038-Q1-E1-G5
aggtccttcttcgtaagccttcaaaccgacgaatttgagcaactgcacccagagcgcgatccattgccggggaagaagcaacttgttgcgagcctcctctatggcgagctccgaccatggttccaccaccgcccccaaggacgtgccgggcagctacggcctgccgctggtgggcgccgtgcgcgaccgcctcgacttctactacttccaggggcaggacaagtacttcgagtcccgcgtggagcgctacggctccaccgtggtgcgcatgaacgtgccgccgggccccttcatggcgcgcgacccgcgggtggtggcggtcctggacgccaagagcttccccgtgctcttcgacatggacaaggtggagaagaaagacctgttcacgggcacctacatgccgtccac

SEQ ID NO: 2171 - DNA, 363 bp, Zea mays
  Clone ID: LIB143-038-Q1-E1-G6
acacgtcaggtctgtgtgtttgtgatagaatccaaagacgcaagcggctgcaggcagcagcgccgcgcaggcgttgtggcctgtgggagaggaaaaagagaaagaggaaccggccaagacaagcaagcgagaggccagggccgcggcgttgcgtcagatggggaagtacatgcgcaagtgcaggggcgccgcaggcgcggaggtcgccgccgtcgaggttacgcaggtcgtcggcgtccggacgaggtccaggtccgcggcggcgaccggcggtgtcgcgaaggtcgccccgaggaggaagagggcgccggcgggggagcctgctgccgccgtgagcgctggtggggacggcggaagctgcta

SEQ ID NO: 2172 - DNA, 429 bp, Zea mays
  Clone ID: LIB143-038-Q1-E1-G7
ctcgtggtccgatacaaccctctataattagtcgtactaagcttagcaatccgtctctctatctacaggcgggggaattaatagatggagggcaaggaggaggacgttcgcctgggcgccaaccgctactcggagcgccagccaatcggcacggcggcgcagggcacggaggagaaggactacaaggagcctccgccggcgccgctgttcgaggcggaggagctgacgtcgtggtccttctaccgggccgggatcgccgagttcgtggccaccttcctgttcctgtacatcagcatcctgactgtgatgggcgtgagcaagtcgtccagcaagtgcgccaccgtgggcatccagggcatcgcgtggtccttcggccgcatgatatccgcgctggtgtactgcacggcgggcatctccggcggccacatc

SEQ ID NO: 2173 - DNA, 259 bp, Zea mays
  Clone ID: LIB143-038-Q1-E1-H12
acaacactctatacgtgacgtcgtctattttctcctcgtcgctcgccccggttgtctcctcctcgacctcccccgtcgcgacaccgcccgatctctctagcgcacggcgggccggagaagaggaggaggggggggacgatctcattcatcggaccggcgtgcctgtgtcgtctgctgttttcgtttttttctttactctttttttttcctcctttgcttgttcaattcaatcagtatattaagatttctgatttggggg

SEQ ID NO: 2174 - DNA, 425 bp, Zea mays
  unsure at all n locations
  Clone ID: LIB143-038-Q1-E1-H3
gacccacgcgtccagacccacgcgtcctcgaagttttgtgggctgaccatcagtcttccaagaggaggttctgccgaaattcccttctctcatcatcacttctccaaggccaagcagtcctcctggtcctgccgaagtgttctctgaacaagagggcatgcatgcactccttcttgtccctgatgttagactagctagctagcactagcagagactgaggccgcagcgtctgttgagaattcagatgttgttgttgctcgtcctgtccgagcacctcctcctgtccggatttatgatcggttccgccataacccgcctcgtccagtccttctctgtcgttttcctctactggttctatgtcttctcagtgnagctgcactgggcagtagtgcagtagttgatctcacctttttcaagttaataac

SEQ ID NO: 2175 - DNA, 426 bp, Zea mays
  Clone ID: LIB143-038-Q1-E1-H4
gaccgacgcgtccaccccatcaccccagaccacagcgcgacagtgagtacagcagcagcagctgagagcgtgagagcgtgcgaagcaggagggaggacaagaagaagccgatggcggttgtgagcggcagcggcgggaggctgaacccctgggcggagcccttcgtgccttccggggcgcggtaccgcggcctgcggaccgtggaggcgacgccggagcaggaggtggaggacttctcccccgagtggtggcgcctggtgtccgcctccccggccttccgcgaccgctggctgcgcgagtacggcgcgctcggcctactcgacgccgaggacgacctggacgacgacgtcgacagcttcctccccgaagacttcctcttcgcctcgggccccgcgctacgagagcgagcgggaggacgccgcgggc

SEQ ID NO: 2176 - DNA, 413 bp, Zea mays
  Clone ID: LIB143-038-Q1-E1-H5
aagctagctacctcttgtcttgtcactgagtgagcagaaggagtgtgtggtggagtgcaaaccaaatcaaacgaagaaaagtgggagcgaggaggaagaaaagaagaagaagaagacgacgacgacacccaccaccagcagcaagcagcaatcagcaaccagcataacgaaatgtcgatcaagtactgcgaccagcacaaggactgcgagcggcagcgtctgtaccgtcgcttctgcgccgccctggtgggcgtcatcgtgctcgtcctcctcatcgtgctcatcgtctggctcgtcctccgccccaccaagcctcgcttcttcctcaacgacgtgagcatcgtgtgcatcaacgtcagctccgcctcctacctcaacgtcaccatgcaggccacgctggcgtcgcgcaacac

SEQ ID NO: 2177 - DNA, 412 bp, Zea mays
  Clone ID: LIB143-038-Q1-E1-H7
aactcacactccgtgcaaccgagcgatcgagctccccggtcgctagcacagccggccactgcacacgacggtgctggtaggttgcaagcacttgcaggatggcgcaggtcgctaagacgcttctccttgtggccctggtggtcgtgtcggcggtggagctgtgccgcgccatcgagttcgacgagcgggacctggcatcggacgaggcgctgtgggacctgtacgagcggtggcagacgcaccaccgggtgcaccgacaccacggcgagaagggccgccggttcgggaccttcaaggagaacgcgcgcttcatccacgcgcacaacaagcgcggcgaccgaccctaccgcctccgcctgaaccgctttcgcgacatgggccgtgaggaattccgttccgggttcgccgactc

SEQ ID NO: 2178 - DNA, 350 bp, Zea mays
  Clone ID: LIB143-038-Q1-E1-H9
cgcgtccggcgttcccctcctgcacgcaacctcatctcgtcctccagatccaggatgggcgtcctccttgagaccttgcctccccgagtgctctcggtgagctactttgtttcgatttatcaggaaatccgtttgcttcatgttgtgcaggctcatatctgattgctggattcggcaaacccgcgttggattctgtatcggttagtccttgcctgcaaggttcttgttgttttgttttggtggtcgagcatcgcatgttctgcttctggatccagatctggagaaatcgcgaagtcgtcgtcgttcggttcggagcggatctgaggcgacgatagatggaggcggcggga

SEQ ID NO: 2179 - DNA, 438 bp, Zea mays
  Clone ID: LIB143-039-Q1-E1-A12
actcgcaggtcgatgcaagcctctatagtcagtcctcatacacaggcagtgatcggcaaccaaatccggacagtcttgagctctctcagtctcagcatttcagttcccagattcacatagccccagccccacaagtagcgaaatggcagctgctccgttcgcgattgccggccggctctcccccgttgcgcgcctcccggtccgcgcctggaggccggcgcacgggtttgcgtcgtccgggagagcccgctcgctcgccgtggcgtccgcggcgcaggagaacagggacaacagtgtcgacgtacaggttagccagaacggcggcaacaggcagcagggcaacgccgtgcagcgccgcccgcgccgcgcgacagcgctcgacatctccccatccccgttcgggttagttgatccgatgtcgccgatgcggacgatgcg

SEQ ID NO: 2180 - DNA, 345 bp, Zea mays
  Clone ID: LIB143-039-Q1-E1-A2
ggggacacccccgtccagttccagccttccaacttccaaccctctcctctccgcaggctgtagcatttgtcgggttggattgggttgttccgcttgggtagcctggtgggatcgaaatctgtgtgggatccatggcggcggtcgaggggacgacgaagaagaaggtaatcatcgacaccgaccccggaattgatgacgcgatggccatcttcgtggcactgcggtcgccggagctggaggtgctgggcctcaccactaccttcggcaacgtccacaccgccctcgccacgcgcaatgcgctccacctgttggaggctgttggaaggactgacatccccgtggcag

SEQ ID NO: 2181 - DNA, 365 bp, Zea mays
  Clone ID: LIB143-038-Q1-E1-E9
acgccacccaacccgccgagtccccaagcaagttgagcatccatccatccatggcgggaggcaagtccaccggcaatgccgcgcgcagcaggaagcgcgtcgaggcaaccgtcctcaagcgctccagggacgggagcgccttcaccagatgcgaggcctgcaacaaggacgtccccgtcgtcctcatcgacatgcacagctgcagcctcgacgagaagatcaggatgacgctcgaggcgcaggtcgtcgagaagaccgtcgaggtcgccagtgcggaccgcaagaagtcctccgccaagggaggtggtaacaaggacgccaagcgcaagcgctcgcccaccgccttcttcctcttcatggacgac

SEQ ID NO: 2182 - DNA, 355 bp, Zea mays
  Clone ID: LIB143-038-Q1-E1-F1
actcgctccacattcccttcgcaccacctttcccctctctctctccctctctctccctctctcactcgctctttctccggggccgccattcctgctccgtccactcccaacacatgcggcggcgcgggcgcctccccgcggcgctgtggctcgttgtcgtgacgttggcggcgctggtggcgcgacctgcgtgtgcggcgtggtgcatcgcgcggagcgaggcctcggacaaggcgctgcagtcggcgctggactatgcgtgcggccccgcgaggggtgccgactgcgcgcccatccaggccagcggcctctgctacctgcccaacaccctcgccgcgcatgcctcttacgcctt

SEQ ID NO: 2183 - DNA, 382 bp, Zea mays
  Clone ID: LIB143-038-Q1-E1-F10
acacgtaggtcgatacaacaccctacagtgacgtcgtactacgcgtccgcccacaccgggcacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtcggtgggcgcgaacat

SEQ ID NO: 2184 - DNA, 371 bp, Zea mays
  Clone ID: LIB143-038-Q1-E1-F11
gcgggccgatacaagcctctagagatagtcatcttaatcacttcactcaaacctcatccccaaatcttcgactacattctcgttgacaagaagactataaccgaacctgaccatgtcgctgatccgccgcaacaacgtgttcgataccttctccctcgacctctgggaaccctttgagggcttcaccttcggctccggcaacaacagcagtctcgtcccctcgttcccgcagatgagctcggagaccgcggacttcgatggcgcgcggatcgactggaaagacactccagatgcgcacgtgttcaacgccgacgtagcggggctgaagaacgacgaagtcaacgtggatgtcgaggacggcaacgtccttc

SEQ ID NO: 2185 - DNA, 389 bp, Zea mays
  Clone ID: LIB143-038-Q1-E1-F12
gcgggtcgacacaagcctctaatctgagtcgcaataaattcactcaaacctcttccccaaatcttcgattagattctcgttgacaagaagactagaaccgaacctgaccatgtcgctgatccgccgcagcaacgtgttcgatcccttctccctcgacctctgggacccctttgagggcttccccttcggctccggcagcagcagcagtctcttcccctcgttcccgcggaccagctcggagaccgcggccttcgctggcgcgcggatcgactggaaggagactccagaggcgcacgtgttcaaggcagacgtaccggggctgaagaaggaggaggtcaaggtggaggtcgaggacggcaacgtccttcagatcagcggcgagcgcaaca

SEQ ID NO: 2186 - DNA, 418 bp, Zea mays
  Clone ID: LIB143-038-Q1-E1-F2
atccatcacagtatcacaccatccccactctcttctctccacccggcgagcggacactcccctgtcctcttgacccgatcccggtccccgcccgcccgccccgccgccgcgcgcgctggtccggacgctcgggcgctggtgatccggttgatgcagcagcggggcctcgcccacaactgccgctcccgcggcttctcccgctcccgccgcgcagtcgagggcgcctgaaacgcacccgccccacgcacgcagggcaaccgaaaacccctcgatccggctctcctcgcgctgtagcttttataacgccgtagacgacaacgaaagagaacggaaagaaataaaacccaacacaccttacgttctcggtaaaggaaagaaggactcgagatggacaccgtcagcgtccccgtggtggccg

SEQ ID NO: 2187 - DNA, 410 bp, Zea mays
  Clone ID: LIB143-038-Q1-E1-F3
gtattattgatcatcaagctcttccccgcctcgtgaatctgttgacgcagaaccacaagaaaagcattaagaaagaggcatgctggactatttcaaatattactgctggaaacaaagatcagatacaggctgtcataagtgccggtatcatcgctcctttgttgcaactgcttcaaacagcagagtttgatatcaagaaggaggctgcttgggccatctcaaatgctacctctggtggttctcatgagcaaatcaagtacttggtgtctgagggctgcatcaagccattgtgtgaccttcttgtctgccctgatccgagaattgtaacagtttgtctggagggtcttgagaatattcttaaagtaaggcagcatgacaggaccatgggtgcaacaggtgacactaacgtc

SEQ ID NO: 2188 - DNA, 379 bp, Zea mays
  Clone ID: LIB143-038-Q1-E1-F5
ctcgcgggccgacccacgcctcaagcatcctccacatgtatgctgcgtctcagaggtggcatgcagatcttcgtgaagacacttactggcaagacgatcacccttgaggtggagtcctcagacaccattgacaacgtcaaggccaagatccaggacaaggagggcattccaccggaccagcagcggctgatcttcgccggcaagcagctggaggatggtcgcaccttggctgactacaacatccagaaggagagcaccctccacctggtgctccgcctcaggggtggtatgcagatttttgtgaagacattgactggcaagaccatcaccttggaggtggagtcgtctgacacaatcgataatgtcaaagccaagatcc

SEQ ID NO: 2189 - DNA, 411 bp, Zea mays
  Clone ID: LIB143-038-Q1-E1-F6
agccaagtgcgtgcgccggccgccccctatcccgccggccctgtgtgtgttccccgctaccagccatggcgtcgccgttctccgtgccttcgctgatcatggaggaggaagggcggttcgaggcggaggtggcggaggtggagtcgtggtggggcacggagcggttccggctcaccaagcgcccctacaccgcccgcgacgtggtcctcctccggggcacgctccggcagagctacgcgtcgggggagatggccaagaagctgtggcgcacgctcaaggcgcaccaggccggcggcaccgcctcccgcaccttcggcgcgctcgaccccgtccaggtcaccatgatggccaagcacctggacaccatctacgtctcccgggtggcagtgctcgttcacgcacacctccacc

SEQ ID NO: 2190 - DNA, 374 bp, Zea mays
  unsure at all n locations
  Clone ID: LIB143-038-Q1-E1-F7
aacgtatatgcccttgtcccggttcctttccccatccccaactccattatttgcttgatccttgagaagagagaggaagacgagagctagaagcgaaggagaaaagcagttcttcagctaggcaggagggcacaggaaggaggagatggcgtcaaagaggattcagaaggagctcaaggatctgcagaaggaccctcccacctcgtgcagtgcaggtcctgttggtgaagacatgttccactggcaggcaacaataatgggtccatctgatagcccatattctggtggagttttcctagttacaatccattttcctcctgattatcctttcanaccatcaaaggtggcatttcgcactaaggtgttccatccaa

SEQ ID NO: 2191 - DNA, 402 bp, Zea mays
  Clone ID: LIB143-038-Q1-E1-F8
agcggacgcgtgggcgggcgcgcacaagttcgccaacccccacgccccaccccccaccccccgcgtgctgcgcgtcgttggaaccaaggattggattagcctcgccgaggaggaggtggtggtcggcgaggggctcgcggggatggggatctcgaggccccttgtgatggcgatggcggtggcgctgctgatcgccgtcgccggtgcgaccgccgaggagcaggagcccctgctggcggcggacgcggtggccggcgcggtggaggcggcgctcggggaggtggagaccgcggcgctcagggccgagctggggcaactccgggcgaagatctcggcgctagagtcagacatagaagagcgatctcaagaactggaagataagggatatgccatcatgaacct

SEQ ID NO: 2192 - DNA, 383 bp, Zea mays
  Clone ID: LIB143-038-Q1-E1-F9
acacgtaggtcgatacaacactctacagggagtcgctaataacagcaagcgaaaatctcccgatcccctctagtctccgcggcgaagatgtcggggcgcggcaagggcgggaagggcctgggcaagggcggagcgaagcgccaccggaaggtgctccgcgacaacatccaggggatcacgaagccggcgatccggcggctggcgcgcaggggcggcgtgaagcgcatctccgggctcatctacgaggagacccgcggcgtcctcaagatcttcctggagaacgtgatccgcgacgccgtcacctacaccgagcacgcgcgccgcaagaccgtcacagccatggacgtcgtctacgcactcaagcgccagggccgcaccctcta

SEQ ID NO: 2193 - DNA, 416 bp, Zea mays
  unsure at all n locations
  Clone ID: LIB143-038-Q1-E1-G1
agtagcgtcaactacgacaactgggccagtggcaagaccttcacggatggagatcagctagtgttcaacttcgccaccgggaaccacgacgtggtggaggtggacaagagcggatacgacggctgctccaccaccaacgccgccaacacaatccaaaacggcccggccaccgtcaacctcacctccggcacccactactacatctgcggcttcaccggccactgcagcgccgggatgaagctcgctgtcaccgtcggctccggctccggctccgggtcncccacccccggcggcggctcgcccagcacacccacaccaaccaccccgagcgcccccacccccgacactccggccagcgcgtccgtgcgcctcacggccggcccagcgctcgccgtggccgccaccgtgctcgtcgc

SEQ ID NO: 2194 - DNA, 387 bp, Zea mays
  Clone ID: LIB143-038-Q1-E1-G11
gcgggtcgatacaagcctctaaagcgcttcctctgaagatcctcatcaacggcgacggcgtcatcgagtccgggttcacccctggccgctactgcatggagatgagctcgttcgcgtaccgggagctctggcggcttgaccaggagggcctccctgccgatctcatcagaagaggaatggccgtggaggacccgacgcagccgcacggtctccggctgctcatcgaggactacccctacgccaccgacgggttgctgctctggtcgtccatcacgcgatggtgcgacgcctacgtggccatgtactacccgtccgacgagtccgtgcagggcgacaccgagctgcagtcgtggtacagggaggccgtgcagacggggcacgcggaca

SEQ ID NO: 2195 - DNA, 413 bp, Zea mays
  Clone ID: LIB143-038-Q1-E1-E8
ccaacgcaaccacgttacgcaccatagaacatacccgtgagaagctaagacccggccgttgctcaccacagcatcatcgccgcgccgtgctagctcaaggatggagaacaacaggcagcagcagcaggcgccgccgccgccaggctacccgacggcggctgcaggcttggagcaggagcagggaggcaggaagggacgacgccgggagaagacgacctcgcgcggggataaaggcttcatcgaaggatgcatcgcggcgctctgctgctgctggatctgcgagatgtgctgcgactaggcacgcagctagcggtcagctagctctccgtctccggcggctatacatacgaaatacgatgagagagctaccctgcacagcttctgcttctgcttctgcaagagagatctgctta

SEQ ID NO: 2196 - DNA, 370 bp, Zea mays
  Clone ID: LIB143-038-Q1-E1-D10
actagcgccggcgcctccacttcgttttcctcactctctcctccagctcagggtccggcggcgaagggaaggcaagatgtacaccgcgaggaagaagatccagaaggagaagggtcttgagccctccgagttcgaggactccgttgcccaggctttctttgatctggagaacgggaaccaggagctcaagagcgacctcaaggacctgtacatcaacaatgctatccagatggatgttaccgggagtaggaaggctgttgtcattcacgtcccataccgcctgcgcaaggccttcaggaagatccatgtcagactcgtcagggagctggagaagaaattcagcggcaaggatgtggtaattgttgctaca

SEQ ID NO: 2197 - DNA, 389 bp, Zea mays
  Clone ID: LIB143-038-Q1-E1-D11
gcgggccgacccacgcctctacggtcgctcggggaatactggcatcattggcaagatgtatttgcagggggtcttataggtcttacagttgcttcgttttgctacctacagtttttcccatatcctttcgatggcgatgctttgtggcctcacgcatacgcggtccggttagccgaggaggggaacagcagaaatgcgaactcgtacagcgtgagaccaaccgagatcgaaacagtcgatattcctgggcacggtgcgatcatcaccctaagagagactctaaacgatgtggagtctggcagtgccaggagattgtgagatgggtctgcaggtgtggagattgatgtctcagataccatgggagttgcttgcatatgtgtacaggtaga

SEQ ID NO: 2198 - DNA, 361 bp, Zea mays
  Clone ID: LIB143-038-Q1-E1-D2
aggcaaacagtgataacctcccaccaaatgtcatcaagcaattgggtaaagaactgaagaatcataatgaatcacctgcagaaggaattaatgtgactgtcaatgatgatgacttcactactatttttgctgatagtgaaggccctgctggaactccatatgacaatggagtgttcaggatgaagctattattgtctcatgatttccctcaatctcccgcaaaacgattcttcttgacagaaattttccatccaaacatagctactaatggtgagatatgtgtagacacactgaacaatgattgggatcctatccttgggttaagacatgttcttctggtagtgagatgccttctggtcga

SEQ ID NO: 2199 - DNA, 418 bp, Zea mays
  Clone ID: LIB143-038-Q1-E1-D4
cctcccaacagtgaatcgtattaacgcgtgggctctcacacactgcaacagccaagtgcaagtgatcgagctcccccctcctcatcagtcgctaggcacagcgcacttgcaggatggcgcaggtctctaagacgcttctccttgtggccctggtgttcgtgtcgtcggcggcggtggagctgtgccgcgcgatcgacttcgacgagcgggacctggcgtcggacgaggcgctgtgggacctgtacgagcggtggcagacgcaccaccgggtgcaccggcaccacggcgagaagggccggcggttcgggacgttcaaggagaacgtgcgcttcatccacgcgcacaacaagcgcggcgaccggcccttaacggctcggcctgaaccggtttcgcgacatggggcgggaggagttccggt

SEQ ID NO: 2200 - DNA, 365 bp, Zea mays
  Clone ID: LIB143-038-Q1-E1-D6
agctcacacgcccaccggggcgtgcactctcacacaccgaaccatcaatctgtacagtggttcagcatctccatgctcaacattcgcgaggcacaccgtacttgcacgatgacgcatgtcaccaagacgcttcgccatgggggacggatgctagtgtcctcgggtgctgtgggcctgtgaagcgcgagtggagttcgacgacgcgggacctgcgtctcggacgagggagtcgtgcggacgtgtacgaccagtggcaggcgcacgactgaggtggatgggcatgacggatacaaggacctgcggttcgggacgtacaaggaaaacgtgcacttcatcgacgctgataatactcgcggcgacgagcc

SEQ ID NO: 2201 - DNA, 364 bp, Zea mays
  unsure at all n locations
  Clone ID: LIB143-038-Q1-E1-D7
agcaggagacggacccagatccgattagtggcgacggtgaggggaacgggcagggaaacgtcggcgcggcgacggaggcgaagcggaaggccaatggctgcaggctcgatgggctcgtcagcaagaagaggaactacgcgcagctccatctggagctagggcagcctgatttcgtcctccacacgtgctccgtgtgcggcatgatgtacgcccgagggaacgacgaagacgaaaaggttcacanggcgtaccacaagagctactccgagggagtccctttcaagggttggaaaaaagagacagtgatagcgaggtccgagggcggtgatcgggttgttcttgcaactgacgagaactcctgtat

SEQ ID NO: 2202 - DNA, 408 bp, Zea mays
  Clone ID: LIB143-038-Q1-E1-D8
agtctggtcacagatctatctgacaaaatggtgaagatctgctgcatcggtgctggctatgtcggtggcccaaccatggccgtcattgccctcaagtgcccagacattgaggtcgtcgtcgttgacatctccaagccccgcattgaggcctggaacagtgacaccctgccaatctacgagcctggtctcgatgatgttgtgaagcagtgcaggggcaggaacctcttcttcagcactgatgttgagaagcacgtcgctgaggctgacattatctttgtctcggtgaacacccccaccaagacccgtgggcttggagctggcaaggctgccgacctcacctactgggagagcgctgcccgcaatgatgcggatgtctccaagtctgacaagattgttgttgagaagtcc

SEQ ID NO: 2203 - DNA, 347 bp, Zea mays
  Clone ID: LIB143-038-Q1-E1-E1
aggagcagtctacaatggctcacagtcacagaagcagtatgagcttctgcttggtgtgcatcgtcgtcatggcggcggcggcggcgttgttgcaacccgcatcttctcagcaagcggtgccggacatcccgaacctgaaggtgggctccaacgatcgcagcacgactctcaagtgcaccaacatcaagagcaacaagaccacctgcagcgccacctgcaacgcacgctgccctcacaagtgcctcatccagtgcccaagctgcaagacattctgcttgtgcgacttctatcccggcgtgtcctgcggcgacccacgcttcacgggcgccgacggcaacaacttctac

SEQ ID NO: 2204 - DNA, 371 bp, Zea mays
  Clone ID: LIB143-038-Q1-E1-E10
tacagtggatgataataattaatcagcaggctttggggccaaaagaaacggagaggagaaaagcgggggcggcaagcaaccacgggcggagctcggagcgtcctcctcctcccgtctataaattcccctccttttcttcctccatatataggggccatcagatccaagaagagggaagagcaccaaggaccttcggcgcccgttcaggatccacatcttcccgagcgagttcttggttgacctcttcctcttcggaccacctccaaggctcttggtgtagcttgccactctcaccaatcaagttttcatgtctgatctcgacattcagatcccaactgccttcgatcccttcgctgaagccaatgctgggg

SEQ ID NO: 2205 - DNA, 384 bp, Zea mays
  Clone ID: LIB143-038-Q1-E1-E11
aagggagtacataccgaaaaaatttaacatttttctgtttcatgtttcttggataaattagttattagctggctgaaattggatagcagttatgttcagctttcattagtttttttttctctcgtacagcattatcgtttctcatggcagaaaattaccactctgccagtaacgaggcagatggttctgtaggctccgaatgaatctggtttatataataacatttgaaatggcaacgtggaatatggattaacagtgtggtttgacctggtttccaccctttttttgtaactgaaaccttcgaactttctcaattggtgctatattctgtttactcctcccgtttgttttccattttcctgtgttttcaatcaaaaaaaacac

SEQ ID NO: 2206 - DNA, 359 bp, Zea mays
  Clone ID: LIB143-038-Q1-E1-E12
tagtcacgcgctctgttcgttccctcctctgtgtaccggccagtaaaatccgaacccacagcgagaaatggcggcggcagcgctccgtccggcgatcctccgccgcatccgcctctccccctccccttcgctcgccctcgccgccgctgggacaggtgcatcccacccgcacgcgctggggcggtggctcgcgcggcccatgtcctcccacgacgcgcacctcacccgcgacgaagtcatcgaccggatcctcgacgtcatcaagagccaccccaagatcgacccctccaaggtgaccccggaggcgcacttcgagaaggatctcgggctcgacagcctggacaccgtcgaggtggtca

SEQ ID NO: 2207 - DNA, 349 bp, Zea mays
  unsure at all n locations
  Clone ID: LIB143-038-Q1-E1-E3
aacccacgcgtccgggataggttcatgcattctctgtttgtgatgaccctgaatacttctatgactatgtccaaggcctgattgatggacttaattctggtttggattcacatgatatagttagcatcgaaaatgctaaggggttaggctatgccatgaacacagctgaggagcttaagtttgtcaaagacatagctgcatcaacaggcattgtccttgatccagtctacagtgggaaggcggttatggattgctaaaagacatggctggcaatccagccaaatggaaaggtcgaaaagttctgtttatccacacangtggtcttcttgggttgtatgataaggctgac

SEQ ID NO: 2208 - DNA, 416 bp, Zea mays
  Clone ID: LIB143-038-Q1-E1-E4
ccaaattagcgagcaggcagttacagacgcggccacgacggcacatcgccgccgtagtccttgaccttgctccacaaccccggcccgactcggcgtcctccgccaccctcctcctgggcagcgccggcggggggatatggcatcggagtacgtggtgggcaagagcaggggcgacacggccgtcaccaccatcgtcaacctggcggaggaggccaagctcgcgcacgagggggtcaaggcgcccggccaccagatcctcaccatctgcaagtcgctcgtcgccggcggcgtagcaggcggagtacaatggccacttctccccaagcgaaaaaaatctgctagaagacctttagagggctttaacattgggatggatatttgggcccttaccttgctttaagtggagattcagtttt

SEQ ID NO: 2209 - DNA, 373 bp, Zea mays
  Clone ID: LIB143-038-Q1-E1-E5
aggcagtcggctgccgcagactggtagtagccggcgcgccgtcaccgtatcctcagatcagaggcgagcagaaaccacaccactctactgacgcccgacgagcagtgtaacattttccttcagccatgggtaaggagaagactcacatcaacattgtggtcattggccatgtcgactctggcaagtcgaccaccactggccacctgatctacaagcttggaggtattgacaagcgagtgattgagaggttcgagaaagaggctgccgagatgaacaagcggtcattcaagtatgcgtgggtgcttgacaagctcaaggctgagcgtgagagaggtattacaattgatattgccctgtggaagttcgagaccac

SEQ ID NO: 2210 - DNA, 366 bp, Zea mays
  Clone ID: LIB143-038-Q1-E1-E7
ctcgcgggccgacacacgcgtcaacccacacgtccgggcagcagcacaagcaagaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgaggcggccaccgagggcggcggctgcgactgcaacacctgcaagtgcggcaccagctgcggctgctcctgctgcagctgcaactgagctggcccggcccggcgatggcgcacgagag

SEQ ID NO: 2211 - DNA, 402 bp, Zea mays
  Clone ID: LIB143-038-Q1-E1-D1
gctccgccggcggcctcgcgctctctcccccgccgctccttctctacgcttggcctgccaagatgaagctcgtcagattccttatgaagctaaacaatgagacggtcaccatcgagctcaagaacggaacgggtgtccacggcaccatcaccggtgttgacataagcatgaacactcatctgaagacagtgaagcttacactgaaagggaagaaccctgtaacgctcgaccacctcagcgtgcgaggaaacaacatccgctattacattcttcctgacagcttaaacttggagactttgttggtagaggaaacccctaaggtcaagcctaagaagccaactacaggaaagcctttggggcctgggcgccggccgtggtcgtggacgtggtcggggccggggg

SEQ ID NO: 2212 - DNA, 351 bp, Zea mays
  Clone ID: LIB143-019-Q1-E1-G6
cccgctcgggttgccatggcggaccagctcaccgacgaacagatcgccgagttcaaggaggccttcagcctcttcgacaaggacggcgacggctgcatcaccaccaaggaacttggcactgtgatgcgctcattggggcagaaccctactgaggctgagcttcaggacatgatcaatgaggttgatgctgatggcaatggaaccatcgactttcctgagtttctcaacctgatggcgcgcaagatgaaggacaccgactccgaggaggagctcaaggaggccttccgtgtgttcgacaaggaccagaacggcttcatctccgctgctgagcttcgccatgtcatgaccaac

SEQ ID NO: 2213 - DNA, 379 bp, Zea mays
  Clone ID: LIB143-019-Q1-E1-G7
actttcctacaactactgctccctccaccccagcattggaggcaattgtgtgtacaggtgtcttcaaagcattctgaatgatttgcacaccaatcttctgatcgaagttcgctgtctgcaatttatcaagctccttcgatgcatagagaagagcaacaccaccacctggtacaataccctcttcaacggcagctttagtagcattcagtgcatctgtcactctatccttcttctcaccaacttctgcttcgctggctcctccaatcttcagaacagcaacacctccagagagctttgccaaccgctcctggagcttttccttatcataatctgaagtgctattctcaattgctgatctaatctgctctgccctctcttc

SEQ ID NO: 2214 - DNA, 370 bp, Zea mays
  unsure at all n locations
  Clone ID: LIB143-019-Q1-E1-G8
agcgtgctttgtgctgcgcgcgcgtgcagcactgcggagacggccgggagcagggggcgcgggagggatagtggcggcctctgctgctgctggtcgaggcttcgattccgggcgggggctggtggtctcgagaatcccggagggaagggagcgagcgcaaagatagatacctaagcgggccgcttccgctgcacagccacaggcatggggtgcggggcgtcgagccacaaggacgccggggcgcgccggagacggccggggagcgtcggcgacgtggtcgttttcctcccgggcctccgggtgccganggccgtcgacttcgcccaggcgctcggcggctgcctggccagggctatagtcgagcggctgt

SEQ ID NO: 2215 - DNA, 409 bp, Zea mays
  Clone ID: LIB143-019-Q1-E1-G9
cccacgcgtccgccacgcgtccgcccacgcgtccgccacgcgtccggaagcagcaaatattttctgacttagagaagtactgtccttcacattgcatccttgctactaacacatctacaattgatcttaatctgattggggagaaaacaaaggctcaagatcgtattgctggtgcacacttctttagtcctgcgcatgtgatgccacttctggaaatagttcgtactcagcacacttcaccacaagttgttgttgacttgctggatgttgggaagaagattaagaagacaccaatagtcgtcgggaactgtactggctttgcagttaataggatgttctttccatacactcaatcagcactcttttatgttgatcttggtatggatgtttataagattgatcgtgcttg

SEQ ID NO: 2216 - DNA, 358 bp, Zea mays
  Clone ID: LIB143-019-Q1-E1-H1
caaagcgcctaacaaaagcatacttcccgaagcactcttgcaatccactgagttctgttgagacgcatagagctagctgctagcgtcgacaatgtcgctcgtgaggcgcagcaacgtgttcgaccccttctcgatggacctctgggaccccttcgacaccatgttccgctccatcgtcccgtcggcgacctccaccaactctgagactgccgccttcgccagcgcccgcatcgactggaaggagacgcccgaggcgcatgtgttcaaggccgacctccccggcgtcaagaaggaggaggtcaaggtcgaggtcgaagacggcaacgtgctggtcatcagcggccagcgcagcaaggag

SEQ ID NO: 2217 - DNA, 429 bp, Zea mays
  Clone ID: LIB143-019-Q1-E1-H10
accacgcgtccgtgaccgtgctgcagattgtctgtttgcacggtcaaaggaaagaaaatctagatatataacagaactggagcggaaggttcaaactcttcagacagaggctactactctttcagcgcagctcacactattccagagagacacaactggactttcggcagaaaatgctgagctgaagataaggttgcaggccatggagcagcaggctcaactgcgggatgctctaaacgatgcgctgaagcaagaagtggagaggctcaagatagcgacgggcgagatgccgaagtccaacgaacaattcaacatggggatgcagcacgtctcgtacagcggcccttctttcttccatctcccggagcagcacgtagacattcagctgccgcaccattttcagcagcctccgcggaacgtccagatgct

SEQ ID NO: 2218 - DNA, 407 bp, Zea mays
  Clone ID: LIB143-019-Q1-E1-H11
cggacgcgtgggagcagggactacactctttcagaccctaacgtgcagctgcaagctgctgcacaaacgccagttctaaggtctccgggagtggcatggcagaacactgcatcagtaccagctgctcctttttatgcaagcacagcgacttcaactcctattggagttggacaggtggctgcttggaatcctaacatgcaggcagggagttttgcatctgcatcgactgcataccccaaccaaccattaatggccaactccatgcctcactatcctgctattggatcgagttccggtgccccaccagtatcatttcaagcttcgcagcagatgacacagtatagcatgccccctggtgctccgccgcacgcaccaccagctggccaatcaatttacttcccgaagta

SEQ ID NO: 2219 - DNA, 428 bp, Zea mays
  Clone ID: LIB143-019-Q1-E1-H12
actaggcttgatcgatctctcgacagcacatagctagcaataatggagaagtacaccaaagccctagcgtcattgctcaccatgctggtgctggcacctctcctcgccatggccaccgacccagaccccctgcaggacttctgcgtcgccgacctcaacggcaagccatcagtgaacgggtacccatgccagccgccgtcgtcggccggcgaccagttcctcttctcgaccaagatcgccacgggaggcgaccccctggccaacccgaacggctccaacgtgacggatctggacgtttccgagtggcccggcgtgaacacgctgggcgtgtccatgaaccgcgtcgacttcgcgcccggcgggcacaacccgccccacgtccacccgcgcgccatcgaggtcgggctcgtcacccgctgcgagctcct

SEQ ID NO: 2220 - DNA, 374 bp, Zea mays
  Clone ID: LIB143-019-Q1-E1-H4
taccgggctagaattccgggccgaggagaataaggaaaaaacaatggcggtgctactccgccgcgccgcggcgctcctcgtcgtggctgctgtctgcgcggacggcgcctccacgttctactcctccgaccccaacctcggatccgcccgcgtcgtcttccagacgaattttggtgatattgagtttggcttctttcctcatgttgcacctaagactgtcgaacacattttcaaacttgtgcggcttggatgctacattacaaatcacttcttccgggttgacaagggtttcgttgcacaagttgctgatgttatgtcaggtcgaaccgcccctatgaatgaggagcacgaaaaagaagcggagaaaacaattg

SEQ ID NO: 2221 - DNA, 350 bp, Zea mays
  Clone ID: LIB143-019-Q1-E1-H5
aggtgggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaatgagctcgacggccgtaacatcaccgttaaccaggcccagtcccgtggcggtggccgtg

SEQ ID NO: 2222 - DNA, 277 bp, Zea mays
  Clone ID: LIB143-019-Q1-E1-H6
aagactatgacaacctcgataaaaaagaagatacagatgaattcctgacgcctctacagtcaaacgaggttcctggggtgccagctgaaggtgaagtggggcacctgttgcagaacactgagcctgttactgatggtgaccatgttgtcggtgaagaagcgaatcagtttgacaatctcattgcatccgatggtaatcaagatccaccaccacctttgcccatactcgatgctgcaggcccctcggaggaaattcctgatgtagaagaaacatcaga

SEQ ID NO: 2223 - DNA, 410 bp, Zea mays
  Clone ID: LIB143-019-Q1-E1-H8
actttctttctcctcttcgggcgcttcgctgcttgcctgctctgctcgcgacctgcttctcagacccgccctcctcgccggccgcccggcgatgcctcctggccagaggcggcggtggcggcggcggcgacggagatagttagctcttcagattgagtgactggtggtcgccggcggcggggacgcggagtatggcggcggcgccggggacgagctcgggcggcgccggaggcgaggtggccgggggcaccaaggtcaacgaggagctgtggtacgcgtgcgcgggaacgctcgtggcgctgccgccggcggggagcctcgttgtctacttcccgcagggacacagcgagcacgtagcagcatctatgcgaaaagatgcagatgccaaaattccgagctatccaaatctc

SEQ ID NO: 2224 - DNA, 421 bp, Zea mays
  Clone ID: LIB143-019-Q1-E1-H9
agtctctgaccgcgtggtggactccccctgctgcctggtgacgggcgagtacggctggacggccaacatggagaggatcatgaaggcacaggcgctcagggactcgagcatgtctgggtacatgtcctccaagaagaccatggagatcaacccggagaacgccatcatggaggagctgcgcaagcgcgcggaggccgacaagaacgacaagtctgtcaaggaccttgtcatgcttctgttcgagacggcgctgctcacctcgggcttcagccttgacgaccccaacaccttcggcagccgcatccaccgcatgctcaagctgggcctcagcatcgacgaggacgatgctccggaggccgacaccgacatgcctcctctggaggatgacgctggcgagagcaagatggacgatgtggactag

SEQ ID NO: 2225 - DNA, 363 bp, Zea mays
  Clone ID: LIB143-020-Q1-E1-A1
gagcgagcagtcgagtgttccctagagtccccgttcctccgccgccgcctgcaaccgcttcacgtgccctgatccatcgcaggtcccctttctgaccccaaatggagccgaagaagtcctctgctcagcaccagccccacgccatgggacccaagaagtcctctccacgcggcgccggggccgtcgccgccacggccactgaagccgagtctccgttgagcagcttgttctacccgccggcgcccgcggcaaatgggaaagatcaggagttgtacagcattatttacaaagggcaaagcgggagcgcacaagctggcgcgacaggtaatggtaaaccgcattgggctccttcaaaaagtcata

SEQ ID NO: 2226 - DNA, 420 bp, Zea mays
  Clone ID: LIB143-020-Q1-E1-A10
aatggacttggccaatgctgctgcagtctctgctcccaagtacgatgatctaactaatgctgggcacgccaaaagaattgtgcactctcaggccaccgcaaagaggaagcatgctggtctgcatcaggaccaaccttgtgggatccccaggaagaaggataagtctcgtccgctctcggagctctgtaatggagacatgtggggtggttccagaccaaatggccagaaagccgatgaacatttgttgggtgtggctacatgttcaagcagctcctctggcacttcaaccttggacactccattggacatgaacaactgtcatcgcagcatggcattcaaaacagatcaagcaaacggcacagaaatatcctgcatgacaaggctactgagtgatgattcccggcatggaaatgattttgt

SEQ ID NO: 2227 - DNA, 381 bp, Zea mays
  Clone ID: LIB143-019-Q1-E1-G5
ttcctcccaacaccacctcgccgcgatctccgtagcctccgtcgcgtcgagcatcgatcatgtcggcctactgcggaaagtacaaggatgagctcatcaagaatgctgcctacattggcacccctggcaagggtatccttgctgctgatgagtccactggcaccattggcaagcgcctttccagcatcaatgtcgataacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaagagggaggcgtcctccctggcatcaaggttgacaagggca

SEQ ID NO: 2228 - DNA, 422 bp, Zea mays
  Clone ID: LIB143-019-Q1-E1-F11
acgcacgcaggtcgtaggctatcctcaatccccgatcccgtgcggcggcggttccatagcaacacagtacggcaagacggcaagtccaagtttgcagcgattgcagctccactgctccccaccttctcgccgtgcacgcctgcgcagcgcgcggcgaacggttcgtcggtgccgtggtcgtggtcgtgcgcgagcgcctgtccacggcgggcccacggcgaggtgcgaagccgctacagggcccacggcgagcactgaccgccgagcgggcgaggccgtgacaagcacccactaggtgtccagcacaacagcacgccaggaacagtggtccagctcccactatggttctaaccagcaatatttcggttcagaagaccttgtacgaggttttatctgtgagtgaagacgctacatacgatgag

SEQ ID NO: 2229 - DNA, 418 bp, Zea mays
  unsure at all n locations
  Clone ID: LIB143-019-Q1-E1-F12
aaaaaggccaccagcagcggcgagaagaacgtgctcatcttcgacctcggtggtggcaccttcgatgtgtcgctcttgaccatcgaggagggcatcttcgaggtgaaggccaccgccggtgatacccatctgggtggggaggacttcgacaaccgcatggtcaaccacttcgtccaggagttcaagcgcaagcacaagaaggacatcagcggcaacccgcgcgcgctgcggcgtctgcggacggcctgcgagcgggccaagcgcacgctgtcgtccaccgcgcagaccaccatcgagatcgactcgctgtacgagggcatcgacttctacaccaccatcacccgcgcccggttcgangagctgaacatggacctcttccgcaagtgcatggagcccgtggagaaatgcttcgcgatgc

SEQ ID NO: 2230 - DNA, 312 bp, Zea mays
  Clone ID: LIB143-019-Q1-E1-F2
accacccgtcaggcatgaaggacggcaacggcaaggcgcccgggatgatcggctggctgccggacaaggccgtcacgttcgtcgacaaccacgacaccggctccactcagaactcgtggccattcccctccgacaaggtcatgcagggctacgcctatatcctcacgcacccaggaacatcatgcatcttctacgaccacgttttcgactggaacctgaagcacgagatcagcgcgctgtctgcagtgaggtcaaggaacgggatccatccggggagcgagctgaacatcctcaccgccgacggggatctct

SEQ ID NO: 2231 - DNA, 386 bp, Zea mays
  Clone ID: LIB143-019-Q1-E1-F3
aatcagacttcatgcatgcaagactgcaacagcaaggcgcccgggaagatcggctggctgccggagaaagccgtcacgttcgtcgacaatcacgacaccggctccactcagaactcgtggccattcccctccgacaaggtcatgcaaggctacacggatatccgcacgcacggatgaacaccatgcatcttctacgaccacgttttcgactggaacctgaagcacgagatcagcgcgctgtccgcagtgatgtcaaggaacgggatgcatcccgggagcgagctgaaaatcctcaccgccgacggggatctccacttcgccaagattgactacaatgtcatcgtgaagatcgggtcacggtaccaagtctggaacctgattccctc

SEQ ID NO: 2232 - DNA, 301 bp, Zea mays
  unsure at all n locations
  Clone ID: LIB143-019-Q1-E1-F4
aattcctcctgatcaatccgctctcaagcacttgttcggaagaaaaagaaggtagaacacgctaacgagacaacaaggatcatggggcgcgggcgcggccacctcctgctgccggcagcagccgcctgcctgtgggcgctgtcgtgcgcgctgctgctgcgcgcgtcacctcaccgcgctggcgccggcgccggcgggctgctgagggtcgggctcagcaggcgcggcggcgggctcgaccagcgcgcgctggcggcggccaatgccgcgaggcagcangaggcaagccgtctcggggcct

SEQ ID NO: 2233 - DNA, 353 bp, Zea mays
  Clone ID: LIB143-019-Q1-E1-F5
aaactacgccagcaacactggcaaaactaacctagtcatcgtcgacctctgttgaggcaccgtcgctgtgtcgctctagaccatctacgacggcaacttctaagtcacggacaccgccggtgatatccaacagggtggggaggacttcaacatcacaaggtcaatgatctcgactagaagttcaagtgcagtcacaatagtgacatcatcggtaacacgcacgcgctactgcgtctgcggactgactgcgagcagaccaagcccacgctgtcatccacagcgcagaccaatatcgatatctaatcgctgtacgagggcatctccttcgacaccagcatcaaccgagcccagtt

SEQ ID NO: 2234 - DNA, 396 bp, Zea mays
  Clone ID: LIB143-019-Q1-E1-F6
acaagtcagagaaggtttcagatgatttcatcaacccaactgctccagctaacatatccacatcatcccattcaaaggcagaagcacatccacctccgagttatggtggcaggccagacagagtatctgacgacttcataaacccaactgcacctagcttctcggcgccttctcgtcctacaaatgaggagccagcccgcccatccgtgaagcggcaagagagcctacctgacgacgacttcataaacccaactgctcttcctggtttctcgtcgtcttcagctactaaggagtctggcgaggaccttccaaaggctccatgggaagcacaagctgccgcgggttccctaccgccgcctccggcgatgtacggccagagacagcagtacttcgagc

SEQ ID NO: 2235 - DNA, 401 bp, Zea mays
  Clone ID: LIB143-019-Q1-E1-F7
aggccgcccttttttgtttttttttttttttttttttttttgttttattttttatttttatatattttattcatttgtattttttacttactcccaaagatactcttaagcaatgccaatgtaactcatgaccacatctactcaatccgcatttgagcttacacgataactatcgcatgaactaaatgctctgattgtcttaaccgatgggaaaaaaaaacatacaatcttagactataaattcacgtaacaatatgatcgactgcgtcactcctccgtatgatatggtaatgactaaagcggaggctttgattcggtgcataaataatcacaacctgaattaaaatttgtacatattggggattggatgccagcaacaatgtagcactttgcactaaaaa

SEQ ID NO: 2236 - DNA, 390 bp, Zea mays
  Clone ID: LIB143-019-Q1-E1-F8
cccacgcgtccggcctccttcgtccctcgatcacaactgctcctctctccactcccctcttcctcgacagatcctcaatcaagcttcatctgtgccgtcgtcggcaatggctccggccttcccacgccgccgtccaacctcccccgactctcctcctcacaccgccgccgctcccatggcccaccctccctgctcgcctccatggccacctggaggcggattcggcctccccgagtcaccgcccaacgtctcgccgcccaaccaaagcgagaaatccactgggcgaagcttctgcacctcccgaacgggggaggggaggggagcacgccagcactatgtgcctgcgggtagggtttctcccggtccgatggcgtccgccatgtcgtccag

SEQ ID NO: 2237 - DNA, 304 bp, Zea mays
  Clone ID: LIB143-019-Q1-E1-F9
aacacgcatagggccacctacatcctccgctaacgcctgcacctacatcgatgtccctcgtcatcgagtgttgcatactgatgtctgatcgatgccgtcgtacagtgagggagctcgtcttcccaaggcggcgtcgaatgtcgtgggagtctcatcgaaagagtagtggagtgccgaaggcgcagcatcccagcacacctcttacgctacactcacgtgcattgcgcctcaccaagtctcctcatcaagtctcacaacccaagctactccagatgactactgcgtgacacagatggaattcgcg

SEQ ID NO: 2238 - DNA, 255 bp, Zea mays
  Clone ID: LIB143-019-Q1-E1-G1
cgtcgcggtgccgtgcgccggtgctggccagtctagggttttcggccctcgcgcgccgatccgtcccgcccggcgggccatgtcgaaacaaggagggaaggacaagccgctgaaagcgcccaatgtcgaaaggaatgagtacgacgacagtgatcttgcctaattgcagaagaaaacagatgaggaaaaggcgctgaatgagctgaatgccacagcacataaaggcgcaattggaggctctggtctcaagagaag

SEQ ID NO: 2239 - DNA, 409 bp, Zea mays
  unsure at all n locations
  Clone ID: LIB143-019-Q1-E1-G10
ctcacttgcatttttggcacaccagaacagaagaagaaaaaaaaaacaggcactgagctgagatggcgaagcacttggctgccatgtgcaggtgcagcctcctagtgcttgtactgctctgcttgggctcccagctggcccaatcccaggtcctcttccaggtacctgcgcagcgtcctcgtctcttcccggccgatcgctcaaaaaatactcatcaatcaggcgtgctagaaagcacaagtctggatttaattttgatgctgatacatatatgctgcgtgtctgcgtgcagggtttcaactgggagtcgtggaagaagcaaggtgggtggtacaactacctcctgnggcgggtggacgacatcgccgcgacgggggccacgcacgtctggctcccgccgccgtcgcac

SEQ ID NO: 2240 - DNA, 343 bp, Zea mays
  Clone ID: LIB143-019-Q1-E1-G11
aacacttgcattttaggcatacgagaacacgatgaacgaagcatcaggaggcactgagctgatacggcgatacacttggctgctatgtccaagtgcagcctcgtagtgcttgtaccgctctgcgtgggctcccagctgggcgaatcccaggtcgtcttccatgtacctgcgcatcgtcatcttctcatcccggccgatctctcaacacatactcatcaatcacgcgtgctacaaagcacaagtctggatttagttttgatgctgatacatatatgctgcgtgtctgcgtgcacggtttcaactgggaatcgtagaagaagcagcgtgggtggtacaactacct

SEQ ID NO: 2241 - DNA, 431 bp, Zea mays
  Clone ID: LIB143-019-Q1-E1-G12
tggagtagggagcacgccgcacgagccctttccgccgccgccaaaatggtgaacgttcctaagaccaagaagacctactgcaagaacaaggagtgcaagaagcacactctccacaaggttactcagtacaagaagggtaaggatagcctgtctgcccagggaaagcgccgttatgaccgcaagcagtcaggatatggtggccagaccaagcctgtcttccacaagaaggccaagaccaccaagaaaatcgtattgaagctgcagtgccagagctgcaagcactactcacagcacgcaattaagaggtgcaagcattttgagattggtggagacaagaagggcaagggaacatctctcttctaagtttctcatcgcccatctcgatgttggatcgaacctgtgggtctactactgttctaaaaactcgtcaa

SEQ ID NO: 2242 - DNA, 392 bp, Zea mays
  Clone ID: LIB143-019-Q1-E1-G2
cccacgcgtccgctatgatgaacatcttcggtggaagaaaaatgctatgcttcaagtcctgaatggttcaagggggtcttacatggactgataccacgagtgtgaccccaagtccgcgaagcttggaatcttgatgtgctcgttgcgcatgtgtatatttgcacctttggttattaatgactagaggtacgtaattgaaactagtctgcttaagcgttctgcactgctggtgtggttagctctatgagttaggcagttcgacagaggccaaaccgacagtgagattttgttctttcatggcaatgtcacagctttttcgtgaatctgagctcatcatactgtctgttagtttatcccccacgattccatgttagaatcgattcatagcaaca

SEQ ID NO: 2243 - DNA, 375 bp, Zea mays
  Clone ID: LIB143-019-Q1-E1-G3
aggacgcgtgggcgagcacgtgaaccgcctcgtcgccgcgcggctccagttcgacgtcatgggcgtggagaccgtcctcgtcgcgcgcaccgacgccgtcgccgccacgctcatccagaccaacgtcgacgcgcgcgaccaccagttcatagtcggcgccaccaacccgggcctcaggggccagagcctcgcggccgtgctctcggccggcatgtcggcgggcaagagcggaagggagctccaggccatcgaggacgagtggctggccgcggcgcagctcaagaccttctccgagtgcgtcagggacgccatcgcgggcctcggcgtcgcggcccaggagaagcagcgcaggctccaggagtgggaccgcgccac

SEQ ID NO: 2244 - DNA, 307 bp, Zea mays
  Clone ID: LIB143-019-Q1-E1-G4
acttcaccttgcacaagtctgagcgggaggccagcaggatccgctaaatccctgttggccttggatgtaactctgtaaactttgttctatgtttgtcgaacttgccgtgtcacttgcaacatctgctttgagatttactgatcctggattgcagttttactttaagtacctgctggaaagtagacttgccgagacatagttatcattggttatctataatagctcaatcgacgcgtgcaatctgaaggctttgttatatgtggtaaagtcgtcgatgtagttttgtcatacttgatgtcggttggct

SEQ ID NO: 2245 - DNA, 426 bp, Zea mays
  unsure at all n locations
  Clone ID: LIB143-019-Q1-E1-F10
caacacacacagagagaggacaactcctcacaactctcccttccctcctgtaggggccaaaagggttagagagtaagagaagtagttcattcccttgcccaacacaagaaaacaagctctcctcatcaccctaatccaagcaactgcttgtgtgttgggaaattcttgtgacccctgttatattattatccgtgtagctactagcttcattcccccctttgtacccatcaaatggctggcatgtctctgcaacacccctgggcgtttgctttcggtctactaggtaacgtcatctcattcatgaccttcctggccccgataccgacgttctaccgcatctacaagagcaagtcgacggaaggcttccagtcggttccctacgtggttgcgctgttcagcgccatgctgtggatcntctacgcactg

SEQ ID NO: 2246 - DNA, 181 bp, Zea mays
  Clone ID: LIB143-019-Q1-E1-D4
acgcgtctaaactgagtcgtagtacgcatcgatgatatggtgggcattccccttcaccagcagctggacatcgttggttggaagcagcttgaggacgtgctcacgcctgccgacttgaggctcccggaggatcagtcaccgcgtcttggtgctacgcttcaggcgatgcactggtcatcct

SEQ ID NO: 2247 - DNA, 352 bp, Zea mays
  Clone ID: LIB143-019-Q1-E1-D5
cgccgcccagcccccgcccacacaggttggaggtgcgagcgatagccccggcacccccactgccatcatgcccgccgcgatgctcgcgttcgtgaggcgtctcgcgcacatcgtcgcaaccaacccccttcctccatcgcggcagaacgacatcctccaactccggcagtgtccatgtccccatcctcttcaacgcgcggcacaacgagctcctcctccctcaacggcggtctccatcagacgaccatcccaacggtcgtcgacctcaaccgtctgttgacccacaacgtccagcagaccagctcacctcctccaactcccgcgcccgcgcctgatatggaatgtccgccgg

SEQ ID NO: 2248 - DNA, 393 bp, Zea mays
  Clone ID: LIB143-019-Q1-E1-D6
ggacatataacatttgatgtcccaacatctttatacaggagcaatacaaaccatgagcatgatcagccgcctcatctccgcttgagggatcctacagtacccgaacgagtaaatgttgcactgtatgcagcgccagaatcacgctattgcccagcccgggtttacgaatatatctctgatgagaaaggtgacccaaagcttcatataaatgcacagaattgtcttcattgcaaggcttgccacatcaaagattcaaagcagaacatccaatggacagttccaaaaaggtgaagttgtcctggttacacaattatgttaaatgcccaatgatgaaaatatgttgccttcaaaaataataaccggtcaatcaacaatggtgtcaaaactggaaca

SEQ ID NO: 2249 - DNA, 353 bp, Zea mays
  Clone ID: LIB143-019-Q1-E1-D7
gcggcagccgagcgatcgagctccccggtcgctaccacagccggccactgcgcacgacggtgctggtaggttgcaagcacttgcatgatggcgcaagtcgctaatacgcttctccttgtggccctggtggtcgtgtcagcggtggatctgtgccgcgccatcgagttcgactaccgggacctggcatcggacgacgcgctgtgggacctgtacgaacggtggcagacgcaccaccgggtggatcgaaatcacgggaagaacggtccccggttcgggaccttcaaggaaaatgcgcgctttaaccacgctcaaaacaatcccggagatcgaccctaccggctccgcctgaaccg

SEQ ID NO: 2250 - DNA, 402 bp, Zea mays
  Clone ID: LIB143-019-Q1-E1-D8
atcctaaaatgtgcatttgaggctgctggtcacagcccagaatatgaaggttcatttgctgatgcaggaaatccagttatagcactagcagcgtatttagctggtcttgtggaagatggtaacgctaccacttcattccgtagttcactaaaatctatatctgaggtgcctcctgcactccaattagcaagtaggcactgttttattcttgaggatccaccaaatgaactcaaagacatttgtgttagtgtaagtaagaaaaatacagatgctgatcaaacaaaagatgaggatatgatttcaaattcaatcgccaatgagaaaaaagagatcaatgagaaagaagataagtctttatctgtggaaaagacaaataattcatccatgtcacaaaatgaccat

SEQ ID NO: 2251 - DNA, 382 bp, Zea mays
  Clone ID: LIB143-019-Q1-E1-D9
atcctaaaatgtgcatttgaggctgctggtcacagcccagaatatgaaggttcatttgctgatgcaggaaatccagttatagcactagcagcgtatttagctggtcttgtggaagatggtaacgctaccacttcattccgtagttcactaaaatctatatctgaggtgcctcctgcactccaattagcaagtacgcactgttttagtcttgaggatccaccaaatgaactcaaagacatttgtgttagtgtaagtaagaaaaatacagatgctgatcaaacaaaagatgaggatatgatttcaaattcaatcgccaatgagaaaaaagagatcaatgagaaagaatataagtctttatctgtggaaaagacatataattcat

SEQ ID NO: 2252 - DNA, 276 bp, Zea mays
  Clone ID: LIB143-019-Q1-E1-E1
aagacgcttggatctctctcgctctcggcgacgactgggcgaccgccgccgccgctgcgccgcccttgtccatgtgcccaggtcttcgcacgcgccttcgccaggtcttcgacggtaacgagcaccaaccggattcagggaatataagtaaaatgaggccagttttttgtgggaaccttgactatgatgttcgcatctcagaggttgagcgcctttttgggaactatggaacggtggaacgagtggatctaaagacagggtttgcaattgtctaca

SEQ ID NO: 2253 - DNA, 414 bp, Zea mays
  Clone ID: LIB143-019-Q1-E1-E10
ggcagaaattctgaagaacaatggatttgctgttgaaaagaaaattaggacctctactgttgaaataaacgacgaatcaagaggtcgtccattccaaaaggccaagattgagataatcttgggaaagagcgacaaatttgatgagctgatggccgctgctgcagaagagaggggcgaagtggaagatggtgaagagcagacttgaaaacagtaccgatgacaagctgctgctgttgtgctctgttagtgttgtttaatttagtttaataccgtgtgcatgagatatggcacgcgttcttgctcaactacatcaccatggcaatgtctgcaaatccatggattgatggatggatgttggttgtttcttgacattctggacatgttgttcactttggctatgtatgttttaacagt

SEQ ID NO: 2254 - DNA, 419 bp, Zea mays
  Clone ID: LIB143-019-Q1-E1-E11
gaccgtgcgtgaggcgtgagtccgtgaccattcccgtcggccgtcccaaaagaagcgcaaatttacaacccagtccaccacgggccacacaatcccaaatctaaccctccgacggcgatggggatctcgagcatgccggagccgcgggacagcctgctggggtacctggtgtacaacacggtgatctcgatcgcggcgctggcggggctggtgcgggcggcgctggtgttcctggacctgcaggccgcgctgccgcccggggacgacggcggggaccgactggcggcgtcgggcccgggactggcggagcggttcctcagggccttccggccggcgctgtacgaggtgctggcgtcgacggcgacgacgtgcgaggcggacggcggcgccgacggcgacgactgcagcgtgtgcctggc

SEQ ID NO: 2255 - DNA, 424 bp, Zea mays
  unsure at all n locations
  Clone ID: LIB143-019-Q1-E1-E12
gacaaaaaatacaggcaaggaaaatggctccgaccgccgccaaggacagtggctccgccgatcgctggcgcgaggtgcaggcgttcgaggacagcaagctgggtgtgaagggcctggtcgactccggcgtcaagtccatcccggccatgttccaccacccgccggagtccctcaaggatgtcatttctccaccagctctgccctcctccgactatgcgccggccatcccagtggtggacctgtccgtggcgcggcgcgaggatctggtggcccagatgaagcacgcggccgggacggtgggcttcttctgggtggtgaaccacggtgtgccggaggagctgatggccagcatgctcagcggggtgcgccagttcaacganggctctctggaggccaagcaggcgctctactcacgggaccccgc

SEQ ID NO: 2256 - DNA, 140 bp, Zea mays
  Clone ID: LIB143-019-Q1-E1-E2
gatgtcactgtgccgctcgtgtttaacaactgtcactgaacgtggcgataaagcccatgagtcgttacaccagactgtaaatccacctatgcgaggcacatacgctcactttctgcgagactgtgcgtacatagcgagtt

SEQ ID NO: 2257 - DNA, 278 bp, Zea mays
  Clone ID: LIB143-019-Q1-E1-E3
gtacctggtacgtcgcagctcatccatcttctcagccaccattcattgcactggtcgtcgtgacacagagtcgtgatggggaaagccctggtgttacacagcttcatcccattgcgtgacacagtcctttcgcggcctggacgtcctgtcagcacagggacagcgatgtcacgaccgcacacattcgcgatccggttgtcccactgggactctccttgtcacggcggactagactagcaagatgatggttctaaacccagagtgccagagctgcatgc

SEQ ID NO: 2258 - DNA, 349 bp, Zea mays
  Clone ID: LIB143-019-Q1-E1-E4
acagcaagctaggatcatcagcatctgagcttatatattactacatcgatcggttgccaaatggcggggatgacagtcggcaataagctggcgctggctgcggtgctgctgtgcgcggcggcggccatggccacggcgcagcaggcctccggcgtgcgcgccacctacaacttctacaacccgcagcagaacaactgggacctcaacgccgtgagcgcgtactgcgcgacgtgggacgccagcaagccgctgtcgtggcgcatgaagtacggctggacggccttctgcgggcccgccggccccaccggccaggccgcgtgcgggcagtgtcctctggtgactaacactg

SEQ ID NO: 2259 - DNA, 374 bp, Zea mays
  Clone ID: LIB143-019-Q1-E1-E5
acggacgcgtgggcggacgcgtgggcggaactgactagaactagtacgtagatccaacactcgggacgaaattaaaagagacgacgcacatcaaccagcaggcatcgcgcggtcaccaccatggcggcgcaggagggcggcatgaggctggtgtcgcacccgatcgcggcgcacgacgggcggctgccgcggcagtacacggcggaggggcatggcgccaagaaggacatgtcgccgccgctggagtggtacggcgtgcccgagggcgcgcggtcgctggcgctgctggtgcaggacatcgacgccgaccccagcgtgccgtggacgcactgggtggtggccaacatcccgcccggccacaggggcctccccga

SEQ ID NO: 2260 - DNA, 405 bp, Zea mays
  Clone ID: LIB143-019-Q1-E1-E7
agcctgcagtcacgagctcccgttctccatttccagccatggcggtgtcgatcgagctcaccaaggagtacggctacgtcgtgctggtgctggtggcctatgtcttcctcaacctttggatgggcttccaggtcggcaaggcccgcagaaactagaaagtgttctaccccaccatgtacgccatcgagtcggagaacaaggacgccaagctcttcaactgcgtgcagagggggcaccagaactctctagagtgggtgcccgttttcttcgtcatactgctgctgggcggtctgcagcacccgaccatcgccggccggtctggggcggatctacatcctcgcgaggttcttctaggtcaagggatacgccaccggcgttccgggcaatcgtcccaagaatgggggg

SEQ ID NO: 2261 - DNA, 368 bp, Zea mays
  Clone ID: LIB143-019-Q1-E1-E8
acgacggcgggccgcgggggccggcgatgaagcctgcgggaggaacggaacgtgaccctcgaggcgggcaaatctggatgcttccttccagccgacgcatcccatcccatacagccccgggacgtacggtgatcggtgaccccactccatcccacggccacgccacacctcctctccacctcctcgtcctcgattcccaagcagtcagtcttcctcgtcactcgcctcctcccgttaggtacgctggcgagccgtcggccgccgtcccttcctccctggatttgattggtgctcgcggctgcagcccagcgagttccttgattcggctgggagcaccgccatcgccatgggatggcaccgctggctgt

SEQ ID NO: 2262 - DNA, 418 bp, Zea mays
  Clone ID: LIB143-019-Q1-E1-E9
cacagcgatccgagaccatgtccatgcttctacagttcctctttctcagcctcatcgtactcgcaacgtccactacgggtggtgatggccatcagttcgcctactcaggcttctccactaacgatctcgtcgtcgatggatctacaaccatcacatcaaacgggctcctcgagctcaccaactcgaacggactaccagacacgccacgccttctagccaagctcggtgtcgttcaccaggtcacccaacggaacggtgcactctttctacagctccttcgtgttcgcaatcctgtccgtgtacaccgacctaatcgcccacggcatggccttcgtcgtggcgccgagcaggaacttcccgggcgtcttgcctgagcagttcctcgagctcaccgacatccggaacgactgcaacgcga

SEQ ID NO: 2263 - DNA, 372 bp, Zea mays
  Clone ID: LIB143-019-Q1-E1-D3
agacaacgtcaaggccagaatccatgacaaggagggcattcccccacaccagcagcggctcatctttgctgggaagcagcttgaggacgggcgcacgcttgccgactacaacatccagaacgagagcacccgccacttggtgctgcgcctcaggggatgcatgcacatcttcgtgaagaccctgaccggcaagactatcacccttgaggtggagtcgtcagacaccatctacaacgtcaaggccaagatccacgacaaggatggcatcacaccggaccaccagcgtttgatcttcgctggcaagcacctggacgatggctgcacccttgccgactatgacatccacaatgagagcaccctccacctggtgct

SEQ ID NO: 2264 - DNA, 324 bp, Zea mays
  Clone ID: LIB143-038-Q1-E1-B3
cacagaggtaatggaggccgcgcctaccaccatcaccgtccaggtcaagttcgccgggcggacgatccccgtggaggtcccggcagcggcttccggcgcggagctgaagcgcctcctccagccgctgaccaatgtcctcccgcgcggccagaggctcatctgcaaaggcaaagtgctccaggatgccgcaagcctgagctcgatgcaagtagtggacggatcgaaggtgatgctcatcgcgtcgcaggggctccatcagggggatgggcctatcacagatagtagcagtagctcagcaacaactgtgagaaggccttcagatgt

SEQ ID NO: 2265 - DNA, 414 bp, Zea mays
  Clone ID: LIB143-038-Q1-E1-B4
accaaatgaatgggaaggattactcgtcgaattctgttcatgtatttcacattggaaagctgagaataaaacttcgaaaaggatggtccacaaaagcaagagagtcgtattccactacgatgaagttatgcgggagccgtggtggtggtaatgctgcagctagggcagttttctggcaccctaggaaaggctcgtcctacactctagccttcgaaacagacagggacaggaatgctgcgattatgattgctcgcaagttcgcttcgaattgcaatatcgctctcgctggcccaggcgaccaaggcacctgatgaagtgatcacgctatgttttgacggcgacaacagtacataattaaggggttgaattggctgattgggtggcgtgcttgtcttagttttgtcgatttgtgct

SEQ ID NO: 2266 - DNA, 326 bp, Zea mays
  unsure at all n locations
  Clone ID: LIB143-038-Q1-E1-B5
agaccgtttgaggagaagccaatcgccagaagcggcaagccttgcctcgcgcagcggtctggttcggttgggtgccctcttcgccggtggccggaaggcgagggggaagccggaggacgctgaggcgnggcgaggncgccgtccccagatctcacttccgccgcccgcccgccccgcttttgggattgagagaggaacgaaggaaatgacgtgcttcaagatgaaggggctcattcttgtcgggggtttcggcagccgccttcggcctttgactcttagcttcccggaagccccgtgtggggtgttgcaagcaagcccatgagtct

SEQ ID NO: 2267 - DNA, 402 bp, Zea mays
  Clone ID: LIB143-038-Q1-E1-B6
agctgatgctgaccgacaagtcgcagctgcaggcgctggcgatgctgctgcggaacaacgaggagctcatgatgagccaggcgatcaagtcggagacggagcgcattgagtacctcaagacggtgagcgactgctacacgcggacgatgaagctcctcgacgattccatggcggccaggaccacgtacgagcgttcgggcggaatgaggagcctcgtcgcccgggacatggacgactacgtcgtctacggcctcaacgcgtgcttgcagaacgtccgcaactgctgcgtgcgcctggacgccatcgacaagctgcgggcgcactacgacgccctcgccgacgccgtcgccgaccccggccgcaaccgtccagggcctcgccgcggaggcgtccgagtacaag

SEQ ID NO: 2268 - DNA, 373 bp, Zea mays
  Clone ID: LIB143-038-Q1-E1-B7
ctcgcgggccgacacacgcctcaacaggagatcgtcccagatccgattagtggcgacggtgaggggaacgggcagggaaacgtcggcgcggcgacggaggcgaagcggaaggccaatggctgcaggctcgatgggctcgtcagcaagaagaggaactacgcgcagctccatctggagctagggcagcctgatttcgtcctccacacgtgctccgtgtgcggcatgatgtacgcccgagggaacgacgaagacgaaaaggttcacagggcgtaccacaagagctactccgagggagtccctttcaagggttggaaaaaagagacagtgatagcgaggtccgagggcggtgatcgggttgttcttgcaactgacg

SEQ ID NO: 2269 - DNA, 408 bp, Zea mays
  Clone ID: LIB143-038-Q1-E1-B8
agcccacgcgtccgcttggccttcgtccccgccttccgacttcctccaaaattccattccctttcccaagaaaccaagaacccaaccccccaacaagacgaactcctcctccccttccaaaaaggggctgaacaagattgcctggaatccggtggaaaaagaactccccgaatggcaacaaaacccccccggcgggttcaagcacaagggccccgataacctccaaaagggggtaaatgaagtgaccggaacgcgggggaccctttatacccgggagagcgtaaaattgcaagtggagatctctgagcactatcccatagaggcgcatcacgtgacatttctcacaccagagccaatgcatccacacatttacagcaacgggcacatctgcttagatattctgtatga

SEQ ID NO: 2270 - DNA, 400 bp, Zea mays
  Clone ID: LIB143-038-Q1-E1-B9
ggtcgatgcacgcgtctagatgtcgtcgactaatggaaatcgactcctgcactcgagttgccccctgtcatctcctgtagcaaaccgcccgctgtcgccccaccttcctctgaagaagccacagttcagcgcgactttctcaatctcgcatcgtatattcggtgtcgcgttgggagttgccatcgtatctgtccctctcgccaccaagttcagcctaatgtttggtgtctgagagcgatttgctgcgtctcaagagaaccatcattttccgtttctgtgtctgtttttcatcgtctcggttaccttgcgacacaactgtaggtgccgttggaataatatctttgccatgcttgcagacttgtgtaataagtaaataaacctataaaataccagtttaact

SEQ ID NO: 2271 - DNA, 323 bp, Zea mays
  Clone ID: LIB143-038-Q1-E1-C1
gtcagcaagtcaatattttattttattttgctagtcattgaattttggcgagatcggacgacttttgtgatgcatggctggctccagtcatgtttgacacgtaactaaaagacccaccgcacgggttagggagtactagtacctactactcctaaacaacaacttgtagttgtccacaacaggttaacagatcaaagaaggatacgtgagcggcactactcaactcgtggcttccggtgacagatgatcagcccacgaatgagaaagaaaaatggactcgcttgatttgcgtggctttgctttccgcgcaaggccgaaagctt

SEQ ID NO: 2272 - DNA, 376 bp, Zea mays
  Clone ID: LIB143-038-Q1-E1-C10
gcgggtcgatacaagcctctacagtgcgtcttattattttttttttaaataaagtcggcctgctttattaacaatatatataaacccataaacatctcgtagacacttgaatgtgacacctaaccccacatgcccatcccatctgtacgtaccggcattatcggtccatgataaccaccgtccaccgccaaataattcatacagacattaacaaatggaaggagatatattccagagatcacaaagtctgctgctcttaatataactaatcaattaatcatgtcccccttgatcgcgagtgcctgatcttccgatcaatcgtccatctccgccgtcttggtcttgggaggaggcccgaacctcttctggagccggc

SEQ ID NO: 2273 - DNA, 386 bp, Zea mays
  Clone ID: LIB143-038-Q1-E1-C11
gcgggtcgacccaagcctctagcatcaatcagtgaatccggcgggcattctctgctggtacaccaataatcgaggagcagctagcgtgcgagagacaacagagccagaggccgcccggccggccagtacagagaaccaagctagtgccaaaccgacagaacacgcctgtgatcggtaggtctacaccaccgacacttggccatgagcacggccacggacgccgtcccggtcgccgtggcgccggcgaagcgcccgcccatcaacaagtacgccttcgcctgcgccctgctcgcctccatgaactccgtcctcctcggctatgacatctcggtgatgagcggcgcgcagctgttcatgaaggaggacctcaagatcacggacacgca

SEQ ID NO: 2274 - DNA, 360 bp, Zea mays
  Clone ID: LIB143-038-Q1-E1-C12
acatgaaatgggagaaagagagagagaagagagagagaagagagagagagagagaggagtgggagacccgcgagaggctgccgtgtagggaccgtagactcagcgactgcgaaggagggataaggggatggccgggatcggaccgatcaggcaggactgggagccggtcgttgtgcggaagaaggcacccaccgccgccgccaagaaggatgagaaggccgtcaacgccgcgcgccgcgccggtgcggagatcgataccatgaagaagtacaacgctggtacgaacaatgcggcatccagcggtacatccctcaacaccaagcgcctcgacgacgacaccgaaaacctcgcccatgagcg

SEQ ID NO: 2275 - DNA, 90 bp, Zea mays
  Clone ID: LIB143-038-Q1-E1-C2
tcgcaatagccgccgccgccgcgctcctccgcctcctgtgcgccgcgtctctcgcgtccgcagccgccgacgaccggttgacgaccttcg

SEQ ID NO: 2276 - DNA, 411 bp, Zea mays
  Clone ID: LIB143-038-Q1-E1-C4
agtgttgctcgctccaatataactatcttcctcttcgtcgctcgcacgtccgatccgtcctcacgtaacacgccgatagatggagtcgtccatgtccatgtccgccgccgcctcggtcgtcgtgaggacatgcgttccggccgctgtcatgttgcccctctcaccgtcctttactaggcccgccctccgcaccaccgggcgaggcttccgctgcaggtgcagcagcgccaccaaggactcggcggtcgtgtacagcaggctgctggacgacgcgctgttccggtcggcggaggtgatccagtgggagagcggcaagtccatgaacgccatcgccacggcgcagggcatccaaatccggcggcgctgccggcccaggtacccgtccgagggcaccggcgccgagcgcgccgt

SEQ ID NO: 2277 - DNA, 343 bp, Zea mays
  Clone ID: LIB143-038-Q1-E1-C6
agctgtctcacgtccacataccacaaccagctcactcaagtacatagaacccaacccatggcttctcccaagccgctcctcctgctcgccacctcgttcctgagctgcggcctcctgttggtcgccgactacgccccattgaccctgaccgtggtgaacaactgcccctacccggtgtggccgggcatccaggccaactccgggcacgacgtcctggagggcggcggcttcgtcttcgcgccgctctcgcataattccttctctgcgtcggcgcagccttggtccggccgcatctgggcgcgcatgggctgcgcgggcgccggcgctcagctccattgcgcca

SEQ ID NO: 2278 - DNA, 375 bp, Zea mays
  Clone ID: LIB143-038-Q1-E1-C7
agcgtcctcgtcctcgtccgccgccaaatcgaaccaccccaaaccctagctacccggcgcaacgtccccttcccgcctctccgcggcgctgcgtgacacccggcctccgctacgaaacaccggggcgggtgtagcctagcgggcgggccatggcgtcaacggtgctggaggcgacgcgggcggcccatgaggatctggagaggctggagcggctcgcggtgcgcgagctgcaacgggagcccgctaacccgcgtgaccgcctctttcagtcccaccgcgtccgccacatgctcgacctcgtcgtctccacctccggcaagctcgtggaaatttacgaggacaaggacaatgctaggaaggatgagattaacactc

SEQ ID NO: 2279 - DNA, 381 bp, Zea mays
  Clone ID: LIB143-038-Q1-E1-C8
agccaaaaacggttttacactgacttccctccacatgagaaagagaaggtctataaatttgctactccatctacaatgaagccaactaaatggagctatcctggcggggggcttaatcaaattccgggagaatgcacaatttcaggggatgtaaggttgactcctttctatagcacttcgcatgtcatggagaagttgaaggaatatgtagaggacatcaatgagagatttgaaacagtacttgatactcgtggtcctgtgtccaaatatattcttcctgatgaaaatctacaaggaaggcttgaaatcacttttgatggagatgtgatgaatggggtggcttgcaatctggagtctcgaggctatcatgcattaatgcaa

SEQ ID NO: 2280 - DNA, 375 bp, Zea mays
  Clone ID: LIB143-038-Q1-E1-C9
acggacgcgtgggtccacattgtaccagacaaggcttcgaacacgctctccatcatcgacagcggcatcggcatgaccaagtccgaccttgtcaacaacctcggtaccatcgccaggtccgggaccaaggagttcatggaagcccttgctgctggcgctgatgtgtctatgattgggcagttcggtgtcggtttctactctgcctacctcgtcgccgagagggtcgtcgtgaccaccaagcataacgatgacgagcagtacgtgtgggaatcccaggcgggcgggtcgttcactgttactcgtgacacgtctggggagcagcttggcaggggtactaagattacacttttcctcaaggaagatcagttagaatac

SEQ ID NO: 2281 - DNA, 414 bp, Zea mays
  unsure at all n locations
  Clone ID: LIB143-038-Q1-E1-B2
gcaacaatgcagcagcacaagcaagaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgaggcggccaccgagggcggcggctgcgactgcaacacctgcaagtgcggcaccagctgcggctgctcctgctgcagctgcaactgagctggcccggcccggcgatggcgcacgagagtcgagaggangangacgacgaccaagcgtataaatataatagcggcgtccagtaaataagatcctgtcaactgcacc

SEQ ID NO: 2282 - DNA, 404 bp, Zea mays
  Clone ID: LIB143-037-Q1-E1-H8
agcagaccaacctagccacccagggagaaaggccaaaagggaggggagagtgtcgtcatggcttccattgtcgcttccaggagggccgttcctctagttcgcgctctggagaagctcatcgcagcgtcctccgcgcccgggactggctccgccctcaggccggtggcagtcgccggcggcctccgtggctacaacaccggcgctccgctccgacgctacgaaggggccgagtcggaagacgatagcgtccgcgagtacgatgggcggcacggcggccgggactacgccgtgcccagcctgttctcagatattttccgtgatccgcttagtgcgccgcacagcattggccgcctgctgaacctgatggacgacttggcggtggcggcgccaagtcgtgcggtgcg

SEQ ID NO: 2283 - DNA, 392 bp, Zea mays
  Clone ID: LIB143-037-Q1-E1-H9
gacccaagcgtcaaggacgatgtgactaagatgaaggagggccagaatgacatctactacatcactggcgagagcaagaaggccgtggagaactcccccttccttgagaagctgaagaagaagggctatgaagtcctgtacatggtggacgccatcgacgagtatgctattggccagctcaaggagttcgagggcaagaagctcgtctcggccaccaaggagggcctgaagctcgatgagagtgaggatgagaagaagcggaaggaggagcttaaggagaagttcgagggcctgtgcaaggtgatcaaggacgtgctgggcgacaaggtggagaatgttgtgggctctgaccgcgtggtggactcgccctgccgcctggtgacgggcgagta

SEQ ID NO: 2284 - DNA, 204 bp, Zea mays
  unsure at all n locations
  Clone ID: LIB143-038-Q1-E1-A1
gggccgacccacgcgtctaacacggctacaccgccacagccgccgccgccggacggcgctgtccttccctgngaggcgctccactaggctcggctcagctcacgcgcggcggcggtgtccgtggctgctgggcttgcgcgcgcacctgattccgtgctgggcttcgcgaggtgctcctcgtgcgagacacacgcccgatgcggc

SEQ ID NO: 2285 - DNA, 379 bp, Zea mays
  Clone ID: LIB143-038-Q1-E1-A10
aaaaattctttgaacttctaaaaaatgacaatgtcatgggtgctatgaagactttacgatgtgagatcacaccccttggtgttaatagaaaaagagtgcatgaactgtcgacttgtatgatttcttgttcttcacagcagttgttccttggtttttcaaagcttggaattgattcttctagttcacggttgaagcttctagaggaattgcagaaggtgcttcctccagctgttatggtgccagagaggaggttagaaaatttagttgagcaagcacttactgtgcaaagagatgcttgctatttccataattctgttgatgggttgtcactttacattgatcatcactgtgggaaagatcagataccatcttgcacgct

SEQ ID NO: 2286 - DNA, 371 bp, Zea mays
  Clone ID: LIB143-038-Q1-E1-A11
taaaagaactaaggatcttgatactgttgctttgcttgatcatctaccatcattgcagcaactccttttccgtcttcttgcttgccagccacaaggagcgtcgtcttacaatgttataatccagcatgcactctcaatggttgctttagagagtattaagatctacactgcgattagtgatggaacaatcaatctagttgacaagttcttcgagatgcaaagaaatgatgctgttagggcacttgatgtatacaaaagagcaactaaccaggctgaacgactttcagagttttatgaagtgtgcaaaactatacacattgggcgtggtgagaaattcctgaaaatcgagcagcctccagcatcattcctga

SEQ ID NO: 2287 - DNA, 413 bp, Zea mays
  Clone ID: LIB143-038-Q1-E1-A2
cagacactctacatatatcctctgcgcgtgtatctcgtcgtacagagccgaaagctggagcttccaatggcgggagacaacgacctgaaggtgctcggcgtgtggacgagcccgttcgtgatccgggtccgcatcgtgctcaacctgaagggcctggcgtacgagtacgtggaggaggacctcagcaacaagagcgcgctcctcctggggtccaacccggtgcacaagagcgtgccggtgcttctccacgccgggcgcgccataaacgagtcccaggtcatcctgcagtacatcgacgaggtgtgggcggggacggggccggacgtgctgccggccgacccctacgagcgcgcggtggcgccgttctggggcgcgtacatcgacgacaaggtggagtcggcgtggctggggat

SEQ ID NO: 2288 - DNA, 410 bp, Zea mays
  unsure at all n locations
  Clone ID: LIB143-038-Q1-E1-A3
tctcctcacggcttcctcacacggcactccagccgctagccctcactcaaccagacaaccagtacaccaccgccaccaagcccgggccgaataactctgccgggcaaccgccgcccttcgccggcaaagaacgcccaccagatccaccccggcctgctatggagtccgcggtgaacccgaaggcgtacccgctggctgatgcgcagctgacgatgggtatcctcgatatcatccagcaggccgccaactacaagcagctcaagaagggagcgaacgaagcgacgaaaaccctgaatagggggatatcggagttcgttgtgatggcggcggacacggagcctctcgagatcnntgctcacctcnccttgttagccgaggataagaacgtcccatatgtatttgttccatcg

SEQ ID NO: 2289 - DNA, 406 bp, Zea mays
  Clone ID: LIB143-038-Q1-E1-A5
agctcacacagcaaatacccacagtccacactccacagcaagaaccgaagatgttcggaaacatcggaaagatcccgatcattggcgacctgacgggcagcaacaagaatgcgcacctcaagggcaacctggtgctcatgcgcaagaccgtgctcggcttcgacgtcaccagcatcgccggctccctcatggacggcctcggcgagttcctcggccgcggcgtcacctgccaactcgtcagctccaccgtcgtcgaccccaacaacgggaaccgcgggaaggtgggtcaggaggcgagcctggagcagtggctgctgcacccgccgccgctgctggccggcgaggaccagttccgcgtcaccttcgactgggaagtggagaagcacggcgtcccgggcgccatcat

SEQ ID NO: 2290 - DNA, 353 bp, Zea mays
  Clone ID: LIB143-038-Q1-E1-A6
agcctgaactcgcgcctcgcttcgtctctcccattcccacccgctgaagcttcaaggaacttctctaagaccgagctaacgagctcaccggcgggcaggatgctggcggcgtccaccaaggtcggctctaggctggcctctccacacgcctccttgtccgccggtgctgcggcggcggctctggcgagctcccccgtgctgggctctgggatgctcccaggcgccgggttcggcgagacggggagtcaccacgcggcagacgcgccgccgccgctgccttgcagttcctcgggcgattcaagggaatattatcagtggaagagactggtgaatcaaaggcagtcaacgctaga

SEQ ID NO: 2291 - DNA, 403 bp, Zea mays
  Clone ID: LIB143-038-Q1-E1-A7
aggcaacaagtacgcaggcagcgcagcctcgagccgtcgccatggcgagcaagcacctcgtcctcgccgcatgcctcctcctcctcctcctcctgcccatcgcctcggtcgccaccgacgtcgactactgcagtaagaaggactacccggtgaaggtgagcggggtgcagatcgtgcccgatccggtcgaacccggcaagcccgccactttcaagatctccgcttctactgataaaaccatcgagaaggggaagctggtcatcgacgtaaagtatttcttcttctacgtgcactcggagacccgcgacatctgcggagagacttcctgcccagcgaccggcgacttcgtgctgtcccaccagcagacgctgccaagccttcactcggccgggctcctacacga

SEQ ID NO: 2292 - DNA, 382 bp, Zea mays
  Clone ID: LIB143-038-Q1-E1-A8
acgcgtgggccgatacaagcctcaacactgagtcctacatatataattatcttcctcttcgtcgctcgcacgtccgatccgtcctcacgtaacacgccgatagatggagtcgtccatgtccatgtccgccgccgcctcggtcgtcgtgaggacatgcgttccggccgctgtcatgttgcccctctccccgtcctttactaggcccgccccccgcaccaccgggcgaggcttccgctgcaggtgcagcagcaccagcagcgccaccaaggactcggcggtcgtgtacagcaggctgctggacgacgcgctgttccggtcggcggaggtgatccagtgggagagcggcaagtccatgaacgccatcgccacggcgcaaggcatc

SEQ ID NO: 2293 - DNA, 406 bp, Zea mays
  unsure at all n locations
  Clone ID: LIB143-038-Q1-E1-B1
ctgtgataataataaactgatataagcagaggaagcggggaggaagctgcgaattgganggggccgggagaggcgtctctggttattgctgggagtggacgggccgggaaggagacgagaagataagggcgccgcgcgcggccatggctggaaatgcgccggcgacggcgatggacaagaccagctttgccaccacgtgcagcctgctgaaccagtatgtcaaggagaagaagggcggcctgctgcagggtcttggtggcctccccatggcgccggcagctggagaagaaagagcttttcggccgccgaccaacatgaacttgctgtcagcgctcgacgacgcgccggccgaggagcgcagcgagaaagccaccgccggggagccaanncaccaggacaaatgcac

SEQ ID NO: 2294 - DNA, 361 bp, Zea mays
  Clone ID: LIB143-038-Q1-E1-B10
agtcgcccacatgtgcggcctcagcctcaagggccgcggggccatccccttcctcgagtccctcgtcgtcgccgacgtcgccgcgctcagggacggcaccggcaccctcaccgtcttcaccaacgagcagggcggcgccatcgacgactccgtcatcgccaaggtcaccgaccaccacatctagctcgtcgtcaacgccggatgcacggacaaggacctcgcccacatcgaggcgcacatggaggccttcaacaagaatggccgggacgtcaagtggcacatccacgacgaccgatcgctgctcgcattgcaggttgatgaatcataagagacttaagagagacttcaatgctgtttagtt

SEQ ID NO: 2295 - DNA, 374 bp, Zea mays
  Clone ID: LIB143-038-Q1-E1-B11
accgcttctgccctcacgctttcgttgtcatgaggagcctcaccgtggcaagccgccacccgggcgccgctttctctacccgccgccgcccccttcttcaccccgccgcagccggaagggactcgaccttccagcggtgctggcgatgggaaaaaactcaggacagctccttcgggagctcactaaggaccagccgccttccaagaactgtgcacggagatattttgaagaatttgctcgcaccaactgctggtgctgtttcagttgagcaagctgaagctattgctgacctcccaaaaggtgaaatgtggtcggtgcacaagtttggtggcacatgcatggggacctctgagagaattcacaatgttgctgat

SEQ ID NO: 2296 - DNA, 385 bp, Zea mays
  Clone ID: LIB143-038-Q1-E1-B12
cgggtcgatccaagcctctaaacaggctcctattagagatgtgcaggaggcctgtgtacatgatggatatgttctacccaaattgtatgcaaaggttcatcactgtgtctcatgcgcaatccatgcgcacattgtccgggtccgctctcgtgagaacaggaggaaccgtgagcccccgcagcgcttcagacgccgggatgatggcccaaggcctggtcagggcccgccgcgcccaggcggtgcagctcctgcagctgcacctgctgctgctcctcgtacctaagttctggaattagtttcggggcttagttttgtgaaacattacctgttttgagaaaccattgttactgtatccccttgatgtcaaactttttagtacaatttg

SEQ ID NO: 2297 - DNA, 368 bp, Zea mays
  unsure at all n locations
  Clone ID: LIB143-037-Q1-E1-H7
gctccttgttgcccatggccatgacgagagcactggccatggtggccatgttggccactgctgccttgttcttcatgtccgctcgcgcacagcagtgcggtatgcaggccggcggcgcgctctgccccgactgcctctgctgcagccagtggggctattgcggctccactcccgactactgtaccggcggctgccagagccagtgcatcggcagcggctgcggcggcggcggcggtggtacccctgctactcccccgagcggcccggtgtctgaaatcatctccgagtcnctgttcaacgagatgctgctgcaccgcaacgacgtggcgtgcccggccaccggcttctacacctacgacgcgttcatc

SEQ ID NO: 2298 - DNA, 416 bp, Zea mays
  unsure at all n locations
  Clone ID: LIB143-037-Q1-E1-G12
aatctcgatggtcgtcttctccacgagaccacgaccgatcaaccccaatcgtagggaactgggaacccggacccagatctcccctagatcctcaatcccaatctgccctccgccgtatcgatcatacctcccgatgcgaccccaagtctggtcgatgcgagtagcggcggcgatttagcgaactgcgcgttcgctagggttagggtttcgagggtttgcgctanggtttgggcgcacgatggggcggtcgcgaggggtgcagaattccggcgacgacgacaccgtacacaggtcgaagcggaggagggtcgcatcgggcggagatgcgacggactccgtgtccgctggcatcgggggagctggagaaagatggggcaagaaagcgctctnacactgcaattactgcaacaaggaca

SEQ ID NO: 2299 - DNA, 413 bp, Zea mays
  Clone ID: LIB143-037-Q1-E1-G2
atggcgactacggttaggggcgaccggacgtcgccgcgcctgcccaaatccacccatcccttccgttcaagccgccggagctccaaggccgctggtgtcgaagccggcgtctcttccttacaggcccgcctcctctctgtccgttctgtcttggtcgacgaagctcaagaccacagtgtcaggatgctctccaatcttccagccaaacacaattcatcagtcagatacacttttaccaaggaatttttcagaatcactccacgagaggttcagctctcgaagctacagaaccagagctctaccaaacaggccatgacgtctctcaaatccccagttcagtaactggctaactgtacgacaacgagagagatggagaacggcggcgctaaacgcgacgtccccgacgatgcgaa

SEQ ID NO: 2300 - DNA, 415 bp, Zea mays
  Clone ID: LIB143-037-Q1-E1-G3
ggtcaatcctccccctacccacaccaacgcgcacacggaccgggagccgcagcggaaaccacaaaaccagcgtgaaggcgcccgaaccaccgcgagccccgcccaccactccacgaaacccaaacgcacctccgcagcgagggatatcccccatcaccccctaccagtttcaattttcaaaagggcgtggaggcgccgcaccaccgccgccgccaccactgacgagggaggaaacgccacctccccgagccagtccgatgttgtccgaccaggagctggcccagtacgtggagtccctcgtccagcacaccgctgcgcagggtggcaccgggatatcggcggatgccgtggtgcgccagctcggggcgcagctcggcgttgacctctcccccaatgcgcagctcatccgcagcgt

SEQ ID NO: 2301 - DNA, 411 bp, Zea mays
  Clone ID: LIB143-037-Q1-E1-G4
cagagagctcctgattatggttcacagggtgaagtgaggcttacttttgcggaaaatggatcctcaaaagttggagtcagatttgataaacagatccccgggggcattgatcttggaggcagttgtgagcttgatcatggcctattctgttcagttgattctctatgcctcgatggtccaggatgggaagatagagccaaacattcatttgatgttgtgtttgagtttgcctctgaagaaagtcaacaggtgcctgtaatcctatttctgaaggatgttgagaaaatatgtggaaataattacacctaccatggtctaaagaataagcttgaaagtttcccagctggagtttttattgttgggttccagattcagacagatgctcggaaagataagtcaaacaatgggtct

SEQ ID NO: 2302 - DNA, 404 bp, Zea mays
  Clone ID: LIB143-037-Q1-E1-G5
aaaggcaccagcacgcctcctcctctttcagcaaacacagctagctagcagcacctgctcccttcgcctgtgctcatggcgtattgctgcgacgacggctgcaactgcccccctgactgcgggtgcccatgcgactgctgcaatttgtaccctgaagtggagaccgccgccgccagcggcatcctcgctgcgccgaccaccaacgccagcgccggcggctgcaacacctgcaagtgcggcggcaccagctgcatctgcaactgcagctgatccggaccaatggtggctcacgagacgagcacgacgacgacgcgtattatatatgtatgtagcagcgtccatataggatcctgtcaagagtcaactgcacccgccactgtatggtcacctgcctcgccttcgtc

SEQ ID NO: 2303 - DNA, 406 bp, Zea mays
  Clone ID: LIB143-037-Q1-E1-G6
acggacgcgtgggctacaagtacggattctaaaacaccttctgccccaactctagctaatgtaaatggtgaacaaaagggaacgagcttgaatgctaccttgcagagttctcttgctttctataatgagatctgtcgaaaagagaacctgaaaatgagacaggccatcctggggaacttggcgtttgttgaattgtgtcttgagaaccccttgaaagctttgtcttatgcaaagtcagtaatgcaggttaaagactgttccaggatgtatatattcctcagccatgtatacgcagctgaagctttgtgtactttgaacagaccaacggatgctgctgagaagctatcagtttatataagagatggcaatgatatcgagttgccgtataatatggagaactctgaaa

SEQ ID NO: 2304 - DNA, 402 bp, Zea mays
  Clone ID: LIB143-037-Q1-E1-G7
aagctcgagccctcgcccgctcagtcacaaagcctcagatctcagtcgcctgcgccgccgcttcgttcgtgtggaggggagaagacaggaaatggcggcgactgagggcgtgctcttggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaactcctggtgcaacaagttacatgggatgcattggaaaggacaagtttggtgaggaaatgaagaaaaacgctcaagctgc

SEQ ID NO: 2305 - DNA, 390 bp, Zea mays
  Clone ID: LIB143-037-Q1-E1-G8
caagcgtcaagtccggaccctcgctcacacggtcacatgaccgcataattctgccgacaatggatccgcatcagttggattcagatttgataaacagatccccgggggcattaatcttggctgcagttgagagcttgatcatgccccaatctgttcacttgattctctatgcctcgatggtccagtatgggaagatacagccaaacattcatttgatgttgtgtttgagtttgcctctgaagaaagtcaacacgtgcctgtaatcctatttctgaacgatgttgagaaaatatgtggaaataactacacctaccatggtctaaagaataagcttgaaagtttcccagctggagtttttattgttgggtcccagattcagacagatgctcg

SEQ ID NO: 2306 - DNA, 413 bp, Zea mays
  Clone ID: LIB143-037-Q1-E1-G9
atatcatcattatctttcaggtatctacattattaaccttggaaagacctgggacaagcttcagttggccgccagggtcatcgttgccattgagaatccgcaggacattatcgtgcagtctgctaggccctatggccagagggctgtcctcaagtttgcgcagtacactggtgcccatgccattgctggcaggcacactcctggtacattcaccaaccagttgcaaacctccttcagtgagccacgccttcttatcctgactgacccgaggactgatcatcatgtaaaacttatatctgttgaaagaaaaactagagcgtgcaactcggtttgctgattcagaggactttaaaatcttctttatccaaactttgtacagcccattaaggagtctgcgcttggaaacattccca

SEQ ID NO: 2307 - DNA, 409 bp, Zea mays
  unsure at all n locations
  Clone ID: LIB143-037-Q1-E1-H1
aggcgaaacatctctcaaacgatacgaaacggcctcgccgctcagtctcacgctaatccccgccggcaccgatcgcccgcactaagcagacagcgcgcacgtcgacgggcggcaatgcgccgcagacgcatctggcgaccaacgcggcgcgcaagatggacccggccactcggggcttgaagaatccgcaccgcttcctcccgggcaacgtggcgctgcgggagatccccacgtattagacgagcactgacctgctgatacggaagctgccgttccagctgctggtgcaggagatcacgcangacttcaacacggacatccggttccaatcctcagccgtggccacgctgcaggatgccacccaggcctagctcgtgagcctcttcgaggacaccgacctctgctccat

SEQ ID NO: 2308 - DNA, 229 bp, Zea mays
  Clone ID: LIB143-037-Q1-E1-H10
gacccaagcgtccaattttaatctgtccatttgaataaaatgtttcctctaacaagtgaagggcactgtttttattgtctcgtgggccacagatgcctgctgaacaatttatgttcatttcttcttttcttaaagaagcatgcactaagaacatgaaggatgcatgtcatgaaagtttttgaaagtcattgaaacttatgagctcctcatgcaatgcattattctcctt

SEQ ID NO: 2309 - DNA, 437 bp, Zea mays
  Clone ID: LIB143-037-Q1-E1-H11
gacgcgtgggacgacacaagcctctagactgagtcgtactagaacgtgaaggccctcgacgagcaggaggtcacctcgcagcactcgcgcgcccagaccagcgacgccgccgaggaggagcagcagcaggcggtggatccgctggcgcggcagtcgtccatcatgtcgctgacgctggaggagctgcagaactcgctgtgcgagccgggccgcaacttcgggtccatgaacatggacgagttcatggccaacatatggaacgccgacgagttccaggccgccacggccggctgcaacaaagagggcgcggagcgggagccggtgcccgtggcgactacgacgggcacaagtgagaatggacgacgaggaaatgggaggggactggttcgggaggggtcgttcgcgctggcgccgccgctgtcccggaagacggtgga

SEQ ID NO: 2310 - DNA, 417 bp, Zea mays
  Clone ID: LIB143-037-Q1-E1-H12
aagcctctatcctgagtcgggctatctcataaaagaccacaacaagcaagaagtcaacatcgaaaaaatcacacgcccagacaaacgaggacagccgaggaggagcgatcagcacgcggtggatccgctggcgcaggagtcgtcgatcatgtcgctgacgctggatgatctgcacaactcgctgtgcgagccgggccgcaacttcaggtccatgaacatggacgacttcatggccaagatacggaacgccgatgagttaaaggccgtcactgccggctggaacacacagggcgcggatccggagattgtgcccgtggcaatgacgactggcacacgtgagaatggacgatgaggaagtgggaagggactggttcggcacgggtcattcgcgctgccgctgccactgtcccagaagac

SEQ ID NO: 2311 - DNA, 415 bp, Zea mays
  unsure at all n locations
  Clone ID: LIB143-037-Q1-E1-H3
accgcttcagttggcagttgcgacttgcgagtggctccaacaaggcaacacaatccaccggcaccaacccagcgcggcgccaccggcgacccgtacccccttccccggagagcgatggcgacggagctgacggcggcgcagctgcgcgcgtacgacggcaccgacccgtccaagcccatctacgtctccgtccggggcaaggtctacgacgtcacctccggccgcggcttctacggccccggcggcgcctacgccgtcttcgcgggccgcgaggccagccgcgccctcggcaagatgtccaaagacgaggccgacgtctccggggacctctccgggctcaccgacaatgagctcggcgtcctcgccgactgggagaacaggttccaggccaagtaccccgtcgtcgcncgactcg

SEQ ID NO: 2312 - DNA, 328 bp, Zea mays
  Clone ID: LIB143-037-Q1-E1-H4
agcagagcatccttccatttcagggagattcgactccgggtacgtgctctactcacaggaaatcatgcgacgagacccgcgcaaagcataccccgttccgcggatagcgtgatcgactgcgctatcagccgtctaggcgcgctgtctacgatcgcacggtcacgtcctcgctcagctatgtctgcatccggggctccgtctacgatctctgctctggccgtggattctattgccccatgagggggaagcccgctattctctgccgctacgccagtcggacccccggagtgatgtgcagagatgacatcgacgtctcgtgagaccttgc

SEQ ID NO: 2313 - DNA, 412 bp, Zea mays
  Clone ID: LIB143-037-Q1-E1-H6
acaaggcccttatgctcattgaagcatggggggagtctggtgatgaactccgttatctgccagtctatgaggaaacatacaagagcttgaaatcaagaggagtgcggtttcctggacgtgacaatgagagcttggctcctatatttactcccgcgcgatcagttgctgaagctgatgttgatgcaagcttgccccagcaggtgttcgaggacgtccatgttcatacatatactgctgaagaaacaaaagaagcatttgatgtagctcgtaacagcgtagaacttctttcaactgttctttcctcttctcctgagcaggatgctttgcaggatgacttgacaaccactcttgtgcaacaatgctaccaatctcagcacactatccagatgattattgagaccgttggagacat

SEQ ID NO: 2314 - DNA, 396 bp, Zea mays
  Clone ID: LIB143-037-Q1-E1-G11
cccacgcgtccgttcacacctcaaatatcttcaatctcgatgtaacatgtaagtttaacacctgtgtttgagcatttgaaaagatttggtttgctcagtttactttcatctgagctactgctgatatccatattcattttgtactaaatatatttttcacaattgaaacctctgtatacaagaatgcatgttcaatctcttgagtaatgtgcagttctgcatggaagatgatgggcaataaactgggttactttgatgcaatgggttgtgcgatgctttgcaagggagcatcttttattgtctaggtggttaggatgcttgctattcaattcttacctaagagacctgtctatgagttctggcaaggcgatggcattatgttttttccttgtgcat

SEQ ID NO: 2315 - DNA, 378 bp, Zea mays
  Clone ID: LIB143-019-Q1-E1-B8
acagagatccgaagctcaatcaattcactcaaacctcttccccaaatcttcgattacattctcgttgacaagaagactagaaccgaacctgaccatgtcgctgatccgccgcagcaacgtgttcgatcccttctccctcgacctctgggacccctttgagggcttccccttcggctccggcagcaggagcagtctcttcacctcgatcccgcggaccagctcggagaccgcggccttcgctggcgcgcggatcaactggaaggagactccagaggcgcacgtgttcaaggcagacgtaccggggctgaagaaggaggaggtcaaggtggaggtcgaggacggcaacgtccttcacatcagcggcgagcgcaacaagga

SEQ ID NO: 2316 - DNA, 426 bp, Zea mays
  unsure at all n locations
  Clone ID: LIB143-019-Q1-E1-B9
tgaagtgagaagagaagttaatgctggaattgcgtccgtatcacggatgatggagcgtctggaaactagaggaaatagcagaacaagtgatagcccggcagcatccacttctgaagttccccctgctacagaatcaagcaatgaaagggttacagagagcaactctgctgctgctgctggtggtggtggtactaccactacgggtaccagcgctagcaacgcctccgccccttgtgttgcgacatccggttcaaattaggacatgtaagggtctcagaaagaaggcttacacctgcaattcttcatcttcgaaggtttgtgagcctggcggcagagcagaagtgcagtaacatgatgccgtcatttttttctcaaccactgcataaacggctgcaaggggaaaaaaccanacggtgatttgatgta

SEQ ID NO: 2317 - DNA, 420 bp, Zea mays
  Clone ID: LIB143-019-Q1-E1-C10
cgcgaagatcgaggcgtattacgacgagacgggaactggactggaaatcatggtcccaaagcaccgggttggaccggaggagcatgaagttcgggtgtgcatgaggcccccgcatcttggcgacagcgatcttgtgctatcctagaacgaggaaaacaggtagctttcggattttccagtgccatgtttattgccatgagatactcgaacgtaacaggtggtgccatggatcagtgagagccatcatatttgctgctaaacatgtagcttataagttgagaaattcttttcctccataaggccccgttcggttaggctggaataagactaggaactattccaggtgaccaattgttatactgcaaattatacagttattccagctgggatccttcctggagtagattcctgaataaccga

SEQ ID NO: 2318 - DNA, 391 bp, Zea mays
  Clone ID: LIB143-019-Q1-E1-C11
agcaagcagcctaaaaaaaccgtatcgtctcgcctgttcagtttccttctcttcccgcagcccggtttgccgaccaggttccaccgttccagagtagccaagcgaatcccgtgtcgggttcgcgcaatggcggaggaccattcaaacccccagaacaagcaaccgggggaaagggaggttatggtggcacaacaacacccggagagggccgaaactgtggtgtccgtgcatttcgcaaatggggggtgcccaggccgcggtgtgcctcgctgggctctacgggctcgccaagggacacaccggggcgctccgccccagagttgacgccgtcgagtctgccgtgaaaggggtcgttagccccgtctacgaccgcttcggcgggcctgccgct

SEQ ID NO: 2319 - DNA, 420 bp, Zea mays
  Clone ID: LIB143-019-Q1-E1-C12
atcaacttctaaaggaaagaggtgagaacattccagcagaagaatcttttgatgtagcaagaaggattaaagaaatgtactgctatacttcttcggacattgtgaaggaattcaataaacatgacaaggagccatcaaagtacattaaacactggacgggcactaaaccgaagactggtgcaaaatacacatgtgacattggatatgagcgattcctagggcctgagatcttcttcaacccagagatatataacaacgacttcaccactcctttgcaagttgttattgacaagtgcatccaatcatctccaatcgacacaaggagggctctttataagaatattgtcctgtctggaggctcgactatgttcaaagatttccacaggaggttacagcgggacctaaagaagatagtggatg

SEQ ID NO: 2320 - DNA, 389 bp, Zea mays
  Clone ID: LIB143-019-Q1-E1-C2
agggaggagaccagcagcagcccatccgaccccccgcctcctcctcctcctcctcccgggttcgcgtgaggctgtgtgctgctgggaggcggcgccggcgccggcgccatggaggcggagaagaagccgccggcggtgtccgacgtgggcgcgtgggcgatgaacgtcgtcagctccgtcagcctcatcatggccaacaagcagctcatgtcctcctccggctacgccttcgccttcgccaccacgctcaccgggttccacttcaccgtcacggcgctcgtccggtggatctccaacgccaccggctactccgtctccaagcacgtctcgctctgggagctcgtctggttctcgctcgtcgccaacacctccaacaccgggatgaaact

SEQ ID NO: 2321 - DNA, 389 bp, Zea mays
  Clone ID: LIB143-019-Q1-E1-C3
aagggaggagacaagcagcagcccatccgaccccccgcctcctcctcctcctcctcccgggttcgcgtgaggctgtgtgctgctgggaggcggcgccggcgccggcgccatggatgcggagaagaagccgccggcggtgtccgacgtgggcgcgtgggcgatgaacgtcgtcagctccgtcagcctcatcatggccaacaagcagctcatgtcctcctccggctacgccttcgccttcgccaccacgctcaccgggttccacttcaccgtcacggcgctcgtcgggtggatctccaacgccaccggctactccgtctccaagcacgtcccgctctgggagctcgtctgggtcccgctcgtcgccaacacctccatcaccgggatgaaac

SEQ ID NO: 2322 - DNA, 385 bp, Zea mays
  Clone ID: LIB143-019-Q1-E1-C4
aaaaaagacacgcaaggaaaatggctccgaccgccgccaaggacagtggctccgccgatcgctggcgcgaggtgcatgcgttcgaggacagcaagctgggtgtgaagggcctggtcgactccggcgtcaagtccatcccggccatgttccaccacccgccggagtccctcaaggatgtcatttctccaccagctctgccctcctccgacgatgcgccggccatcccactggtggacctgtccgtggcgcggcgcgaggatctggtggcccaggtgaagcacgcggccgggacggtgggcttcttctgggtggtgaaccacggcgtgccggacgagctgatggccagcatgctcagcggggtgcgccagttcaacgagggctctct

SEQ ID NO: 2323 - DNA, 355 bp, Zea mays
  Clone ID: LIB143-019-Q1-E1-C5
atgctcctatctggtataggacggagctgagcttctagcaacgtacagtgtatccgccatgagtcctttcggggcggtgatcacgccagaaaccctcaagtacatgtccaagtaccagggacgtgagatcacgcacgtggactgcgcacgggaggcgatgacgctgatccacgcggaagacaagaacctcaaggccgaggactcagcgtgggagctgaagaacaagttcggcaaccgcgtgagcaccatggtcctcgtctacaacgccaccggggccagcctgagcctggtggacgaccggaaagactggatgggctccgtctacagctcgccgattccggacaccttccacaac

SEQ ID NO: 2324 - DNA, 384 bp, Zea mays
  Clone ID: LIB143-019-Q1-E1-C6
gttccttctctctcggcttggagctcacccgtatctgggatataaaggcaggcacccacgataccctggctatcaatcccggtgcctccaagttttgccgagagggtcagcagcaacaagaaaccggagcttgaaactcgctaccgctcgcaccatgatcagtggcggaggagaaccattgccatctgcccagccgatgccctcatcccctagaaccgagcaagcaaccacgtcatagcagaaacagagagggtgagagaaagttgggaaggcgggcggctgcgttgagctgtagccgcgccgtgcccagaacctcgggttcatcctcatcggtcgctgcggtgcttctacaggacacagggagctcttgctacgaattctgcg

SEQ ID NO: 2325 - DNA, 382 bp, Zea mays
  Clone ID: LIB143-019-Q1-E1-C7
gccgagacggttgaccaacgctgccacgattccgtccacacgccgacgcggcgggctcctggccgacgagcactcccctccgaacgccgcgttggacggccccgccccacgaggccacgatgcagtagcagcgttcacaccatctgtctgtctcaagtgtcacggtgtccgtcattcgattcaacccccaaccccccatgggcctggccgtataaatcaaccgccggtgaagtctagtcgtctcgtcgctcggtccagcacctcagctccgccgcttgcccgcgtttgctctctccctcccgggtctcggcttcatcgacacgctaacgtcccaaaaccgtaaacgcccctcccggattccggtaattcgccaacggcgccc

SEQ ID NO: 2326 - DNA, 372 bp, Zea mays
  Clone ID: LIB143-019-Q1-E1-C8
gtcgttcggtaacttgcggggtcaatgggaggagggaaagacaagcatgacgagagcgacaaggggctcttctcgaacatgatgcacggcgttgccggtggtcatgggtacccccaccagggataccctccgcagggctacccaccgcaaccaggagcatacccgcctcccccaggggcgtatcctcctcctccaggggcatatcctcctccacctggggcatacccaccacaatatgggtaccctcagccaggtggctacccacctcaaggtggatatcctcctgcaggctaccccggctcatctcaccagggttatgggagcagccacggcgggggccacgggggccacatggggatcggggcaatgcta

SEQ ID NO: 2327 - DNA, 387 bp, Zea mays
  unsure at all n locations
  Clone ID: LIB143-019-Q1-E1-C9
acactcaacagcaacagctaagcctctcccacaagacagcaacatggctgaggaggaggccaagaaggtggaggtggaggtcaccaaggagcccgaggcggcggcgaaggaggacgtagccgatgacaaggccgtcatccccgcgaccgacccgccgccgccgccgccgccggccgacgactccaaggccctggccatcgtcgagaaagttgcagatgaacctgctcccgagaagcctgcccctgcgaagcaagggggctccaatgacagggatctcgctcttgcaagggtggaaacagagaagaggaactctttgatcaaagcttgggaagagaatgagaagacaaaagctgagaacaaggctgctaaganagtatccgctattct

SEQ ID NO: 2328 - DNA, 417 bp, Zea mays
  unsure at all n locations
  Clone ID: LIB143-019-Q1-E1-D10
gttgacatctcaccaggaagaaagagatgcagtttttgccaagatagaagtttctcaggttcatttggaactgttgaagcgtactaatgttctcaatgatgcattctatatatcacatgatggagtaatcggaacaataaataactttcgcctaggacgtctttctaatgtagaggttgagtgggatgagataaatgctgcatggggtcaggctgcactgctgttgcataccatggctcagtatttcaccccaaaattccaataccggattaagattcaccctatgggaagctatccaagagtcacagacatccagaataacacatatgaactgtttggtcncgtgaatttgttctggagcacccgatttgacaaagccatgacatggtttcttacttgcctgcaagagtttgctga

SEQ ID NO: 2329 - DNA, 103 bp, Zea mays
  Clone ID: LIB143-019-Q1-E1-D11
agcctagttttcagtccttattcgcctcttggttttgagatctatatctggactagcagtgctttcttgtctcacctatttgtgttaagaagacgtagttttt

SEQ ID NO: 2330 - DNA, 424 bp, Zea mays
  Clone ID: LIB143-019-Q1-E1-D12
cgcctatctccgcgactcaaagcttcttccatttcctaccgccgccgctgcagctccaccccattccgtcgacaccatgagggagtgcatctcgatccacatcggccaagccggtatccaggtcggaaacgcgtgctgggagctctactgcctcgagcatggcattcaggctgatggtcagatgcccggtgacaagaccattgggggtggtgatgatgctttcaacaccttcttcagtgagactggtgctgggaagcacgtccctcgtgctgtttttgttgaccttgaaccaactgtcatcgatgaggtgaggactggcacctaccgccagctcttccaccctgagcagcttatcagtggcaaggaggatgcagccaacaacttcgcccgtggtcactacaccattggcaaggagattgttgac

SEQ ID NO: 2331 - DNA, 393 bp, Zea mays
  unsure at all n locations
  Clone ID: LIB143-019-Q1-E1-D2
cggataggtagcaccggagcaggtanaacgctgcacaatccccttcgccgccgccaagatggtgaacgttcctaagaccaagaagacgtactgcaagaacaaagagtgcaagaagcacacactccacaaggtgactcagtataagaagggcaaggatagcctgtctgcccagggaaagcgccgttatgaccgcaagcagtcaggatatggtggtcagaccaagcctgtcttccacaagaaggccaagaccaccaagaagattgttctgaagctgcagtgccagagctgcaagcactactcacagcacgccatcaagagatgcaagcattttgagattggtggagacaagaagggcaagggcacatctcttttctaagcttctcgtccaactgt

SEQ ID NO: 2332 - DNA, 311 bp, Zea mays
  Clone ID: LIB143-019-Q1-E1-B7
acagcgatccgaagctcaatcaattcactcaaacctcttccccaaatcttcgattagattctcgttgacaagaagactagaaccgaacctgaccatgtcgctgatccgccgcagcaacgtgttcgatcccttctccctcgacctctgggacccctttgagggcttccccttcggctccggcagcagcagcagtctcttcccctcgttcccgcggaccagctcggagaccgcggccttcgctggcgcccggatcgactggaaggagactccagaggcgcacgtgttcaaggcagacgtaccggggctgaaga

SEQ ID NO: 2333 - DNA, 402 bp, Zea mays
  Clone ID: LIB143-019-Q1-E1-A11
cggacgcgtgggcggacgcgtgggatagtcgatcatgaagggtggcaagaacgaagtggccggtgcggtggtggccatactgctggttctgcagctcatggcagctccaccgacggccatggccgcccgctcgccgcgcggagccgtgccggatggctccctcgccacgacgcccacggtgacgatgctgtcggccacgctgtgctacacgggggagacatgcaagtacattggctgcctcactcctgcttgctcctgcatctatagtgatcgtctatgctacatcatatttactcctgttgcttgaggccattccgcgaagccacagctcttacaatatgcatgcgccggccgacgacgacgcgcgctgcctctcgtgagcttctgttcaagtgatgcatg

SEQ ID NO: 2334 - DNA, 426 bp, Zea mays
  unsure at all n locations
  Clone ID: LIB143-019-Q1-E1-A12
atttttgtttgcctgatataaggcaaagtgtgaaagggaaacgcgaaaagaaacgtgtcctggtcccaagtcacctgccatactgaacacgattgatcgcagaaagaaacacgttctggtctagactgacagttttggagctggagccggccatgcgctcgatcagagttccgctgcagccacgacctctctcccgaacgcgcacgagaagaccaagtggaacatatgcaagcaggttctagagcaataaccccatgaatccacatcgggggtctgcatctacacgggcgtgtactccgcaccgctcccctccggccccgaccgccgtgtgctcgttgtagccggggtcgacctcaaccacgacgacgatgcggtctccttgcnctaggctcgacctcctcgctgacctcgccctgctccacctca

SEQ ID NO: 2335 - DNA, 364 bp, Zea mays
  Clone ID: LIB143-019-Q1-E1-A2
cccacgcgtccgcccacgcgtccgcccacgcgtccggcgagagagaacccaaacggagagagacaatcgagagagatggcaaactgttttggtgacgtcgtggacaattacaagctagacacaatgccaagatatatcggcaaaaagaagactcgagaagaccgggcaacgagaggcctcctatctcagtaatgagaatgagaagtacaagaaagctaaagactatgtgaacatgctgaaggactggtacggcaatggagcgtcgacgctgtgcgtgatctacaaccagacgggcggaaccctgcggtacgtcgacgacaaggactggctgggctacccggggccgacgccctacccgacggag

SEQ ID NO: 2336 - DNA, 352 bp, Zea mays
  Clone ID: LIB143-019-Q1-E1-A3
cgcacccggttccacatgcctttccccacctattctcgcagatctcgccagccagtctagggtttccgtcccgagatgcttatccgccctgcgccggtcatgtcgaatcaaggacggaacgccatgccgctgaatgcgcccaaagccgacacgcaagagtaccacgacacagatgttgcatatctgcataataagaatgatgaggaaaaagcactgaaggagcttaatgcccatgcacagagaggcgcaattgagggctccggtctgacgatgcgtggtctgaaatgagactggtcacacgtctccaatacctaaaggatgagaatgcatctgtctatctgtgttgcgcttc

SEQ ID NO: 2337 - DNA, 91 bp, Zea mays
  Clone ID: LIB143-019-Q1-E1-A4
attgtttatggacacctagaggggatgaacgttacaaacagatctcacaaaaaagtcaaaagaaaaaggaccacgcatgagaagaataaaa

SEQ ID NO: 2338 - DNA, 284 bp, Zea mays
  Clone ID: LIB143-019-Q1-E1-A5
agtttttgtttgcctgatataaggcatagtgtgtcagggaaacgcgaaaagaaacgtgtcctggtcccaagtcacctgccatactgaacacgattgatcgcagaaagaaacacgttctggtctagactgacagttttggagctggagtcggccatgcgctcgatcagagttccgctgcagtcacgacctctctcccgaacgcgcactacaagaccaagtgggacatatgcaatcaggttctaaagcaataaacccatgaatccacatcgggggtctgcatctac

SEQ ID NO: 2339 - DNA, 377 bp, Zea mays
  Clone ID: LIB143-019-Q1-E1-A8
acgccgcctctgatctccgcgaggttgtcaggattcaatatgtcgaccagcacattcgctacttcctgcacgctgttgggcaatgttagaacaacgcaggcctcccagacagcggtgaagagcccttcgtctctaagcttcttcagccaagttacgaaggttccaagcctgaagacctccaagaaactggatgtctccgccatggctgtatacaaggtgaagcttgtcgggcctgaaggtgaagagcacgagtttgatgctccagacgacgcctacatccttgacgcagccgagactgccggtgtggagttgccatactcgtgccgtgctggggcttgctccacctgtgccggcaaaatcgagtctggttcggttga

SEQ ID NO: 2340 - DNA, 298 bp, Zea mays
  Clone ID: LIB143-019-Q1-E1-A9
ataaaaagggatgggcgttattggacaagtatttcttttatttctgccccccattttgtaagactcatctttgttaaagtataaagcaaagtaaatcctccaaaaaaaaaaaaaaaaaaaaaaaaaaaaaaaaaaaaaaaaaaaaaaaaaaaaaaaaaaagaaaaaaaaaaagaaaaaaaaaaagaaaaagaaaaatcaaaatcaatgaccggtatactaaatgtaacatgaatggggaaaaaggtgaagaaaaacaatttaatgacccaaaaaaaaaagcacaattttgacacaaat

SEQ ID NO: 2341 - DNA, 132 bp, Zea mays
  Clone ID: LIB143-019-Q1-E1-B1
aatttccttgggctctggactccaaaatcccagccttttgtttgcttctctgtctcctgctgattggtgtccccgggtccaagactcttgatttgctcctcgcgggggttcggtcccatggcggcagctgcg

SEQ ID NO: 2342 - DNA, 427 bp, Zea mays
  Clone ID: LIB143-019-Q1-E1-B10
aaagaaattgccagaacagtcctaggagcgtcaggcgtgaaagaagttactcacgctccccatctccacgccgtggaagaggtcgcagtccaagctatagcaggagcaggagccggagccggagccggagctatagccgatcgaggtccctatctggatctcctaggggaggccgccgtgaccgtgatgataggagatcgaggagtcttagctacagcaggagccccatgcggtcgccacctgcaaaggaaaaggagcgcagtcccacacctggcggaagcaggagcccaaggagccgcagcccacaggatcaggtgatgagcccaccacctaaggataacggcgacaggaatggttcagaccgtggcgacagccccagagggagggaaaacagcaggagccgcagccgcagccgcagcccatccgg

SEQ ID NO: 2343 - DNA, 415 bp, Zea mays
  unsure at all n locations
  Clone ID: LIB143-019-Q1-E1-B11
gaaggccacagagcgaaggaattgcagagttttcttggcgcgaaagaaggggagagagagagagaaagacgaagatgtttatccagaaggcatggaggacggcggcgtttgggctctacggcttcaaccatttcacaaaatctggtttcctggagcatgcgaagaaattcagagaggaggatatgcagatccggttggatggaaaaaattgcctagtaactggagcgaattctggcattggttttgctacggctgagggcttggcttcacatggtgctaccgtctatatggtctgtcgtaacaaggagagatgggaggcagctctcaaccaaataagatccaaaactggcaatgcacacgttcatctggagatatgtgacctttcatctatcantcaagtaaaatcgtttgcaac

SEQ ID NO: 2344 - DNA, 417 bp, Zea mays
  Clone ID: LIB143-019-Q1-E1-B12
gctcacactccggcagccgagcgatcgagctccccggtcgctagcacagccggccactgcacacgacggtgctggtaggttgcaagcacttgcaggatggcgcaggtcgctaagacgcttctccttgtggccctggtggtcgtgtcggcggtggagctgtgccgcgccatcgagttcgacgagcgggacctggcatcggacgaggcgctgtgggacctgtacgagcggtggcagacgcaccaccgggtgcaccggcaccacggcgagaagggccgccggttcgggaccttcaaggagaacgcgcgcttcatccacgcgcacaacaagcgcggcgaccgaccctaccgcctccgcctgaaccgcttcggcgacatgggccgtgaggaattccgttccgggttcgccgactcgcgcatc

SEQ ID NO: 2345 - DNA, 285 bp, Zea mays
  Clone ID: LIB143-019-Q1-E1-B3
gcggcgcgccgcacaacaacaccatcaagctcgggaacgccgtcatattcgggccggatgatacgccgtgggacggtggcacgtgcaagcttaccttgcagtttacagaagattatccacacaagccaccaactgttcgatttgtctctacgctgtttcatccaggtatatatgctgatggactcatctgtttggatatcctacagaaccaatggagtcccatatatgaagttgctgcagatttaacttctatccagtctctgctgtgtgattcatacccaaact

SEQ ID NO: 2346 - DNA, 324 bp, Zea mays
  Clone ID: LIB143-019-Q1-E1-B4
agctggcttctccacaccctcttatcaagtcctcctcgggttatggttccttagggttttgtggacgggcgatggctgcggctgatgtggagtaccgttgcttcgtcggcggacttgcctgggccaccagcaacgagtcgctggagaatgccttcgcctcctacggcgagatcctcgactccaacgtcatcaccgaccgggagacggggaagtcccgcggcttcggcttcgttaccttctcctccgagaactccatgctcgacgctatctagaacatgaacggcaacgagctcgacggccgtaacatcaccgttgaccaggccc

SEQ ID NO: 2347 - DNA, 308 bp, Zea mays
  Clone ID: LIB143-019-Q1-E1-B5
agctcgcactccgtgcagccgcagcggatcgagctccccgggtcgctatcagaggcggccactgcacacgacggtgctggtatgttgcaagcacgtgcaggatggcgcaggtcgcgaacacgcttctccctgtgagcctgatggtcgtgtcggctgtggagctgtgccgcgccatcgagttcggcgaacgacatctggcatcggacgaagcgctgtgggacctgtgagagcggtgtcagacgcaccatcgggtgcaccgggaccatcggcataagggccgcctgttcgggaccttcaatgagaacgcg

SEQ ID NO: 2348 - DNA, 424 bp, Zea mays
  Clone ID: LIB143-019-Q1-E1-A10
acatcgcaccaagccaccagtccgcagcacgaaagcttccccccctctcttctcctgctggttggctcatcaggcctgcccgaataatcctcctgcggattcccctcacggcaggccaaaacccgcacctttcccccgtcgacagattctcaaacccggcgaactccgggcagggctcacgtcgccgatcccgctcccggattctctttgccgccgcgaggagacggcgtccagtccaggccttcagcagctccgtctccgtgtgtatctgatcgggggattctttgcttgagaaactgctagcatgggcgcggtgcttggacggcatgacacgcacaagcggagttcccatggttcgaagctggaggtaaagatggtcgacgctatgcagcagagagcatcgcatggaacctcactgaaatcg

SEQ ID NO: 2349 - DNA, 422 bp, Zea mays
  unsure at all n locations
  Clone ID: LIB143-018-Q1-E1-G4
ggtcgacgacgcgtccacggacgagtggggtcccctttcctccactggaatttaaccctcctggtgctccgtccaactcccccgctccgggccgccggcggcggcccaagccacgttctgaaggtttcgttggtctcttcgcccgcgacgagcacccagcagttctgtaaaaatggctgatggtgaggacatccagcctcttgtctgcgacaatggcactggaatggtcaaggctggttttgctggcgatgatgcaccaagggcggttttccctagcattgttggccgtcctcgccacactggtgtcatggtanggatgggacagaaggacgcatatgttggcgatgaggcacagtccaagagaggtattcttacgctcaagtacccgattgagcacggtattgtgagcaactgggatgaca

SEQ ID NO: 2350 - DNA, 402 bp, Zea mays
  Clone ID: LIB143-018-Q1-E1-G5
cccacgcgtccgcccacgcgtccgggtggatccaacatgtatagttcatatggtggatttggcaacacttatggtaccggtggactcggaaatagcatgtactcgagttacggaggaggttatggtggtggcatgtacggtggtggcatgtatggaggcggcatgtatggtgggatgggaggttatggtggttatggcatgggcggaatgggtggtatgggcatgggtccatacggtaatcaggatccaaattcgatgggccctcctgcatccccgccaggcttctgggtgtccttcctccgagtgatgcatggtgttgtcaatttcttcggacgaatctcattccttgttgaacagaatactcaagcatcctatttcttcatgacagcaatgctgcagctc

SEQ ID NO: 2351 - DNA, 408 bp, Zea mays
  Clone ID: LIB143-018-Q1-E1-G6
ctcaaaactggcaactcttccaccacccaatagtgtacttgaagtgctcctgattaactgtttattaagttccttgcttggttcatggctataattcagagtctccttataattgcttctcgcaagcactactcggtcgatgttgttgttgcgtggtacactgtaaacttagtagtattctttgtcgacaacaagctgccagaaatgccggatcggacgagtggactacatttgcttccattaagctccaaagaaaaagagggcaggcagaaggaggagaaagacagtaaactgaaggacgagttccacaagttactgaatgggaaccatgcggatcctactgatcggcgacagcgggcacagatgaacgggaggcacgacgaagacatcaatcacgcgctctccgag

SEQ ID NO: 2352 - DNA, 103 bp, Zea mays
  Clone ID: LIB143-018-Q1-E1-G7
cccacacgtccaaggacgcttgtgcgaacgcgtagagcaccttggtgggaatacaaatcaacggtggacaatgaatacgtcattagcctcatgtaccggaaga

SEQ ID NO: 2353 - DNA, 413 bp, Zea mays
  Clone ID: LIB143-018-Q1-E1-G9
gaaaaagagcaaccatgtcacgaggaagcttgagaagcgcaaggagggacgtacccttgacccacacattgaggagcaatttggcagtggacggttgctggcatgcatttcttcccgccctggacagtgtggccgtgctgatgggtacatccttgagggtaaagagcttgagttctacatgaagaagctacagaggaagaagggcaagagcgctgtagcttagagcattctcatggattgtcttgcaccgaaatgtgtgtcctgatgagtacactttttttggttagtcgtctcaagttcagagcgttatgccatgttttcagacctgattagtacactcttttctaaaagcgattgagctctagtccaatgtattgataatatctgctgttgtcctattgcggtgatgttta

SEQ ID NO: 2354 - DNA, 412 bp, Zea mays
  Clone ID: LIB143-018-Q1-E1-H11
ggatgacatgctgatgtttgactataatgttgaagaatgagttaatgatttttgttgctgcagccatagaacaggtaaactttcaatattgttgccacagactgtagttcactagagcaattaactatgcttcgttcaaagtaagaaaattggatttaattaacttgtgatgatcaggcaaactttacgcgtacaaaccacataatttggaccatgggagataattttagttacaatatatagaatcttggttccggaatatggacaaacttatctatcgcgtgaacaaggtattgctgattttaaactgaagctctcaagttttgatacacagttttcttgtttagctgtcattttaatttacctttctgcaatgatactactacatacaaaatcttttttctatgagatg

SEQ ID NO: 2355 - DNA, 409 bp, Zea mays
  Clone ID: LIB143-018-Q1-E1-H2
cggacgagtgggcggacgcgtgggcgagtacgggagaacgcatgtggtgaggcccaagggcacgcacaaggccaccattgtctggctccatggacttggggacaatggagccagctggtctcaactactggaaactcttccccttcctaatataaaatggatatgccccactgcaccttcaagacccgtgtcagtgtttggcgggttcccctccacagcatggtttgatgttgctgatctttctgaggatgctcctgatgacattgagggaatcgatgcctcagcagcacatgttgcgaatttgttgtcaactgaacctgctgacatcaaacttggtgttggcggctttagtatgggtgctgctactgctctgtactctgcaacttgctttgcccatggaaaatatggg

SEQ ID NO: 2356 - DNA, 407 bp, Zea mays
  unsure at all n locations
  Clone ID: LIB143-018-Q1-E1-H3
cgctcatcaatcgccagaggagttgttgatcgaggtgagtgaggttgaaaagcacaccatcgtcatggacggcggatactacggcggtcgcgatcagcgctacagcggcgggtactacggcggcggtggcatcgcaacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgacgggaaaggtgtgcctgcccccgggaaccccaaaggccaattacagcactggatcaaggacatgcggtggagcacgagcatcaaggacgangaaggttacccggcgttcgcgctggtgaacaaggcga

SEQ ID NO: 2357 - DNA, 406 bp, Zea mays
  Clone ID: LIB143-018-Q1-E1-H4
cggaaatgataacacattaaacctttggacacccgatccaaatgcaaaatcaagggttgctggacaaaaacttgatgtattaagtgccatagagaataaccagcggacgttatgtcggaagcgtcaaattgtactgccttttgaatttttggaacgagttcggatgcgagagttttcagaaagtttcgagtgtaaccagagctgatttactatcgctggagttgctgaggaaaagggtaatagttggaagaatgatatcatccaagctacaagcagcctatgtttgaagtagtgaaatcgcaaggccttgctacgaatagagtgtagacacacctggatagataagcaggtgtgctggtgctgaaactattacttgagatgtcaataaacattggaattatgttgt

SEQ ID NO: 2358 - DNA, 410 bp, Zea mays
  Clone ID: LIB143-018-Q1-E1-H5
ctttcccccgtcctccctcgccttcgccttcgccggcaggagatttccaccaccaccgccgaaccgccccgaccctcctcccctctcgcgctatggcccagactgttgtgctcaaggttggcatgtcctgtgagggctgtgttggagctgtcaagcgggtcctcggcaagatggaaggcgtcgagtcctacgacgtagacatcatggaacaagaaggtcaccttaaagggcattgtgaaacttgacgccgttctggaaactggttccaaggactggcaaagaagaactccggtcctgggaaggctgaaggccgtgacaggttaatccgccacaactgccggtgccaccgcctgacaggttcgatgatctggaagtgcccggcaaggcggcaaagaaaaaaaatgtgaatg

SEQ ID NO: 2359 - DNA, 192 bp, Zea mays
  Clone ID: LIB143-018-Q1-E1-H6
aaaattcaacagtcatcactcgcattacgccttcaccaggaggaaaatgtcaaaagacaaagccgaagacgcacaaggactcatcacctcgcgcgccagcgagacagactgtagtgcccaaagttgacatgtcatgggagaggctgtgttggaggctgtagagccgatccgcgggtgtagggaaggcgtcaa

SEQ ID NO: 2360 - DNA, 406 bp, Zea mays
  Clone ID: LIB143-018-Q1-E1-H7
atccattcacctccccccacgctgccaggagctctgcccggcccccgggtgccgaacgaccaccaggttcacccgtgtctgccgccggcggatgcccccctcccccggtggctaggagctccattcgtgctgccgtcgtgtgctgctgggcgtctcccccaatggtgttacagcatgggcattagagcactcaatgacggacggggagctactctggcgcgcatcgttcaccccggcagtacctattctgacgcgtatggtaggtggccatcatgttcctcacgcaagggcaggtgcaactcgggaggtgcctcactactgcatctacgtccacacgctatcggccaatttcaccttcaaatccatcttcccccaacgccaaatacccagtaaggctaggccacat

SEQ ID NO: 2361 - DNA, 419 bp, Zea mays
  unsure at all n locations
  Clone ID: LIB143-018-Q1-E1-H8
cacgcgtccactcacctccattccaagcacatattcccggcccggcagctcaccaactaccttgcacttcaattcatcttatcgcggcacgcacagatatatatagattagtacctagctagatgctcatttagctgcagaggcgccatgattggggtgcgcattgtcagttataagtctctgatcatggtgctactgctggtgctcctcgtctgcgttgtctcgccggcgacggccgcggccggccgggcggaggaggcgcacctggtgcccgcgttgtacgtgttcggcgactccaccgtggacgtgggcaacaaccagtacctgccggggaactccgcgccgcagctcccctacggcatcgatttcncgcactctcgggccaccgggcgcttcagcaacggctacaacgtcgccga

SEQ ID NO: 2362 - DNA, 413 bp, Zea mays
  Clone ID: LIB143-018-Q1-E1-H9
aggacgcgtgggcggacgcgtgggcggacgcgtgggaaaaaaacaaaaagaaacattgagttgccttcacccggcttctcttgagaaaatacaaggcgttaagaaattctttagaaaggcatattattactacatatagagctaggagtagatcttcatccgaacccctccaacgacgactaggtcggcgttttctctccctgctgtttcagcttaaaaactagatgtaccaaacatgctatctgagcaccgcactgatacaacctttgatagtctgcgttttctctcgctgctgtttcagggcaagagaggaggcactctgactgtcactctgagcttcgcgtcacctgagtactgacggacgacatgggagaagttgaggacatgtacacccaagacgggaccgtggacat

SEQ ID NO: 2363 - DNA, 89 bp, Zea mays
  Clone ID: LIB143-019-Q1-E1-A1
ccaaacgtccgaatgcaaaaccgtgtgacacaattaaccccgacaaaaaaggaatttgagggaacaaccccaaaacaggttccgaaaaa

SEQ ID NO: 2364 - DNA, 367 bp, Zea mays
  Clone ID: LIB143-037-Q1-E1-E6
acacacgtcaccagcgtgtcaggcgtcttccgtcaccgtttgtcttgaaggttctggaccccgcgagcgtcttctcctctgctccttggtgcttcgtcctcctcccacgtgtgtgcgcctggacgacacaagcttaggggtcaacggctaccagcgctacgatcatgtgtgaccaatcgctgcttgcgatttgcaaaccgccggatcaaggcgtgtgagcatacctttagatggcaaagggacggaagccgaagagggcatcatattctgtagtctctatccatttgttggcaacataaatgagccaatcgtatcagaaactttatccagagcaatctaaagccacctctcgagtgtaaggatgtca

SEQ ID NO: 2365 - DNA, 413 bp, Zea mays
  Clone ID: LIB143-037-Q1-E1-E8
aggaaactcgcacgcacgcactctcttccccccctcctgcccactctccaacgcagcacaagcatctagcaaagctgcgcagcgcagccagcaagcaagcttggtccggagagacaacagatataagccagccagagagcagcagacggaggcatggcgacgtccgtggcctgcgccttcttcttcgacgcggagccgctgggcgagcccgggcggcacgcgctggacgcctgcgcgctctgcgccaagccgctcagccgcaacagcgacatcttcatgtacaagggcgacaccccgttctgcagcgaggactgccgctatgagcagatgcaccacgacgcggcgtacgcaaggcaggcggccagcagccggcggaagcagcagcagtcgcagcggagcagaggggcctcgtc

SEQ ID NO: 2366 - DNA, 388 bp, Zea mays
  Clone ID: LIB143-037-Q1-E1-E9
agcgtccacaatacactcaagtcaaggattcctctgctaatccaccaccatcgcctggaactacttatggtcctgttgggtctatatcaaaggtttatgctccccacacgcttatccgatccccggcttctgcagctgctggcatgcaagcgtcataatgagacacggttgagagcattagtcctctctgtcatgaagatagttcttgggcaatcttctcaggtttttctaccattggcggaatgaggtctcgattcttttttgctccagttcgacttcccggcaattgtgaataaaggctgcagctgacatagaaaagtctcaataaatgcaaagataggaattggcaagctcaatcactttgccatttttctgtccatctcggaaa

SEQ ID NO: 2367 - DNA, 414 bp, Zea mays
  unsure at all n locations
  Clone ID: LIB143-037-Q1-E1-F1
gtcgacgcggggggccaggcgttccagttctactcggagggcgtgttcacgggcgactgcggtacggacctggaccacggcgtggcggcggtcggctacggcgtcggcgacgacggcacgccctactggatcgtcaagaactcctggggcacctcctggggcgagggtggctacatccggatgcagcgcggcgccggcaacggcggcctctgcggcatcgccatggaggcgtccttccccatcaagacctcgcccaaccctgcagacccgccgcgcaagccccgccgcgcgctcatcgccagggacacctcttcttcccagtgacacacacgaccacaactggcacgtaagtacacgttgccaggaatgacatgctatgctactagtgtntgcttgaactattatcgattgggt

SEQ ID NO: 2368 - DNA, 381 bp, Zea mays
  Clone ID: LIB143-037-Q1-E1-F10
cgacaactaaaaagaaacggagggagtgctaatttgtgaattcttctacagtctgatgaagatatggaacttgaacaatttcactggtgtcattggagtgttcaattgtcagggagctggacagtgggtttggccagttaaacaaactgcttatgttcctaccaacataaacataactggtcagctctcaccgtccgacgtagaatctctcaaggagatagctggtgatgactggaatggggagactgcagtatatgctttcggttcatgtaaatatttgttggctgactgtttctttctaacaatcccatcgtaccactatactatcagtgactgattagccatctgttttgtctcccaggttctctttcaaggcttcag

SEQ ID NO: 2369 - DNA, 126 bp, Zea mays
  Clone ID: LIB143-037-Q1-E1-F11
gggccgactcaggcgtcgacgacagctatcgagacgcggagggagtgctaacttgtgaatacgtcaatcgacggatgaacatattgaacttgagcagcttcacgggcgtcacaggagtgttccttg

SEQ ID NO: 2370 - DNA, 414 bp, Zea mays
  Clone ID: LIB143-037-Q1-E1-F12
ctcattattattctcactggtcgatctgctaacacaaacagcagcagctcctcctcactagctagccttctctatttttgctactgcaagtgtccaagtctgcgacgacgtccgagatgtcgacggtgagccgtgcatcccttgaccagaagcttgccctcgccaagcgctgctcccgagaggcgactcttgccggagctaaggcggcagcagtggcgactatcgcctccgcgattcccaccctcgcgagcgtgcggatgctgccgtgggccaaggccaacatcaaccccaccggccaggcgctcatcgtctccacggtggccgggatggcctacttcatcgccgccgacaagaagatcctgtcgctggcgaggcgccactcgttcgaggaagctccggagcacctcaagaaca

SEQ ID NO: 2371 - DNA, 433 bp, Zea mays
  Clone ID: LIB143-037-Q1-E1-F3
cgggtcgagcacgcgtccgattaaattctcgttgacaagaagactagaaccgaacctgaccatgtcgctgatccgccgcagcaacgtgttcgatcccttctccctcgacctctgggacccctttgagggcttccccttcggctccggcagcagcagcagtctcttcccctcgttcccgcggaccagctcggagaccgcggccttcgctggcgcgcggatcgactggaaggagactccagaggcgcacgtgttcaaggcagacgtaccggggctgaagaaggaggaggtcaaggtggaggtcgaggacggcaacgtccttcagatcagcggcgagcgcaacaaggagcaggaggagaagacggacacctggcaccgcgtggagcggagcagcgggagattcctgcgcaggttccgactgcccgagaacgccaag

SEQ ID NO: 2372 - DNA, 417 bp, Zea mays
  Clone ID: LIB143-037-Q1-E1-F4
gcgtccggagaaattccctcctgttcctcttctgaggtcctacctggaggactctaagaagacgacaaccgccgcttcagataattcaagcactagcatcagcgggcaatcagggagcaactcgaacaagaaagagcagtctgcactgcgagctgtcatcaagtgtgtcgaggaccgtaatcttgaagctgagtttccactggatgatctccggaagcaactcgaagagctggagaaagccaagaccgagaagaagaacgcggcatcaagcgctaccagtggcggcagcagcagcgggcctgcaaccaagcgcatccgcgcgagcaacggaggcccaatgcctcgcggcaaggcaggtcgtctcgctaccaatgcctgcgcgtactctttcccagtctcaccacattcacccagtct

SEQ ID NO: 2373 - DNA, 364 bp, Zea mays
  Clone ID: LIB143-037-Q1-E1-F6
aatagtcacccactctactactcgatgttactaccagcagcttgcttcaacagtagaagatagcgagaggatggcgtcaccgaagccctcgtcggcggtcctgctcctcctggcggtagcggccgtgctggcgctggcgcgcgcggacctgatgcatcacagctgcttggcgaacaacaatgtgaccgtgcagaacttgtgcagccacgacgtgacgctgacgctggagccgctgggcaagagcccgccgctgttcgcgggcacctagacgctgcacccgctcagccacgccgagttcgccgtgtgctggtagacggggcgcctgcgcgcgcctgacgccggcctggtggcgttccacgtctgc

SEQ ID NO: 2374 - DNA, 408 bp, Zea mays
  unsure at all n locations
  Clone ID: LIB143-037-Q1-E1-F7
actaaaatcagccctcctctagtcctctttcatcgtgatgttgaccctccttcatcgtcagcttacaagtaacaaactgaccataaaaatgcaaggacagctgataactgccaagaaagaaaggggtcgaatttctcacccctttacggccaatgtactcggccatctgcccgctggcgatcgccccgaccatgccgccgacgttggacagcgatccgaacgccgagaactgcagagcgcgcgcggtgagtattcacgctcaagcacggttcttcaacanagaaaaaaaaaaagaatctaagagaggacggcctattggttacttcgttacctcggagatagagaggttgaggtcncgaaccatggcgtcctgngtcggggaggagaagccgctggtgaagccgaact

SEQ ID NO: 2375 - DNA, 408 bp, Zea mays
  Clone ID: LIB143-037-Q1-E1-F8
acggacgcgtgggcggacgcgtgggagcacacacggatcaatcacactcactcgcggccattgtcctgctcgtgcgtgctctgccttttcaggcgatcgaccaaccaacttctcgtcactgccatggctctgctctccgacctcatcaacctcgacctctcggaccgcaccgggaagatcatcgccgagtacatctgggttggcggttccgggatggacgtcaggagcaaagccagggtcagtagtagtacacgcttttgttcaccttcaatcttatccttatcttggcagtacgctgtccggacctgttgatgaccccagcaagcttccgaagtggaacttcgacggctccagcaccggccaagctccgggcgacgacagcgaagtcatcctttgccctcgggccat

SEQ ID NO: 2376 - DNA, 394 bp, Zea mays
  Clone ID: LIB143-037-Q1-E1-F9
aagagcgtcgcctcattccgacttccgatccccaacggaaagcggagccaggaccgggagctggagcagttgtcttcccccctcgtctccgtcaactggtctttaattctctctttacacatatcttggtatttaattctctcatcaccagcgtaagaaaaaaccatttgaagctaaatttttcaacaagccacttgagaactaccattacatggctgttatatttgggaatcatcaagcaactggactatttgcaaaatgcaccagtgatcccctacgtttcgacacatctgaaagtgcaggtacatatggtgtgggttattctggagacttggctggtcatgagagtaacaatgcaagtccaactcgtgatagtggaaaatcattggaacca

SEQ ID NO: 2377 - DNA, 198 bp, Zea mays
  Clone ID: LIB143-037-Q1-E1-G1
cgggcgtccgctgtaacgcgctaatacggggccgctctgatgagggtctctgctctgccgatacgcgctgatcgccggcgatcgtgatgagcatgtcacggctatgctatcacgttctccacagtccaaatagctcgcctacggatgagcacgatatggcatcagtccgtctgagttcgccgatatctcattgatcta

SEQ ID NO: 2378 - DNA, 414 bp, Zea mays
  unsure at all n locations
  Clone ID: LIB143-037-Q1-E1-G10
acttgatcaaggtcactgtggctcttgttgggcttttggtgctgtggagtgcctccaggaccgtttttgcattcacctcaacatgagcattttactttcagtcaatgacctactggcatgctgcggttttatgtgcggcgatgggtgtgatggaggctatcctatagaggcatggcgctactttgttcaaaatggtgttgttacggatgagtgtgatccatacttcgacccggtcggttgcaagcatcctggatgcgaacctgcttatcctacaccaaagtgtgaaaagaaatgcaaggagcagaaccaagtttggcatgaaaagaagcatttcagcattgatgcgtacagaataaattcagatccacatgacataatggcagaggtctacanaaatggtcctgtagaagttgc

SEQ ID NO: 2379 - DNA, 409 bp, Zea mays
  unsure at all n locations
  Clone ID: LIB143-037-Q1-E1-E5
ggcagatctagggcgatcatggcttacgtcgagagaggtgttgtgaaagacaaacggactatatggcgactgagcataatctcagacttcttctgggccattgtgagctttatcagaatcttctttgacacactgttctcattggacaaaactgacaacttcaagaaagggtatggtgctggtaagaagtgggatggtggacctggtggtggtgggcggggcccatatggcggtggaggaggtggaggattcggcggcggaggtggaggtggttcacggngtcctcgcactctatctgacatccaatccaatgaccacagttctctccctgcttgtggatcctgctgtggctaataagcgtgcaaccgttccgcctgatgactacgtataacanatgaatacacatgct

SEQ ID NO: 2380 - DNA, 417 bp, Zea mays
  Clone ID: LIB143-037-Q1-E1-C9
cgggccgacccaaacgtcaattcatggggaaaagaccagtggtctagttaagcacacgggcgctagttctggtattggtttggcttccattgtcatttctcttagatgctggagtttgtggccaatttatttgcggaaaggggaaaaaaactttcaggtcttgtgcttcactaccatgagggtatttgttacttcccagtgtaaaatttgcataagtagtttaggtggtgtttgaatgcgctaaagctaatagttagccgctaaaattagctgaagacttccaaacagtctagctaatagttcagctattagctacttttagcaaattagctaatagttgctagctaattccactagtaatttttttgtcaactaactattaggtctagtgccttcaaacaacccccttagtacatc

SEQ ID NO: 2381 - DNA, 277 bp, Zea mays
  Clone ID: LIB143-037-Q1-E1-D1
ctctcgtcttccagacgcctcgaatctgggctcccagcggccagcgtctcggaaaagaggagcagcacggcacggcggcgatggcgaggaacgctccaataatatgctaacccgttctatccagtccaattagcagcctcccaaggagaatgagatccaatcctgcgggcgggcgtcccccgtatcgcatccatcgatacgaatctcggaatctgaccctgcggcacggcttcttcgtggagaagaggttgctgtcgaagccatcgcgaggtagcca

SEQ ID NO: 2382 - DNA, 398 bp, Zea mays
  Clone ID: LIB143-037-Q1-E1-D10
aagcaagatggtccttgatgactggaagaggctatactcaaacacaaagaccaacttccgggaggttgccatcaaaggtttctgggacatgtatgacccagagggctactctctgtggttctgtgactacaagtacaatgacgagaacaccgtctcctttgtgaccctgaacaaggttggtggattcctgcagcggatggacctgtgccgcaagtacgcctttggcaagatgctcgtggtaggttctgagccacccttcaagctgaacggcctttggctcttccgtggccaggaggttcccaagtttgtaatggatgaggtctatgacatggagctctacgagtggaccaaggtcgacatctctgatgaggcccagaaggagcgtgtcaatgccatga

SEQ ID NO: 2383 - DNA, 407 bp, Zea mays
  Clone ID: LIB143-037-Q1-E1-D11
atgctcaacaacagagactgccaaggtcaaatatgttagaggagttgctgtgccactggggaaaacaaagtctcttgttgagagatgggaaaaaagagagacttctagcactgattattcaccacaaactggttcttgtggtgatcgggcatcgagaaatgacaaccatccattccatctggcggaaccaagtacaacatttgaaaaggacctgtcaactgtagatgaagcgatggctcctgtcaatttagtgcggaaccatgatgaattcctaaatgctgtaaaacttcggctgacaaaactagagatgatgcggcatgtctttgaacaaagtggtattaaaggagcaattgctgcagtggcaaagctacctgacaatgctgttcaagcagatgttgttagtgctc

SEQ ID NO: 2384 - DNA, 414 bp, Zea mays
  Clone ID: LIB143-037-Q1-E1-D2
atctcctatcaaatcgacaagtgatgaacaatggaatgaccttgtggaacattggaaaggtccaaaaaatatggcgacatgtgaacataacaaaggcaaccgaggcaaagttaagttccatcaaacaactggatctcgtagctatatggttcatgtagaaaatttgggggacaagtacatggatcaagaacctgatgcattggatctgttcaaggagtgccactacagtaagaaaaagcaaggctacacttccactactcaaatggaagacaagcgatctacaccaggagaaggtgaacaaccaatgtctacgactcaggttgtagctgatgtgcttgctgagaacacaaagaagaatcggtttcttcaaaatgtgggaatccaaaatgcacgacctagatctagtgtacaaaa

SEQ ID NO: 2385 - DNA, 343 bp, Zea mays
  Clone ID: LIB143-037-Q1-E1-D5
cgagatggcacagcagcaggagccaaacacgtccgcaatgccgccctccttcctcctggcgcttgcgcctgcgagcgccactcgcatttcctcccactgccttctccacccataatcttctccgcttcggcgccaaccccaaccaccttgtacagtctccatacacactacgtcaccgctcggctccatggccgccatccccgcgcggctccaccacctcgtcgtcgtcatcctcctcctcgtgtcgtccctcaccgctgctcagtcacgcgcattcgaacgggcgccgccggcgtacacgcggtacctggtcgacgcggcggctatgccggcggtggacctg

SEQ ID NO: 2386 - DNA, 402 bp, Zea mays
  Clone ID: LIB143-037-Q1-E1-D6
agtcccgcctcggcactcgacggccgccggcacacaccgcgcagtctcgagacaggaaccggaggaacgaggatggaggatgactcgccgctgacgaagacgatgaagggtgcggtgacaggactcgccgcggggaccatctggggcaccgtcgtcgccacctggtacgacgtgccccgtgtggagcgccacgtcgcgctccctggccttatccggacgctcaagatgtgcggcacctacggggccaccttcgccaccatcgggggcctctacatcggcgtcgagcagctcgtgcagagccagcgcaagaagcgcgacttcgtcaacggggccgtcggcacgttcgttgccagagcctctgtctgcggctacagaggaaagagtattcagtcagccttcatc

SEQ ID NO: 2387 - DNA, 185 bp, Zea mays
  Clone ID: LIB143-037-Q1-E1-D8
tacaggtcaaggaattcccgggctctacatacatgcaaggagatcaggatataatcctcttgtcagtctaaagttctgccctggttccctgctaactggtttgattggccttgccgcttattatctcagttccctatgaacgccttatggctgttgtatgatccataaattatgctaattatatt

SEQ ID NO: 2388 - DNA, 413 bp, Zea mays
  Clone ID: LIB143-037-Q1-E1-D9
aataccacgaccgcaagcagcgggaggcgcgcatgtcgctgccccgcgccgagcgcgcgcgggcgccgtacgtcgacttcctcaagcccatcatcgccgacggcgacacgggcttcggcggcgccacggccaccgtcaagctctgcaagctcttcgtggagcgcggggcggccggggtccacctcgaggaccagtcctccgtcaccaagaagtgcggccacatggcgggcaaggtgctcgtcgccgtctccgagcacgtgaaccgcctcgtcgccgcgcggctccagttcgacgtcatgggcgtcgagaccgtcctcgtcgcgcgcaccgacgccgtcgccgccacgctcatccagaccaacgtcgacgcgcgcgagcacgagttcatagtcggcgccaccaacccgggcctc

SEQ ID NO: 2389 - DNA, 412 bp, Zea mays
  unsure at all n locations
  Clone ID: LIB143-037-Q1-E1-E1
catctctgagccggtctcccggcagcagcagtccctcgggttgtccacgcggagcgccagccgatggccggccacagtatgtcggttcacccgaagcctataaattcctcgccgccccgcctctcgccgcccatttccctccgccgcctcctaatcctcaacacccgcgcccccaaccgcgcccgtcgtatgccaccatgcaccgcgcccgccccaccgcgcacgctaatgaccccgatgctccgtacgccgccgccgtcgcgatgctgctggagcccaaactcgaggacgaggagttgccgctgcagcagctggcgtcnccgggccccttcgtgtcnctggaccagctgatgccggcggtggccgtgccggccgaaccgcgcccgctggaggcgctgctgcaaggcccgca

SEQ ID NO: 2390 - DNA, 411 bp, Zea mays
  Clone ID: LIB143-037-Q1-E1-E10
ctcagccaaggactggagaggtggcagggctgccagctttaacatcattcccagcagcaccggtgctgccaaggctgtcggtaaggttcttcctgaattgaatggcaagctcactggcatgtccttccgggttcccaccgtggatgtgtcagttgttgacctcactgtcagaatcgagaagggggcctcttacgaggaaatcaagaaagctattaaggctgcttctgagggcccactcaagggtattatgggctacgtggaggaggatctggtttccaccgacttcaccggtgacagcaggtcgagcatcttcgacgccaaggccgggattgccctgaacgaccacttcatcaagctcgtctcttggtacgacaacgagtggggctacagcaaccgcgtcgtcgacctgat

SEQ ID NO: 2391 - DNA, 409 bp, Zea mays
  unsure at all n locations
  Clone ID: LIB143-037-Q1-E1-E11
accagatcggcgacgccgcagggcacgagggtgccagcgtgaaggaggaggacctcatccagccgccgcggggcgcgcgcactgtggacggtctgcggctcaacgtccgcgtgggcgtgcagtacctcgcggcgtggctggccggctccggctccgtcccgctgtacaacctgatggaggacgcggctacggcggagatcagccgcgtccagaactggcagtggctgcgccacggagcggcgctggacgccggcggcgtggaggtgcgcgcgacgccagagctactcgcacgcgtcgtcgaggaggagatggcgagggtcgaggctgaggtcggccccgacaggttccganaggggcggtacgcggaggcgggcaggatcttcagccggcagtgcaccgcgccggagct

SEQ ID NO: 2392 - DNA, 415 bp, Zea mays
  Clone ID: LIB143-037-Q1-E1-E12
cggacgcgtgggctttaggttgcttgagtcaaacataaatgagcatagttctgaggaagatatccggagcgtgccaaattctgtacatcacaacaatgagatagagtctgattctccacctcacgtctgtgagatagaaagtgtgaaaagcaaccaagaagggtaccaatcttcggatggtcgtgctttccccaagacaagatctgagcgaagcattgaccaatgggtatttgcaaagtcaaaatctgaagaaagcatggatcagtggtctgaaataccttcagatgtggaatccttcagagaaggtaaaaggtacctcagtagcgaggagctgagtgacgttgatagtgccaacgttgttgtcatggacaaatacatggattcactcctctctgaccggaggaaccttccctac

SEQ ID NO: 2393 - DNA, 410 bp, Zea mays
  Clone ID: LIB143-037-Q1-E1-E2
gcacaaacggctcaatcacactcactcgcggccattgtcctgctcgtgcgtgctctgccttttcacgcgatcgaccagccaacttctcgtcagtgccatggctctgctctccgacctcatcaagctcgacctctcggaccgcaccgggaagataatcgccgagtacatctgggttggcggttccgggatggacgtcaggagcaaagccaggacgctgtcgcgacctgttgatgaccccagcaagcttccgaagtggaacttcgacggctccagcaccggccaagctcctggcgacgacagcgaactcatcctttgccctcgggccatcttcagggacccgttcaggaatgggcataacatactggtcatgtgcgactgctacgagccgaacggggagccgatcccgagca

SEQ ID NO: 2394 - DNA, 404 bp, Zea mays
  unsure at all n locations
  Clone ID: LIB143-037-Q1-E1-C7
ctctcggtctcggactacggttgagcgaactcgtcactgtaatctactgatctgcacatggcagaggcggaggctacggtggggcgactgatgctgtactcgtactggcgcatctcgtgctcccaccgtgcctgcatcgctctcaatctcaaatgtgtggattacgagtacaatgctgtgaaccttctcaatggcgagcactctgatccacaattcgtcaagcttaatcctatgaagttcgtccctgcgttagttgatggcatttctgtaatatgtgactcttagacgataacactgtatttggaggacacgtagtcataacctcctcttctacctcaagaccttcaatagaatgctttgaattaccagattgcaagcattgtagcttctggtantcaacctct

SEQ ID NO: 2395 - DNA, 413 bp, Zea mays
  Clone ID: LIB143-037-Q1-E1-B2
tgaaaggctgaggaacactccagctgattccatcaatcctaggatgatactacaagcactccaagagcttgagatggactcccccaagatctctgaaaatgaagatgttgggcatctgatcacaccccaggaagcctgcaaccgcatagcagaggtagtccaagaggccgtgagaaagatggagctcgtggcagaagaaaagatgcgactttacaagaaggctcgcctcgccgtggaggcctgcgaccgagagctggaggagaaggttagggaagcccaggagctgaaggcagagcgtcagcgcaagaagcagcaggtggaggagctggagagcatcgtgcggttgaagcaggcggaagcggagatgttccagctgaaggcgaacgaggcccggcaggaggcggagcgtctgc

SEQ ID NO: 2396 - DNA, 409 bp, Zea mays
  Clone ID: LIB143-037-Q1-E1-B3
ccacaacagcgaaggagaaagcagaccaacctagccacccagggagaaacgccaaaagggaagggagagtgtcgtcatggcttccattgtcgcttccaggagggccgttcctctagttcgcgctctggagaagctcatcgcagcgtcctccgcgcccgggactggctccgccctcaggccggtggcagtcgccggcggcctccgtggctacaacaccggcgctccgctccgacgctacgacggggccgagtcggaagacgatagcgtccgcgagtacgatgggcggcacggcggccgggactacgccgtgcccagcctgttctcagatattttccgtgatccgcttagtgcgccgcacagcattggccgcctgctgaacctgatggacgacttggcggtggcggcgcca

SEQ ID NO: 2397 - DNA, 409 bp, Zea mays
  Clone ID: LIB143-037-Q1-E1-B4
ccacaacagcgatggagaaagcagaccagcctagccacccagggagaaaggccaaaagggaggggagagtgtcgtcatggcttccattgtcgcttccaggagggccgttcctctagttcgcgctctggagaagctcatcgcagcgtcctccgcgcccgggactggctccgccctcaggccggtggcagtcgccggcggcctccgtggctacaacaccggcgctccgctccgacgctacgagggggccgagtcggaagacgatagcgtccgcgagtacgatgggcggcacggcggccgggactacgccgtgcccagcctgttctcagatattttccgtgatccgcttagtgcgccgcacagcattggccgcctgctgaacctgatggacgacttggcggtggcggcgcca

SEQ ID NO: 2398 - DNA, 374 bp, Zea mays
  Clone ID: LIB143-037-Q1-E1-B5
cttcttctcttctctgaattccagtccaagggccggaataccgtcagagcagagggagtgggaggaagaaaaaaaaaagatggtgaagctcgcatttggaagctttcgcgactctttgagcgccgcgtcgctcaaggcctatgtggccgagttcatcgccacgctgctcttcgtgttcgccggcgtcgggtccgccattgcctactcgcaattgacgaagggcggagctctggaccccgccggcctggtggacatcgccatcgcccatgcgttcgcgctcttcgtcggcgtctcaatagccgctaacatctccggcggacacctgaaccccgcgtcaccttcggcctccccgtcggcggccacatcaccatcct

SEQ ID NO: 2399 - DNA, 410 bp, Zea mays
  Clone ID: LIB143-037-Q1-E1-B6
ctcatctgaagcgcgcgagagacagacgcgtatacccaggcggcggttgaggaggaggagaagaagaagaagaagatggcttcctccgcgtacgcctcatggtccaagcggtggatccgtcccgaggtgtacccgctgttcgtgccgatggccgtggccctgggtatctgctcgtaccagcttgtgcgcaacatcacgggcaaccccgaggtgcgggtgaccaaggagaagagggcggccggcgtcctggacaaccacgacgagggcgagaggtacgccatgcacggcctcaggaagttcgtccgcgggaagaagcccgagatcatggcttccatcaactccttcttcgccgaccctcccaaggacgattaagctagattccgtcatggatggatgagtatgttttacaa

SEQ ID NO: 2400 - DNA, 380 bp, Zea mays
  Clone ID: LIB143-037-Q1-E1-B7
tccatatcggccagcggacacacatactctgtatatccattacggtgggtgatcgatgaggagaatgttatcataacatcgcttcctccgcgtacgccgcatggtccacgcggtggatccctcgcgaagtgtatccgctgttcgtgcgcatggccgtgggcctgggtatccgcgcgtatcagcttgtgcgcaacatcacggggaaacccgatgtgcgggtgaccaaggagaatagagcgggccgcgtcctggacaaacaagatcagcgaataggtacccatgcacgcggtcaggacaattctctgcggaaacagtcccgagatcattgccttgatcaactcattcttcgccgaatcactcaacgactattaagctagatt

SEQ ID NO: 2401 - DNA, 280 bp, Zea mays
  Clone ID: LIB143-037-Q1-E1-B8
acccacacgtccagtcagatgcgccacacgagatacataagcctacacccattccgcggttgaggatgacgagaataagatgaagaaaatgggttcctcggcatacgccgcatggtccaggcggtggatccgtcgcgaggtgtagccactggtcgtgccgatagtcgtgggcctgggtagctgctcgttacagcgtgtgcgcaacatcacgggaaaccatgaggtgcgggtgacaaatgagaataaggcggacggcgtcgtggataaccagcacgagggc

SEQ ID NO: 2402 - DNA, 399 bp, Zea mays
  Clone ID: LIB143-037-Q1-E1-B9
cgtccaagcagcagatcatcagcgacgagctcatgctggacggcaacccgcgcctgaacctggcgtccttcgtcaccacgtggatggagcccgagtgcgacaagctcatcatggactccatcaacaagaactacgtcgacatggacgagtaccccgtcaccactgagctccagaaccgctgcgtaaacatgatagctcacctgttcaacgcgccgatcaaggaggacgagaccgctataggggtcggaacagtgggatcctcggaagcgatcatgcttgcaggtctagcgttcaagaggaaatggcagaacaagaggaacgagcaggggaaaccgtgtgacagacccaacatcgtcaccggtgccaacgttcaggtctgctgggaaaatttggcagggt

SEQ ID NO: 2403 - DNA, 415 bp, Zea mays
  unsure at all n locations
  Clone ID: LIB143-037-Q1-E1-C1
acaagttcgcttctgccagtctgcctgcgtgctctgctggacagctggagagctagatggcgatgccgtccgggtggaggggtatcctgggcttccactacgggatcgtgcaagcgccgttgggccccgacatctccgggcccgagctcgtcgccgccgtaacgaacgccggcgccatcggcctcctccgcctccccgactggccggcgccggatcacgtcagagaactgatccggaagaccaggagcctcacgtccaagccgttcggggcggccatcgtgctggccttcncgcacgaagagaatctcanggtcgtcctggaggagaagctcgccgtgctgcaggtctactggggggacttcnnccaacaccgggtccaagaggcgcatcgcgccggggttaaggtcttgcatca

SEQ ID NO: 2404 - DNA, 314 bp, Zea mays
  Clone ID: LIB143-037-Q1-E1-C10
acacaaacgtctatacatggtgataagaccagtggtctaattaagcacacgggcgctagttctggtattggtttggcttccattgtcatttctcttacatgctggaatttgtggccactttatttgcggataggggaagaagactttcaggtcgtgtgcgtcactatcatggaggtatttgttacgtcgcagtgtaaaatttccataagtaattaaggtagtatttaaatgccctagaggtaatagttatccgcaaaaattacctgacgactttcaaacagtctacctaatagttcagctattatctactttta

SEQ ID NO: 2405 - DNA, 347 bp, Zea mays
  Clone ID: LIB143-037-Q1-E1-C11
agcttgagggtttcagcatcccgcggccaacctcctacaacgtcgagcgctctcagcccgtgcagcggctctaccgtccgaccgatgacgcggacctcgacgacatcgccgtctccgacgacgctcggtcagatgccccagccggcaccgcggtggatggaaaggcggagcatgacgaggagatcgacccgctcgacgccttcatggcggagatccaggaggagatccgcgcgccgcgagcgccgcccaaggacgaagcgcttcgccgcgcggactccggcgacgatgaacatggaccccggttgagagctttctgcgggccaagagggatgccgggctcacgctgg

SEQ ID NO: 2406 - DNA, 414 bp, Zea mays
  Clone ID: LIB143-037-Q1-E1-C12
accgatccccaattcctccttcggatctcgcattcagcgcagcgcaggtgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaggacaagatcagacctctttggaggcattacttccagaacacccagggtcttatttttgttgtggacagcaatgaccgtgaccgtgttgttgaagccagagatgagctccacaggatgctgaacgag

SEQ ID NO: 2407 - DNA, 375 bp, Zea mays
  unsure at all n locations
  Clone ID: LIB143-037-Q1-E1-C2
acaactacgcctctgccagtcagcctgcgtgctctgctggacagctggagagctagatggcgatgccgtccgggtagaggggtatcctgggcttccactacggcatcgtgcaggcgccgttgggccccgacatctccggcaccgagctcgtcgccgccgtancgaacgccggcgccatctgcctcctccgcctcgccaactggtcggcgccggatcacgtcagaaaactgatccggaagaccatgagcctcacgtccaagccgttccgggcggccatcgtgctggccttcacgcacgatgagaatctcacggtcgtcctggaggagaagctcgccgtgctgcaggtctacaggggggacttctcgcaacaccggg

SEQ ID NO: 2408 - DNA, 320 bp, Zea mays
  Clone ID: LIB143-037-Q1-E1-C4
aggacaatctgtcttcgcgacgctgagccacaagaatctcgagagaactgacgctcgaaatgctgcaggaaataccataggtgcaagtcggaagggttttgcaagtggaacggaagcaatggcttctactgcagtaattggggcatctgtcatgcaggctgcaaactccactgtatacgtactgagtcataaggtactcatcgggcttattgtccgtgctatgctcgtgtactggatcacatcacagctcatgaacagtgtgcagcagtgaagctctaaagatcgtggtagaagttcatcagcagttcaacatgagccct

SEQ ID NO: 2409 - DNA, 250 bp, Zea mays
  Clone ID: LIB143-037-Q1-E1-C5
tgctacggagaatttaacatgtgatgtggcgtcataccagagcaagccgccattgtcgtctccaatgttgtacttgtgcatcgtcaattgtacatctatatgtatcaatggattttagttgtacattctctgtaggcagtgctcatagggtgactgtagaatttcttatccccaattcagaattgcactgaatggctgaaatacagttgtctttcaaaagaaactgaaatatagtgatgctcactggctt

SEQ ID NO: 2410 - DNA, 409 bp, Zea mays
  Clone ID: LIB143-037-Q1-E1-C6
aatccagctctcccagcgcgctgctcgactcgactcgacttcctctgcaacgcgtgtccggtgtaggctgatagagtgagtgagaggcgagatgaggagcgggcggctggcggtggcagtggcggtggctctggcgtgggcgttcgcggcgtcagcggcggcggccgcacagaagtacaatgccatcttcaacttcggcgactccatcatcgacaccgggaacctctgcaccaacgggaggccgtctcagatcaccttcacgcagccgccctacggcgagacctacgtccgcacgccgacttgccgctgcagcgacggccgcgtcatcccggacttcctctgctccacgttcggcctgccgttcctgccgccgttcaagtccacgacggccgacttcaagaacggcgct

SEQ ID NO: 2411 - DNA, 410 bp, Zea mays
  Clone ID: LIB143-037-Q1-E1-B12
ggacaatttactggtagctggtgggtttcaaggagagctgatctgtaaacaccttgatcaggaaggtattagtttttgctgtcgaacaacttatgatgataatgctattacaaatgcggttgagatatttaatacctctagtggcgccgttcacttcatggcatcaaataacgactctggtgtgagatactatgacatggagagattccagctattcaagcattttcagtttgaatggccagtgaatcatgcttcgttgagtcctgacagaaaggtggttgttattgtgggtgatgatcctgatggtctacttattgatgcaaactctggaaagacagttcattccataaaaggacatcgggactactcatttgcatcggcttggagccctgatgggcgaacatttgcta

SEQ ID NO: 2412 - DNA, 390 bp, Zea mays
  unsure at all n locations
  Clone ID: LIB143-018-Q1-E1-E3
tttgcaccttccaaaccttgaaaccaccccggtatttctttcttggccaatggccctgaggaggatcaccaaggacctcaaggacctgcaaagggatccacccacgtcctgcagcgcagggcctgtgtccgacgacatgttccactggcaagcgacgatcatggggcccagcgacagcccctactcagggggcgtgttcctggtcgccatccacttccctccggactacccgttcaagcctcccaaagtggcgttcaagacgaangtgttccaccccaacatcaacagcaacggcagcatctgcctggacatcctcaaggagcagtggagccccgcgctgacngtctccaangtgctgctctccgtctgctccctgctcaccgaccccaa

SEQ ID NO: 2413 - DNA, 414 bp, Zea mays
  unsure at all n locations
  Clone ID: LIB143-018-Q1-E1-E4
acaaccacgttacgcaccatagaacatacccgtgagaagctaaaacccggccgtttgctcaccacagcatcatcgccgcgccttgctagctcaaggatggagaacaacaggcagcagcagcaggcgccgccgccgccaggctacccgactgcggctgcaggcttggagcatgagcanggaggcaggaatggacgacgccgggagaagacgacctcgcgcggggataaaggcttcatcgaacgatggtaactacttactactagactagaagctcttttttttttggcgccaaaaaacctgatcgatggatgagctgacctgtggtatttaatttattcggttcttaattaatgatctgtttcagcatcgcggcgctctgctgctgctggatctgccagatgtgctgcgactacg

SEQ ID NO: 2414 - DNA, 403 bp, Zea mays
  Clone ID: LIB143-018-Q1-E1-E5
aggagccacccaaggagaagcccccgccacctaaggaggagccgcccaaggagaagccacccccgcccaaggaggagccgcccaaggagaagcccgccccggcaccgcccaaggaggagaagcccgccccgccgccacccaaggtggtggaggtcccctacccgtggccgtacccgtacccgtaccctgcgtggccgtccgactgctgctgccaccacggccacggcgggtgccactgctgctcctgcggcaaggcccccgagccggtcccggcccccgccccggccccacccccgccgcagtacttcccgcagtacatgccccagccgtacccctgcaacccctgcggcggcggctaccggatcgtctgcgaggaggacccctcctacgcctgcgccatcat

SEQ ID NO: 2415 - DNA, 399 bp, Zea mays
  Clone ID: LIB143-018-Q1-E1-E6
ccagaggctggcctgcagtgggctttgggagctaacagtgattttattctttcttttgtccctagtttcttgttctccgcatcccccgaaatcacatgtttcattgtcgtaggaatagtccgtattatgaatgtacaataacaacataggccgtagggggaatgtagttgtgctgtttcagttcctgggctgtctgcctttcaggttgtatgctcgtgtcacatggaatcagtgaccgcatgcctaaatctgagttaagattgtatatcacataatagccgtgcaattcaactatgtagccctatgtacagaggcgccatatattgaagcatcttctggttgcaaaaaacatgaatgttgtataaatagtgtaactgaaggtatacaaatcttccaggc

SEQ ID NO: 2416 - DNA, 401 bp, Zea mays
  Clone ID: LIB143-018-Q1-E1-E7
cccacgcgtccgcgccccgccgccgcttcgacggcgcgccgaccggctaggacgcgcctccgacccggatagtgttccgctcggtcgaatccgacggccgctcgctgctgcagcgggcgcttgctgtgcgtcgcgtgggctcggctggaggcaggcggaacctttcctgggtctcggagatggcggcgcctccggcgaaggcccgggccgactacgacttcctcatcaagctgctcctcatcggagatagcggtgttgggaaaagttgtctccttttacggttctcagatggctccttcactactagcttcatcaccaccattgggattgacttcaaaataagaacagttgagcttgatggtaagcgcataaagttacagatatgggatactgctggtcaa

SEQ ID NO: 2417 - DNA, 435 bp, Zea mays
  Clone ID: LIB143-018-Q1-E1-E8
ctcgtaggccgatacaagactctagactaagtcgtattaagaggaaaacgagtgagaggggggaaatgctgcgccacgccgcccgccgtctcgtctcccgcaccgccgcggcgcccaccgcccgccgggcgctcgtcacggcagatgtgcctgcggaggccgccgaggactccacgtttgtggaggcgtggaagaatgtcgcccccaacatcgagcccccaacgacgcccctcttcctcatgcatccgcgcccgcccacgccggctaccatccccactaagctcaccgtcaacttcgtcctcccctacaagtccgagatcgccaacaaggaggtggacatggtaattgtaccagctacaactggtcagatgggcgttttgccaggccatgttgccacgattgcagagctcaagcctggtgttctctcagtacatg

SEQ ID NO: 2418 - DNA, 401 bp, Zea mays
  Clone ID: LIB143-018-Q1-E1-F1
acagcaagctaagcatatgccaaccaacgagtagcaggaaacatgtctccgcccgtcaagatcctcggccactacgcgagcccgtactcgcaccgcgtcgaggccgctctgcggctcaagggcgtgccgtacgagctggtccaggaatacctgcgcaacaagagcgagctgctgctcgccaagaaccctgtccacaagaaggggcccgtgcccctccaaggggacaaggccgttctgccagtccctcctcatcctccagtacgtccacgaggccttcgacgggccgtccatcctgccggccgacccccacgaccgtgccgtcgcccgtttctgggcgaacttcttggacaccaagttctcccagccgttctggctggcgtactgggcggagggcgaagcgc

SEQ ID NO: 2419 - DNA, 256 bp, Zea mays
  Clone ID: LIB143-018-Q1-E1-F10
agagttttgtactaaaagcttaatcagaagagattataatttgtacaattaagaattagttaaaatatgatcaatgatcaatggcaacaccagaaaaggcaacataagttgtacagcataaaatcttgtacacgaaatctctaggcaactcagaagtaagtgttgtcgataatatctgtacaagatggggtatattgtatacgtgcatacggtaactcaacgatgcattggaagagattttgtttatgccgtatcc

SEQ ID NO: 2420 - DNA, 419 bp, Zea mays
  Clone ID: LIB143-018-Q1-E1-F2
acccacacatccggcgccggcgaaggcggcgaccccgaggtccaggagcttcctccgccggagccgacgaggtttgccttcgccaccgcggccaaggcagcagttgatggcgtgatgacgacgactccaaaggatgtcaaaggagatagaccagtaaagcgcggccggaagaaccagtacaggggaatccggcagcgcccttggggcaaatgggcagctgagatcagggaccctaacaagggcgtccgcgtctggctcggaacctacaacaccgccgaggaggcagctagggcatacgacgccgaagctcgcaagatccgcggcaagaaagcgaaggtgaatttccccgatgacgacgcgccaggcactggtcacaggccagcgaacgcagcgcctaagctagtagctccacccccacc

SEQ ID NO: 2421 - DNA, 439 bp, Zea mays
  Clone ID: LIB143-018-Q1-E1-F4
attcaggggcttgaggatgttgcatctcaagattcactcagtgtttcagttgcaattcttcatcagttcaacattttacctgagaagtatcaagttggctacacaaagttgttcttccgaactggtcagattggcaaccttgaagatactcggaatcgtactctgcatggtattttaagggttcaaagctgtttcagggggcatcaagcccgtcatcatgcaagagaacgaacaagaggagttttgactcttcaatcattcattcgtggtgagaatgcacggcaaatttactcctctttgttgaggaaacatagagccgcagttgttttgcagagaaatgtgagatgttggcttgcaagaaggtatttcataaatgtccggaaggcctcagtgataatacagtctggtattcgtggcagtcttgttcgaagatgtaatg

SEQ ID NO: 2422 - DNA, 410 bp, Zea mays
  unsure at all n locations
  Clone ID: LIB143-018-Q1-E1-F6
aggcaatcaccatgggagatcaatctggctctagaaatggaccacaacagaagtacgtttcaggagcccagaatgcctgggatatgttctctgatgagctgtcacagaaacacatcactactggttctggtgacctcaatgacatacttggtggcgggattcactgcaaagaagttactgagatcggtggcgtcccaggggttggtaaaactcaactggggattcaactagcaatcaatgtacaaatcccagtggaatgtggtggccttggtgggaaagcagtttatatagattgctgaagggtgtattanggacatactggagcactttccgcacagccatgagaagtcctcttctgtccaaaaacaattacagcctgagcgtttcctggcggatatctattacttccg

SEQ ID NO: 2423 - DNA, 404 bp, Zea mays
  Clone ID: LIB143-018-Q1-E1-F7
attcagtttcggcataagggcatcccttatctgaacacgtatgacggccgcaccatccgctacgctgaccccctcatcaaggccaacgacaccatcaagatcgatctggagaccaccaagattgtggacttcatcacgtttgatgttggcaacgtcgtcatggtgactggcggaaggaacactggccgcgtgggtgttatcaagaacagggagaagcacaaaggcagctttgagaccattcacgtggaggactccctgggccaccagttcgccacccgtatgggcaacgtgttcaccatcggcaagggtaataagccgtgggtgagcctgcccaagggcaagggaatcatgctgagcatcatagaagagcatacgaagcgggatgccgctgcccaggctgctgc

SEQ ID NO: 2424 - DNA, 405 bp, Zea mays
  Clone ID: LIB143-018-Q1-E1-F9
gaaatatattcgataggcttattctgatgcgttataatttgttcacttatgatttgttcacttatgatcttgttcattaacagctcctgcaaagcaacataatttgttcacttatgatcttgtactcaaatatttatgcagctcaaaacgactactgtctatatttatgtacaatttccttatattgcatcatgcttatcaaaagaaaaaaatgcaaagcaatagattttgcttatgccttatcctgttcccaagtgtttatgtgactcaacaattttatacatgttcatgtatactttctttacaataagacatgttaaaggacctaacatgcgcgcatgggcgcgcccagtacactagtattgtacaagaattatcaaagatgttggacgagcagaatccctt

SEQ ID NO: 2425 - DNA, 166 bp, Zea mays
  Clone ID: LIB143-018-Q1-E1-G10
aaaataagtcctaaaaaaacaaaaaagaaaaaaaaaaaaaagaaaagaaggaaaataaaacatgatcaataaattaaaggggcggctcttcaatgggctgtatgcctgcattcatttcttccggtccttgtcagtgtggccgttctgttgggtacatccttgtagg

SEQ ID NO: 2426 - DNA, 415 bp, Zea mays
  unsure at all n locations
  Clone ID: LIB143-018-Q1-E1-G11
ccgcgcgctgcctctcccttccactccataccataccgccacgacaacgtcgacaagcgcaataccggagccctccgaaatggccgaggacaaggagaccgactcgccgcagccgccggccaagctgccccgcctctcccgcgccgacacgagcgccggtaagcacgcgcgggcaggcagtagtacgttctagccccggttggttagttgaagtactagctggtagctgatcgctctgtgtttggcgtttctgtcctgttcgcangagaggtgaccatggcggcctcgtcgccgctggttcttgggctggggctgggcctcggcggggcgcggcggcggcggcgagcgagacgcggatgtgtcccccgcgacggtgactcccaagaggccgtcggcgctgacgttcatgcagcag

SEQ ID NO: 2427 - DNA, 323 bp, Zea mays
  Clone ID: LIB143-018-Q1-E1-G12
agccacccacccacccacccactcgcttcagccgcctccgccgcgcgtacaagcaggtggagacaggatgccggctggccacggcctgcgctcgcggacgcgcgacctcttcgcgcgccccttccgcaagaagggctacatcccgctcaccacctacctccgcacctacaagatcggcgattacgtcgatgtcaaggtgaacggcgccgtccacaaggggatgccgcacaagttctaccacggccgcaccggtcgcgtctggaacgtcaccaagcgcgccatcggcgtcgacgtcaacaagcaggtcaatgggcgcatcatca

SEQ ID NO: 2428 - DNA, 410 bp, Zea mays
  Clone ID: LIB143-018-Q1-E1-E2
agcctcctgcggacgctttgttccccgcgctgttctcatggatcttgagcctgggacaatggacagtgtccggaccggaccctatgggcagatcttccgccctgacaactttgtgtttgggcaatctggtgctggtaacaattgggctaagggccactacaccgagggtgctgagctcattgactctgttctggatgttgtgaggaaggaagctgagaactgtgactgcttgcaaggattccaagtatgccactcccttggtggtggtactggatctggtatgggtacgctgttgatctcaaagatcagggaagagtaccctgaccgcatgatgcttacattctcagttttcccctcaccgaaagtatctgataccgtggttgagccatacaatgccactctttctgtcc

SEQ ID NO: 2429 - DNA, 401 bp, Zea mays
  Clone ID: LIB143-018-Q1-E1-C7
acccacgcgtccgctcaattcgattggctccgtgtcgacctccaggttgagaaggaaagcatcgcgagttcgccatacggatgggttccaaagcgcctttctgtctcacgctcctcttgctgctcgccgcggcctgtggacctgctgcacatgccaacgatgctgtcttgaaggaacatatttcttcaaccaagattcctgcccgtctcaagaggggcagcggactatgctcggcctgtgaaaacttcacgagcgaagccgtcacttatctcggcaatgaacagacacaggacatgatcgtggagttccttcatgatgcttgctcccaatcattctcctttgaacagaagtgtgtcgagctgatggactcttatgcgactctcctgtgtgccaagatcacg

SEQ ID NO: 2430 - DNA, 104 bp, Zea mays
  Clone ID: LIB143-018-Q1-E1-C8
acgcgcagttcgacgcaagcctctagatcgagtcgtcgtacgcccgcccgtttttgttttttttttttttttttttttggttgtctttggtagttttgtttatt

SEQ ID NO: 2431 - DNA, 431 bp, Zea mays
  unsure at all n locations
  Clone ID: LIB143-018-Q1-E1-C9
tcgcgggccgacacacgcgtctagcctcgttcgactaaccccgctaccgctagccgccgcgctgctcatctggtggcggctcgcctccctccccccatccgccgccgccggctcctcctctagctccctccttaccccgagctttaagctcgtgctacctgcctacctatccgtagggagagagagagagaggggagaaggttcggtcggtcggtcgggggctctcggatctcgccgctgcctccccgtttcttcgttgggatctcgctcgcttcgcgccatggccgccgtcgcgacgccaccggcccccgcgcccgccgcgccggcaccggcaccggcaccggctgctgctccggctcccgtcaccgtcgcccctgccgcgggacanaccacggatctgctgcagaagttgtcgctggattcgcagccca

SEQ ID NO: 2432 - DNA, 404 bp, Zea mays
  Clone ID: LIB143-018-Q1-E1-D1
aacttgaaatactcagcggaaagcgggctaccgatgcaccttcattgaaaagggattaaacattgttggatggttaaattttcgggctggagagaaccgggagagggaaatcgtcgatctgaattgtgaaggagtgcacaccgagaccttggacgctctgctctctctcgccaagcagtgcgtcagctctttgccggaggagcggccgacgatgcacagggtggtacagatgctggagtcggatgtagttaaccccttcccctaaccaactctacgattcagagtagcctcctggacggacaagccacagtggtgccgctagtttcccgtggaggcgcattcctttattctttgcagatattgtgtaaatgcattgccgcggtgtttgtttggtctcctccaat

SEQ ID NO: 2433 - DNA, 413 bp, Zea mays
  Clone ID: LIB143-018-Q1-E1-D12
cggacgcgtggggccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagca

SEQ ID NO: 2434 - DNA, 412 bp, Zea mays
  Clone ID: LIB143-018-Q1-E1-D2
acatccatctccatccccatcccgtgacccgtgcacgccgccgcttcaagtcctaacaagccgcatcgcatcgcatgcgtgtgctgtccgaccgccatctccgcagccggctggcctagctacctcacctcacctcacgcaggcacactgcacacacacccatggtggtggcggcgatgcggcggccgtgcgctgtgccagcgctgctggtggcggcggcgacggcgacgctagtgcttctgctgctgctgtcaccgtcgagcgcgcagccggtgccgtccccggcggcggcgccgggccccgcgggcgggaccgggatcgactcggcgtgcctgaactcgctgctcaacatgtcggactgcctcccgtacgtgagccaggggagcacggcgcggcgccccgacgcgccctg

SEQ ID NO: 2435 - DNA, 399 bp, Zea mays
  Clone ID: LIB143-018-Q1-E1-D3
ggaaggtaatacaaggaagggggttaaataaagggaactggaagggagaaaattcaagagaaaccaatttgaagaaggcgaaggcgcggagaaagaccaaagtttattgcgccagcttattcccaaacccagccgaaacctgtttttgcggagtctgattcagacaatgaagagaaataaccatgcgcctggttacctaaacctagcatgcacttgcaatccggtttccggacagatgtctcttgatgagcctgttgcacatgccctgtaacctgcttttcaacagtggagaaacaaaagagcgtcttcaagggtcttgatgataggagctctgccccttcattacagatggataggattagtatctacgacacttcagcactagagctctatgatttg

SEQ ID NO: 2436 - DNA, 223 bp, Zea mays
  Clone ID: LIB143-018-Q1-E1-D5
agtcaaaggcgcaaaagccctgtacaagttcggaaggctgcagcgcgggcgatacagccccaatggatctgaccaggcaatcttctacaattccaccagctactgggacgagtttgtgtggggtggtgcgtggatgtactttgccacagggaacaattcatacctcacggttgccactgccccaggaatggcaaagcatgctggagcctactggtttggaagt

SEQ ID NO: 2437 - DNA, 379 bp, Zea mays
  Clone ID: LIB143-018-Q1-E1-D6
aaaaccatctgcttcagccttcagctagccccaagtttagtcggccgatcgatcactgaagtagtaatggcctccgccaacagctggaccctcgagatcgcgtcgccggtggccccgcagcgcctgttccgcgccgccgtgatggactggcacaccctggcgcccaaggtcgcctcccacgtcgtcgccagcgcgcagcccgtggagggcgacggcggcgttggcagcgtcaggcagttcaacttcacctcagtcatgccgttcagcttcatgaaggagcgtctcgagttcctcgacgcggacaagtgcgagtgcaagaacacgctcatcgagggaggcggcatcggcgtcgccatcgaaacggcgacgtcgcacatca

SEQ ID NO: 2438 - DNA, 431 bp, Zea mays
  Clone ID: LIB143-018-Q1-E1-D8
ctcgtgggccgacacaagcctctacactcagtcgcagtatccgtctctaaactctagtctgtgcgaatctgctgccagcagcgaggaacagaacagtagccaatttgccatctcacagttgcgttcctccgattccccgtcccccgatggacctgtctcccagctcgtcggcgccatccgcgccgccggtgccgtgcgagtggtccggcgccgggctcggctccgcggcgtgcggcctcgcctgcacggtgctctgcgccgtcgccacctgcgtcttcgcggccgtggggtcgctggtcggggcggtgactgggtccatggtggggctggcgaccgagagcgggatgctgcgcggcgccggcatcggggccatctcaggcgccgtcttctccatcgaggtcgccgagtcgtcacgcgacctctggcactcg

SEQ ID NO: 2439 - DNA, 345 bp, Zea mays
  Clone ID: LIB143-018-Q1-E1-D9
agttacaaccttatttcacttggatcggccaatgtatttactaggatatcttgcaaaccaaagccgtgtctatcttattgataagcaatttaatgttgtggggtatactttactccttagtttgatcgagtataaaacacttgtaatgcgtggggattttgatcgtgcaaatgatgttttagcatctacaccaaaggaacaatatgacagtgtggcacgtttcttggaatcacgtggaatgttggacgaagccctcgagattacaactgacactaattacagatttgacctggctgtgcagcttggtcgacttgaaatagcgaaggtgattgctactgacgtgca

SEQ ID NO: 2440 - DNA, 398 bp, Zea mays
  unsure at all n locations
  Clone ID: LIB143-018-Q1-E1-E1
ggccgcgctgcagcctgcctgtcaatctcgatcgatcaaggggtggcttgccgaaatggcggaccggccgtcgcttcctgctctcattattgctatcgccgttcttgctggcagttactgccgcgtggcgagctcggcctcgccggcggtggaagatgagctgcgcggtggaggaggagccggcggtccgacgacgatgccgcggcgcgccgcgtccgtgatggtgcccatcnacatcctcaagtccgctgttagcgacggagctgtgtgcatggatggaacgccacctgcttaccacttggatcctggctccggagcgggcagcagaagctggattgtgaacttagagggaggtgcgtggtgcaacagcgccaagacatgccggctcaccaggagct

SEQ ID NO: 2441 - DNA, 368 bp, Zea mays
  Clone ID: LIB143-018-Q1-E1-E10
agcagcatcctggggatgtacgcataagatggcaggtagtcggcctcgtcgttttcttctaggagaagcagtcggaagaaaagaagtactatacagaagccaaacttgtctacccctatccagctggtgtgtctgctatgcggcagcgaaacttgagtcattagattgtagcctgaatgaaagcagcgctagcttgcgatgtagcagtaccttttttttccctggcgatatcatctgactgtaaatttgtaaatgctttcggactacgagttgttcttatttttcatccacctcttctctacggaacgtttttttctatataagaaaataaagtcaacagagcagttctaaaaaaaaaaaagaaaaga

SEQ ID NO: 2442 - DNA, 413 bp, Zea mays
  unsure at all n locations
  Clone ID: LIB143-018-Q1-E1-E11
agaacaatccttctgctgtttgtctactaattctatctcacattgttgatacaaatgggtatcttagcctcattaattttcttctctctgtctttctttatatgctatcgatttgtggcttccgctaagatgcttttcttgtttggataataaaatgttgcctaggattttaatatgtgagttgtcaagttttacagttagtccagttcccgctactgacatgcttgtttcctcgccagggcttgctatggtgttcttcgttatgttatggagagtggtgccaagggttgtgangtgattgtgagtggaaagctcagggcccaaagagccaagtccatgaagttcaaggatggctacatgatctcatctggtcagccagtgaacgagtacattgactcggctgtgagacacgt

SEQ ID NO: 2443 - DNA, 414 bp, Zea mays
  Clone ID: LIB143-018-Q1-E1-E12
acagacatgatcattggtgatgacactgtgtactactatcatgacatgatagtggaaatgattaaatggggatatcaagaaggaaaaactctctttggatttggttatgatttccgtcaaagcaacaggctctcagagacacttgacagattttctaaaaagctggagtcagtgtacacagcttctggtggaaagaagatcaatctcattactcattcaatggggggattacttgtgaaatgtttcatctcactgcacagtgatatatttgaaaaatatgtcaagagttggatcgcaattgctgcaccattccaaggtgcccctgggtacataactaccagtctgctgaatggaatgtcttttgtcgaaggatgggaatcaagattctttatttccaaatggtgtatgcagcaa

SEQ ID NO: 2444 - DNA, 390 bp, Zea mays
  Clone ID: LIB143-018-Q1-E1-C6
agagaggtttctgatacaaccgagagtacatgatgcagtgcttggccgtcggaaggctgaaaaggcaatggcttggcgggcagtttttacatcggctgggtttgctccagtgccactcagcaaccttgcagaggcacaagctgactgcctcttgaagcgggtgcaggtccgaggattccatgtggagaactgtggaatgggtctagcactctactggcatcggggcgagctcgtgtcagtcacggcgtggctgtgctgatcatagcaaccgcagccgtcgaccatcgtcgtcgtcgcgccgacactattcgcaggcatgttcaactccggtaagatgcgtctgatcgtgcaaacattgcagtgatactattgtcatggttgttccatgcc

SEQ ID NO: 2445 - DNA, 412 bp, Zea mays
  Clone ID: LIB143-018-Q1-E1-B2
acatcgattggcctgagcttctcagcatctgatgcaccagaaccatcaaaatcagcatcttctattccagacggtaccgcaatacgtaaggagacaccagttcagccttgggaatcaagtattgattcatctctcacgagcgaggaaagggagcaaaagcggaaacaggccaccgggagggcaacctttgtgcaaggcctagtgatgtctactctattcggagattgatcgctcaagcagccctaggttcttgcacttgctagatcggctctttctcctgcctggtccgtcgtcagatagtgctccacccggttcggactctgatggcagggaaaattcgccccaggaaacttagccgcgttcacctttttttttttcagaaaagtgcgccgttgattctagcatgatgcag

SEQ ID NO: 2446 - DNA, 401 bp, Zea mays
  Clone ID: LIB143-018-Q1-E1-B3
ctcgcatttcctcccaatcaatcccgcctcaaaacccgaactccaagtcgccccgcatcgatggcgcccaaggccgatgaagaagcccgcggcgaagaagccggcggaggaggagcccgctgccgagaaggcgccggccgggaagaagcccaaggcggagaagcgtgtcccagcaggcaagtccgccggcaaggagggcggcgagggaaagaggggccggaagaagggcaagaagagcgtggagacctacaagatctacatcttcaaggtgctgaagcaggtgcacccggacatcggcatctcctctaaggccatgtccatcatgaactccttcatcaacgacatcttcgagaagctcgccgccgaggccgccaagctcgcgcggtacaacaagaagccca

SEQ ID NO: 2447 - DNA, 396 bp, Zea mays
  unsure at all n locations
  Clone ID: LIB143-018-Q1-E1-B5
acttcagcaaaattctctctttatgtgtttcctacttcacttctgtgtacgtaatgaagtggaaagacttctttcctaacaaagagctgaaggagccaccatattttgatgctcgagctgtatgttacccgaatttgaagactattcgtgattatttggcttggagacaagtggactgtaagctactggaattgattcaaattatcttgtatagcaaacgccacctcatatttgttcacacaacttttttgtttgccctgaagtcctacaaggaaactgcattatatacaccaaagttgtacaaagcatgaacctttgtgaacataaaaagaaaagtgatctatgtacgtgtcagaatcanncagtaattttgttagttcactgatatgcatattc

SEQ ID NO: 2448 - DNA, 405 bp, Zea mays
  Clone ID: LIB143-018-Q1-E1-B6
acttcagcaaaattctctctttatgtgtttcctagttcacttctgtgtacgtaatgaagtggaaagacttctttcctaacaaagagctgaaggagccaccatattttgatgctcgagctgtatgttacccgaatttgaagactattcgtgattatttggcttggagacaagtggactgtaagctactggaattgattcaaattatcttgtatagcaaacgccacctcatatttgttcacacaacttttttgtttgccctgaagtcctacaaggaaactgcattagatacaccagagttgtacaacgcatgaacctttgtgaacataacaagaaaagtgatctatgtacgtgtcagaatcaaacagtaattttgttagttcactgatatgcatattcgttgtttgt

SEQ ID NO: 2449 - DNA, 400 bp, Zea mays
  Clone ID: LIB143-018-Q1-E1-B7
ctcgcagctgccgccggccaccgacgccgacggcaacgagaacgagcgctggagctggtagagcatgctgcatcgggacaagaacaagacagcagcgagaagaaagaaaaaacaataaattagtagcaataattggtgggtggtttggcatttggcaatgatgcgtgacgtggcgcctgcaggctttcttggtcctaatcctaatcctaatcctaatcccaatccatccagctaagacgtccacgcccgtggttttgtcctgttgatttgccaccggagacgacgatgcagcgcttgctctttgatttccatggcttattatcgatcagcctccgattcttctcctgcactactactacttgtaccatttcatctattgattgaatgaatggtcacgatg

SEQ ID NO: 2450 - DNA, 417 bp, Zea mays
  Clone ID: LIB143-018-Q1-E1-B9
actacgactacgtttacgactggaacctgaagcaggagatcagcgcgctgtctgcagtgaggtcaaggaacgggatccatccggggagcgagctgaacatcctcgccgccgacggggatctctacgtcgccaagattgacgacaaggtcatcgtgaagatcgggtcacggtacgacgtcgggaacctgatcccctcagacttccacgccgttgcccatggcaacaactactgcgtttgggagaagcacggtctgagagttccagcggggcggcaccactagactagacccatattccgcccaacccctacagataattctcttttcaggtccattttgaacctggaaaagaaatttaagagaggctaaataaccggaatacgattgtgtactgagcttctttcagctaattattgaa

SEQ ID NO: 2451 - DNA, 400 bp, Zea mays
  Clone ID: LIB143-018-Q1-E1-C1
acggcaaaaagaagctggtgctgcccgggactggtgacccgggcgtcaaggtgtacgatgaggtggtggcctgcaggctgggtctcgaggggaaacaacccgagtttgcagtgctcacagcacaaggcatacgttggatacgtctcattaggcccttgaacagctacgaggaaatgatcacgactgtgttgatcacagcgcagatgctgcattttctaaagaggaagcctcatgagccagaaaaaaccttgtggaaccacctttgcaaagtttttaacaagtttgacgttccaccctcagaggacgatttcaggaaccactgctcactgattcaacactttgcggcaaaagatcctgtcttagcagaatcagacattttgcgagtatttattgaaggaaa

SEQ ID NO: 2452 - DNA, 406 bp, Zea mays
  Clone ID: LIB143-018-Q1-E1-C10
actctctctctcgtggcgacgactgggcgacctccccgcccccgccgctctacgccaggtgcccagatcttcgtcgggcccttctccgaagagcagccaacagcttaggttaaaataaaaaaaattgccgggcggataatacaaggcctacaccagaaggaataccctttgtgcgacaggcgaacagctgtctctatctctctctgcagtgttatttggtttattatatgcagttgcaggggagaaaactaaggcctgttcactgcagctagaatcacagccgcagcagatgcagcaggcttcttatacagtatttgcagcttagaagttgcagtggcagctgcagctagctgcagcaaacactcctaacaataatagtggagagagactttcacgctgtttaaat

SEQ ID NO: 2453 - DNA, 414 bp, Zea mays
  Clone ID: LIB143-018-Q1-E1-C11
gcattccaacccattcccatcgtcttcaacaaccaacccagcgccaccagcagcgccatcagcaggagagagatcgccggagccatgacaaggggcggcggaggcgacatgaagtccttctaccgtcagcagaagacgcacgccgccgctgctgccgccgccactaccaagcccactggtggcgtctccaagaaggcggcggcgcaccaccacaagaaggccgcgctcgccaccaacgtccacccagccccagatcacggcgctggcagccgccggaggcggaggcggagcagcgagagagggcgggccgcgagttcgacatggacacgcgctacgggccatgcctcgacgtcacccgcgcccagcggtggcgccgcgccgacgaacagccctgcctctgggatggtcgcgtct

SEQ ID NO: 2454 - DNA, 414 bp, Zea mays
  Clone ID: LIB143-018-Q1-E1-C12
agctgggcacgttctggctctagacttcattgaaagtgtgattaagaagaaccaaagcataaatgggcatcacaagaacataaccttcaggtgtgctgatgtgacatctaacgacttgaagattgaagataactctgttgatctgatattttcaaactggctattaatgtacctttcagatgaggaggtccaaaagcttgtggggaaaatggtaaaatggctaaaggtcggaggccatattttctttagagaatcatgttttcaccaatctggagattccaaaaggaaggtgaacccaacacactatcgagaaccaaggttttataccaaggtatttaaagagggccattcatttgatcaagatggaggttcgtttgaactttctctagtgacctgtaaatgtattggggctta

SEQ ID NO: 2455 - DNA, 409 bp, Zea mays
  Clone ID: LIB143-018-Q1-E1-C2
accacgagtccgctgactcgtgggcggacgcgtgggtccgtgtgcgcccctcggttcaccacccgccgccgccgagacctcctcctcgccggctactcctgactccataaaggcaacgctcggaggtggccctctgtcgggtggcgtggtggacacatccgcgcccatggccaacctcggcgctgcggccggcaagctcaccgtcgccgagacattctccaacctcagggagcaacgcaagagtgcattcatcccgttcatcactgctggtgatcctgacctggcaaccacatcaaaagcattgaagattctcaattcctgcggttcggatgttatagaggttggcgtaccatactcggatccactggctgatggaccagttattcatgcttctgcaacacgggcgctt

SEQ ID NO: 2456 - DNA, 405 bp, Zea mays
  Clone ID: LIB143-018-Q1-E1-C3
gcctagatctatagctcgagtattgcttgctctccacaagaaacaaggcagagcaccaacaatggccgccgcctcctcgtcctcggtcctcctgctgctcctggccgccgccttggctggcatgagcgccaacgccgccaccttcaccatcaccaacaactgcgggttcaccgtgtggcccgcggccaccccggtgggcgggggcacgcagctgaacccgggcgggacgtggaccgtcaacgtgccggctggcaccagctccggccgcgtgtggggccgcaacggctgctccttcaacggcaacagcgggagctgccagacaggcgactgcggcggcgcgctggcctgcacgctgtcggggcagccgccgctgacgctggccgagttcaccatcggcggcagcca

SEQ ID NO: 2457 - DNA, 399 bp, Zea mays
  Clone ID: LIB143-018-Q1-E1-C5
acaggctacagctcccgtctctccgccgcttgcttggaaaacgaagaaaccctcctccaccaacccaatccagctacatccgtctgggtgaactccagggccaggagcagttcgccgccttcgttcgcatcacctacgcggttcgatccaactggcaggaaggaacgtgatggccaagacgagctcgttcaagctggagcacccccttgagaagaggcagtctgaggctaatcggatcagagagaagtaccctgacagaattccagtgattgttgagaaggctgagaggagtgacattcctgacatcgacaagaaaaagtacctcgtccctgctgatcttacggttggacaattcgtgtatgttgttaggaagagaatcaagctcagtgctgagaaagc

SEQ ID NO: 2458 - DNA, 380 bp, Zea mays
  Clone ID: LIB143-018-Q1-E1-B12
aaacacacttctgctagatgattcaatattaaacaaatgtagcaagtcaaccagacatgggctgtcgctgaatggatcatttgatctgatacagctaaaggctattattgaacgtgtgtctaagaaatgaattggatagaagattgtcgtgtatgggacaatgccaatcgttgtctccgctgtccctgcaagcgttgtagcttccttgtgtgatgcttatttgagaacatatctgttgtgctcagatcatatcctgagtgcctgtcatgacagctacttttggcgacatcataccatcatactcactgtcaagctttaaagagtgaagatacgcccatggtcctggcaaactagtacatgtgactttgaactttgccaat

SEQ ID NO: 2459 - DNA, 438 bp, Zea mays
  Clone ID: LIB143-036-Q1-E1-H6
agtggaggcccgcaacgcgctggagaactacgcgtataacatgcgcaacacggtgcgggacgagaagatcgcgtcgaagctgcccgccgatgacaagaagaagatcgaggacacgatcgaggacgccatcaagtggctcgacggcaaccagctcgcggaggccgaggagttcgaggacaagatgaaggagctggagagcatctgcaaccccatcatctcgcagatgtaccagggcggcgcgggcgctgcgggcatggacgaggacgtgcccggcggtggcgccggcaacggaggtggcagcggcgccgggcccaagattgaggacgtcgactgagcgagccgtggacggtgatgatctggatggacgcttctgcgcgtgcggtgcagctagagagtgtgctacgtgaactcgtgaaggcgtattaatctgtgtgtgcg

SEQ ID NO: 2460 - DNA, 441 bp, Zea mays
  Clone ID: LIB143-036-Q1-E1-H7
gaataatattagaaatgcaacggaactgctgtatgatatggtgaatgctttgaaccctgctgaccgcatgacagttaaagatgaaattattgcagatcttgtaaatcaatgtcgttcaaatcaacaaaagctcatgcagtttgtcagttccacaggggatgaagacctgctaaagcaaggactagaattaaatgatcgcttacagagtgtcctcacaagacatgatgctattgcttctggttctccattaccagttgagacaccgattagagaaccacagagagaggatccaaatcctgagccatctacaccaattacacatgataataaggctcaagttgaagaggatgaagatgatgagtttgctcaaatagcacgaagaaaaaacaaatctgtgatatgcggtgatgaggcatcatcgagtgctggtgatcaagccct

SEQ ID NO: 2461 - DNA, 428 bp, Zea mays
  unsure at all n locations
  Clone ID: LIB143-036-Q1-E1-H8
acttcgtctgcggctgccgcgacctcggcgaggcgctccgcanggtgcgcganggcgccgccatgatccgcaccaagggggaagccggcacgggcaacgtcgtcgaggccgtgcgccacgtgcgctccgtcatgggcgacgtccgcgcgctccgcagcatggacgacgacgaggtcctcgcctacgccaagcgcatcggcgcgccctacgacctcgtcatgcagaccaagcagctgggccgcctcccgtcgtgcagttcgccgcggggggtgtcgccacgcccgccgacgccgcgctcatgatgcagctcggatgcgacggcgtcctcgtcggctcgggcattctcaannancngcgaccccgcgcgccgcgcccgcgccatcgtccaagcagtcacccactacagcgacccccacatcctggccgac

SEQ ID NO: 2462 - DNA, 351 bp, Zea mays
  unsure at all n locations
  Clone ID: LIB143-037-Q1-E1-A10
acccaaacgtccaganataaaatgtaaaaaaaaaaaaaacaaacaaaaaaaaaagataaaaaaaataaaaaaaataagaatgaaatgaaatcaaaataacagcaataagctaaaatatgtaaatagcttccatcttgctacagtacttcatggaatgctggtgaagttcttgtgcctatggtttgtttcggtgcatgattagaatcttccttcttggtcaatctggaggatactgaacattattatcctgccacatgagcgtgtgtacttgggtgtcgagacctcgatgcttagtcacagtgatatgtaagttctaagttcgggttggttattgcaaaaatgggatgccac

SEQ ID NO: 2463 - DNA, 409 bp, Zea mays
  Clone ID: LIB143-037-Q1-E1-A11
gacccaagcgtccactctgtcgcttgcaagttcaatctcacctccaaccatgggtaaagagaagtcccacatcaacattgtggttattggccatgtcgactctggcaattcgaccaccacaggacaccttatctacaagcttggaggcattgacaagcgtgtgatcgagaggtttgagaacgaggctgctgaaatgaataagcggtccttcaagtacgcgtgggtgctcgacaagctcaaggctgagcgtgagagaggtatcaccattgatattgctctgtggaagtttgagaccaccaagtactactgcacggtcattgatgcccctggacaccgtgacttcatcaagaacatgatcactggtacctcccaagctgactgtgctgtccttatcattgactccaccact

SEQ ID NO: 2464 - DNA, 417 bp, Zea mays
  Clone ID: LIB143-037-Q1-E1-A12
gcaaacctctagactgagtcgtactagttcaatctcacctccaaccatgggtaaagagaagtcccacatcaacattgtggttattggccatgtcgactctggcaattcgaccaccacaggacaccttatctacaagcttggaggcattgacaagcgtgtgatcgagaggtttgagaaggaagctgctgaaatgaataaccggtccttcaagtacgcgtgggtgctcgacaagctcaaggctgatcgtgacagaggtatcaccattgatattgctctgtggaagtttgagaccaccatgtactactgcacggtcattgatgcccctggacaccgtgacttcatcaagaacatgatcactggtacctcacatgctgactgtgctgtccttatcattaactctcacactggtggttttga

SEQ ID NO: 2465 - DNA, 409 bp, Zea mays
  unsure at all n locations
  Clone ID: LIB143-037-Q1-E1-A2
gctttgttcagacttcagagcccttcctcttgtgtccgtgcaaattggtgatacttgaacagggatctcctccatattagtgagcaggatgtataatcctcccagtgggcaggacatgtcctactacgatcatgtgcagaagcgccatgaggagaagggctgcctatatgcatgcctgttcactgcgtgctgctgcttctgctgcttcgagacctgtgagtgcctgcctcaaggccatctgctgctgctgctagttctgcttggagggcatgggcgtccatcatcgtggagatgtggccatgcgggacannccacgccgaataaaatgctgtacttatatgcacgcacgttagaaatgcattagtgtctgtntgatgtgatcttgtgtgtgtgcgcgcgcatcttcatt

SEQ ID NO: 2466 - DNA, 402 bp, Zea mays
  Clone ID: LIB143-037-Q1-E1-A5
ttaaaaatcaacggcattacgttgtgtgggatatgaatctgaatagtcatatctattctgagtttgtagtcactgtcaaattgccttctaaaaccaaagattcctttgtatcgcaagaaaactgtcagaattcgtctgatctatcactggtgttgaactctagttcacctgattgtatttcacaggagatgaacctggaggcacctccagcattgggaggtggatgtgcagcccccatgctaggagattcgatggaaaaggctccaagctcaccttggatgcctttctccatgctgtttgcagcgatctctaccaaagtgtctcctgagaatatggacgtgattattggttgctatgaagagtttaagagcaagaaaataagccgaggtgaactagtgaaga

SEQ ID NO: 2467 - DNA, 429 bp, Zea mays
  Clone ID: LIB143-037-Q1-E1-A6
attcccgggccgaccttaaaaatcaacggcattacgttgtgtgggatatgaatctgaatagtcatatctattctgagtttgtagtcactgtcaaattgccttctaaaaccaaagattcctttgtatcgcaagaaaactgtcagaattcgtctgatctatcactggtgttgaactctagttcacctgattgtatttcacaggagatgaacctggaggcacctccagcattgggaggtggatgtgcagcccccatgctaggagattcgatggaaaaggctccaagctcaccttggatgcctttctccatgctgtttgcagcgatctctaccaaagtgtctcctgagaatatggacgtgattattggttgctatgaagagtttaagagcaagaaaataagccgatgtgaactagtgaagaagctgacgcatg

SEQ ID NO: 2468 - DNA, 393 bp, Zea mays
  Clone ID: LIB143-037-Q1-E1-A7
acaagttcgcttctgccagtctgcctgcgtgctctgctggacagctggagagctagatggcgatgccgtccgggtggaggggtatcctgggcttccactacggcatcgtgcaggcgccgttgggccccgacatctccggccccgagctcgtcgccgccgtagcgaacgccggcgccatcggcctcctccgcctccccgactggccggcgccggatcacgtcagagaactgatccggaagaccaggagcctcacgtccaagccgttcggggcggccatcgtgctggccttcccgcacgaggagaatctcagggtcgtcctggaggagaagctcgccgtgctgcaggtctactggggggacttccccaaccaccgggtccaagaggcgcatcgcg

SEQ ID NO: 2469 - DNA, 352 bp, Zea mays
  Clone ID: LIB143-037-Q1-E1-A8
agaagttcgcttctgccagtctgcctgcgtgctctgctggacagctggagagctagatggcgatgccgtccgggtggaggggtatcctgggcttccactacggcatcgtgcaggcgccgttgggccccgacatctccggccccgagctcgtcgccgccgtagcgatcgccggcaccatccgcctcctccgcctccccgactgacctgagccggatgcactcacacaactgatcgcgacgaccaggagcctcacgtccaagccattcggggccgccatcgtgctggacttcgctcacgacgagaatctcagggtcatcatgcaggaaacgctctccgtgctgcacgtctactg

SEQ ID NO: 2470 - DNA, 368 bp, Zea mays
  unsure at all n locations
  Clone ID: LIB143-037-Q1-E1-A9
ttcnttctcttacgatgttccatatgtatgcaaattacaaggcagtgcagtcactttcactcactacgctaaactatgagagagcttccatcttgctacaatacttcaaggaatgtggtgaagttcttgtgccacggaaggtttcccagcaggaacatattcttccttcttggtcaaactggaggaaactgaacagaattaaactgccacatgagcgtgtgcacttgggtgctaaagcctcgatgcttacacacagtgacatgtaagttctaagttctggttggtgattgcaaaaacaagataccactatgaaaacgcgaactactttttgctggataaacaaggcatcgtttacgttttcatccaca

SEQ ID NO: 2471 - DNA, 378 bp, Zea mays
  Clone ID: LIB143-037-Q1-E1-B1
gatcctcatccctgcatgggacaacgcggtgcagacggaccatgccgcgcatatggtgtacctccacgccggcgacaaccccttcgacaccgtcaccgccgccgtcaaggccgtggacaagcaactgcagacgttccaccaccgcgacaagaacaatctgccgtcgttcctcgactggttcggctggtgcacctgggacgccttctacaccgacgtcaccgccgacggcgtcaaacacggccttcagagcctgtccaagggcggcgcgccgccgcggttcctcatcatcgacgacggctggcagcagatcgcctccgagaacaagcccgaccccaacgtcgccgtccaggagggcgcgcaattcgccagccggctgac

SEQ ID NO: 2472 - DNA, 413 bp, Zea mays
  Clone ID: LIB143-037-Q1-E1-B10
aacaatccgaaaaccatctgcttcagccttcagctagccccaagtttagtcggccgatcgatcactgaagtagtaatggcctccgccaacagctggaccctcgagatcgcgtcgccggtggccccgcagcgcctgttccgcgccgccgtgatggactggcacaccctggcgcccaaggtcgcctcccacgtcgtcgccagcgcgcagcccgtggagggcgacggcggcgttggcagcgtcaggcagttcaacttcacctcagtcatgccgttcagcttcatgaaggagcgtctcgagttcctcgacgcggacaagtgcgaatgcaagaacacgctcatcgatggaggcggcatccgcctcgccatcgagacggcgacgtcgcacatcaacgtggagctcgcggccggcggcgg

SEQ ID NO: 2473 - DNA, 315 bp, Zea mays
  Clone ID: LIB143-037-Q1-E1-B11
atcagctaattcatacgcatgcatgtccacaatctcatggccccatggtcatatcatccgttggttcagtagtcaggctggatcttccagagctggttgtcgccctcgcatgacttctacagcacgacgttggtgccgtcacggatgccgccgtgccagttgtcgccgtggagggcatcgaagttgaggtagatgtcgttgaccacgcggacgcagcggatgccgttgccgacttcacggatctccgtctacagcatcgactcgtcaagaaagtccggcttgtatggcacgaggcggaccaggtggatacgcccc

SEQ ID NO: 2474 - DNA, 358 bp, Zea mays
  Clone ID: LIB143-036-Q1-E1-F8
agcagctcaaaaacccaacacacctcaacaagcagagcaaagacccgggattcgccggcgcggtagcgagagcgagagatggacgggaggatgttcggtctcgagacccccctgatggtggcgctgcagcaccttctggacgtgcccgacggcgacgccggcgcgggcggcgacaaggcgagtggtgccgcggcgggcggcgggcccacgcgcacctacgtccgcgacgcgcgcgccatggcggccaacccggccgacgtcaaagagctcccgggcgtgtacgcgttcgtggtggacatgccggggctgggcacgggcgacatcaaggtgcaaggtgaggacgagcgggtgctggtga

SEQ ID NO: 2475 - DNA, 407 bp, Zea mays
  Clone ID: LIB143-036-Q1-E1-F9
acttccaactaagaaaatcaaggacccagaggctaagaagcctgaggactgggatgacaaggagtacattcctgaccctgaggacaagaagccagagggctatgatgatattcccaaggaaattcctgaccctgatgctaagaagcctgaggactgggacgatgaggaagatggtgaatggactgcccctaccattcccaacccagaatacaagggaccatggaaacaaaagaaaatcaagaacccgaactaccagggtaaatggaaggcacctatgattgacaacccagattttaaggatgatccatacatttacgccttcgacagcttgaagtacattggcattgagctgtggcaggttaaatcgggcactctgtttgacaacatcatcatcactgatgaccctg

SEQ ID NO: 2476 - DNA, 407 bp, Zea mays
  Clone ID: LIB143-036-Q1-E1-G1
agcttcatctagctctagctaggctcgtctgctgcaagaaggtaacagtaacagcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcggcatccagggcatcgcctggtccttcggcggcatgatcttcgccctcgtctactgcaccgccggcatctccggcgggcacatcaac

SEQ ID NO: 2477 - DNA, 389 bp, Zea mays
  Clone ID: LIB143-036-Q1-E1-G10
gtgatgatgtggacttaatgatcattgctagaggaacaccgggattctctggtgcagaccttgctaacttggtaaatgttgctgctcttaaggctgccatggatggtgcaaaagctgtcacaatggatgatcttgagtatgcacaggaccgaatcatgatgggtagtgagcggaagtcggcagttatctctgacgaatgcaggaagctgacagcataccatgagggagggcatgcccttgttgcaatccacacataaggagctcaccctgtccacaaggctaccatcttacctagggggatggccctacgaatggtggcccaactccccgacaaagaccagacaagtgtgtcaaggaaacagatgctagcataactggatgtctgcatg

SEQ ID NO: 2478 - DNA, 403 bp, Zea mays
  Clone ID: LIB143-036-Q1-E1-G12
gaagttactaccagcagcttgcttcaacagtagaagagagcgagaggatggcgtcaccgaagccctcgtcggcggccctgctcctcctggcggcggcggccgtgctggcgctggcgcgcgcggacctgacgcacgacaactgcgtgaagaacaagaaggtgacggtgcagaacctgtgcagccacgacgtgacgctgacgctggagccgctggccaacagcccgccgctgttcgcgggcacctacacgctgcacccgcgcagccacgccgagttccccgtgtgctggtggacggggcgcctgcgcgcgcccgacgccgcccaggtggagttccacgtcggcgtcgacggcggctccttctacctggcccccaacgcgcagccgggccagcgcgtcccggtctc

SEQ ID NO: 2479 - DNA, 414 bp, Zea mays
  Clone ID: LIB143-036-Q1-E1-G2
ctctagctaggctcgtctgctgcacaaaggtaagacccgggattcgccggcaggggaacgaggaggacgtccgcctgggcgccaacaagttctcggagcgccagcccatcggcacggcggcgcacggcacggacgacaaggactacaaggagcccccgccggcgccgctcttctagcccggggagctcaagtcctggtccttctaccgcgccggcatcgccgagttcgtcgccaacttcctcttcctctacatctccatcctcagcgtcatgggcgtctccaaattccacctccaagtgcgccaccgtcggcatccagcgcatcgcctggtccttcggcggcaatatcttctccctcgtctactgcaccgccggcatctccggcgggcacatcaacccggcggtgaccttccgg

SEQ ID NO: 2480 - DNA, 171 bp, Zea mays
  Clone ID: LIB143-036-Q1-E1-G3
tctctaaactgaatcgtattatatctaggctcctctgctgctcgaacgtactagtcatagcacgcatggaggggaaggacgacgacgtccgcctgggcgccaacaagttctcggagctctagcccatcagtacggtcgcgcatggcacggacgacaacgactaccaggagc

SEQ ID NO: 2481 - DNA, 390 bp, Zea mays
  Clone ID: LIB143-036-Q1-E1-G4
gcgtccaactgtacccggctccccgccgccgcacaaagacgagaggaagaggttcccggcggcgccacgactatgtcgtcgatgatgaacgcgctggcgaactggctggcgaacccgcgccgcaacccgctggcgcgcctccacatgcacgccgtctcctcgcgcctcaggaaatacggactgaggtacgacgacctctacgacccctacttcgatctggacatcaaggaggcgctcggtaggctgcctagggaggtggtcgacgcccgcatccagcgcctcaagcgtgccatggacctctccatgaagcaccagtacctcccggaggacctccaggcacagcaggttccattcagaggatatttgagtgacatgttggcgttggtgaaa

SEQ ID NO: 2482 - DNA, 441 bp, Zea mays
  Clone ID: LIB143-036-Q1-E1-G5
aaggataagtagatcagcatctgcgacagaaggcagcgggggtggcgatgatggagagccagccgctgcaggctccaaccgccacggctccggccaccggatctgcggagccagccggagctccgccggccgtcacccccggcaaggagttcacgcgcacctgcaagggtgtcttcatcgtgctcatcggaagatatgtgctgctccagctcctctcttcgtcactcaactacctcgccatcatcccctccaagacaatcccctatgtatggaccgtctttaccgctggttacatcgaacatgtcctcccatcggccattggcagttctcttggtcatctcttttgtggaaaggacattgatccagcatggggccgcaacgaattcatgaagttcagtattttgatcaactccatctgtggcattcctgcaatttgcattg

SEQ ID NO: 2483 - DNA, 388 bp, Zea mays
  Clone ID: LIB143-036-Q1-E1-G6
ggccgacccacgcgtccagctgatcttgatcctgcaccccgagccgtacacaagagctagtcggtagaacgtgcaggagcggagcagaactaagtgcagagaacaggacatatggctacgccggcggtgaaggtttacgggtgggctatctcgccgttcgtatcgcgggctctgctggccctggatgaggccggcgtcgactacgagctcgtccccatgagccgccaggacggcgaccaccgccgcccggagcacctcgccaggaaccctttcgggaaggtgccggtgctcgaggatggcgacctcacgctcttcgaatcacgtgcgatcgcgaggcatgttctccggaagcacaagccggagctgctgggcggcggcaggctggagc

SEQ ID NO: 2484 - DNA, 425 bp, Zea mays
  Clone ID: LIB143-036-Q1-E1-G7
aagggtgtgcatggccacttcaccaagcgccccgaggagattggagctggtgaccagggacacatgttcgggtatgcgaccgatgagacccctgagttgatgcccctcagccatgtccttgccaccaagctaggtgctcgtctcaccgaggtccgcaagaacggaacctgcccctggctcaggcctgatgggaagacccaggtgacagtcgagtaccgcaatgagggtggtgccatggtccccatccgtgtccacaccgtcctcatctccacccagcacgacgagacagtgaccaatgatgagatcgctgctgacctgaaggagcatgtcatcaagcctgtcatccctgagcagtaccttgacgagaagaccatcttccaccttaacccatctggccgctttgtcattggtggacctcacggcga

SEQ ID NO: 2485 - DNA, 428 bp, Zea mays
  unsure at all n locations
  Clone ID: LIB143-036-Q1-E1-G8
caacaaccgagctagcagagggcatgtttgcgttcttctgaatgttgtgcgcgtgtctgtggcagcataagtagagagtatgttgatgatgatgatgacgacgacgatcagttcgcggcggggaggttagaagtggccgggcgccgatttccgtcctagtttgggcgtttggcctatagccgagccggcaggcgcgttctccagttcttggatcaggggaagaactcctgccgggctgcctgcttcgttttctacgcaccctcctcccctctgtaattatcccaagcaccacctcgtactggtagtagtagtagcagtgtntttgtgtgtgtgtgtgtgatgctacgatgtagctgtgccttttcttctgctcgcctggaaaccttttgcgttccaaactgcagctgttgtgttccctccctgcattg

SEQ ID NO: 2486 - DNA, 433 bp, Zea mays
  Clone ID: LIB143-036-Q1-E1-H1
gggtcgacgcacgcctctaaactgagtcgtactatagctaggcgcgtctgctgcacgaaggtatcagtcacagcatgcatggaggggaacgaggaggacgtccgcctgggcgccaacaagttctcggagcgccagcccatcggcacggcggcgcacggcacggacgagcaggactaccaggagcccccgccggcgccgctcttcgagcccggggagctcaagtcctggtccttctaccgcgccggcatcgccgagttcgtcgccaccttcctcatcctctacatctccatcctcaccgtcatgggcgtctccaagtccacctccaagtgcgccaccgtcggcatccagggcatcgcctggtccttcggcggcatgatcttcgcccacgtctactgcaccgccggcatctccgggggggcacatcagcccgggg

SEQ ID NO: 2487 - DNA, 455 bp, Zea mays
  Clone ID: LIB143-036-Q1-E1-H2
ggtcgacgcccgcgtccggcgaaaagagaaaccaacacaacaagcaaagcagcgatccgacatccgagagatggacgcggtgatgttcgggctggagactcccctgatggccgcgctgcagcacctgctggacgtgcccgacggcgacgccggcgcgggcggcgacaacaagacgggcagcggcggcagcgccacgcgcacctacgtccgcgacgcgcgcgccatggcggccaccccggccgacgtgaaggagctgcccggcgcgtacgcgttcgtggtggacatgccggggctgggcacgggcgacatccgggtgcaggtggaggacgagcgggtgctggtggtcagcggcgagcggcgccgggaggagcgcgaggacgacgccaagtacctgcgcatggagcggcggatgggcaagttcatgcgcaagttcgtgctgccggacaacgccgacg

SEQ ID NO: 2488 - DNA, 296 bp, Zea mays
  unsure at all n locations
  Clone ID: LIB143-036-Q1-E1-H4
cgctcaatgacagagtagattattacatcttgatcaggtcgtcggggagtacctgctcggtgaagttccatcttccgtagactggcgcgggaagaaggtcctctctaaaaagccgccggcgttgacgagcagctggcgcgcgctggagtattgacatcagttcgaggtcctgtatgaatgcactactcgtacgatatatcttgggcgagtgcttgctgaaataatcggacatggncggtggggctctctancgcgacctggtacaagagcgactctcctctgtgtacgtccggacg

SEQ ID NO: 2489 - DNA, 413 bp, Zea mays
  Clone ID: LIB143-036-Q1-E1-F7
aagacaatcacccttgaggtggagtcctcggacaccattgacaacgtcaaggccaagatccaggacaaggagggcatcccaccggaccaacagcgcctgatcttcgccggcaagcagctggaggatggtcgcactcttgcggattacaacatccagaaggagagcaccctccacctggtgctccgcctcaggggtggcatgcagatctttgtgaagacattgactggcaagaccatcaccttggaggtggagtcgtctgacacaatcgataatgtcaaagccaagatccaggacaaggagggcattccaccggaccagcagcgcctgatctttgctggcaagcagctggaggatggccgtaccctcgccgactacaacatccagaaggagaagcacctccacctggtgctccg

SEQ ID NO: 2490 - DNA, 415 bp, Zea mays
  Clone ID: LIB143-036-Q1-E1-E12
aggtgctcgtcgccgtctccgagcacgtgaaccgcctcgtcgccgcgcggctccagttcgacgtcatgggcgtggagacggtcctcgtcgcgcgcaccgacgccgtcgccgccacgctcatccagaccaacgtcgacgcgcgcgacgaccagttcatagtcggcgccaccaacccgggcctcaggggccagagcctcgcgggcgtgctctcgggcggcatgtcggcgggcatgagcggaagggagctccaggccatctaggacgagtggctggccgcggtgcagctcaagaccttctccgagtgcgtcatggacgccatcgcgggcctcggcatctcggcccaggagaagcatcgcaggctccaggagtgggaccgcgccacgggcggctacgacaggtgcggtgtcaacgacca

SEQ ID NO: 2491 - DNA, 416 bp, Zea mays
  Clone ID: LIB143-036-Q1-E1-E2
gattcacctccagttcataggcacagcagcagaaagcgccaggagcttaagaacatggcgaacaggggcttgcatctggctctgttcctcgtccttctcgggctgtcgtccaatttggcagccgggcagatcctgttccagggcttcaactgggagtcgtggaagcagaacgggggatggtacaacttcctgatgggcaaggtggacgacatcgccgaggccggcatcacgcacgtctggctccctccggcgtcacactctctcgccgagcaaggctacctgccggggcgcctgtacgaccttgacgcgtccaagtacggcaacgaggcgcagctcaagtccctgatcgaggcgttccacagcaagggcgtgaaggtcatcgccgacatcgtcatcaaccaccgcacggcggagca

SEQ ID NO: 2492 - DNA, 380 bp, Zea mays
  Clone ID: LIB143-036-Q1-E1-E3
gccccgtggctacctcacccgccggggctcgccacgatgaaaggcctcctcgcgtgcgccaccctcgcccgccgcgccgccgcctcctccgcgcccgcgcgcgtccgccacctggcgggcgccgcggatgcggcggaggccgagctcaagaggacggcgctctacgacttccacgtcgcccacggcggcaagatggtgccgttcgccggctggagcatgcccatccagtacagggactccatcatggactccaccgtcaactgccgcgccaacggcagcctcttcgacgtcgcccacatgtgcggcctcagcctcaaaggccgcggggccatccccttcctcgagtccctcgtcgtcgccgacgtcgccgcgctcaggga

SEQ ID NO: 2493 - DNA, 178 bp, Zea mays
  Clone ID: LIB143-036-Q1-E1-E4
caccgggcacacgccccgagctcagcttagctccactccatctccaatcagagtcgtggcgactgcaccagagctagctacatcggccctcacaatgccgattaataggatcgccctggggaaccatcatgatgtgtaccatccaggcgcactcatggcagcattccctgagttcatc

SEQ ID NO: 2494 - DNA, 414 bp, Zea mays
  Clone ID: LIB143-036-Q1-E1-E5
aaagaagacgcggcactccgaggtcggccacaagagcctgctcaagagcgacgacctctaccagtacatcctggacacgagcgtgtacccgcgggagccggagagcatgaaggagctccgcgagatcaccgccaagcacccatggaacctgatgacgacctccgccgacgaggggcagttcctgaacatgctcatcaagctcatcggcgccaagaagaccatggagatcggcgtctacaccggctactccctcctcgccacggcgctcgccctcccggaggacggcacgatcttggccatggacatcaaccgcgagaactacgagctgggcctgccctgcatcgagaaggccggcgtcgcccacaagatcgacttccgcgagggtcccgcgctccccgtcctcgacgacctcat

SEQ ID NO: 2495 - DNA, 417 bp, Zea mays
  Clone ID: LIB143-036-Q1-E1-E6
tgaagcgctcgggccgcccatgccgtcgtctccgttcgacggtgaggcagtgggcacgttagcgatttcagtctagatgtatcctgagtgcgagatccctttcaaacttctgctgattggtgattcgggtggtgggaagtcacgcttgcttcgcagatttgcatcataattcttatttggacaattagttcaccagggttgcggttgagttcaacattcgtacagtggtccacgatgggaaggccatattacttcggatttgggatactgctgggcaagagcgcttcatgacgatcattagcagctactatcgcggtgctcatggaatcattcatgtatctgacgtgacagaccaagaaagcttcaattatgtgaagcaatggttggtctagagtgaacgttatgcaggtgataatg

SEQ ID NO: 2496 - DNA, 421 bp, Zea mays
  Clone ID: LIB143-036-Q1-E1-E7
acagccgcttcaccgcgccgccaccgccaccgcgaggatgccgttcaagaggttcgtggagatcgggcgcgtggccctggtgaactacggggaggactatggccgtctcgttgtcatcgtcgatgtggtcgaccagaacagggcacttgtggatgcccctgatatggtcaggtgccaggtgaacttcaagcggctctcacttactgacatcaagattgacatcaaacgtgtccccaagaagacagccctgatcaaggcgatggaggaagctgatgtgaagaccaagtgggagaacagctcatggggcaagaagctgattgtccagaagaggagagcatcgctcaatgactttgataggttcaaagtcatgctggcgaagattaagaggggcggtgctatcaggcaagagctcgccaagctg

SEQ ID NO: 2497 - DNA, 441 bp, Zea mays
  unsure at all n locations
  Clone ID: LIB143-036-Q1-E1-E8
cacaccgggcacaccccccgagctcagcttagctccactccagctccaatcacagtcgtgaccagagcgcgagagctagctagagggccgtgaaaatgccgatcaataggatcgccctgnggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctggttcgtgccgtgtccggtggcgcgaacaatctccggcgggcacgtgaacccggccgtaaccttcggcgccttcgtgggcggcaacatcaccctgttccgagggctcctgtactgggtggcgcagctgctggggtccacc

SEQ ID NO: 2498 - DNA, 229 bp, Zea mays
  Clone ID: LIB143-036-Q1-E1-E9
cgtccagcggcatggtgtgtttgggtacggatcgcaggccgaggagggtcgccatcgtcgtcgccggcgacgcccgtgaagctggtttgggtacacatgagccgttcatcattccgcgcggatgtcggctcgtgcctgatcggggtgccgtgcgagctgatctgataagacgtgttcggtaacaatagcgagctcctgcgccaccacaaccccgtgcacgggaacgtgc

SEQ ID NO: 2499 - DNA, 400 bp, Zea mays
  Clone ID: LIB143-036-Q1-E1-F1
ggtcgatgcacgcctctagaatgagtcttatcaccagaagaggagtgctaaaatccatgacttctgccttgggatcccttttggtggtcttttattctctatggggcttctaggatacatcttctccagaagcaccataagtcttgtcttgggcattgcaccagggctagccactctgctacttggcactctcagtctgaagttctggaggagcggcagatccagcttcctgcttatcttggctcaggcaacaatttctgcattcctggcatggaaatactctcatgcttacttcttgacaaatagactccttccttggggcttctacgcgtcactgagcactgcaatgggttgtttctacgcctatgtgctacttgcgggaggaaatcccccgcctaag

SEQ ID NO: 2500 - DNA, 417 bp, Zea mays
  unsure at all n locations
  Clone ID: LIB143-036-Q1-E1-F10
acgcactctgacccccgcccccgccgcagcgagacgagagcgcccgcaccaaggcaagccgaggcggcgagcgggacaggtagcggctgcctaccaccgccagcctccgcccacccaacaacagcaccaccaccacagtccggtcccgtgccttccaattcggtcgtcccacgcatcgattgcgcccgcgcacgcgcccgtcgctttgccgtcttcgaccacccgcaagcaacctatatagcgcgccgcgaattccgcccggcttcctcgtcgcccgccgcagtgagtgagaggaggaggtcgatggatctcaaggacggcgagaggangggagcggcggggccggagccggggccgctgtcgaggcacgggtcgatctactcgctcacgttcgacgagttccagaacacgctcggc

SEQ ID NO: 2501 - DNA, 412 bp, Zea mays
  Clone ID: LIB143-036-Q1-E1-F11
actcatggtgtatgctgttgaagcctgtgaaattgttgtccaggtaatatgttattcgatgtagtttccttttcagttcaagttgctcaggcacacgttcattttggagtcatatgggagcaaatagaacccacattcctaccattgactccagtacagtgtgctgtcgtggggtgaataaaagcagctaaacagacaatgttttgtaagatctaagttggtaagatctgcggcttcaagtggattgcaccacaagttctaaatggaacaatctaatgcctccatctttacagtatcgtttgtattctgatgagaagaagaaaaaggcttgcacacctgacaacagatgaagttaggttacctcagaagtcatcaacctgtgcatcagggtttcttatgtccgctgctgatt

SEQ ID NO: 2502 - DNA, 321 bp, Zea mays
  Clone ID: LIB143-036-Q1-E1-F12
atatatgcatagctctcgcgactgctctaatggacgacgccctaaaacggtgggacatgaatgtcacagttatgcacaaggtcatgctcacaagaaagttcgcattagcagaagaactgagtaaacatacgctccatatcacgaaggataacagtggagacaataccgacagaacatgattcagggaagtaactatccaaggtgtgaccacaggtgtacagaccaccagcatcatggctgcgcagcacccagacatgtagaacaaatgacttcgcacgatgcaccacagtaccgggtaatcgatactcatgaacacacatg

SEQ ID NO: 2503 - DNA, 442 bp, Zea mays
  unsure at all n locations
  Clone ID: LIB143-036-Q1-E1-F2
ctacgattttgctgctctccgaccccgagctccgaaggccgcagcatcaggcgaggcccccctcgcgtgtgaccgagatggcgctgccgaatcaggggaccgttgattaccccagcttcaagctcgtcatcgtcggcgatggtggaactggtaaaactacatttgtgaataggcatctcactggagagtttgagaagaaatatgaaccaaccattggtgtggaagttcatccgttggatttcaccactaactgtggtaagatcaggttctactgctgggataccgcagggcaagagaagtttggtggcctcatggatggatactatatccatgggcagtgtgcgatgatcatgtttgatgtaacctcaaggcttacttacaagaatgttcctacgtggcataaggatctgtgcanggtctgtgaaaacatcaccattgtcct

SEQ ID NO: 2504 - DNA, 406 bp, Zea mays
  Clone ID: LIB143-036-Q1-E1-F3
cgtcatctccaagtgcgtgcgccggccgccccctatcacgccggccctgtgtgtgttccccgctaccagccatggcgtcgccgttctccgtgccttcgctgatcatggaggaggaagggcggttcgaggcggaggtggcggatgtggagtcgtggtggggcacggagcggttccggctcaccaagcgcccctacaccgcccgcgacgtggtcctcctccggggcacgctccggcagagctacgcgtcgggggatatggccaagaagctgtggcgcacgctcaaggcgcaccaggccggcggcaccgcctcccgcaccttcggcgcgctcgaccccgtccaggtcaccatgatggccaagcacctggacaccatctacgtctccgggtggcagtgctcgtccacgca

SEQ ID NO: 2505 - DNA, 330 bp, Zea mays
  Clone ID: LIB143-036-Q1-E1-F6
ggtatcacaattcacaattaaccaacagttttgccactttcatttgttttctttttcaaggcacactgcttacttccttgttgctggcaatgagatgacaaggcaacagggccatggagtagcctgcaaacatgcaacaagtaaaccagctgagtaaccattttagccgtggagctggtaaccattggaataattactgataagccttttatccagtgtgcctttatagcattccgtatacaatggagttgaaacaacctccacattcaaagaaacaatggtactgactctttgtaggctttatagccattcttgagcagaaaatgtact

SEQ ID NO: 2506 - DNA, 358 bp, Zea mays
  Clone ID: LIB143-036-Q1-E1-E11
aaggggctgtacatgggcaacggcggcggcgccaacgtcgtcgcgcgcggctacaccaagggcgacggcctcggcgccgagatcgtcggcaccttcatcctcgtctacaccgtcttctccgccaccgacgccaagaggaacgccagggactcccatgtgccgatcctcgcccctcttccaatcgggtttgccgtgttcctcgtccacctggccaccatccctatcaccggcaccggcatcaaccccgcgcggagccttggcgccgccgtaatttacaaccagcaccatgcgtgggctgaccactggatcttctgggtcggccccttcatcggcgctgcgctggctgccatctaccacc

SEQ ID NO: 2507 - DNA, 384 bp, Zea mays
  Clone ID: LIB143-017-Q1-E1-H8
acattctactcgccgcatcttctagaatcatccagaggcgtacctgtgaagcgctagatcggtgacgcatggcaatgcagaccggggtcgcgacctctaacgtcctcatcctcgtcggtgcagggatgacgggctcgatactgctgcagaatggccgcatagctgatgtcttgggagaactccagcgtgtaaatcaaggaacttcttcgggtccctatgacattgcacttattcaagctcagattctgaatttatcgcaagaagtcagatatttgacattgtcaaagcccattactatactgaatggtaaatctgactcgggacgcactttatcatcctacatactgccatcagcagcacttggagcaatgggttattgctaca

SEQ ID NO: 2508 - DNA, 418 bp, Zea mays
  unsure at all n locations
  Clone ID: LIB143-017-Q1-E1-H9
atcaaagcaagccatgtggaggagggctttagcgatggtcctgttcatggctggcgccgcgctgctcgccggggctgccggcgccggcgcgcatcagggcgtgtggagcatcatcacccggcccatgttccagagcatgctgagccaccgcggcgacagcgggtgccagagcgccttctacacctacgacgccttcatcgaggccgccagcaagttccccggcttcggcaccaccggcgacgagcagacgcgcaggcgggagctcgccgccttcttcggccagacgtcccacgaaaccaccggtggatgggcgactgctccggatggaccgtttgcctgnggatactgccgggtgaaggaacagaaacagacggacccaccctactatggacgaaggaccatacagctaactcataag

SEQ ID NO: 2509 - DNA, 392 bp, Zea mays
  Clone ID: LIB143-018-Q1-E1-A10
acggacgcgtgggctttactgatatcagcatagaaaaagcagttgagtatgatgaatactgtcatagccaccagccgccaattgctttcattaagtccgaagtttgtggcctttttggcagtgttttctgtgactttggtcctgagttcactgttttggatgtcgatggcgaggaaccacatacaggaattgtggcatcaatcagcaacgacaatccagcacttgtttcttgtgtggatgatgaacgtctggagttccaggatggtgatctagttgttttctccgaagtgcatggaatgaccgaactcaatgatggaaaaccaagaaagattaagaatgcaaggccttattcttttactctagaagaagacaccacctcatatggcacttac

SEQ ID NO: 2510 - DNA, 375 bp, Zea mays
  Clone ID: LIB143-018-Q1-E1-A11
actcgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagacgctttgcaagaagtaccatgct

SEQ ID NO: 2511 - DNA, 342 bp, Zea mays
  Clone ID: LIB143-018-Q1-E1-A2
agagaaatatgctgtggatgagaaggctttctttgatgactacaaagaggcccacctcaagctctccgaactggggtttgctgatgcttaaatagaccctatcttggagtgatacattctgctgcctgtatggaatcatgtggtcttttgcatctggagtcaatgtgaacaagcagattgtcgtattgtctttctcgtaataaatttgtcgatgttgagcccttaggctgttgttggtacattggtacttcgtcgatgcttgaattgggacccttagtccgttttcccagactctgatgctgtatgcaactgaaacaagtaaatctatgatcttaaggctgc

SEQ ID NO: 2512 - DNA, 413 bp, Zea mays
  Clone ID: LIB143-018-Q1-E1-A3
ggtctagggttgacgggcccgtcagacatgcatccgctataaataaacatcacagcacaaacgatgaaatcaaatgctctttcgcttctattagtgataatatctgtgcagatcttgtacctttcacccgagctgaatacctctttcagaacactgagtgtggcttaaatttacaatacactgggtgtggcttaaatttaaaacgttattttatgtatcccttaaaacacactgtttactatcctctagtgaacctacaattggccaattgtgggaccaggtaaaaacggatttgacaaacaattgtctgacactgtcaactttacatttgatttagagagtacaaaaaactaggggtgagattatagggttgacaacctgaagaaaaaaagatgttaaattactgacacaaa

SEQ ID NO: 2513 - DNA, 394 bp, Zea mays
  Clone ID: LIB143-018-Q1-E1-A5
accacgcgtccgcggacgcgtggggggaagatcccgattgatgtgaacaggatggggattgggctcatgtccttgtccggccacaagatttatggccccaagggcgtgggggccctctaccttcgtcgccgccctcgcatcagggtggaaccacagatgaatggtggtgggcaggagcgtggcatccgcagtgggactgttcctacacctcttgttgttggatttggggctgcctgtgagattgccgctcaagagatggattatgaccacaggcgtgtcagtgctctgcagcagaggctgcttgatggcatacgtgcgcaggtcgatgatgttgtcatcaatggaagtatggagcaccgttacccaggcaatctaaatttgtcatttgcttatg

SEQ ID NO: 2514 - DNA, 405 bp, Zea mays
  Clone ID: LIB143-018-Q1-E1-A6
accgcatcctctcatcagcttccttccacattcgtctcgagatctcgccccgtcgccatggacgcgatcgacagcgtggtggatcccctccgcgacttcgccaaggacagcgtccgcctcgtcaagcgctgccacaagcccgaccgcaaggagttcaccaaggtggcggcgcggacggcgatcgggttcgtcgtcatgggcttcgtcggcttcttcgttaagctcatcttcatccccatcaacaacatcatcgtcggttccggctaagcttacacgagtacatggcgactagcatgggagtagtgcaatacttttgggagcaatagataacgaggatcctggtctttcgaatagtattgttaatgaaatttttcgttcggttgtgtttctgaagtaatcgttgta

SEQ ID NO: 2515 - DNA, 398 bp, Zea mays
  Clone ID: LIB143-018-Q1-E1-A7
agggctcctctgtttcctttcgtcaccgtcctcgccgttgtgttcccctctcagtctcggggttttcttctcgcgggcacctccggctgcttcctttgccaccgcagcaccagcgctgtccatgaagcccccgccgctctcctcgttgcaggaggagggggaggaggggcctaccgtcgaggactcgtccgtcttctccgcagccgttgtgccgcctcgccccgccacgcacagccactcgctccacaagtacgcgccgctggactggtccgcctacttcgacgaggagcgccgcgtagccatccccgacaccgacaacgttttcaatgcgtacacgaccggatcggaggggcccgtcgtgtcctgcctgcacggaggcggttattcggggctttcat

SEQ ID NO: 2516 - DNA, 409 bp, Zea mays
  Clone ID: LIB143-018-Q1-E1-A8
acagcaaggcaccacacctcttcttcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactgagccggtcaggcgatggcgcacgagagtcgagaggacgacgacgagtcgtataaatataatagcggcgtctaaataagatcctgtcaa

SEQ ID NO: 2517 - DNA, 433 bp, Zea mays
  Clone ID: LIB143-018-Q1-E1-B1
ggtctggggtcgacgacgcgtccggccagcagatacgaatccgacgagctcgatcgctccacttccccgatcgcacgccaatcagcaccagccaccgtggcgatgacggaggaggcggaggcgaaggcgaagggcaacgcggcgttcgcggccggccgtttcgaggaggctgtccagcacttcagcgacgccatcgcgctcgcgcccgacaaccacgtcctctactccaaccgctcggcggcgtacgcgtcgctctggcgctacgcggaggcgctagatgacgccaagcggaccgtggcgctgaagccggactgggccaagggctactcccgcctcggcgccgcgcaccttggcctcggtgacgcgcccaaggccgtcgaggcctacgagaaagggcttgcgctcgagccgtccaatgaggcgctcaaatccg

SEQ ID NO: 2518 - DNA, 413 bp, Zea mays
  Clone ID: LIB143-018-Q1-E1-B11
aattgcagcagtgcttgaggattcagtgatcagcagatctgcaaggacaaaaggaccaaaggagtgagctggtttttatattttaactgatgcacctggatgctttattgagcggtgtctatgaaatgagttggatggaagattgtcgtgttttggacaatgccaacctttgtttccgctgtgcctgccaaggttgtggcttccttgggtgatgcttatttgagaacatagctgttgtgctctgagcatgtcctgtgtgcctgtcatggcggcttcttttggcgacatcataccaacatattcaatgtcaggctttaaagattggagaaacgcccatgggcctggcaaactgtggcatgtggctttgaactttgccaattggagacctgatgtggatcattttgggacgcgag

SEQ ID NO: 2519 - DNA, 416 bp, Zea mays
  Clone ID: LIB143-017-Q1-E1-H7
acatcccccttgcaagtatagtctcggcggctctagaagacgatgggcaaggacgacgtgatcgagagcggcgctggcggcggcgagttcgctgccaaggactacacggaccctcccccggcgccgctgatcgacgcggctgagctggggtcctggtcgctgtaccgcgccgtgatcgccgagttcatcgccacgctgctgttcctgtacatcacggtggccaccgtgatcgggtacaagcaccagacggacgcgtcggcgtcgggtgccgacgcggcgtgcggcggcgtgggggtgctgggcatcgcctgagccttcggcggcatgatcttcgtcctcgtctactgcaccgccggcatctcggggggccatatcaaccccgccgtcaccttcgggctcttcctggcgcgcaaggt

SEQ ID NO: 2520 - DNA, 430 bp, Zea mays
  Clone ID: LIB143-017-Q1-E1-G2
agaactggcaggtggctatggaactctggaggagttgcttgagatcattacttgggcacaactggggatccacaagaagccggttgggcttttgaacgttgatggattctacgacccgcttctgtctttcatcgacttggctgtcagagaaggtttcgtatcggaggcggcaaggcgcatcatcatctcagccccaacagccaaggagctagttatgaagctggaggactacgtcccggagtatgacgtcggcttggtctgggaggagcagaagcccaacagcttggtcccagctgctgggatcacctcatcctgatgatctctcaccttccagcctgcaccgcatcatatatacacatataactaagtaactaaccgatcgaagcctgccacaaattttttgttcatctgccaaagtcctaaccaaagg

SEQ ID NO: 2521 - DNA, 399 bp, Zea mays
  Clone ID: LIB143-017-Q1-E1-G3
ggaggaacgaacggacaggttgttgcacagaagcgacatggctttcgcgcccaaaacgtcgtcctcctcctcgctctcctcggcgttgcaggcagctcagtcgccgccgctgctcctgaggcggatgtcgtcgaccgcaacaccgagacggaggtacgacgcggccgtcgtcgtcactaccaccaccactgctagagctgctgcggctgctgtcacggttcccgccgccccgccgcaggcgccggcgccggcgccggtgccgccaaagcaagcggcgggacccgccgataggaggagccgtccggtgtcggacaccatgggggcgctcatggccaagggcaagacggcgttcatcccgtacatcaccgcgggcgagcccgacctagcgacgacggccga

SEQ ID NO: 2522 - DNA, 361 bp, Zea mays
  Clone ID: LIB143-017-Q1-E1-G4
gggtcgacgcccgcgtccacccacacgtccgcgatctcgtttcaaatccagccatcctcgtttcctccgtcccgcagcatctcaaccccatggccaagatcaagatcgggatcaatgggttcggcaggatcggaaagctggtggccagcgtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctgtgtttggctgcaggaaccctgaggagatcccgtggggttc

SEQ ID NO: 2523 - DNA, 416 bp, Zea mays
  unsure at all n locations
  Clone ID: LIB143-017-Q1-E1-G7
acggacgcgtgggcggacgcgtggggcaccttggtgggaaacaaaccaagggtggacgaagaagacgtcaagagcctcagctacctgaagatggtggtgaaagagaacttcaggatccacccaccggggaccttgttgattccacgggagaccatgaggagctgcgtcattggcggctacgacgtgctgccaggcacaaggattttcgtgaacgtttgggcaatgggaagggatgctagcatctgggatcgcccggaggagttcagtcncgagaggttcgagggaagtcatgtcgactttagaggctccagttttgagctcctcccgttcggctcagggcgaaggtcatgcnctgccatcgccatgggtgtcgccaatgtggagcttgtcttggccaacctgttacattgctttga

SEQ ID NO: 2524 - DNA, 423 bp, Zea mays
  Clone ID: LIB143-017-Q1-E1-G8
cccacgcgtccgcgcgcgccaccgagatcatcttcgtcctcgagggcacgctcgaggtcggcttcctcaccaccgccaacaggctcctcagcaagaccgtcgccacgggggacgtcttcgtcttcccccgcggcctcgtccacttccagcagaacagggggcacggccccgccgccgtcgtcgccgccttcaacagccagctccagggcacgcaggccatcgccatgacgctcttcggggccacgccgcccgtgcccaccgacatcctcgccaaggcattccgggtcggcagcggggaggtcgagcacatcaaggcaaacttcgcacccaagtagacgacgaccaggcagcgtgtctgcatttgttggtttctcaataaatatcccgcggcaacgattatattgctcggtcgatgtatcgtgt

SEQ ID NO: 2525 - DNA, 420 bp, Zea mays
  Clone ID: LIB143-017-Q1-E1-G9
acacacaacagcagctcacaaacctaacacacctcaacaagcagagcaaagacccgggattcgccggcgcggtagcgagagcgagagatggacgggaggatgttcggtctcgagacccccctgatggtggcgctgcagcaccttctggacgtgcccgacggcgacgccggcgcgggcggcgacaaggcgagtggtgccgcggcgggcggcgggcccacgcgcacctacgtccgcgacgcgcgcgccatggcggccaccccggccgacgtcaaggagctcccgggcgcgtacgcgttcgtggtggacatgccggggctgggcacgggcgacatcaaggtgcatgtggaggacgagcgggtgctggtgatcagcggcgagcggcgccgggaggagcgcgaggacgccaagtacctgcgcatg

SEQ ID NO: 2526 - DNA, 421 bp, Zea mays
  Clone ID: LIB143-017-Q1-E1-H1
acaggtctatatgttaaaggctgaaggtatcgcatttaggttcttacccgaccctcttcaaataaagaatgcactggagatgaaatcgggcttaactgcttttgatggtgttcctgtttttcagtcagatctgctggttgtgaagaagcagaagaagcgctactgtccagtatattttcaaaaggaagacatagaaagagaacttacaagggcttccaaaggttcaagagggtcagccttatctaagaaaattatggttggaagtttggaggatgtcctgaagaaaatggagataaatgaaagagattctggctgggatgatttgatctttataccccctgggaagagcctcaaccaacatatcaatgaggtatcagcatgattttgttccacggtgatagctcagagtttgaacagacta

SEQ ID NO: 2527 - DNA, 395 bp, Zea mays
  Clone ID: LIB143-017-Q1-E1-H10
gtccgatacaccaaccgagctcagcttagctccactccagctccaatcacagtcgtgaccagagcgcgagagctagctagagggccgtgaaaatgccgatcaataggatcgccctgcggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgccttcgtgggcggcaacatcaccctgttc

SEQ ID NO: 2528 - DNA, 418 bp, Zea mays
  Clone ID: LIB143-017-Q1-E1-H11
acaggtctatatgttaaaggctgaaggtatcgcatttaggttcttacccgaccctcttcaaataaagaatgcactggagatgaaatcgggcttaactgcttttgatggtgttcctgtttttcagtcagatctgctggttgtgaagaagcagaagaagcgctactgtccagtatattttcaaaaggaagacatagaaagagaacttacaagggcttccaaaggttcaagagggtcagccttatctaagaaaattatggttggaagtttggaggatgtcctgaagaaaatggagataaatgaaagagattctggctgggatgatttgatctttataccccctgggaagagcctcaaccaacatatcaatgaggtatcagcatgattttgttccacggtgatagctcagagtttgaacaga

SEQ ID NO: 2529 - DNA, 405 bp, Zea mays
  Clone ID: LIB143-017-Q1-E1-H12
gacgcgaaaaggtcagagttcagtcatgtcatgcttgatttgagttctgtgccagatcaaagcaagtagtagtacgtgagaagttaaccatgaacagacaccctttttctctttgtgtatcacagattttgaaacttgctgagagggaaaaacaaatttatggggaaaaaatgtgacactgaaagccatttgcttccagcagcttaagaattgttgcggtagatgcaactgaagagggtcttcaagtaagtaaatcaactactacaatggctcactaaaaatggtcgacaggacagtttcggaaccttattgttgttcttcagagagaacatcgacaaaggaacttgaagctccgtaggcgaaaggatctctagaaacgactaactaaattctcctaggtactac

SEQ ID NO: 2530 - DNA, 421 bp, Zea mays
  Clone ID: LIB143-017-Q1-E1-H3
acatgaattgcaactcatcagcatgcagcagctagtaccccggctgttctgttctgttctgtccgctagtgtcgtcttctgctggtgagcgaggcaaactatgcgtgcgtggatgtggatggtacaggaggcactggccaagggcagcccagccgagagcaggatccgcgcggacacggaggaggccgtcaagagcatgcgcgccgcggcctgctcctgctcctgcacggggcggcccgccgcccgggactgccggccgtgcatgctccggcacgtcgccgaccggctgcgcgacgccggctacgacagcgcgctctgcaaatccaagtggacgcgctcgccggatatcccttcaggtaacctgcgtctcgcgcgtcgtgattataacttcgtcttttcgttctttctaccgcaataaacg

SEQ ID NO: 2531 - DNA, 394 bp, Zea mays
  Clone ID: LIB143-017-Q1-E1-H4
gactcacgcgtctacgtggtgcgagagcgcgcgcgcaagcaagcaagcaagcaaggagcgtcgtgtctagctagctgagcacctggttttggagcatggaggacaacggtgccgccgccgccgccgccgctcccgcgacgagcatgcctgccgagaagcgtgtggcggtcatccagggggacgcgccgccggagccggcggcggggctactgccctgcgggccgaggaagacggggctccacctcttcgtcatgaacatcaggagcgtcttcaagctggacgggcttgggtcggaggtgctgcgcatcgcggtgcccgcggtcgcttgccttggggggggatccgctcccctctttggtggacacggcgttcatcgggcgtttaggttcggtgg

SEQ ID NO: 2532 - DNA, 418 bp, Zea mays
  unsure at all n locations
  Clone ID: LIB143-017-Q1-E1-H5
acaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcncacccggtcaagctcgcgcctttcagcccggaccaggaggacgcgtcggtgctgtggacggagagcaaggacttgggcaagggcttc

SEQ ID NO: 2533 - DNA, 322 bp, Zea mays
  Clone ID: LIB143-017-Q1-E1-H6
ccgggccgacccaaacgtccacccactcgtccgggccaggcagctcggcaccgttgtggctgtgcggaactgcacaagagcgtttcgcctcggccaccacgaacggagaacgcggtagccatggccatggaggaagcggtgaagatgacgtgcaggaagaagggtggtctgagaacagtgcccttcatcttcgccaacgaggtggccgagaacctcgccgtggtgggtttctcgaccaacatgctgacgtacctgaccagtcagctgcacatgccgctggggaaagccgccagtacgctcacgaacttcggggggacctccg

SEQ ID NO: 2534 - DNA, 411 bp, Zea mays
  Clone ID: LIB143-017-Q1-E1-G12
gtccagcagcacaagatcggggacgacagcagcctgactgacgagatcctcgcagcaggccccaacttctgaactaaagcaatggatccggatgaataaaacgatggtgtgtgtgcgtgggtgcgtgtgaagatgattacgacgacgacgaaaaaaaaggtgttggatcgatgagccaacatagtaatagattagctgggtatattgtcatgggtgcgtctggtctctggtcttgttatctataaagctgtctcaagcagctatcatattctatttcaaattctattctgtaagcgtgtagttcaaaacaatgctttacacaaccatatgcacagtctatctaaggttggtctgttctatcagcttgttgggaaaagtttgcgtgtgcttgtatcttgccccctgtactct

SEQ ID NO: 2535 - DNA, 389 bp, Zea mays
  unsure at all n locations
  Clone ID: LIB143-017-Q1-E1-E3
gacatggacgcgctggtggcggcgtggctgccggggtcggaggggcanggcgtggcggacgtgctgttcggcgactacgggttcacggggaagctgccgcggacgtggttcaagtcggtggaccagctgcccatgaacgtgggcgacgcgcactacgacccgctcttcccgttcggcttcggactcaccaccaagggcacgaagtgagtgagtgtgaggcgctctgatgggatgtggcctgtgagtgagctgtgtattcgtgggcgggcgtgaggctctttgggtttcgaattggttgggggtgacgggcggcgagtcgtgtacgccgcacacattgcgcagcgtacgttgggttgggatgtgtgcgtctgggtaataacagtgatgca

SEQ ID NO: 2536 - DNA, 422 bp, Zea mays
  Clone ID: LIB143-017-Q1-E1-E4
agatttaatcagaaaaactgcaaaaaaattgggcgcagtggggttttgaacccaggacctccctcttctaagctgggagcactaaatgtaagaggctaaccagtagaactctagcgtatttgttgtaaatagcaaatataaaatctaaatatatatatactatgttttataaaataaaaaaaatataatcgtgccgggccgggccggcactgcgggccgagacagcggcccaagcacggcacggctgtcgtgtcgggcccgacccggcactattaaacgggccgtgcttcgggccggcccgttaagcacggcccatttggccatctataaataagggacgagttgtgagacagcacctcgctgtctcgtaatcagacgcatggagcaatatgattcttgtaaactctagcttcatccaatct

SEQ ID NO: 2537 - DNA, 425 bp, Zea mays
  Clone ID: LIB143-017-Q1-E1-E6
cgcctccccctcaagttccacaaacgcaagccccaatctcgccgtcaccacccccaatccagcaaacgcaaacccgatatcgccgccgccgccgccgccgccgcgatgtctcgccgctatgacagccgcacgacgatcttctcgccggaggggcgtctctaccaggtggagtacgcgatggaagcgatcggcaacgccgggtcagccctcgggatcctagcggccgacggcgtggtcctcgtcggcgagaagaaggtgacctccaagctcctccagacctcgcgctccgccgagaagatgtacaagatcgactcgcacctggcgtgcgccgtggccgggatcatgtccgacgccaacatcctcatcaacaccgcccgcctccacgcccaacgctacgcgctctcctaccaggagaccatccccgt

SEQ ID NO: 2538 - DNA, 415 bp, Zea mays
  unsure at all n locations
  Clone ID: LIB143-017-Q1-E1-E7
acccacgcgtccggctcccggctcccccacggtactccagccgctaccctgcgattccgccagtacgccaccaccaccgagcctggactaccgccgccgcccttcgccgatatcttcagcggcgaacagcgcccaccagatcccgcccctgcgatggagtccgtggtgaacccgaaggcatacccgctggctgatgcgcagctgacgatgggtatcctcgatatcatccagcaggccgccaactacaaacagcttaagaagggagcgaatgaagcgacgaagaccctgaataggggcatatcggagtttgtagtgatggcggcggacacagagcctctcgagatcctgctccacctcnccttgttagctgaggataagaacgtgccatatgtgtntgttccatcgaagcaagctc

SEQ ID NO: 2539 - DNA, 422 bp, Zea mays
  Clone ID: LIB143-017-Q1-E1-E8
aaaaactttttatgctggaaaagcgggtgtgccagttactgaggtgaatgttcctgttgttggaggccatgcgggtattactattctgccactcttctcgcaggccactcctgcaagcaattcgttgtcccaagaagacattgaggccctcaccaagaggacacaagatggtgggacagaggtggttgaagcaaaggcgggaaaaggctctgcaacgttgtccatggcatatgctggtgctgtttttgcagatgcatgtttgaagggtctgaatggagttccagacattgtagagtgctcttttgtgcaatcaactgtgacagagttgccattctttgcctccaaggttcggctcggcaagaatggagtggaggaagtgcctggtctgggtgagctcagcgagttcgagaagaatgggctgg

SEQ ID NO: 2540 - DNA, 420 bp, Zea mays
  Clone ID: LIB143-017-Q1-E1-E9
gcaagagaacggcctcactacggacaatctcaaggccatcttggtggacatgttcgaggcaggtatagagacatcttacctgacgctagagtacggcatggccgagctcatcaacaacaggcacgtcatggagaagctacagacggaggtgaggacgacgatgcgctcgccggacggcaagaagctggacatgctagcggaggaggacctcggcagcatgccctacctcaaggcgaccatcaaggagacgctgcgcctgcacccgccggcgccgttcctcctcccgcactactccaccgccgactccgagatcgacggctacttcgtcccagccgggacgcgcgtcctcgtcaacgcctgggcgctcgggagggaccgcacgacgtgggagaagccggaggagttcatgccggagcggtt

SEQ ID NO: 2541 - DNA, 378 bp, Zea mays
  unsure at all n locations
  Clone ID: LIB143-017-Q1-E1-F1
agatgatggtggtgatgagggatcagatgacactgataatgaggaatatgactatcgtgatgatgatgatcctgcagccaatggctaagggggaacctatgacgacgaatatgatggtggagatgattaacatgatgatgacaacgacgacgataatggcgacgatggcaatgaccgaacacgacgaagaaatctgaanacagatgactgatgattatgaagtcgcccaaccagctactagctacaggaaatgatcatcngctgcgacgactagttgcttatactcatgaatgctgcctgttcgtccctgcgcagcagtttactgtttactgggtacagttttttagcttggtcgtggacaattcatagcctagtttg

SEQ ID NO: 2542 - DNA, 405 bp, Zea mays
  Clone ID: LIB143-017-Q1-E1-F3
gaccacacgtccgctcctcgcacgcgaaaaacctagcactccgtagtccctctcctctggaggtattcgcagtcgaccgtgtcctcggagcacgatgaaggttgttgctgcctacctgcttgctgtcctcgctgggaatgccagcccctccgctgaggatttgactggcattctggagtcagttggctgtgaagttgacaatgaaaggatggaactgctgctgtcccaactgagcggtaaggacatcaccgagctcattgccgcgggcagagagaagtttgcttcagtcccatgtggcagcggcggtgtggctgttgcggcaagtgcacctgctgctggcggagctgctcctgcagctgaggcaaagaaagaagagaaggtggaagagaaggaagaaagcgatga

SEQ ID NO: 2543 - DNA, 426 bp, Zea mays
  unsure at all n locations
  Clone ID: LIB143-017-Q1-E1-F4
acccgaaccgcccgtccgtcagccggaagccgatgccggcgccgggcagcgacgagtacgcggagctggagcgcaagccggagaaggtgttcgtgcgcaccagcaccagccagttccaggccctcgtcggcatctcgctgctggagatcctgtccagccactcctccgacgaggtgtacctcggccagcgcgacaccaaggagtggacgtcggacgccaaggcgcatgaggcgttcaagcggttcggcgcgcggctgaccgagatcgagaaacgcgtcgtcaccatgaacgcggaccctcgcctcaagaaccgaaacgggccggccgagttcccctacacgctgctctacgccaacacctccgacacgaagggcgacgccgccggcatcaccgccaagggcattccanacagcatctccatttgag

SEQ ID NO: 2544 - DNA, 398 bp, Zea mays
  Clone ID: LIB143-017-Q1-E1-F6
accaaattcaacgaatttctagcgatttttcgttttcgcagacgaccaccggaaaaatgcgttcaaaacctgcacgtactaattcatcaaagaagattactacgtacgtgcatcgcttttgagaaacgagcagagcaacctgcattgtatgaaactggaaaccgttggccatggctactcagaagatcaaaacggtggcaagcttggccagtagctccttgagaacagcagggcagctggcgttgagcacctcgaagccatccgtcgtctgagtgaaggagccaaggttgccgctagaagagaggaaacggaagcacgcctccttgagcgcagggcaatggtgtcggtcagctaaaaccagcatcgtggccaccgagtccgcgcgtatgtgcttgcac

SEQ ID NO: 2545 - DNA, 421 bp, Zea mays
  Clone ID: LIB143-017-Q1-E1-F8
ggaaaaaaggcccagaggcagtgccgtgaccgattcgagacgcaagagaaggatcgagacgaggcggcggttttccggggcagcatcgtctcggccacgaagatgtcttactcaaggggctcaagtgaaaggtatggatctcgctcaccttactcgagaagcacaaggtaccgaagtcgctctaggagtgtcgactctagtgatgctgaaaaccctgggaacaacctgtatgtgactggtttgtcggctcgtgtaacggatcgagatctggagaagcacttctccactgagggtgaggtgattgatgcaagcgttgtgtatgatccttggacaagggaatcacgggggtttggttttgttaccatggctgctgttaaagatgcagatcgctgcatcaaatatctggaccgttctgtgttgc

SEQ ID NO: 2546 - DNA, 407 bp, Zea mays
  Clone ID: LIB143-017-Q1-E1-F9
attcccaataaagggaatctagctattcacggtctcccagtatgaagagtgaaatgaggcatgagaagaatcctgatgatggagatactaactcatctaggagtctcagtgtctctgacaataatgatgatagcatatcggagacactgttaagtggtgatgatacagaggatcacgacatacagctcatacacatacgacaggacatggaacttttgcgtgatgacaaatctctcttggacataattttggatgagaagaatgctgaagtgcgcaagatttctagcagattaaatgatcttgatctgcagctaatgaaggatatagacgaatgccacaggatgacctcaatgattaaaaagttccttatagcccatgctcgctttttgaaagcacatgaagaattg

SEQ ID NO: 2547 - DNA, 151 bp, Zea mays
  Clone ID: LIB143-017-Q1-E1-G1
agaaaaaaaaaaaaaaaaaaaaaaaaaaaaaaaaaaaaaaaaaaaaaaagaaaaaggcacaaaaagaaaaggatcaaaaattaaacataaacgtgaatacaaaggcaggtcgtcctagaggttgaaacctaacttacggttactggcgagt

SEQ ID NO: 2548 - DNA, 387 bp, Zea mays
  Clone ID: LIB143-017-Q1-E1-G10
tccgccgcagcagctgagtgcgaagaagagatggccggcaagggcgatggcccggctatcggcatcgatctcggcacgacgtacgcttgcgtcggcgtgtggcagcacgaccgcgtcgagatcattgccaacgaccagggtaaccgcaccacgccctcgtacgtcgccttcagcgactccgagcgcctcatcggagatgcggccaagaaccaggtcgccatgaaccccatcaacaccgtctttgatgccaagcgtctcatcggcaggaggttcagtgatgcgtctgtccagagtgatatcacgttgtggcccttcaaggtcatttctgggcctggtgagaagccaatgattggtgtccagcacaagggtgaggagaagcagtttgca

SEQ ID NO: 2549 - DNA, 307 bp, Zea mays
  Clone ID: LIB143-017-Q1-E1-G11
ggcacgccacatgataagcgcacgggaggacttacagctgcaatacaggatgactcagaaatcggcaatgacatggtgacggaatcgccgtagtcgctggcaaagctgccacgcctctcgtgcgccgatactacctcaggttaacacgcgcgggcaggcaatagtacgttctaaccccggttgggtaattgaagtactagctggtagctgatcactctgtgtttggcgtttctgtcctgttcgcaggaaatgtgaccatggcggcctcgtcgccgctggttcttgggctgaggctgggcctcagcgg

SEQ ID NO: 2550 - DNA, 230 bp, Zea mays
  Clone ID: LIB143-036-Q1-E1-C11
tctcgtgtctgggattcgccatgcagatctgtacgagaactgatgctctggatgttgcacgacataccactgctgctgttgctaagggttttgccattggctctgcagccttggtttcccttgcactagggggtgcgtttgtaagtcagtctgctagctcctactgtttatgttctgagtcttaaagttttcatcgggcttatagtcggtgttatgctcctgttctggtt

SEQ ID NO: 2551 - DNA, 418 bp, Zea mays
  unsure at all n locations
  Clone ID: LIB143-036-Q1-E1-C12
agcggaagagttcgcggangaggacaagaaggtgaaggagcggatcgacgcccgcaaccacctggaaacttacttgtacaacatgaaaaacacggtgggcgacaaggacaacctcccggacaagctggaggcggaggaaaaggaaaaggtggaggaggccctgaaggaggcgctggagtggctggactacaaccagtccgccgagaaggaggactacgaggagaagctcaaggangtggangccgtgtgcaaccccatcgtgtcggccgtgtaccagcggtcgggcggcgcccccggtggtgatgccgacggcggcgtcgacgacgaccacgacgagctgtagatggtggtggggagcggtgacgtggagtgccgggaaccaagccaaattttgtaatggtgtttaagggggagggtg

SEQ ID NO: 2552 - DNA, 405 bp, Zea mays
  Clone ID: LIB143-036-Q1-E1-C2
atggcttctcctcgccctcttactaggtcctcctcgggttacggctccttacggttttgtggaagggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggagggctcgcggcctcggcttcgttaccttcgcctccgagaactccatgctcgacgctatcgagaacatgaacggcaaggagctcgacggccgtaacatcaccgttaaccaggcccagtcccgtggcggtggcagtagcggccgtggctacggcggcggtcgcggcggctgccgctatggtggcgggcgccgtgacggc

SEQ ID NO: 2553 - DNA, 197 bp, Zea mays
  Clone ID: LIB143-036-Q1-E1-C3
gcctcatagggtaagatcctcaactccaagatcataatggagcagtatactcttacgtcacgctgcttcagcttcattaacttctactccgaaaactccatactcaattccatcgacaacataaactgtaatgaaatcaactttcttataatcagatttatatacacccaataacgttgcgatagcatttgcagcag

SEQ ID NO: 2554 - DNA, 434 bp, Zea mays
  Clone ID: LIB143-036-Q1-E1-C4
tttccaagccgcaaccttctttcttccctgcttcttcttcttcacggaagcaccagccactagcgacgccctccctgctcaatgggcgcgggtctctctgctcaaaccatggccacccagcaacagcgccattcttccccctcggctccctgggatgcagcaccacgccatcgcgggagcatgcccccatgggagcgccccttatccacgacgtcggcatcatggagctttttcttcaccgtgcgcaggagctccatggccgagctcatccaggccccaatgcctctgctcggtcgcagctctgcaggctctctccatcgcgcctgctccttcctcggcgcgctgaagctcctcagccatggcgcccaagcccttcttcttcctctgcgcaacgccccctcttctccactgcgttaagagcaaggagccttttt

SEQ ID NO: 2555 - DNA, 440 bp, Zea mays
  Clone ID: LIB143-036-Q1-E1-C5
agcgatggggatcggtgagcacttcgagggcgtcaagcagcactgggcgagcaacttcgccttcctcgactacttcaagaaggtctacggccgcgccgagcccctccccaagtggtccgacgccgacgtcgacgagttcatcgcatccgacccggtctacgggccccagctcaaggccctgcgggagtcgaggaagttcgcgctcgccggggccctcgtcggcgccgcccacctcggcggcgtcgcgctcaagtactccaaggcgccgcacggcgtcctgctggcgaccggcttcggcgcgatcaccggcgccgtgctgggatccgaggtggcggaccactggtaccagctctacgagatggacaagcagggggccaacctcaggttcatctactggtgggaggacaaggtctcaggccagaagagctgaaccacatcga

SEQ ID NO: 2556 - DNA, 425 bp, Zea mays
  Clone ID: LIB143-036-Q1-E1-C6
aacgatggggatcggtgagcacttcgagggcgtcaagcagcactgggcgagcaacttcgccttcctcgactacttcaggaaggtctacggccgcgccgagcccctccccaagtggtccgacgccgacgtcgacgagttcatcgcatccgacccggtctacgggccccagctcaaggccctgcgggagtcgaggaagttcgcgctcgccggggccctcgtcggcgccgcacacctcggcggcgtcgcgctcaagtactccaaggcgccgcacggcgtcctgctggcgaccggcttcggcgcgatcaccggcgccgtgctgggatccgaggtggcggaccactggtaccagctctacgagatggacaagcagggggccaacctcaggttcatctactggtgggaggataaggtctcaagccagaaga

SEQ ID NO: 2557 - DNA, 444 bp, Zea mays
  Clone ID: LIB143-036-Q1-E1-C7
accacgcgtccgcaagcccctcaggcctcagctcaccaccacgaaccaaccgacagaaagagggacgaatggcgagctctcagtgctgcgataacccgccggccctgaacccggcctgcggggagggcaaggtcgtcgacagcttcggcgggctcaaggcctacgtcgccggccccgaggactccaaggccgccgtcgtcctcgtcgccgacgtcttcggattcgaagcgccgattatgaggaagatagccgacaaggttgcttcgtcagggtactttgttgtggtaccagattttgtttcatggggattcttatgcacctgagaatgttgagaagccctttcctgtgtggataaagtcacatactccggaaaaagggtttgaagagacaaaacaagttattggggctctaaaggagaaaggagtgtctgctgttggagctgca

SEQ ID NO: 2558 - DNA, 427 bp, Zea mays
  Clone ID: LIB143-036-Q1-E1-C8
cggacaaagcccgtccctctcctactcctcccccaaagttccgttcagttccctcccgcaggtcaaaaccctcaacctcccacgcggctcgctgggtgggtcggtcggccatggctccccccgcgctcggatctcaggtggccgccgcagcctcggttcccgtcggctcggactctctcgctaagggcgcggcgctcaagggtaacagcactctaaactttcggaccaaaccatgcatcggaatggcattagcatggaaaaacaggacccagcaaccacggcgtctgaacaaggtactctgcatgtctgttcaacaagcaagcaggagcaaggttgctgtcatgcccgtcgagttggagaaggcaaaggagccactgctccacctgtacaaaccaaaggagccttacacggccacgatcgtcactgt

SEQ ID NO: 2559 - DNA, 283 bp, Zea mays
  Clone ID: LIB143-036-Q1-E1-C9
tggatgggattagtcatctgattcgtgagagagctgatgctctagatgttgcatggcataccatggcggtttcttgggaatggttttgctagtggctcggtaaccttgggttccgggaaaataagtgtgtgcgtctgtgcgtcaggctgataacggcactggttacgttctgattcatagattgctcatctagtttattttctgttcgatgctcctgtaccggttctcggctatgatcattaacagtgtgggtagtgctgctctcaagattatgtcagatgtt

SEQ ID NO: 2560 - DNA, 414 bp, Zea mays
  unsure at all n locations
  Clone ID: LIB143-036-Q1-E1-D10
tactgatccatccatctccatccccatcccgtgacccgtgcacgccgccgcttcaagtcctaacaagccgcatcgcatcgcatgcgtgtgctgtccgaccgccatctccgcagccggctggcctagctacctcacctcacctcacgcaggcacactgcacacacacccatggtggtggcggcgatgcggcggccgtgcgctgtgccagcgctgctggtggcggcggcgacggcgacgctagtgcttctgccgctgctgtcaccgtcgagcgcgcagccggtgccgtccccggcggcggcgccgggccccgcgggcgggaccgggatcgactcggcgtgcctgaactcgctgctcaacatgtcggactgcctcncgtacgtgagccaggggagcacggcgcggcgccccgacgcg

SEQ ID NO: 2561 - DNA, 410 bp, Zea mays
  unsure at all n locations
  Clone ID: LIB143-036-Q1-E1-D3
acgagagctagaagcgaaggagaaaagcagttcttcagctangcanganggcacaggaaggaggagatggcgtcaaagaggattcagaaggagctcaaggatctgcagaaggaccctcccacctcgtgcagtgcaggtcctgttggtgaagacatgttccactggcaggcaacaataatgggtccatctgatagcccatattctggtggagttttcctagtcacaatccattttcctcctgattatcctttcaaaccaccaaaggtggcatttcgtactaaggtgttccatccaaacatcaacagcaacgggagcatttgcctcgacatcttgaaggaccagtggagtccggcactaacaatctccaaggtgctgctgtccatctgttccctgctgactgattcgaaacc

SEQ ID NO: 2562 - DNA, 203 bp, Zea mays
  Clone ID: LIB143-036-Q1-E1-D7
ggcgtgctcacggtcaccgtgcccaaggcggaggagaagaagcctgaggtgaaggctattgagatatctggttgagcatccaatccaatatggacgtggaaggaaggtgtactgctgctgctggtccgtggctgtcgctgtcttgtgggatgtttcctgtgtcttctacgatatataacgtacttctgtttgtttcgtttaaa

SEQ ID NO: 2563 - DNA, 439 bp, Zea mays
  Clone ID: LIB143-036-Q1-E1-D8
ggaatagttcccctttcagaaagatcatatgtatctgatgaaaaccacaatgagagcattgatgtcaggactgaacctgctctgccgtttaatccattggctgctagagcagccacaataagtctatcagcatttggaccatttggttttggcttcttcaacggcaagggcaaaaggcagaacaagaaacccaacaatctagatcagtcccaccagaagcccaagacaccagatcagtcttccatgaaacaaaaaggagtcaacccaccatcacatgaggcattcagcgatgagtggttggaaaatggccagtgcccacttgcgcggtcttaccgggcaatgagtggtgttttgcccctcgtcgccaaggctttacagccaccagctggtatgaagctgaagtgcccacctgctgtggttgctgtccgagctgcccttg

SEQ ID NO: 2564 - DNA, 413 bp, Zea mays
  Clone ID: LIB143-036-Q1-E1-D9
cccacacgtccggccgaagcttgagggtttcagcatcccgcggccaacctcctacaacttcgagcgctctcagcccgtgcagcggctctaccgtccgaccgatgacccggacctcgacgacatcgccttctccgacgacgctccgtcagatgccccagccggcaccgcggtggatggaaaggcggagcatgacgaggagatcgacccgctcgacgccttcatggcggagatccaggaggagatccgcgcgccgcccccgccgcccaaggccgaggcgcttcgccgcgcggactccggcgacgatgaagatgaccccgttgagagctttctgcgggccaagaaggatgccgggctcacgctgggcgccgacgccatgcgcgctgggtatgactccgacgaggaggtctacgccg

SEQ ID NO: 2565 - DNA, 364 bp, Zea mays
  Clone ID: LIB143-036-Q1-E1-E10
agagatagcgtcgccggtggctccgcagcgcctgttccgcgccgccgtgatggactggcacaccctggcgcccaaggtcgcctcccacgtcgtcgccagcgcgcagcccgtggagggcgacggcggcgttggcagcgtcaggcagttcaacttcacctcagtcatgccgttcagcctcatgaaagagcgtctcgagttcctggacgcggacaagtgcgagtgcaagaacacgctcatcgagggcggcggcatcagcgtcgccatcgaaacggcgacgtcgcacatcaaggtggagcccgcggccggcggcgggagcgtggtgaaggtcgagtcgacttacaagctgctgccgggcgtggaagtg

SEQ ID NO: 2566 - DNA, 442 bp, Zea mays
  Clone ID: LIB143-036-Q1-E1-A4
agcacaacacttcttcctcctcttcctcctcctagcacagctagcgcctgctccccttcgtctgtgatcatgtcttgcagcagcggcaagtgcaactgcggctccagctgctcctgcggcagctcatgcaactgcatgtcacctgacgtggagaccgccgccgccagcagcatcaagaccatggtcctcgctgcgccgaccaccaaggccagcgccggcggcttcgaggctgccaccgagggcggcggctgcgactgcaacacctgcaactgcggcaccagctgcggctgctcctgctgcagctgcaactgagccggcccgcccggcccggcgatggcgcacgagagtcgagaggacgacgacgacgaggcgtataactataatagcagcgtctaaattagatcctgtcaactgcacccgccattatcgattcatggtcgct

SEQ ID NO: 2567 - DNA, 438 bp, Zea mays
  Clone ID: LIB143-036-Q1-E1-A5
gcccctccctctctctctcgtggagacgactgggccgccgtcgttgctgccctacgcggctacacccacgtcttcttcgggcccttagccgcgacgagcgccaccagggagtagaagaggttaaccttctggttggaaacgatgtacttcgaaggctatggcttccgtggaagtactttcgagcagacatatcgctgctatcctgcgtctttcatcgacaagccacaacttgaggccggtgacaaaattataatgccaccatcagctcttgatcgtcttgcatctctgcatattgaataccctatgctatttgaagtccacaatgcagcagcagaacggacttcgcattgtggtgttctggagttcattgcagaagaaggcatgatctacatgccatattggatgatgcaaaatcttcttttgcaagagggagatatg

SEQ ID NO: 2568 - DNA, 441 bp, Zea mays
  Clone ID: LIB143-036-Q1-E1-A6
acccctccctctctctctcgtggagacgactgggccgccgtcgttgctgccctacgcggctacacccacgtcttcttcgggcccttagccgcgacgagcgccaccagggagtagaagaggttaaccttctggttggaaacgatgtacttcgaaggctatggcttccgtggaagtactttcgagcagacatatcgctgctatcctgcgtctttcatcgacaagccacaacttgaggccggtgacaaaattataatgccaccatcagctcttgatcgtcttgcatctctgcatattgaataccctatgctatttgaagtccacaatgcagcagcagaacggacttcgcattgtggtgttctggagttcattgcagaagaaggcatgatctacatgccatattggatgatgcaaaatcttcttttgcaagagggagatatggtg

SEQ ID NO: 2569 - DNA, 442 bp, Zea mays
  Clone ID: LIB143-036-Q1-E1-A8
agcaatcacaacgaacaaaagctctcgatctcaccgacaccgaggaagaagagatcaatggcgtccgagcagggagtcgtgatcgcgtgccacagcaaggctgagttcgacgcccacatgaccaaggcccaggaagccggcaagctggtggtcatcgacttcactgccgcctggtgcggtccatgccgcgccatcgccccactgttcgtcgaacacgccaagaagttcactcaggtcgtcttcctgaaggtggacgtggacgaagtgaaggaagtcaccgcggcctacgaggtcgaggcgatgccgaccttccacttcgtcaagaacggcaagacggtcgcgaccatcgtgggtgccaagaaggacgagctcctggccctgatcgagaagcatgccgcgcctgcgcctgcgtctgcgtctgcctaaaggagatcagatcagt

SEQ ID NO: 2570 - DNA, 212 bp, Zea mays
  Clone ID: LIB143-036-Q1-E1-B1
aaaaaaaaaaaaaaaaaaaaaaaaaaaaaaaaaaaaaaaaaaaaaaaaaaaaaaaaaaaaaaaataaaaaaaaaaaaaaaaataaataaaggaaagatattcataagattaaaaagtttgattgaacgtaggtggaaattattttttctttgttggtgttacttattttggttttaagatgactttcttttttgtcattgatttttggttta

SEQ ID NO: 2571 - DNA, 419 bp, Zea mays
  unsure at all n locations
  Clone ID: LIB143-036-Q1-E1-B10
acccacgagtccgagataaaatgcctcagggttttgatacttccgttggtgagcatgggacacagctttctggtgggcagaagcaaagaattgcgattgcaagggctattctgaaagatccaagaatcctactattggatgaagctacaagtgctctggatgccgagtctgaaaggattgtgcaggaagctctcgacagggtcatgacaaacaggacgacagtcatagtcgcacaccgtctgagcactgttcgaaatgctgataccattgctgttattcatcagggaacactggttgaaaaaggtccacacagtgagcttctaagagatccagaaggagcttatagccaactgataaggctacaggaagcanaccagcagaacaatgggaaaggttgatgcaatgctcgtccaggcaaa

SEQ ID NO: 2572 - DNA, 365 bp, Zea mays
  Clone ID: LIB143-036-Q1-E1-B11
acgcagcagatcatcagcgacgagctcatgctggacggcaacccgcgcctgaacctggcgtccttcgtcaccacgtggatggagcccgagtgcgacaagctcatcatggactccatcaacaagaactacgtcgacatggacgagtaccccgtcaccactgagctccagaaccgctgcgtaaacatgatagctcacctgttcaacgcgccgatcaaggaggacgagaccgctataggggtcggaacattgggatcctcggaagcgatcatgcttgcaggtctagcgttcaagaggaaatggcagaccaagaggaaggaccaggggaaaccgtgtgacagacccaacatcgtcaccggtgccaacgt

SEQ ID NO: 2573 - DNA, 389 bp, Zea mays
  Clone ID: LIB143-036-Q1-E1-B2
ggtcgagcccgcgtccgaaatcaacatcacagcaagctccgcgcactgaaatcttccaagccacaggacacagctctacttccacagttcgcagactcgcacgcaccgagcggctagctatcagcgataaatgtcgctggtgacgcgcaccagcgtgttcgacacagtctctgtggacctcttgaaccccttcgagaccatgtttcgctccatcatgccgccgtcgttgtcgtcctcggcggcctcctagaccgcctccttcgccaacgcccgcatcgactggaatgagacgccctacgcgcacgtgttcaatgccgacctcaccggcgtgtacactgaggaggtcacggtgaaggttgatgactgtaacgtgctgctcatcagcgggc

SEQ ID NO: 2574 - DNA, 321 bp, Zea mays
  Clone ID: LIB143-036-Q1-E1-B3
ggatgaatcatgcgacaaggtcgacatgtcatctccgccgccggtgaagctgatcggcttcttcggcagcacgtacgcgttccgcgcggaagcggcgctgtgcctgaaatgcgtggcgtacgagctgatcctgtaagagctgttcagcagcaagagcgagctcctgctccaccacaaccccgtgcacaagaaggtgcccgtgctcctccacggcgaccgccgggccatctccgagtccctcgtcatcgacgactacgtcgacgaggacttcgacgggctgctgctgctcgccgccgacccctacgcgcgcgccgcggcccg

SEQ ID NO: 2575 - DNA, 450 bp, Zea mays
  unsure at all n locations
  Clone ID: LIB143-036-Q1-E1-B4
gcgtccgaatagaaaaaacacacacacacacacacacacaaagcgcacttttcaaatcgacaaaggggaaaggttcgcttcttctcgcatcttgctttacttcgagtgccatggccgatccggcggaggagaacgttgtctcgccgccaccgacccctgcggccccagccgtgggcgcctcagactcgcccctgcagcctgttgctgacggcgcctcaacggagaacgtgtctgccccggcgccggaggtaaggtcncggggattcaggcttcttggagaggacacttccgtgcacaaatcccttgggggcggtaaaactgctgacgttctgttatggaaagacaagaaaacttctgctgttgtaataggcggcgcaactgtcatctgggttctgttcgaagtgcttgattaccacctcctgaccctgatatcccatgtactgattggtg

SEQ ID NO: 2576 - DNA, 445 bp, Zea mays
  Clone ID: LIB143-036-Q1-E1-B5
agttcccggctctctgatgccataacaggagatggcattgtgaacagaggccaggcattgaatgatgctgacgatgaagagtgcaaggacatgcctttgatcctccgcaacaaggccccaaggtggcacgagcagcttcagtgctggtgcctcaacttccggggccgggtgactgtcgcctcggtcaagaacttccagctagtcgcggcgacacagcctgccgccggagccctgaccccatcacaggcagccccgcagccagctccgcctcctccgccggaccaagagaaggtcatactgcagtttgggaaggtcggcatggacatcttcaccatggactactgctacccgctgtcagccttccaggccatcgccatctgcctgaacaacttcaacaacaatttggcctgcgaataaatccaaccaacaattctggtacctacca

SEQ ID NO: 2577 - DNA, 415 bp, Zea mays
  Clone ID: LIB143-036-Q1-E1-B6
atggcggggagggataacgatgcgcgacaagcggcgccgctcaaaggcgacaagcagcagttgcggcggaggctgaaggaagcggcgctcctcatccgcacgatcaaagggcatgtgcgctggatcttcgaagaggttgccgccggccgcaccacgtctagagtgcaccaccggtaccggaactattgctcctccgccgactctgcgtccacgtccccatgtgcatgcagctactacatcctcgtccacacggacgtcctcactctgctctacaacgacgaccacacttccagcctcaatgtgctcatgaggatgctgttcgtggagcagcatctcctgcagcaaagcaagcactgctccaatagggacatctatcacatgtacgcctccagcgtcgtagaagtagcagttgttg

SEQ ID NO: 2578 - DNA, 440 bp, Zea mays
  unsure at all n locations
  Clone ID: LIB143-036-Q1-E1-B7
cacaacacaactcgtaggcagcgagcgtctctcctcttcctctcccacgcaccgcgccaaggaaggcagagagagatcgccgctcctcttctctccgtcggtggtgcggttgaccgccctcctcgagcgagatctcgctgcagtccctcgagatctggtcacagatctatccgacaagatggtgaagatctgctgcatcggtgctggctatgtcggtggcccaaccatggctgtcattgccctaaagtgcccagacattgaggttgtcgttgttgacatctccaagccccgcattgaggcatggaacagcgacaccctctcgatctacgagcccggcctcgatgatgttgtgaagcagtgcaggggcangaacctcttcntcagcactgatgttgagaagcacgtcgctgaggctgacatcatcctcgtctcggtgaaca

SEQ ID NO: 2579 - DNA, 443 bp, Zea mays
  Clone ID: LIB143-036-Q1-E1-B8
atcgactccgccgccgctccgcctcagcgcgtcgcccgccgccacatcctacagcgacctcatcgatcaccttcaactttcaatcatggcggacgtcgatgtcgaaccggaggttgccgccggcgctcccaagaagaggacgttccgcaagtacagctaccgcggcgtcgacctagatgcgcttctcgacatgtccacggacgacctcgtccagctcttccccgcgcgcgccaggagaaggttccagaggggtctgaagaggaagcccatggcactcatcaagaagctgcgcaaggcgaaaaaggatgctcctgctggtgagaagccagagccagtcaagacacatctccgtaacatgatcattgtccctgagatgattggaagcattgttggggtctacaacggcaagacgttcaaccaggttgagatcaagcctgagatga

SEQ ID NO: 2580 - DNA, 398 bp, Zea mays
  Clone ID: LIB143-036-Q1-E1-C1
ctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggccgccgctatggtggcgggcgccg

SEQ ID NO: 2581 - DNA, 376 bp, Zea mays
  unsure at all n locations
  Clone ID: LIB143-036-Q1-E1-A2
aattcaactctcagctcctctcctggcaaccagacaacctccgtacactcgcaagaaaacatgaccggagaccatggcggacgaactcagagaataccacatcgccgattccagagacgtcatcagactcttcataaaggacacggactgttgcgacgaactcaaggaagccgtgaacgtcatcgaatcagagagtcagagtttcatcgcaggctgaccaccaccgacatgatcatgagaagtctatgcggacaagctcagtgacaacgacgtcnacgagatcctcagtcacatcgacctcaacatggacgaccacgtcaccgacgaggagctcatcgaggcgatcatggtgttctacagagacgacaacggcatc

SEQ ID NO: 2582 - DNA, 180 bp, Zea mays
  Clone ID: LIB143-035-Q1-E1-G3
ctcaaatgtccatacaacactctaaagtgaatcgtattatactgggacaagtgtcaccatatacagcaacggcatgtccacctatgatgacactcgttctttgcaatacgcacctatcgtattaccatatctcgggccgtgggagtatctctcgctcctgttatggatctaattattcaa

SEQ ID NO: 2583 - DNA, 244 bp, Zea mays
  Clone ID: LIB143-035-Q1-E1-G5
attgaaacataggtaattcaagcaactagttatacaattacagcctgcaaagcctcgagctaaatacattgatgtagaaataatgcataatttctctctttgttgccaagagtcagtatcacacgtcaacatcttagatttcctctagcataatacgacgtgaagcactgcggaaacatgtacacgttcacaatccccagcagatctccaatgtaccggtgttcacgatctatgtgatgtggtg

SEQ ID NO: 2584 - DNA, 425 bp, Zea mays
  Clone ID: LIB143-035-Q1-E1-G7
acccaacacccggagtgagcggcggcgagggatcggatcgtcggcggcgatggaggacgaggtgcagagggcagcggtgagcagttggaacgagcttgactatgaggcgggagcgcgtttggtggcggaggcgagggcgtcgtgggataggaaggcaaggggggaggaggaggatgaagaagaacatgatcctgagatgaccttggactactacgcctaccaggctaaaaagtttcgcaacacctggaacatcctctatttcgggcactttcggtcgcttcgaggacaccacacggatccctcctatgcgctttacagagaagccgcctgactccccggcgtacccgcgcactacactgcaggtcttttcgatcaaagttgcagggatagaggggggtttacagtggccactccatgtgtttggg

SEQ ID NO: 2585 - DNA, 80 bp, Zea mays
  Clone ID: LIB143-035-Q1-E1-G8
agcaaagaccgaggcgcgtgctctgctcaaggctacgttcccccccccgcccatcgctgaccacagtgcacaccggcacg

SEQ ID NO: 2586 - DNA, 398 bp, Zea mays
  unsure at all n locations
  Clone ID: LIB143-035-Q1-E1-H1
acgaccgcgactgatgggaaggaccggcggcaaaaccccgggaaaccggaacaattccggaacaatgaagaattccgggggctccaacctgaaccaacaatcaagcccgggcacgcggcngtggcacttcctcggcacgctggcctcgctcgcctgcgcggtgctcgcggccgccactggccgcgccgcggtcctcctcgtgggccccgttctcggggtacggcatggcgtggtacagccacttcttcgtggagggcaaccgccccgccacgttcggccaccccgtgtggtccttcctctgcgacctccgcatgttcctgctcatcctcaccggccgtatcgacgccgagctcgcacgcctccgcgtccggccggcggcctctgcgcaacatgactga

SEQ ID NO: 2587 - DNA, 402 bp, Zea mays
  Clone ID: LIB143-035-Q1-E1-H10
aatgctagtacaattcagtttagtaggaatggcaatgggtcgggtggagaaaaaacctgctaaatccgcccgtgatcacacgcgtgggtgcaattccaaacccacacgcgaacccgttaggtttcgggtgggtttcgagtcacctgtgtgttttaaaccataattcagctataaacaattaagtaccaataataatgaagttatatctacggattttaaacgttgagcagcgataaaacatttcatgaaccattagccaagttacttattcagaataactactattgtatcttaatcattttttaacataataaggatgaatcaaatttcggatcacattgggccctactataatctggagcagtttttaatgcaagtcacattcgtgctcaaaagaaagaa

SEQ ID NO: 2588 - DNA, 419 bp, Zea mays
  unsure at all n locations
  Clone ID: LIB143-035-Q1-E1-H11
cctctccgaaatcaaggtagcatacaccgctgcagtttctagagccctctctgccactcgtgatcccactagtcacgatgcctgccctcgctaagcccgcctcccgcaccgccaagcccgccgcggctccgaagccgaagcctgccgccgccaagccgaaggcggccaccgctggtgcctcccacccgccttacttcgagatgatcaaggaggctatcacggcgctaaaggagaggaccggctccagctcgcaagcgatcgccaagtatgtgggggacaagcacggcgcgtctctgccggccaacttcaagaagatgctttccatccagctccgtgggtccgcagccaagggcaagctcgtgaaggtcaaggcttcgtacaagctctcggacgccgccaagaaggcatcnncccaagac

SEQ ID NO: 2589 - DNA, 373 bp, Zea mays
  Clone ID: LIB143-035-Q1-E1-H12
ttgttgctcttgccatcctcactctcttctactatgctatatttggatggagaaagaggaaaccaacaggaagattccagctctcaaattgatttgctctgtaagtgaagtttgacggattcatcatatgtgccccctgagtggtagttcagttagcatcttagaaatgtatatgatcaacaaaaccaaaccaatccaaaccaaatcatcttcccaaagagttgaggaactgcaaatgatcaactctgagaccttaaaggccagaattatcaactctgagactttgaaggcaagaatggggcaactgttggttaccacggacatggatgttaaagtagaacccagttgactttgcaatgtacacatttcttgt

SEQ ID NO: 2590 - DNA, 426 bp, Zea mays
  Clone ID: LIB143-035-Q1-E1-H2
ctcatcaactacgtcgactgggcgaggcgtcgcggcaacggcaacggcaaggccgcctgtggtgacactcgttctttgcaagaggcacctatggtaagaccatgtcttgtgccgttcctgtttctctcgctcctgcgatggatgcaattgttcagggagtacgtcatgcacctgctctgcttatcagcttatgtttactgacgtgtgtatctgtgaaatcattttgcatgttaattttcattaacaatgatctagctagctagctagcaccttaattttcattgctgggaaacaagctagctagctactagtatgcagctgttgttggtcctctgtttttcggactactatctgtcgagttcaggtgaaattgcctttcttttttgaaccagattaaataggtatgttggaataatcctaattttt

SEQ ID NO: 2591 - DNA, 355 bp, Zea mays
  unsure at all n locations
  Clone ID: LIB143-035-Q1-E1-H3
caagtacactcggctaggtaatctggtgggttacacgacatggcgggcaccagcagcaggtcgtcatcgtcctcgagctcggcgcaacgggcagctgccgcactgctcgtggccgcggccgtggcngtgtccgtcctgatggtgggcgctgcggcggtgtgcgacatgagcaacgagcagttcatgtcgtgccatcccgcggcggccaatacgactgacccgccggccgcgccgtcgcatgcgtgctgcgactcgctggccggggcggacctcaagtgcctgtgcggctacaagaactcgccgtggatgggcgtctacaacatctaccccaagcgcgccatggagcttccggcca

SEQ ID NO: 2592 - DNA, 427 bp, Zea mays
  Clone ID: LIB143-035-Q1-E1-H6
gcctcatctgtggaaaaggagagaagactgaagagaagggaagacatggccgtgacggcggaagcggcggcagagatggtgttggagcggcgggcgtacgcgcgggtggggctcctcggcaaccccagcgacgtgtacggcggcagggccctgtccttcgccatcgccgacttttccgccaccgtccacctccgcccttcgcccgagctgctcatccagccgcatccgcaccacgacctcgtcgccttcccctctctccctcaactcgtgagccgtttgcaaagtgaaggatattatggaggcgtccggctgctgatggctatctgtaaagttttctacaactattgtgttcaaaataacatcagtttaaaagctgaaaatttcaccttatcatacgatactaatattcctcggcagtctgggctgt

SEQ ID NO: 2593 - DNA, 423 bp, Zea mays
  unsure at all n locations
  Clone ID: LIB143-035-Q1-E1-H7
aagatcacttctcttggagttggccaatggtcagcagtgcttcaatcatctactactgataatcaggatgtgctgaacggggagcttgtcttgattgaacctcagtttggttgagatgaattgacaagggtgcacggggagcttatcttgattgaacctcagtttggttgagatgaattgacaagggtgcgggaagaggctatggaaggagctcgaaataagtgggttgccagataaatgatgtttttgttcaaatctggcatttcatgtgaacaatcataagctatgttcgatttatgttagaagtgtaagaaactatactgatcttttttagttaaaacataatatatgggtagattgtcgtgaaaaaaacaaaacaatangaaaaacccgcgaaaacccgaaaaaaaaaagggcggccgc

SEQ ID NO: 2594 - DNA, 419 bp, Zea mays
  unsure at all n locations
  Clone ID: LIB143-035-Q1-E1-H9
cggacgcgtgggcggacgcgtgggcggacgcgtgggaaaccggattaatttaacacctgttgcattaatggaggcaacttgctttgctaaaactgtgtttggtggcgagcaagttaagcctgatcacagagatgttccttgtgctgttttctccattccaccactatctgtagtgggcctcagcgaagaacaggccttggaggaagccaatggtgatattcttgttttcatctcatcattcaacccaatgaagaacagcatatccaagcgccaggagaagactatcatgaaactggtagttgatgctgaaactgacaaagtacttggtgcatccatgtgtggaccagacgcacctganattttatcaggcatcgctattgcggttaaatgtggagccacaaaagcagacttcgacagca

SEQ ID NO: 2595 - DNA, 417 bp, Zea mays
  Clone ID: LIB143-036-Q1-E1-A1
cttggaacggtgatgcgctcccttggccagaaccctaccgaggcagagctgcaggacatgatcaacgaggtcgatgcggatggcaatgggaccatcgacttcccggagttcctgaacctgatggcgaggaagatgaaggacacggactcagaggaggagctcaaggaggccttccgcgtcttcgacaaggaccagaacggtttcatctcggctgccgagctccgccatgtcatgaccaaccttggcgagaagctgactgacgaggaggtcgacgagatgatccgtgaggccgacgtcgacggggacggccagatcaactacgaagagtttgtcaaggttatgatggccaagtgaggagcggtccccgtgaaataagtatctatggattgaagcggattatcaggcacacaagctgta

SEQ ID NO: 2596 - DNA, 344 bp, Zea mays
  Clone ID: LIB143-036-Q1-E1-A10
acccacgcgtccgcccgggcctacgtgtatgtagtagtactagtgcagtcagtgccactcacgttttgggtgccggtgctacgtgcggacgtaccgccgccgcctcggactctttctactattctcttctttaatttcctctttaatttcctgtaccactgccacctcatcgagatgatttatttatatctttattccaaaaaaaaaaaaaaataaaaaaaaaaaaaaaaaaaaaaaaaaaaaaaaaaaataaaaaaaaaaaaaaaaataaaagaaaaaaaaaacataaaaaaaaaattataaaaagaacaaaaaaaaaaaaaaagggggggccccccaaaagt

SEQ ID NO: 2597 - DNA, 351 bp, Zea mays
  Clone ID: LIB143-036-Q1-E1-A11
agctttgaatgtatgggcatcttttctttctgatacgatcgtccatgcaaatccactgtttacgtgcctgtgcaacatgaagaccacagtgggctatcatgagactctctcggacattctcgacgcagaggacaacgttaatgtcgtggaggacctgaatgacgccctgatgtggctggactacattcagtccgcctagaatgacgattactacgagaagctcaaggaggtggacgccgtgtgcatccccatcgtgtcagccgtgtatcaacggtcgggcggcacccccggtggtgatgccgacggcggcgtcgacgacgaccacgacgagctgtaaatggttgtcgggaa

SEQ ID NO: 2598 - DNA, 366 bp, Zea mays
  Clone ID: LIB143-035-Q1-E1-G2
ggggcaaggcttcccggcaacggcaacggcaaggccgcctgtggtgacactcgttctttgcaagaggcacctatggtaagaccatgtcttgtgccgtgcctgtttctctcgctcctgcgatggatgcaattgttcagggagtacgtcatgcacctgctctgcttatcagcttatgtttactgacgtgtgtatctgtgaaatcattttgcatgttaattttcattaacaatgatctagctagctagctagcaccttaattttcattgctgggaaacaagctagctagctactagtatgcagctgttgttggtcctctgtttttcggactactatctgtcgagttcaggtgaaattgcccttcttttt

SEQ ID NO: 2599 - DNA, 372 bp, Zea mays
  Clone ID: LIB143-017-Q1-E1-C7
acggacgcgtgggcgacatgttccgcatcatgttcgaccgccggttcgacagcgagcacgacccgctcttcaacaagctcaaggcgctcaacgcggagcgcagccgcctgtcgcagagcttcgagtacaactacggcgacttcatccccgtgctccgccccttcctccgcggctacctcaaccgctgccacgacctcaagacgcgccgcatgaaggtcttcgaggacaacttcgtacaggagcgcaagaaggtgatggctcaaactggtgagattcggtgcgccatggattacatcctcgacgccgagatgaagggcgagatcaaccacgacaacgtcctccacatcgtcgagaacatcaacgtcgcaacga

SEQ ID NO: 2600 - DNA, 409 bp, Zea mays
  unsure at all n locations
  Clone ID: LIB143-017-Q1-E1-C9
aattacctaacgctagagtacggcatggccgagctcatcaacaacatgcacgtcatggagaagctacagacggaggtgaggacgacgatgcgctcgccggactgcaagaagctggacatgctagcggaggaggacctcggcagcatgccctacctcaaggcgaccatcaaggagacgctgcgcctgcacccgccggcgccgttcctcctcccgcactactccaccgccgactccgagatcgacggctacttcgtcccagccgggacgcgcgtcctcgtcaacgcctgngcgctcgggagggaccgcacgacgtgggagaagccggaggagttcatgccggagcggttcgtgcangaaccgggcgccgtggacgtccacatgaagggcaaggacctcaggttcatcccgt

SEQ ID NO: 2601 - DNA, 414 bp, Zea mays
  Clone ID: LIB143-017-Q1-E1-D1
gccaaagcttctggcaagaagaaagaatctgggaaatcgtcagttttacttgatgtgaagccatgggacgatgagaccgacatggccaagctcgaggaagctgttaggagtgtccagatggaaggactgctttggggcgcatccaagcttgtcccagttggatatggcatcaagaagctgcaaatcatgatgaccattgtcgatgaccttgtctctgtcgacactctcatcgaggactatctctgcgctgagccagtgagcgaatacgtccagagctgcgacattgtcgccttcaataagatctaaatttccttgcaatggtggttggtggacactgtaccagcctaatttataattttccatgagcatcttcaagagtttttctaaattatcatttggagtcatttacataaa

SEQ ID NO: 2602 - DNA, 196 bp, Zea mays
  Clone ID: LIB143-017-Q1-E1-D10
agctgggcagcagactccgcatagccttcacgtgtggtgatataacatctagggccctgacgattgcatatagctctattggtatgatatttccatggtggctaggcatgcgcctttcgaatgacgaggtccaacagcttgtgaggaaaatggcaaattggctgaaggtcggatgccatattttctttacagaatc

SEQ ID NO: 2603 - DNA, 333 bp, Zea mays
  Clone ID: LIB143-017-Q1-E1-D12
ggggccgccgccaagcccttcgcgtgcgccgcaaccgctgagtgagaagaagagatggccggcaagggcgatgggccggctatcggcatcgatctcgggacgacgtacgcgtgcgtcagcgtgtggcagcacgaccgcgtcaacatcagtgccaacgaccagggtagccgcaccacgccctcgtgcgtcgccttcaccgactcggagcgcctcaacggagatgcggccaagagccaggtcgccatgagccccatcaacagcgtctttgacgccaggcgtgtcagcggcaggagggtcagtgaggcgtctgtccagactcagacgaagttgtgg

SEQ ID NO: 2604 - DNA, 415 bp, Zea mays
  Clone ID: LIB143-017-Q1-E1-D3
actccaccctggaaatcctggagacaacaacggtcgtttttctctccgggacaagagaaaaggggagagagaggtgaggcgccgtgtccgcccgatctgctctgccccgacgcagctgttacgacctcctcagtctcagtcaggagcaagatgggtgccggcggcaggatgaccgagaaggagcgggagaagcaggagcagctcgcccgagctaccggtggcgccgcgatgcagcggtcgccggtggagaagcctccgttcactctgggtcagattaagaaggccatcccgccacactgcttcgagcgctcggtgctcaagtccttctcgtacgtggtccacgacctggtgatcgccgcggcgctcctctacttcgcgctggccatcataccgggggctccaaccccgctccgct

SEQ ID NO: 2605 - DNA, 354 bp, Zea mays
  Clone ID: LIB143-017-Q1-E1-D4
acggacacgtgggcttttgatgtcagtaacttgaccattgacacccgtgtgtttgaggtgctggccaccaatggtgacacccatcttggacgtgatgattttgaccacaggatcatggtatacatcaccacattcatcatcaagaactacatcaatgacatcagcaaggacaaccgtgctcatggaaagctgcagaaggaagctgagcgtgccaagagagccctgaccatccagcaccagctcctagttgagatcgagtccatccttgatcggatcgacttcgcgagcccgcctgaccgtgtcaagtttgcggagctgaacactgactcgttcctcaacactatgggccctgtc

SEQ ID NO: 2606 - DNA, 382 bp, Zea mays
  Clone ID: LIB143-017-Q1-E1-D5
aaccctagccgcgatccgacaacgcctccatccctagccgactgctgcaagcttcagagctcaagagtcagggcgccatggcgacagagacggagaccttcgcctttcaggctgagatcaaccagctgctctcactcatcatcaacaccttctattccaacaaggagatcttcctccgggagctcatttccaactcttccgatgcgttggacaaaatcaggttcgagagcctcactgacaagagcaagctcgatgcgcagccggagctgttcatccacattgtaccagacaaggcttcgaacacgctctccatcatcgacagcggcatcggcatgaccaagtccgaccttgtcaacaacctcggtaccatcgccaggtccgg

SEQ ID NO: 2607 - DNA, 421 bp, Zea mays
  Clone ID: LIB143-017-Q1-E1-D6
acttctctcctccccaaaatcaatcgcccacaaaggagagccaggcagccagccaaatcttccacctcctccatttccagccccgtccccacaccagctcgcgtaacctcctgcccatggctggaggcggcggcgcaggcgcgggctcgtcgtccggcggcggcggagggggcggcagggagggcgactgggactgcggcagctgcggcaaccgcaactacgccttccgctcgctctgcaaccgctgcaagcagccgcgcctcctcgtcgaccccaacaccccgcgcgactccaagtggctaccccgcgccggggactggatctgcaccggttgcagtaacaataattatgcatccagaaagaactgcaaaaagtgtggcttgcccaaggaggaagcagcaatgccagcattgcaaatggc

SEQ ID NO: 2608 - DNA, 298 bp, Zea mays
  Clone ID: LIB143-017-Q1-E1-D7
aaattcccacctcccatccgtcaatgcctcaatcccgagacgcatgctgccagcttcagcttccatcactcaaggttcaatccccgatcagcaaaggagctcttctcctttcatgctgacatgctggaggtgctcgcacacgatcaggctagtttccatgcgacgacggaggatgccgtacggaagctcacttcgactgctgcagctgcgtatgcacaagtcacgtttcagcgccctactgaacagcgcaagccagatgcgcatccacatctgttcaaccacattgcgcgagtccaag

SEQ ID NO: 2609 - DNA, 390 bp, Zea mays
  Clone ID: LIB143-017-Q1-E1-D8
aaaatcccacccgcgatccgacaacccctcaatcccgagccgactgctgcaagcttcatcgctcaagagtcaaggcgccatggcgacagagaccgagaccttcgcctttcatgctgagatcaagcagctgctctcactcatcatcaacactttctattccaacaaggagatcttcctccgggagctcatttccaactcttccgatgcgttggacaaaatcaggttcgagagcctcactgacaagagcaagctcgatgcgcagccgcatctgttcatccacattgtaccacacaaggcttcgaccacgctctcgagcatcgatagcggcatcgtgatgaccaagtccgaccttgtcaacaacctcggtaccatcgcctggtctgggaccag

SEQ ID NO: 2610 - DNA, 421 bp, Zea mays
  Clone ID: LIB143-017-Q1-E1-D9
atcctacgcgagggcgaaacccacaaaccctctccctcctgtactccggccgacacatccaggggcgatgacgctgggtagctccggcgccggatcgagcgtcgtcgttcctcgaaacttcaggctattagaggagctcgagcgtggagagaagggcattggtgatgggacagtgagctatggaatggatgatgctgatgacatctacatgcggtcatggactggtaccatcattggccctcacaatactgtacatgagggtcgcatctaccagctgaagttgttttgtgacaaagactatccggagaagccaccatctgtcagattccactcaagaatcaacatgacatgcgttaatcacgagacaggaatggttgatccaaggaagtttggtttgctagcgaactggcagcgggactac

SEQ ID NO: 2611 - DNA, 403 bp, Zea mays
  Clone ID: LIB143-017-Q1-E1-E1
cggacgcgtgggcggacgcgtgggcgcaggtcgctaagacgcttctccttgtggccctggtggtcgtgtcggcggtggagctgtgccgcgccatcgagttcgacgagcgggacctggcatcggacgaggcgctgtgggacctgtacgagcggtggcagacgcaccaccgggtgcaccggcaccacggcgagaagggccgccggttcgggaccttcaaggagaacgcgcgcttcatccacgcgcacaacaagcgcggcgaccgacccctacggcctccgcctgaaacgccgtcggcgacatggggccgtgaggaattccgttccgggttcgccgactcccgcatcaacgacctccgccgggagcacgacgcggcgccggccgtgccggggttcatgtacgacga

SEQ ID NO: 2612 - DNA, 258 bp, Zea mays
  Clone ID: LIB143-017-Q1-E1-E10
aggcagccaccatgccaccgcacgcaaccaaggatcccgtcgccgcgcctgcagcagccacagctgcagcgctgtcgcgggccctggcagcggcgcgccctttcctgcacggggaggacgcggaagttgacccggcgctgcctggcctcaccgccgtgatgtgcggggccggcaccggggaatgctgagcaaagccgcggacgttcctggcacaactgccgggcgttccaccggttatccgcccgttgggcgcgcccc

SEQ ID NO: 2613 - DNA, 404 bp, Zea mays
  Clone ID: LIB143-017-Q1-E1-E11
acggacgagtgggcggacgcgtgggcgcacgtcgctaatacgcttcaccttgtggccctggtggtcgtgtcggcggtggagctgtgccgcgccatcgagttcgacgagcgggacctggcatcggacgaggcgctgtgggacctgtacgagcggtggcaaacgcaccaccgggtgcaccggcaccacggctagaagggccgccggttcgggaccttcaaggagaacgcgcgcttcatccacgcgcacagcaagcgccgcgaccgaccctagcgcctccgcctgaagcgcttcggggacatgggccgtgaggaagtccgttcccggtgcgccgactcccgcattaacgagctccgccgggagcacaccgcgagtgccggccgtgcgggggttcatgtacgacgacg

SEQ ID NO: 2614 - DNA, 415 bp, Zea mays
  Clone ID: LIB143-017-Q1-E1-E12
agtgcttaagtgcgagatgtgaggagaaatctcatatgtgtgaagcgaaacaagtcacgcgacggttgtcgggtgttcagtgttatgctcaaaccgggaatcgtcgtcatgcgtataaatatcgttttgatttgcgatatggtacgctatatgattatgcgagctgaaggacatggatcagagcgaaccataagatggtattggtggattaatcttgtggatgcatcaagccagcaacagaatggaagatgctcaccaagtggtcgtcaattaacaacactaacgtagtgtttatcccaggttataagtttgttctgttgtggatggtgctaagtgccggtgggcttggccttcttatataagtatatcccgtctttagtttctctattgaggattgtcacttaaagctagcatg

SEQ ID NO: 2615 - DNA, 411 bp, Zea mays
  Clone ID: LIB143-017-Q1-E1-C6
acccacgcgtccgaaagtttctctggaagatctttacaatggaatctcagagaagctctctctttcgcgcaatgtcatctgctccaagtgcaaaggcaagggctcgaagtctggtgcttcaatgaggtgccctgagtgccagggctcacgtatgaaagtcaccattcgtcagctggggccttccatgatacagcagatgcagcagccttgcaacgagtgcaatgggactgcggagagcatcaacgataaggaccgctgcccatggtgtaagggtgagaaggtcgttcaggagatgaaggttcttgaggttcatgttgagaacggaatgcaacacagccagaagatcaccttccctggtgaagctgatgaagcgcctgataccgttactggagacattgtattcgtcctcca

SEQ ID NO: 2616 - DNA, 422 bp, Zea mays
  Clone ID: LIB143-017-Q1-E1-A9
acgagacgccttcttgctctcgcttccggtgacgcccgccacttcctccccgacgagatgacgaaacgcaccaagaaggcaggaatcgttggcaaatatggtaccaggtatggtgccagtttacgtaaacagatcaagaagatggaggtctcgcagcactccaaatacttctgtgagttctgtggcaagtttgccgtgaagaggaaagcagttggtatctggggatgcaaggactgtgggaaggttaaggccggtggcgcctacacaatgaacactgctagtgcggtcactgtgagaagcacaatccggcgcctgcgggagcagaccgaagcatgattgcgggcagcttgaaaaggagtacctggatttttgtagttcagccaagagccgtgaaccattttgcctttttagctaaatgaaca

SEQ ID NO: 2617 - DNA, 232 bp, Zea mays
  Clone ID: LIB143-017-Q1-E1-B1
agatgatggtggtgatcagggatcagatgacaatgacaatgacgaagatgaccatgcacatgatgatgatcctgcagccaatggcgaagggggaagccatgaccacgaacatcatggtggagatgatcaacacgatgatgacgacgactacgatgatggggaccatggcaatgaagaagacgatgaagaatctgaacaggatgatgatgatcatcaaatccccaaccaccta

SEQ ID NO: 2618 - DNA, 413 bp, Zea mays
  Clone ID: LIB143-017-Q1-E1-B2
cccacgcgtccgcgccaataatggagtttccgcaccaccaccaccaccacggccatcgccgcgacgactagcgaggacgaccgcagatgcccgcctcccccggtctacggcggctacggccagccaccgccacccgacccgtacagccgcgcgcccgtcgaccccgatccgtacggtcgacctccgccccagtccgcgtacggtggggccggggacgcctacggccacagcggccaatgctacacgcccccgccggtctacagcgcccggggcgggtacggcaacgtcgtccacgtcgcgcacgatgtctgcgacgagaggccttactacggcggcggcggcagcagtcttggtggcgcctacggatgcggtggctccgagtacggccacgatggccgaccgcaccacggcgg

SEQ ID NO: 2619 - DNA, 377 bp, Zea mays
  Clone ID: LIB143-017-Q1-E1-B3
ttgacttcgaggtctgctggaatcggttctttctaaaccctgatgcgcctaaggagggcgtcaggaaatctgacttctacaacgcgaagtttggtcctgttcagtatgagcgtgtcaattctcgcatggccgagatatttcgatgactcgggcttgagtatgacatgtcggggctgataggggatacgatggatagtcataggctcatagcacttgctggacagcaacgctatgacaagcaaaatgctcctgttggagaattagtccataattacttttgtgaacgaaagtatattggtgacaagcatgttttgctggacgctgcaagaaatgttggcatagaatggggccaagaactgtttcaagaccctaacaaa

SEQ ID NO: 2620 - DNA, 267 bp, Zea mays
  Clone ID: LIB143-017-Q1-E1-B4
gatagaagcgaacattctcgcgtatgcgacctcaggaatccgctcattcgtaacccagatgcacttcacggggcctcgatgaacacagacgtcaacggcgcgacgttggggccagttaagttaaaccgtgtgaagtctatcatggtttcgacatctcgaggactcgggcttaagtacgaaatgttcgcgctgccaagcgattgcacagactagtcgacgctcgggacactctcctgtagcggaacgctatgcccagcgggtatcgcg

SEQ ID NO: 2621 - DNA, 205 bp, Zea mays
  Clone ID: LIB143-017-Q1-E1-B5
atccccgccaacacgcgcgtcctcgtgaacggctgggccatcggcagagacccggcggtctgggagaagcccgaggagttcatgccggagaggttcatgcgggacggctgggacaagtccaacagctacagcggccaggacttcaggtacctgccgttcgggtctgggcgccggatctgccccggggccaacttcgcgctcgcga

SEQ ID NO: 2622 - DNA, 409 bp, Zea mays
  Clone ID: LIB143-017-Q1-E1-B6
actcaggagagatgacgctctaccgtcgtgtcctgctcctccgtcgcctctcccacctccacccctcgcccgttccggccatctgctcctcacgaccacccagcctcgcggggctgctcacccccatggggcgccgccacttctccttctcgtccgctgaggatgccgccgccgagtgccgccgccgcaagcgccgtctccgcatcaaacctccaatcaacgccctccgccgcgggccaactctcccacgggacgtcaacgcgccccgcctcccagacaccagctccgcgctcactggcccgcacctcagcctccacaaccgcgtccagtcactcatccgctctggtgatctagaccgtgcctcagccgctgcacgctccgccgtctcctcgcgagtcaggcccaccgt

SEQ ID NO: 2623 - DNA, 419 bp, Zea mays
  Clone ID: LIB143-017-Q1-E1-B8
cccacgcgtccgcgccaataatggagtttccgcaccaccaccaccaccacggccatcgccgcgacgacgacgaagacgaccgcagaggcccgcctcccccggtctacggcggctacggccagccaccgccacccgacccgtacggccgcgcgcccgtcgaccccgatccgtacggtcgacctccgccccagtccgcgtacggtggggccggggacgcctacggccacagcggccaaggctacgcgcccccgccggcctacggcgccgggggcgggtacggcaacgtcgtccacgtcgcgcacgaggtcggcgacgagaggccttactacggcggctgcggcggcggtcttggtggcgcctacggaggcggtggctccgagtacggccacgagggccgaccgcaccacggcggcggcgga

SEQ ID NO: 2624 - DNA, 414 bp, Zea mays
  Clone ID: LIB143-017-Q1-E1-B9
acgggctcttcgccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcacctccgacgacgtgggcctcgacgccgaccgctgcaaggtgctggtgaacatcgagcagcagtcccccgacatcgcgcaaggcgtgcacgggcacttc

SEQ ID NO: 2625 - DNA, 343 bp, Zea mays
  Clone ID: LIB143-017-Q1-E1-C1
agataactcaagtcatcgagtccacagctcgcgcgcgcagccaatcgctctccctccggcctccacagcccaaaaccacctcggccccacttcttctctccgtcgccccctgtttgtccaacccatggcgacccacgccagcgacaatggcagcgggcacgcggagtggcggttcgctcgggcggcgaaggagggtgcgctggccgtggccggggacaagatgagcatccgggcggcgcggttcaagatcagcgcgagcgtggacgggcgcgacccgcggcccgtgctgccgcttgcgcacggggacccctcggtgttcccggccttccgcaacgccgccgaa

SEQ ID NO: 2626 - DNA, 392 bp, Zea mays
  Clone ID: LIB143-017-Q1-E1-C10
atcgcaaatagggtttatcttctcgcgtcctctgcacccatctcgcgtctcgcatacggcagccggattccgaagcgcagcccctcggccccagccaagagcatcgcagtttcgaaacgtttggagagcacacaagaatgtcgttcgtgcagctctctggtgcaggagtcgctgcagtggccttcacgaacaggagcctagtctctcggcacgcaacgctacgggtctgctcgtcgaggcgcgcgatccgtaccctgctcgttaacgctgcaactgtcgtcaccccaaagtagacttcaatgaagcctctgggagatagggtgcttgtgaagcttggtgccgcataggagaagacagttggtggcattttgcttccatctactgcccagact

SEQ ID NO: 2627 - DNA, 404 bp, Zea mays
  Clone ID: LIB143-017-Q1-E1-C11
acccacgcatccggcggcggatgggcaagttcatgcgcaagttcgtgctgccggacaacgccgacgtcgacaaggtcgccgccgtgtgcacggacggcgtgctcacggtgaccgtcgagaagctgcccccgccggagcccaagaagcccaagaccatcgaggtcaaggtcgcctgagggagcaagcagtagctgtgcttctgaaactttgtgtgtttgtgtatgcttccttctttggtatcaccaatcatcctatctgatatatcgactggggtttttgctgtctccatagaataaatctctacatgtctcttgtaaccttttctggtgaagatcgtgtcgcgatgaatctataagttaccgtttgttttcttttgaaaaacagcaaagacgacaggataagga

SEQ ID NO: 2628 - DNA, 282 bp, Zea mays
  Clone ID: LIB143-017-Q1-E1-C12
tccaagcgtccagctgggcacgttcgggcactataattcagctgttttgtgctgacggataaccacgacataaatggggatcacacggtcatacaccttaaagtgtgctgatgtggcatctacagacttgaagattgtggatgactcagttgatcagacatatccaggccggctattcatggtagcattcagatgaggaggtgtcaccagcttgtggggaaatttgaattagggtcaaaggtcggatgccataggatctgtagagaatcaggttttcaccag

SEQ ID NO: 2629 - DNA, 243 bp, Zea mays
  Clone ID: LIB143-017-Q1-E1-C2
ctttgaacacgtcttattgctctccccgtggcctcgatcacaagcagtctccttgggtagtcagggcacgccccttatctggaaccgcttcatctctcagtgtgggaccgttggaaaacatcaatgcgatgcaagtgcacgaatgcagcaactagcactgagcataggactgctctcgcatggcgatcgaagctctgcttcccgtgccaggggacaatagcatcatgcctcctgctcggttca

SEQ ID NO: 2630 - DNA, 391 bp, Zea mays
  Clone ID: LIB143-017-Q1-E1-C3
aaaccagtgagaagggggaaatgctgggccaagccgcccgccctctcgtctcccgcaccgccgcggcgcccaccgcccgccgggcgctcgtcacggcagaggtgcctgcggaggccgccgaggactccacgtttgtggaggcgtggaagaaggtcgcccccaacatcgagcccccaacgacgccccctcttcctcatgcagccgcgcccgcccacgccggctaccatccccactaagctcaccgtcaacttcgtcctcgcctacaagtccgagatcgccaacagggacgtggacatggtaattgtaccagctacaactggtcagatgggcgttttgccaggccatgttgcgacgattgcagagctcaagcctggtgttctctcagtacatg

SEQ ID NO: 2631 - DNA, 447 bp, Zea mays
  Clone ID: LIB143-017-Q1-E1-C4
ccggtcaggattacgggtcgacgcccgcgtccggctggaggcccacatagcccacgatgagggcgaccaccaccagccgggcgtacctgccccggcgcccgcaccgcccgtggcggtggacacgcatgctcaccaccaggagggagagcacaagccgcacttcccggcgccggcgcctcccccgcacgtggagacgcaccaccccgtccgtcgtccacaagatcgaggacgacgacacgaagactcagacgccagcacacgcaccggaggacgagaagaaaggcctgctggacaagatcaaggagaagctacccggtggccacatgaagccggaagacgctgctgccgccgccgccgcgccggccgtccacgcgccaccgccgccggcgtcccacgccgaggtcgacgtcagcagcccggatggcaagaagggcttgctgggcaaga

SEQ ID NO: 2632 - DNA, 412 bp, Zea mays
  Clone ID: LIB143-017-Q1-E1-C5
acccacgcgtccggcggcggatgggcaagttcatgcgcaagttcgtgctgccggacaacgccgacgtcgacaaggtcgccgccgtgtgcagggacggcgtgctcacggtgaccgtcgagaagctgcccccgccggagcccaagaagcccaagaccatcgaggtcaaggtcgcctgagggagcaagcagtagctgtgcttctgaaactttgtgtgtttgtgtttgcttccttctttggtatcaccaatcatcctatctgatatatcgactggggtttttgctgtctccatagaataaatctctacatgtctcttgtaaccttttctggtgaagatcgtgtcgcgatgaatctataagttaccgtttgttttcgttttgaaaaggaatgggtgtgtagggggaggggggggggg

SEQ ID NO: 2633 - DNA, 419 bp, Zea mays
  Clone ID: LIB143-017-Q1-E1-A8
caccagcctcctcgcgcacgcggtcccgcttgcctttccccacctactcgccgtcgcggtgccgtgcgccggtgctggccagtctaggttttcggccctcgcccgccgatccgtcccccccgccggccatgtcgaagcaaggagggaaggccaagccgctgaaggcgcccaaggtcgacaagaaggagtacgacgagagtgatcttgcttatttgcagaagaaaaaagatgaggaaaaggcgctgaaggagctgaaggccaaggcacagaatggcgcaattggagggtcgggtctcaagaaaagtggaaagaaatgagcattgcccacccacccatctccaaaacacctaagagaacgataagacagctgcttatctgtgttgcgcttcactatatgatatatgtggctgtgagacaat

SEQ ID NO: 2634 - DNA, 436 bp, Zea mays
  unsure at all n locations
  Clone ID: LIB143-016-Q1-E1-H2
acgaccacgagctccagagtggccgtcgccgagtctcgggctcttggctcacgcggcgcggctccccaggccccacccacccccacccccacgcgcccggcggcgtgctctctgctgtctgctctgcacccaggaccttcgcccacaggagctcagccctatccctcgacggtgctcgcggccggcgcgcggcggctcgacccttccccatctccagctgcacgcggtctccaccgcctggaatccagggcctccgacgccaccccacctccaccgcctggaatcgaggaccgtcggcgccgccgtcncctgcctgctgcctcgactcaactgtgtcagggtacttgcaaacagtgacaaaggttctgccttgccttactgtggagccatggctgcaaagatacgcgtggtgatgaagtcttttatgagccaaagc

SEQ ID NO: 2635 - DNA, 402 bp, Zea mays
  Clone ID: LIB143-016-Q1-E1-H3
agcagagcaagcatgttactctgagggcgatccgaccaccggcctcctttcccgcaggcacgggtgcaccgcacgcggtttccactcgcttcgtccgcgttcggatcgccctcagagtaacagtctagcacagcaagcatgtcgtcgtcggcggagaacgaccccacggtgacggtgaccgagcgcggaggcaaggacaagcacgatgacggcggcgacaaggagcagggcggcggcggcttcatcgacaaggtgaaggacttcatccacgacatcggcgagaagatcgaggaggtcgtcgggttcggcaagcccacggccgacgtgtgcggcatccacatcccgcacatcagcctccaccgcgccgacctcgtcgtggacgtgctcatcaggaaaccgaac

SEQ ID NO: 2636 - DNA, 439 bp, Zea mays
  unsure at all n locations
  Clone ID: LIB143-016-Q1-E1-H4
ggcattccaccnagaccagacagcggctcatcctttgctggcaagcnagcgtggaggatggccgtaccctgtgcggattacaacatcccagaaggagagcaccctccacttggtgctgcgtctcaggggcggcatgcagatcttcgtgaagacacttactggcaagacaatcacccttgaggtggagtcctcggacaccattgacaacgtcaaggccaagatccaggacaaggagggcatcccaccggaccaacagcgcctgatcttcgccggcaagcagctggaggatggtcgcactcttgcggattacaacatccagaaggagagcaccctccacctggtgctccgcctcaagggtggcatgcagatctttgtgaagacattgactggcaagaccatcaccttggaggtggagtcgtctgacacaatcgataatgtc

SEQ ID NO: 2637 - DNA, 431 bp, Zea mays
  unsure at all n locations
  Clone ID: LIB143-016-Q1-E1-H5
acccacgcgtccgctcccctcccccgaatcgcgtcgtcccgtctcctgctgccgcggaaccctcgccatggcggaggcgcccgagaccgccgcccccacccagccgcctcccgcgccggcggcttcgtccccgcctcccaagtcggggatcccgccgcggtacgacctggacgccaagtgggacgcgtgcctcgacctctccatccgccgcgtcgcctactcctccctcggcggcgccttcgcgggcctcctcctcttccgtagccctactactcgctgggcatcagttgcccttggagctggtgtggggataggggctgcatacactgaatgctcatacttattcaatggtgctccaaagtgttcacccaaagtatcaactattccctctgcacactctgatggnggagataagtaaacccttgctgttg

SEQ ID NO: 2638 - DNA, 400 bp, Zea mays
  Clone ID: LIB143-016-Q1-E1-H6
agtttgcctacaggctgccaccctgccttttcgaagttcttcttccatctgtcgaggcacactcccttctctctcgtagcaacatatggggcgccgtcgctgccgctctactcgggtgccgatttcttgttcgggcccatctccgggatgccacgggacactttctttggtatgagatgatcaatgtccaactattatgatgattacgacgacattgatgatattgaggatgactatgatatggatgatcctgctgatgacatggtagacgaccatcgacgggttatggattctgatgcggaggataaagattatggacaaccaaatgacaagatcccagatacttcatcagcagatgcaataaatggaagggacattcaaggaatactctgcgagcagc

SEQ ID NO: 2639 - DNA, 421 bp, Zea mays
  Clone ID: LIB143-016-Q1-E1-H7
acccacgcgtccgcccccagtctcggaagagaactatccagaagcgcaagactccaaagccgtcgccttcctatccatcccttcctcgccacgggggtcgcctgagatcacataaacaatggtgaaggctgttgctgtgcttggtagcagcgatggtgtcaagggcaccatctttttcacccaagtgggagatggccctaccactgtcaccggaagtgtctctggcctcaagcctggcctccatgggtttcatgtgcatgcgcttggtgacaccaccaatggctgcatgtcaactggaccacactacaatcctgcgagcaaggaacatggagcaccagaagatgagaaccgccatgccggtgatcttggaaatgtgacagctggagcagatggtgttgcaaacattaatgttaccgacagc

SEQ ID NO: 2640 - DNA, 412 bp, Zea mays
  Clone ID: LIB143-016-Q1-E1-H9
gtcacactggtgagctctgcagtctgcactctgcttagctccgagcttcagtgccttcgttgttagctgttagctccacagtccacagttccacacacacgtccagctgcactgcaccaatggccgccgtcgaggtccaggtcccgactgccgctcccgtcgaggaggctgctgctgctgctgcagcgggagtggaggctgcccagctggccgccgtcgagaccccgaacgaggagaccgctgctccggcggcggagaccgaggtcgtcgccgctaaggagccggtgtcggccgaggccgagactgagtccaaggaggtcgaggtcgaggccgaggccgtagctgaggctgagccgaccgaggcagagcccaaggaagcagagcccgacgccgccgcgccggcagcagagac

SEQ ID NO: 2641 - DNA, 420 bp, Zea mays
  Clone ID: LIB143-017-Q1-E1-A10
ttcaggagagatgcaaggaaaaacctgagtgctcgggcaatccagtcacggtgtacatcactgacatgaactacgagcctatcgctccctaccacttcgacttgagcggcaaggccttcggctccctggcaaagcccgggctcaacgacaagattcgccactgcggcatcatggacgtcgagttcagaagggtgcgatgcaagtaccccgccgggcagaagatcgtgttccacatcgagaagggctgcaaccccaactacctggccgtgctggtgaagtatgtggcggacgacggcgacatcgtgctgatggaaatccaggacaagttgtcggctgagtggaagcccatgaagctctcttggggcgccatctggaggatggacactgccaaggcgctcaagggccccttctccatccgcc

SEQ ID NO: 2642 - DNA, 406 bp, Zea mays
  Clone ID: LIB143-017-Q1-E1-A11
actgtcgtctcggtctgcgtctcgctctccggcgactggtgggccgccgccaccctaagttgcggaggtttacattggtctcttcgccggcgacgagcacccaccaggagtcttgacaagtttttccaatggaccaagtaccgaatggaaggcataaggtttcttttgcgaagccaagagtagttgtgctttcagattctgactctgactctgaaggttttgtagaagagctaactcctgttcactcaaagtcaaacgggaaggcttcatctgcgagcctaaaaactggtggaaaggcttcagccttttctaaaggtgaggcaagcaaaggaaaagcatacagtagtgacaaaggtggaaagggttcttcatcacatgcagtgcctaccaagtctgatgcagaact

SEQ ID NO: 2643 - DNA, 421 bp, Zea mays
  Clone ID: LIB143-017-Q1-E1-A12
aggacattgagatatactcccatgttatgcacatcagctcaacggttagtggacagttggatgatcatctccagagttgggatgccttgagagctgccttgcccgttggaacagtcagtggtgcaccaaacgtcaatgccatggagttcattgataagttggcagttacgatgcgatgaccatatagtggtggtctaggaggaatatcgtttgatggtgacatgcaaattgcactttctctccgcaccatcgtattctcaacagcgccgagccacaacacgatgtactcatacaaagacgcagataagcatcgggagtgggtcgctcatcttcaggctggtgcacgcattgttgccgacagtatgccacatgacgaacaacgtgaatgcgacattaaggctgcgtgcactaactcgggcca

SEQ ID NO: 2644 - DNA, 322 bp, Zea mays
  Clone ID: LIB143-017-Q1-E1-A2
gcacgcgtccagatcaacgccgccgcaggagaggaggagagaccagctccaaagctagacggacaaagcgagagctcagcggggacggaggaagacagagaacatggggaacggcgtcctggatgtgcacctcgtcgacgccaagggcctctccggcaacgatgtcttacggaagctggacccctacgtgatcatgcagtaccagcgccaggatcgtattaccatcgtcgaccgagaccaaggtgatggaccgtactggaaagaggtgttcaacttccacatcaactcggccgcggtcagattgcatcacaatctcatccta

SEQ ID NO: 2645 - DNA, 230 bp, Zea mays
  Clone ID: LIB143-017-Q1-E1-A3
cccgggtcgacgtacgagtcggagacacacctcttcatcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaagaccacggtcctcgccgcgccgaccaccaag

SEQ ID NO: 2646 - DNA, 225 bp, Zea mays
  Clone ID: LIB143-017-Q1-E1-A4
acgccactctgacctgctgttgcatcgcgaccgtcagcaaatcccttcgactcttccgcaccatctccactgagaaggctgtctactgactgcgcagacctgctcggtggagccatccaccagcatgcccattatgtcgacggaaggcgcaacacacgcgcctgctacttggcggagaggaggacagctctgctaccttttcatccactagaatcatcagcgctg

SEQ ID NO: 2647 - DNA, 403 bp, Zea mays
  Clone ID: LIB143-017-Q1-E1-A5
ggctcctatctggtatacgacggagctgagcttctagcaacgtacagtgtatccgccatgagtcctttcggggcggtgatcacgccagaaaccctcaagtacatgtccaagtaccagggacgtgagatcacgcaggtggactgcgcacgggaggcgatgaggctgatccacgcggaagacaagaacctcaaggccgaggactcagcgtgggagctgaagaagaagttcggcaacggcgtgagcaccatggtcctcgtctacaacgccaccggggccagcctgagcctgctggacgacgggaaagactggatgggctccgtctacagctcgccgattccggacaccttccacaacgggcagtggatcgccttcctccacgtcaagcccggctcgctggcgcagg

SEQ ID NO: 2648 - DNA, 422 bp, Zea mays
  unsure at all n locations
  Clone ID: LIB143-017-Q1-E1-A6
gttccagaactgcgcctaaggtttcttgcacgcgcaaatgaagcggcagccaccacatcctcgaggcggcggcggcgcggcggtcggcgagagcggaagcggcggagggttccataagggggaggggaaagggaaagggaggtggggcggcgggtgccggcggcggaacgagcagcggctgggtgtcggcggcggcggcggggccctctccctcgctgctttcgccagcgccaagtcccggactaccggctacaacccggccgtcatcaagaagcanaaggagttctacaagaatgctaaactaatcagcagatacaaaaggacaaagaagcaacagagtcagtcaaacgaccatccgcagattccaatccatgaggatggtggcgacaatgcccaatatgtaccgaaaccgcgctaccaag

SEQ ID NO: 2649 - DNA, 323 bp, Zea mays
  Clone ID: LIB143-017-Q1-E1-A7
acatcgaaacatacctcttctgcttcttccacatcctcctaacacagctaccaccagatccccttcgcctgtgatcatctcctgccggagcgagaagtaccaccgtagggtctaatacgcctgacggaaaatcagaaaaggtacatgtcgcctaagcttccagaccgccgacgacaacaggatcaatatcagggtcctcgccggggccatcatcccacgccaactttccgcagcttcaaagcccgcaccaaaggctacagctcggacttcaacaactggcaatacgagttccacctgagttggaccctaatcagcagctactg

SEQ ID NO: 2650 - DNA, 419 bp, Zea mays
  Clone ID: LIB143-016-Q1-E1-H10
actactgcgacgcaagcaacaggcagtggccgtgcgcggcggggcagaagtactacgggcgcggcccgctgcagatctcgtggaactacaactacgggcccgccgggagggacatcggcttcaacgggctcgccgaccccaacagggtggcgcaggacgccgtgatcgcgttcaagacggcgctctggttctggatgaacaacgtgcaccgcctgatgccgcagggcttcggcgccaccatcagggccatcaacggcgccctcgagtgcaacgggaacaaccccgcccagatgaacgcgcgcgtcggctactacaagcagtactgccagcagctccgcgtcgacccagggcccaacctcacttgctaggccagcagctcctgctagctcgtccacaataaatgctcggcgtcgcaccct

SEQ ID NO: 2651 - DNA, 439 bp, Zea mays
  Clone ID: LIB143-035-Q1-E1-E3
tagcgtcgaaattcagggtcgaccacgcgtccggggcccatcagcttccagctgcagtggttccagcaggtcacctccgccgtgtgcgggcaggactgcaagagctacctggccaactcgctgttcgtgttcggcgagttcgggggcaacgactacaacgccatgctgttcggcaactacaacgcggaccaggccagcacgtacacgccgcagatcgtgagcgccatcgcggccggcgtggagaagctgctggccatgggcgccacggacgtggtggtgccgggggtgctccccatcggctgcttccccatctacctcaccgtctacggcacctccaacagcgccgactacgacgcgctcggctgcctcaagaagttcaacgacctctccaccaaccacaacgcccagctgcaggcccagatctccgccctccaggcca

SEQ ID NO: 2652 - DNA, 380 bp, Zea mays
  Clone ID: LIB143-035-Q1-E1-E5
cggacgcgtgggctgctactagcgtaccacctttttttaatcgaaagtactgtacaagtcgccatgtcgagtacaaaattcagtgtactccaatccaacagaagcgcggggacccagcaaatttgggtcttggtgcccagcgtggcatggttgaactgtaaaactaaaaaaaggtggtacgctagtagcagtgctgtagaaatgaatggatcgcacgcactatcataaaagttagtataaatagtaggcaaggcattagtggggctgaatagaactgtagcctaagctaagcagtgatgctcgtgccttgccacgcacgagacaacgtaacagattacatcagcgctatagtgatctatcctcaataggaagaaagtttg

SEQ ID NO: 2653 - DNA, 404 bp, Zea mays
  Clone ID: LIB143-035-Q1-E1-E7
gagagagggagagattagagggagcgccctgcccaagcaaagagaaaccgcggcgcgagaagagggaggaagggcagacgggcgagcaggatgagagagatcatcagcatccacatcggccaggccgggatccaggtcggcaacgcctgctgggagctctactgcctcgagcacggcatcgagcccgatggcaccatgcccagtgataccacggttggcgtcgcacatgatgccttcaacacgttcttcagcgagaccggttctggcaagcatgtgccgagggccatcttcgtcgaccttgagcccactgtcattgatgaggttcgcactggctcgtaccgccaactcttccacccagagcagctcatctcgggcaaggaagactcagctaacaactttgcccg

SEQ ID NO: 2654 - DNA, 339 bp, Zea mays
  Clone ID: LIB143-035-Q1-E1-F1
gtcgacacacgcctctagactgagtcgtattaggtcgccgcgcggaggcaggcttccgcgcggagggaggtagccatgcgccgggcgcgggaagcccgtcgggactacgagctcatccccaccgctcgcggcgagactctcttgacgcagtgctggtggccgcgcccgtcctccaccgttaaaccaagggcgctaattgttgtcatgcacgggctacacgagcacagtgggaggtacgatcatttagcgaggcggttgaatgatatcggcatcaaggtgtacggcatggactggactggtcacggtggaagtgatggtctacatggatatgtgcaatct

SEQ ID NO: 2655 - DNA, 440 bp, Zea mays
  Clone ID: LIB143-035-Q1-E1-F10
actcgcgggtcgacacaagcgtctaaactaaatcagcggaggcgcgggcggacaaggagcaggcggaggaggagctgtgccaagccacaatgggtatctcacgcgactcgatgcacaagcgccgtgccaccggtggaaagcagaaggcctggaggaagaagcgaaagtatgagcttggtcgccagccggccaacaccaagttgtcaagcaataagacagtgaggagggtccgtgttcgtggaggtaacgtgaagtggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcac

SEQ ID NO: 2656 - DNA, 338 bp, Zea mays
  Clone ID: LIB143-035-Q1-E1-F2
cgtgacggcatcacgcgcgcgctctcctcttccacgagtccgtcagcctgctaagtcttaagatggcgtcaagcagtggtcagacagaagctccagcaccatctgtccccaaaaatcctgctatggcatcatgccggaagaagaaaacagatgatgctaccttccttgaagatctgaaagaccacatggatgagttcattcacgcctccatggatgagcacaagagctgctttaagaagacaattcagaagatgtttggggatgtcgaaggctgttgcagagagatccgcggcggaagcaaacaaagctgaagttgacagtgctttgccacttcagac

SEQ ID NO: 2657 - DNA, 417 bp, Zea mays
  Clone ID: LIB143-035-Q1-E1-F3
ttgttctggatatgactctgggtatcgaaatttttgtacctaccatgtagtatatatggagtaccatgcttcctgcatgattgtggtggtttttatcgtggtttcgccccctagggtaccaggacaacgcccatttgctggcgtcttgtcgcaaccgaagggcttgaacagtgatgcatcaactcacatattggatgtatattgttctttgtttatggagtgtatagtatttgaaagactttaggcatcgttttcattttcattttaattataaccgagttctacgtttaccgatgcatgatgcatcaactcacaaagtgcctttgtttttcagttatctgtgtgggggggttgctgaagctcggaatgtgtttgtggcatcacgtctagtgttgtgtgtttagtgcttgtgtcaaa

SEQ ID NO: 2658 - DNA, 396 bp, Zea mays
  Clone ID: LIB143-035-Q1-E1-F5
gacaagaaggagaaggcgctcgcggacaggaagaaggcgctcgagagccgcaagatcatcttcgcccgcgccaagcagtacgccgaggagtaccacgcccaggagaaggagcttgtgcagctcaagcgtgaggcccggttgaagggtgggttctatgtgagcccagaggccaagcttctgtttgtggttcgcatccgtggtatcaatgccatgcaccccaagacccgcaagatcttgcagctcctgcgattgaggcagatcttcaacggtgtcttcctcaaggttaacaaggcaaccattaacatgctgcgcatggtggagccatatgttgcgtacggatagcccagcctgaagagccgtaaggagttaatctacaggagaggttacgggaagctg

SEQ ID NO: 2659 - DNA, 421 bp, Zea mays
  Clone ID: LIB143-035-Q1-E1-F6
cgtccacctacccggacgcgcgcacgcaaagcagaacgctcccctcccggccttcccttcctccccgccctccgaagtccgaaggccagaagcttccggaagccagcccaagccatgaacgccgccagcaccgccgccgcggcccccgcgcctgccgcgaccgtgcaggtcccgcgcgggcaggtggatctgatcgacttcatcgactggaccggcgtcgagtgcctcaaccaggactcgtcccacagcatcgtcaacgcgctcaagcagagtttgagagacgacgaggggctgtacctcgccagcgattcggacgagcagctgctgatctacatccccttcatgcaggtagtcaaactgcattccgcgctattcaaaggtcccgaggaagagggccccaaaacaattaaactcctctcca

SEQ ID NO: 2660 - DNA, 196 bp, Zea mays
  Clone ID: LIB143-035-Q1-E1-F8
ggagcggaaggcgaaagagtagcagcagcaggcggcgccgagtagcggctccccacctcgagcttgccaccatggctagaggattgaagaagcatttgaagaggcgcagtgcgcccaagcattggatgctggacaagcttggcggagcttttgctcctaagccatcttctggacctcacaggtctagggagtgccc

SEQ ID NO: 2661 - DNA, 122 bp, Zea mays
  Clone ID: LIB143-035-Q1-E1-F9
gactcacgggccgacacaagcgtctacagacagtcaaataaaagcagtacagtgtgacgcgatatacagaaatacaacgagtgtcagactgtgaaataaaagcagtacagtgtgtttcttgc

SEQ ID NO: 2662 - DNA, 437 bp, Zea mays
  Clone ID: LIB143-035-Q1-E1-G10
cgggccgacccaagcgtccatgattcgtgaagagatcgagcttcttttgcaccacaaggtcgaggatgtcttgcaactgcggatcaagctgcggctgcggctcaagctgcaagtgcggcaagaagtagcctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacatatgtattgtgtggtgtgtgtgagagagagagaaacagagttcttc

SEQ ID NO: 2663 - DNA, 422 bp, Zea mays
  Clone ID: LIB143-035-Q1-E1-E11
gacgcgtgggccgacacaagcctctacagtgactcgtgctaacgcgtggggtgccaacgaagaacaaaggatccatccgcggatcggcgatcgcgatggagatcgagcaggcgatgcgcggcagcagcgacgtccggctgcgcgccaagtacgacgccgctgtctacatcgtccgccgcgcctacgccttgtacccgttcgaggagctggctttcagtttcaacgggggcaaagattcaactgtgctgctgcatttgcttcgggccggctactacctccacagagcaagttcaggtggtgacgtggacgacgacagcacggtcctccagaccgtgaagaactgccccatgcggaccatctacttcgaggaccccgatgctttccccgaaatcgactgcttcacgtacgagacggcatcgacg

SEQ ID NO: 2664 - DNA, 397 bp, Zea mays
  Clone ID: LIB143-035-Q1-E1-C1
gtccacccgcccgtccgaacacgcgtccgctccatgtttaatggagtgattgactccagagaggttagatctcacaggtcggggtcttcctccgaacgatcaggggctagaactcatcgccaatcagagcatgagttggacgttgcaacggtgcaagaggagataaggcaacgtgatgcattccaaaggcacaacatgagtactttgcctcattcttggcgcagcagcagaccgtgcttcaagcaactttccaacagcaggggataaacgtagtccttccacaatttcaacctccaccactgccaccaatatggggatcgggtacccaataccttctgcaagtcaaacggccgatgctggaactacatttgtaaatgcaatcttcggtccaccctct

SEQ ID NO: 2665 - DNA, 381 bp, Zea mays
  Clone ID: LIB143-035-Q1-E1-C10
caagcctctagattaagtcgtagaatacggtgggggatgggcggctggtggcgcacgggcggagcgtcctcgccggcgtgccggacaacatcgtgctcacgcacgcctccggggcggggctggtcgacggcgccttcgtcggcgccacggccgccgagcccagcagcatgcacgtcttcaccttcggcaccctccgggacctgcgattcgtgtgctgcttccggttcaagctgtggtggatgacccagcgcatgggcacctccggccgcgacgtcccgctggagacgcagttcatgctcctggagtgcggcccgggcgacggccacggcgacggcgacgcggcggtgtacgtggcgatgctgccgctgctggagggccagt

SEQ ID NO: 2666 - DNA, 438 bp, Zea mays
  Clone ID: LIB143-035-Q1-E1-C12
actcgcgggtcgatacaagcctctagctgtcgcctcatcacttctatcgagaagctgcccgcgcgctccctccgtagagtccaaaccgccacaggaagcgcaacagcggagtctccaaaatggccgccgaggacaaggagaccgactcgccgcagccgccggcgaagctgccccgtctctcctgcgccgacacgagcgccggagtggcggcctcgtcgcctctggttctcgggctgggcctggggctcggcgggggcggcgagcgagacgcggatgcgtccccggcaacggcgacgcccaagaggccgtcagcgctgacgttcatgcagcagcaggaactggagcaccaggtgctcatctaccgctacttcgcagcgggcgcgccggtgccggcgcaccttgtgctccctatctggaagagcgtcgccgcgtcctcct

SEQ ID NO: 2667 - DNA, 412 bp, Zea mays
  Clone ID: LIB143-035-Q1-E1-C4
agctgcttcaagaaacaccgagagcccaaccgcacaggcaggagagagagcagggagccagggacagtagcgtggggccggggagcaaagatggaagggaaggaggaggacgtgcgcctgggcgccaacaagttctcggagcggcagcccatcggcacggcggcgcagggcgccggggccggggacgacgacaaggactacaaggagcccccgccggcgccgctgttcgagcccggggagctcaagtcctggtccttctaccgcgcgggcatcgccgagttcgtcgccaccttcctcttcctctacatcaccgtcctcaccgtcattgggcgtctccaagtcaacctccaagtgccccaccgtcggcatccagggcatcgcctgagtccttcggagggatgatcttcgcgct

SEQ ID NO: 2668 - DNA, 397 bp, Zea mays
  Clone ID: LIB143-035-Q1-E1-C5
ccctgcgctgcaaatcctcggtggttttgcagcttccagagcttgagattgagaccagcgcggcagttctttcttggtcgatggcgctgaggaggatcatcaaggagctcaaggacctgcagagggatccacccacgtcctgcagcgcagggcctgtgtccgacgacatgttccactggcaagcgacgatcatggggcccagcgacagcccctactcggggggcgtgttcctggtcgccatccacttccctccggactacccgttcaagcctcccaaggtggcgttcacgacgaaggtgttccaccccaacatcaacagcaacggcagcatctgcctggacatcctcaaggagcagtggagccccgcgctgacggtctccaaggtgctgctctccgt

SEQ ID NO: 2669 - DNA, 152 bp, Zea mays
  Clone ID: LIB143-035-Q1-E1-C7
agttaacccacaaataagcgcattccagaaagcacaggattgtcttctgcccatgggaattacgtctgaaaatgttgcccatcgatatggtgtaaccaggcaagagcaagatcaggccgccgctgagtctcataggagagctgctccagcca

SEQ ID NO: 2670 - DNA, 425 bp, Zea mays
  unsure at all n locations
  Clone ID: LIB143-035-Q1-E1-C8
atgagtcagagaggtgcagatcaatgcggcggtggtggtgcgccgccggcggcctcgcccgctgcgtcctctcgtcctccacctccgccatagcatcccatgcccgcccgctgccggcacccctgatgcccaaatctccctcctttaccgtccctttctccttgtcctgtcgcaggcaccactctctccagggattcttccacctggtcatcgcttcttccttccgccctccgtcggcgcatcatcagcaagtgcggcactacgccaagaaggagaggtcgcgcgctccgctcacgcccactaaatccaaagtcaagaaatacaagatgaaggccccctcgtccatgaagttcagattcagaaccatganagacggacaggtccgcaggtggagggccggcaagcgccacaatgcacacctcaag

SEQ ID NO: 2671 - DNA, 425 bp, Zea mays
  unsure at all n locations
  Clone ID: LIB143-035-Q1-E1-D10
ctcaaaagaaggaatactttctttgcgctgaaactcctggtgctgcaaaagcttgggtatctacattacacgcaactcagttagtcttacgagctcataaagaggcagtaaattctttggctgggaatggctctccagctacattaggcacagttgctactgcagttgctaatgctaatgcaacagccatggaggctaccaaggagatagaagctgcactaaaggtttcaatgagggcagcccttgggttgggtacaaataactccaacgatggccaacttgatgacctaacaatcatgaaggagactctacgagtgaaagatgaggaattgcaacatttggccaaggatatacgttctcgagatgctacaatanatgaaatagcagacaaactaacagaaaccgcagaggctgcagaagctgct

SEQ ID NO: 2672 - DNA, 389 bp, Zea mays
  Clone ID: LIB143-035-Q1-E1-D11
acgaaagtacgagcttggtcgccagccggccaacaccaagttgtcaagcaataagacagtgaggagggtccgtgttcgtggaggtaacgtgaagtggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatg

SEQ ID NO: 2673 - DNA, 356 bp, Zea mays
  Clone ID: LIB143-035-Q1-E1-D2
gtccggagaaagtatggcaacgccaatgcatggaggtactgcactgatgtgtttgattaccttacgctatcagcaatcattaatggccaagtcctctgtgttcatggtggtcttgctcctgaggtacgcactattgaccagatacgaacgattgatcgcaattgtgaaattccccatgaaggccctttctgcgatcttatgtggagtgaccctgaggagatagagacatgggctgttagtccccgtggagcacgttggctgtttggatcgcgagtaacagcagagttcaactttgttaatggtatcgagctagtttgccgggctcaccagctggtccaggaaggcttaaagtacat

SEQ ID NO: 2674 - DNA, 439 bp, Zea mays
  Clone ID: LIB143-035-Q1-E1-D4
gcccttccgaccgaccttgaagaggggaagagttctgagaactttctctatgttgtggagggaatgcaatttgaccgtggttacatctctccgtactttgtaacagacagtgagaaaatgactgcagagtacgagaactgcaagctgcttttggttgataagaaaatcaccaatgcaagggatcttatcaacgttttggaagaatccatcagaggtgcatacccaatcctgataattgcagaggatattgagcaggacgctcttgctacccttgtcgtcaacaagctcagaggatcactgaagatcgctgccatcaaagcccctggttttggagagcgcaagactcagtacttggatgatattgccatccttactggagcaactgtaaccagacatgaagttgggctatcacttgacaaggcagacaaattagttcctg

SEQ ID NO: 2675 - DNA, 300 bp, Zea mays
  Clone ID: LIB143-035-Q1-E1-D5
ggccgggtcgcccatggtcgccgcgcggaggcaggcttccgcgcggagggaggtagccatgcgccgggcgcgggaggccgggcgggagtacgagctcatccccagcgctcgcggcgagacgctcttgacgcagtgctggtggccgcgcccgtcctccaccgttaaaccaagggcgctagttgttgtcatgcacgggctaaacgagcacagtgggaggtacgatcatttagcgaggcggttgaatgatgtctgcatcaaggtgtacgggatggactggactggtcatggtggaagtgatgg

SEQ ID NO: 2676 - DNA, 367 bp, Zea mays
  Clone ID: LIB143-035-Q1-E1-E1
agagagaggggatggtgtgagggagggaagggagcacaggcaaagcagccaacgaccagagagacacggaggctcagagagagagagcgaggaagaagagtagaagaagaggatggagcaagaggaagcgtgctcctcctcgctgcggcagtgcaggatttgccacgacgaggaggacgagcggcgctccgccatggagtcgccctgcgcctgctccggctccctcaagtacgctcacaggggatgcgtgcagaggtggtgcgacgagacgggaatcgccgtctgcgagatgtgcgtccagaagtttgagccaggctacagcgttcctcgcaagaggaccctagctgccggatgtcgcggtgaccat

SEQ ID NO: 2677 - DNA, 383 bp, Zea mays
  Clone ID: LIB143-035-Q1-E1-E10
gtaatcttctttttcttctctccctcgcagaagtcgagaaaacaacccggtttagcatgcatcggtacggtagctcgctgcgttgattctgctgtttacgtgtgcctgagacaccagtacacggggggaatcatttttcttctgttgtgtttggggagggcggcctcgctggtgtgggggcgatccggctcctgggcgggggcgcggggccccccggcttgctgtccctcctggggacgcgaaggggtgagctgtgagcagcactgcgtgctctggaccttgtcagggcatgtacagtgggtgtcttaagttgtgtcttcgagtgtgtctaggggggtgattgtaaaaaaactcaagacatgtatcttgacgaagacacagtg

SEQ ID NO: 2678 - DNA, 421 bp, Zea mays
  Clone ID: LIB143-035-Q1-E1-A12
cccacgcgtccgcccacgcgtccgcagttctcactctagcgctctctctccctcgctctctctctacacatatatatcagtataggatggatgtgcaaacctagcttgctgctgcctttctagctgagaactgagctgtagctgttggtacggttttcctcctcgctcttcttctcctccttcttgctgctggttgccgggagctgagatcgatcgagagcactgctgttgttcgtgcggccggcggcggcggcgcgcggcagtgggcggagacgacgaccgatcggtcagaaggaatgtcgtcggcccaaatcgtgccggcggaccatgtgtgctatgtgcactgcaacttctgcaacacagttctcgcggtgagtgtcccggggaacagcatgctcagcatggtgacagttcggtgtgg

SEQ ID NO: 2679 - DNA, 165 bp, Zea mays
  Clone ID: LIB143-035-Q1-E1-A2
ccgtccgcactgatagcggagcccagtcttcacccgaccgtggtcctgcactcttgcctcagcgtggagcaactgactaccattgttgagctggcagcttgtcttcattgaccctcagtttgggtgatatgaactgtcaacagtccacagtcagcctatcttgac

SEQ ID NO: 2680 - DNA, 234 bp, Zea mays
  Clone ID: LIB143-035-Q1-E1-A3
atactatattttaagctgaagaaaggtgctgctcatgggctacctgaatctaataactcggcatctatgctatccgttcaaacaattgagaaaatgatggaaggtccagctctccacaacatggtgtatccctacttgcctgaagagatgctgaacccaaattcacttaactggatgctccagaatccaatgtaccgcccacacctacaggatatgctacctaagcatgggcgc

SEQ ID NO: 2681 - DNA, 387 bp, Zea mays
  Clone ID: LIB143-035-Q1-E1-A4
gtcaggccgtcggtccccgggcagtggcgcccaccccaacgccgaggctgcctctcatcgccgtgggcaacgtgctaccgctgctagcgtccctcgccaagagcgcgtcctcgtccggtaggggcaagccgccgctccctccctcgccgccgggcaccctccccatcgtggggcacctacaccacatcgggccccagacccacatctcgctccaggagctggtggccaagtacgggcataacgggttcctgttcctccgcgccggcgccgtgcccaccctgatcgtgtcgtcgcccagcgccgccgaggctgtgatgcgcacccacgaacacatcttcgcgtcccggccgtggtccatgggctccaacatcctccgctacaacacct

SEQ ID NO: 2682 - DNA, 416 bp, Zea mays
  Clone ID: LIB143-035-Q1-E1-A6
atcgacaatggcactccaggcagcctacgagtacctgcagcaggccgtcggccatggcgcgtggtcgtccacgcagacgctgacgctgctgctcatcgccgtacccaccgtactactgctgctagcgtccctcgccaagagcacgtcgtcgtccggtaggggcaagccgccgctccctccctcgccgccgggcaccctccccatcgtggggcacctacaccacatcgggccccagacccacatctcgctccaggagctggtggccaagtacgggcacaacgggttcctgttcctccgcgccggcgccgtgcccaccctgatcgtgtcgtcgcccagcgccgccgaggctgtgatgcgcacccacgaccacatcttcgcgtcgcggccgtggtccatggcctcccacatcctccgct

SEQ ID NO: 2683 - DNA, 402 bp, Zea mays
  Clone ID: LIB143-035-Q1-E1-A7
aagagtttcttcccagtcacgcgtggaacaagacaagacaacttcttttgtttctgtgaagtcagatgatattcagcttagtattcgtatgcccagtggaaatagactggagatcaaactaacaaaacaagatgttttaaggaaagtgaagaatttcgtggatgaaaaccaaggcaatgggcttggctcatatgacctttctctggtttatcctaaaagagttttctttgaacaagatatggaagcaacactatccgagctgggtattcaaaaccgtcatgcaatgattgttgttccacatcggcagtctggtcaggtatcaaggcgtcactcctcggcatcttatgatatgggtgtcaattcaggtgcggatgatgtttgtggcaattcacgtgcgggggg

SEQ ID NO: 2684 - DNA, 420 bp, Zea mays
  unsure at all n locations
  Clone ID: LIB143-035-Q1-E1-A8
gactccatcatgcccatccaagatgttacgaaagacctagtaggaacgtccatttctgtcaaggtggctgaagtgaatgaggaggaaaagaaacttgtcttctctgagaaggatgctagttggtcaacatactcttcccgaataaagattggcgacatctatgatggaattgtgggctcagtgttccactatggtgcatttgttcacctgcgatttcctgatggattatatcatcttactggccttgtacatatctcggaggtgtcttgggatcntgtccaagacgtcaaggattttctaaacgaaggggatgctgtcaaggtcatagttgtgaacattgatatgacgaagtcaaggatagctttatctatcagacaactggaggaagatcctttattggaaacttggacaaagttatcc

SEQ ID NO: 2685 - DNA, 286 bp, Zea mays
  Clone ID: LIB143-035-Q1-E1-A9
gtggatcatattgaaaggcgtgctgcaggtgcacgacggctctgatatacgggcgctcgtgtggatgaagtcagtgttcacgaagttcgtcttgctcatcgctcagaaagactcgacgctggatcgacacggcatgctgtctgtgagattagctccatccagccatcacttgcatcgctactgtaccctactgtccatatgatgctcttcgatctacggatcgataactacatcgtagtcgccatgtacttcactcgcaggtatcatgagatcgtgtccaagacct

SEQ ID NO: 2686 - DNA, 365 bp, Zea mays
  Clone ID: LIB143-035-Q1-E1-B1
attgcaccaatgaattcatataccattacttcaaaaccttcaaaaaggaaagggcaacggaccttggtttctttggtttttgattagtagctgtggaaccttgaaccgatagctgaattttcttgtaaggccctgtttggaagcaacccggttttttagaaaccagtttttatattttagctaggagaggccagcttcttggtttttaagaaactgagaatctaatttctataaacttagtcataaactagtatgtttggaaccacctcaatttctataaaccagtttcttaaaaactgggtgtttccaaacagggcctaagtcactgtagtgcttagccagttgtaacttaagagagttctgtt

SEQ ID NO: 2687 - DNA, 414 bp, Zea mays
  Clone ID: LIB143-035-Q1-E1-B10
cccacgcgtccgcaacccagtcgagtccccctccgctctctctgcagttctgcactctgcagctgccggccatggcgcgcgccccgagctcgtggacgccgtccctcgccatggtgctcctcgtcgtggccgccgccgccgtggccgtgtcgtcggaggcggccagggtgcccgccgccgtcggcaactggacgggggaggagctgcgcggggccgcggcgaggcggggcggccggcgctcccggcgccgcgcgttcgagaacggcctcggccggacgccgcagatggggtggaatagctggaaccacttcggctgcgggaataacgagaacctcatcaagcagacagctgatgcgctggtcaacaccggtctggcgaagctgggctacgagtatgttaacatagatgattgct

SEQ ID NO: 2688 - DNA, 385 bp, Zea mays
  Clone ID: LIB143-035-Q1-E1-B11
gtcttttcctgataagatggtttcccaacttcggtcaacatgcaagtactacactggatatcccaaggacttagggcgatcaagaattataccattcacatctgagcgtcagtttgtgcagctattacatgaaggcaggcctgtagtcgttgcctttactattaagtgcacatatacacagcatcttgataaagttctggaagaggccgcagctaaattttatccacatatcaagtttgtccgagttgagtgcccgaagtaccctgggttttgcctcacaaggcaaaggaacgaatatccatttgttgaagtattttacaacccagaacaggctgcaagcccaggaaagagcgtggatcctaacatcaccaagtattctgtaaaa

SEQ ID NO: 2689 - DNA, 422 bp, Zea mays
  Clone ID: LIB143-035-Q1-E1-B12
gtcagctgcagagagatatattgaacaaaacggaccagaagcatttgagaagctcatcagcaagtctacgaagtcttcgaagtcaaggaacacaaagcggttgaacttggaggatggagaggctgaaaatcgagctaaagccgagagagaatcgtggggcgaaaatcccttctacgacaaaaactacagatactaaaccagttcaaaatccactcagcagtttgaagatgaccttgctcacgagcctcatgcaagctttagttgcgtcggaccgaagacgacattcccatatttctgactctgaatattgtaccttgttacatccactgctactacataatgatgagttctagagcaattgtggactgtgtaaatggaagtagatgctagcgttaatcgtttatgtgctttttggatggtgt

SEQ ID NO: 2690 - DNA, 335 bp, Zea mays
  Clone ID: LIB143-035-Q1-E1-B2
gtccacccgcccgtccggaagcctagagcagccaagaaaagcacatacccgagtcgccgaaacaacaacaatcccaatcccccctcgtcactcaaaactcgaccaacaatgtcgctgattcgccgtggaagcgcattcgaccccttctcccttgacctctgggaccccttccagggctttcccttcggctctggaagcagcagcagcagcagcctgttcccctcgttcggaggcaccaccagctctgagacggccgccttcgccggcgctcgcgtcgactggaaggagacgccggaggcgcacgtgttcaagaccgacgtgccggggctgaagaa

SEQ ID NO: 2691 - DNA, 347 bp, Zea mays
  Clone ID: LIB143-035-Q1-E1-B4
cctctaaactcagacgtagcacggtgggcgaccagtctcctccgcacgcttcccaccgagctcacacactgcacactcccacactcccactcccacctgtaggttcacgggaggcgaggaccctgccccccctgcattcttcccgtatcgcggaccgatcctcgccgcgggaggcgagcggagcggggcgtttctgcgggggagaagcgcgtccctgcaatttctgagagaggggaggccgcgagtggaaaagagcaggcgttgctatcctatcttgctgacacagcggcggtgtggcgaggcgcatggcgagggcgcgcggtggcgccgcgtggtgggtgctggca

SEQ ID NO: 2692 - DNA, 400 bp, Zea mays
  Clone ID: LIB143-035-Q1-E1-B6
agcgccgtccgccgcgtgcgccgccccgcgcgcagcccctggctggactgcatcgaccagtacccggcgcgcatggacgcctagcacgtacctgcaatgcagtggctgctatctatctatcgctcgcttcgctagctaccagtgcagtgctgcacttcaccgatggatggatcggatatttgatatggtataggacgcggtcggtcgatttgcatgcatgcaccaagtgttactataccgttctgaaggtacgtttgaactttgttcgtgtgtattgcactattgcttgttgtttaagtagcggttaagggagggaagtactactccggtcctgtcctgtgtgagccttatgtacgtgcaattttaatgtgttttgatattacaagacttgacggttggc

SEQ ID NO: 2693 - DNA, 388 bp, Zea mays
  Clone ID: LIB143-035-Q1-E1-B7
aacaaagcgatactagctagtccctaccaaagcatacttcctgaaacactcttgcaatccactgagttctgtttgttgagacgcatagagctagagtcgacaatgtcgctcgtgaggcgcagcaacgtgttcgaccccttctccatggacctctgggaccccttcgacaccatgttccgctccatcgtcccgtcggcgacctccaccaactccgagactgccgccttcgccagcgcccgcatcgactggaaggagacgcccgaggcgcacgtgttcaaggccgacctccccggcgtcaagaaggaagaggtcaaggtcgaggtcgaggacggcaacatgctggtcatcagcggccagcgcagcagggagaaggaggacaaggacgaca

SEQ ID NO: 2694 - DNA, 427 bp, Zea mays
  unsure at all n locations
  Clone ID: LIB143-034-Q1-E1-H9
caacgcatccgccaacgcgtccggttctaaatcccaaccggccgcccttttttttttttttttccccaataaggattctgctcattcttaatttggacggatcagaatagaattgccaacatttggacgacggattctcaataaggattctaaacgatcacttaaatatcctgtgacattcctcccattaaccagcatattagtactacagcaaatgggcgcgtttttacagggaattataataatccttccatcatccatccatccacgaagaagaaaaataaatctaggcacggttccggctggccggaggaggggagcaagctaggcgaggagcgcatcggattccgacactgnggttggggccccggcggcccgagcccgatgacgatccgtcaccgcgtgtgcttgcaggggcccgcggcgg

SEQ ID NO: 2695 - DNA, 427 bp, Zea mays
  Clone ID: LIB143-016-Q1-E1-F1
cccacgcgtccggcgccgatctggtggttcgtggggagcggaagttcgtgccgcaggagttcatcgacgagctcgcgtccttcctcggggacaacatcactctggactacgaggagaggagcttccatggcacgccacagaacagcttccacaaggcggtcaacctgcctgatgtcgtcgtgttcccgagctcgcaagatgaggtacaaaggattgtgatggcctgtaacaagcacaaggttccaattgtaccatatggtggggctacctcaatagagggtcacacactggcacctcatggtggtgtttgcatcgacatgaccttgatgaagaaaataaaatccctgaatgttgaggatatggacgtagttgttgaacctggagttggatggatagagctgaccgaatacttgaagccctatggcct

SEQ ID NO: 2696 - DNA, 398 bp, Zea mays
  Clone ID: LIB143-016-Q1-E1-F10
ccgaactggagcaatcgcccgcccaaggagacgatcctcctcgacggctgcgacttcgagcactggctcgtcatcatggagccgccgcctggtgacgcctccaaccccgacatcacacgcgacgagatcatcgatagctatatcaagactctcgcccaagtcgtcgggagtgaggaagaagctaggcaaaagatatactctgtatcgactcgtcattactttggctttggtgctcttgtatctgaggaactttcttacaaactgaaagaaattcccaaggtccgctgggttcttcctgattcatacttggatgtcaaaaacaaggactatggaggcgaacccttcataaatgggcaagctgttccttatgatcctaaatatcatgaggagtgggtgag

SEQ ID NO: 2697 - DNA, 412 bp, Zea mays
  Clone ID: LIB143-016-Q1-E1-F11
accccgtccgtcaccagaggaagaggaagaggaggatgtcggggtcgaaggtgtacacccttgaggaggtggccaagcacaacaccaaggatgactgctggctcgtcatcggcggcaaggtgtacaatgtgaccaagtttctggaggaccaccctggaggtgatgatgtcctgctgtcttccactgccaaggatgctaccgatgatttcgaagatgtggggcacagcaccaccgcccgtgcaatgatggacgagtacctcgtcggtgagattgatgcggccacgatacccagtaaggtgaagtacacgccccccaagcagccgcactacaaccaggataagaccccggagttcgtcatcaagatcctccagtttttggtcgccctggcaatactgggcctggctgttgctgt

SEQ ID NO: 2698 - DNA, 347 bp, Zea mays
  Clone ID: LIB143-016-Q1-E1-F12
gggccgacccaagcgtccaccccgtccgtcaccagaggaagaggaagaggaggatgtcagggtcgaaggtgtacacccttgatgaggtggccaagcacaacatcaaggatgactgctggctcatcatccgcggcaaggtgtacaatgtgaccaagtttctggaggaccaccctggaggtgatgatgtcctgctgtcttctactgccaaggatgctaccgatcatttccaagatgtggggcagatcactagcgcccgtgccatgatggacgagtacctcgtcggttagattgatgcggccacgatacccactaacgtcaagtacacgccccccaatcagccgcactac

SEQ ID NO: 2699 - DNA, 233 bp, Zea mays
  Clone ID: LIB143-016-Q1-E1-F3
agaagtgtctctggtaacgctgtccggttggatgtggtctacaggcttttgttgtgaccatggatgaagtctcattcacatgaccgcagatcattctcagctcgggaaacgttgtagcgttctaaatgattaccttaatcagcaggaccatcccaaatgtccagctgtccagaagcacgttacggctagtgatgcaaccttccaactggatcaccatgggtctgacagatgca

SEQ ID NO: 2700 - DNA, 176 bp, Zea mays
  Clone ID: LIB143-016-Q1-E1-F4
tcgaccacgcgtccgcaagggtccaattcctgatgcccggtccttgaccggccacctccacctcttttcataaaccccatggagaaaaatatcattccacaggtaccattgtttaacatactgaagaatttcgatggtgagacagttacagaggttgtccaaccttccattgcccg

SEQ ID NO: 2701 - DNA, 171 bp, Zea mays
  Clone ID: LIB143-016-Q1-E1-F5
acacagattcatacaagtcgaactaatagagacaggagatctggagattagatcagctcgcatccaagccaattgcacacgaaatatactgagcacatagagtggacgcggcctgcatcacgtggatctgactcccgacgtctccgatcacattgccgtggatgacatgta

SEQ ID NO: 2702 - DNA, 106 bp, Zea mays
  Clone ID: LIB143-016-Q1-E1-F7
cggaactctctaatctgagtcgtagtactcgtgcatgctacctcatcactcttccacagtgtcacctatgttcacttcactggctgtctattgccaacctcgctga

SEQ ID NO: 2703 - DNA, 77 bp, Zea mays
  Clone ID: LIB143-016-Q1-E1-G10
agtacagcagcccttgagctccagcactactggccgcgactggcgtcaatgtgttggggatgtcggcgatcccgcat

SEQ ID NO: 2704 - DNA, 222 bp, Zea mays
  Clone ID: LIB143-016-Q1-E1-G12
tagtgatttatagtcatgaatatgtcagccaagctgtaagaaacctaagttctcagaggaacacggtgtatagaacttacaagtgtaatatgaatgagctcatgcatgagttttcttctgccagattaggaatcgaatattgcaagtcagcttggtcgagatttggtttgagctcatggtatcgtgtagaataatgccgttcagttctgacgcacagggttt

SEQ ID NO: 2705 - DNA, 432 bp, Zea mays
  Clone ID: LIB143-016-Q1-E1-G2
acttctctaacttggaccaagttttctgaaaaaagatgttcacatctacaagttcaaataaatgcaactatcaaaaactcggccaaggagggtaagaccatccttgtggtatttcattaatagaacgttgcggcaacggtcccgactgagaaacccccgaaccctgtcctcctatcactaatgggccgattcaagctactcactctgcaaaggcccacctatgcccgagggtggcgcacagccgagttgtagcctgagagcggatgacgaatagcaatgagaattttttgtgtagagccagggtttgaacccgtgacctggtgaaagggaccctgctgccttcaccagtgaggtattacaccatctgcgaatgcaactatcaacactttgttcttttttgcttacagtgattacatcttattatttaatgaa

SEQ ID NO: 2706 - DNA, 220 bp, Zea mays
  Clone ID: LIB143-016-Q1-E1-G3
acctcagccgcgtcgcgtcgcatcctacgatccaaagctctctctgctcgcagccatggcgaagaactaaccgaccgtgagcgccgactacagcgaggctgttgataatgccaggcgcaagctccgagccctcatcgccgagaagagctgcgccccgctcatgctccgcctcacgtggcaatccgcggggacgttcgacgtgtcgtcgaggaccggccgt

SEQ ID NO: 2707 - DNA, 339 bp, Zea mays
  Clone ID: LIB143-016-Q1-E1-G4
acattgctattcgttgcatcgttcctgtacatgtccatacaagtcttgcatacattgaccgcatcacaccactcaagctagcatgaatgtcagtagcagctggccaaacagatgggttgttacttacagagcttgacacacccgatagacaggcatccgtatacgctcaagagtttggattggtgaagaaaattctcatttcatccctagaacagagataccatgatgctgcatcatggaacgaccaactgatgcggctgacgtctaagcggaacaacagagcctgatagcgttgcatgtctggatcgtgtacatattgatgatgcccacctgaactcc

SEQ ID NO: 2708 - DNA, 377 bp, Zea mays
  Clone ID: LIB143-016-Q1-E1-G5
ggaccagctcggagaccgcggccttcgctggcgcgcggatcgactggaaggagactccagaggcgcacgtgttcaaggccgacgtaccggggctgaagaaggaggaggtcaaggtggaggtcgaggacggcaacgtccttcagatcagcggcgaacgcaacacggagcaggaggagaagacggacacctggcaccgcgtggagcggagcagcgggaggttcctgcgcaggttccgactgcccgagaacgctaagacggagcagatcacggccgccatggagaacggcgtgcttacagtcactgtgccgaacgacgacgccaagaagcctgaagtgaagtccattcacatctccggctagacctccgtctgcggtcgt

SEQ ID NO: 2709 - DNA, 424 bp, Zea mays
  unsure at all n locations
  Clone ID: LIB143-016-Q1-E1-G6
ccgcggcctacccgacgccgttcgtcgctccgggtgaggagtcctcccgctacgccatcattgtcggcggagccaacttcgggtgcggttcctctcgcgagcacgcgcccgtcgcgcttggggccgctggcgcacgcgccattgttgcggagggctacgcgcgcatcttttttcgcaactccgtggccactggagaggtgtaccctctggagctcacggacgttggggcctggaaggagtgcaagacaggggatgtggtcaccgtggaccttgctaactccgtttttattaaccacacctctggcaaggagtacaagctgaaaccaattggtgatgctggccctgtaattgaggcgggagggatctttgcctacgcccggaagacaggaatgattgcgtcganagctgctgcatgagggaaaga

SEQ ID NO: 2710 - DNA, 269 bp, Zea mays
  Clone ID: LIB143-016-Q1-E1-G7
gagggaggactcagcgggcgctcgtcccgacgaggatagagacgacccgcgctccgcacactggagccagaggatcgctcgcgctacgattcggcgcgcaaccagcctggcgtccgcctgggcgggccgcagccacacgccatgcacttcggcgggctcggccgtatcctccgccccagctccgtcgcatatggcgaggtctaccctgcctcgctcagcgacgttgtcgtgcgccacgagttcaccacacgggacgtcgtcaacatcgc

SEQ ID NO: 2711 - DNA, 426 bp, Zea mays
  Clone ID: LIB143-016-Q1-E1-G8
accaaacagcagttgctgctcaatgtttgaaagaagtatttttctagattgtgtaatctaatctttgttgcaaatgcttctgtccagatcagtttgtcagtaacttaaatgcttccgtcaactagttgccactgtctgttagtacagtagcttgacaactcttcgtgttcatctgggttcatcattcacatgacaggattataggatccatgggtgtggatatgctcctagtgcacatttcaggaccaatctctgtgaccccttcgtcctgtgttattatagttccactgatcaacaaccttgttctggagaaatcatagatcaattaaatgaaaggaaagaggtagcgaaatgaaaacacaggtcatgcctttgcaaggttcctgaagtaaattgttgtgtagttccccgttgggaagacaattt

SEQ ID NO: 2712 - DNA, 250 bp, Zea mays
  Clone ID: LIB143-016-Q1-E1-E9
ctcaagctctccgaactggggtatgctgatgcttaaatggtccatatcctggagcgggacacaaactgctgcctgtatggactcgtgcgattcagggtgaaccatcagattgtctagtgtcttctttgtaataaatttatctgttcttggtactttgtctatggttgaatcggaacccattttccgtttgcctagattcttaatttctggtgctgtatccagctgaaactagtagatcaaggatcttgtg

SEQ ID NO: 2713 - DNA, 331 bp, Zea mays
  Clone ID: LIB143-016-Q1-E1-G9
aaggcaccacacctcttcttcttcgtcctcctcctcctagcacagctagcgcctgctctccttcgcctgtgatcatgtcctgcagcagtggctagtgcgattgtggctccagctgcgcctgcggcagctcatgcatcggcatgtcccctaccgtggagaccgccgccgttagcatcagcatgaccatggtcctcgccgcgccgaccatcaatgccagcgcctgcggcttccacgccgcaatcgagggcggccgctgcgactgcagcagctggtatctgcggcagcatctgctgatgcacctgctgcagctgcagctgacccggtcaggcga

SEQ ID NO: 2714 - DNA, 419 bp, Zea mays
  unsure at all n locations
  Clone ID: LIB143-016-Q1-E1-H1
aatacatggaagcaatttcgatcttattggaagaatccaccctacaatgccatgcgctatcttatgacaatcctctacggtctcgtgttcggttcagtcttttggcgcatgggaaagaacgtgaaatcagagcaggaactgcaaaacctacttggagccacctatgctgctgttttcttccttggatctgcaaacttgctctcatctgtacctgttttttctatcgaaaggacagtcttctaccgtgaaaaggctgctgggatgttctctccgctgtcctattcgtttgcggtgacagttgtggagcttgtctacagcatagctcagggcatcctttataccatccctctgtattcaatgattggttatgagtggaaggcagacaagttcntctacttcatgttcttcctaacctgctc

SEQ ID NO: 2715 - DNA, 370 bp, Zea mays
  unsure at all n locations
  Clone ID: LIB143-016-Q1-E1-D3
ttccaactggcgtagttgaaccgggggaagatattaatgttggagccaaaagaaaattaaaaaagaaaacgggaatgaatcagaattttgttaagttgctggcttcaggcanagccacaaagctttttttgataaatcagatctatttttcgtgtgcctgctacgaccactgtcatatgacattacgaagcaagactcggaaatagaagcatgccagtggatgccagtagaggaatttgcagcacaaccatttgtccagaaacatgagcttgtgaagtacatcctcgaagtaggcctggctaaaattgacaagaaatatgcagggttttcgccaatctccataaaatcggcgtttacagacaaattgtcc

SEQ ID NO: 2716 - DNA, 423 bp, Zea mays
  Clone ID: LIB143-016-Q1-E1-D4
agagaatactgcgacctctgctccccctgcacaatcctcaagtgggagttctacatctgcacaacccagcagtgctgcttctgctcgttctactaatggtccctctctgatatctcgtcctgctggccttggatcatcctcttccctatcgcagcctcctgcccgttctgttcaacaggtccgtgccagcaggccagccgctgtggataagggaacccatgaggctactgagtctgccgaggatgatagagatgagaatgatgatatccatgataaacttcaaatgatccgggttaagtttcttcgcctcgctggcatgttggggcaaacatctcataacatggtcgtttcacaggttctgtaccggcttgggctggcagaacaacttagaagaactgctaatgggacgtttagcattgaccg

SEQ ID NO: 2717 - DNA, 73 bp, Zea mays
  Clone ID: LIB143-016-Q1-E1-D5
agtgtcggtgtgcactgtgttgtcatctccatctccagctccagcgccgccttacgcggtctgcgtccgctcg

SEQ ID NO: 2718 - DNA, 430 bp, Zea mays
  Clone ID: LIB143-016-Q1-E1-D6
gccaagtccccttccctcgcctcgcgttagtagcctgcttccgacccgcacatctccctccggttctcgccatgggcgccggcgccaacaaccacgaggagtcgagccccctcatcccagctgcggtcgccgcccccgcgtacgagaagcccccgcaggctccggcgccggaggccgccaattactatgccgacggggtcccggtcgtgatgggcgagcccgtgtcggcccacgccttcggcggcgtcccgcgggagagctggaactccgggatcctctcctgcctcggccgcaacgacgagttctgcagcagcgacgtcgaagtgtgtcttcttggaacggtagcaccatgtgtgctctatggtagcaatgttgagaggcttgctgctggacaaggcacatttgcaaacagctgtttgccttacactgg

SEQ ID NO: 2719 - DNA, 405 bp, Zea mays
  unsure at all n locations
  Clone ID: LIB143-016-Q1-E1-D7
cggacgcgtgggtggaaaccacaaagagcttcaagctacaacgagtgattcctatagtgtttgtagagctgagaaagttgtaaccaatttcatataaggagagattcctatataagtgttgtgtgtattgagtgtttgtgataatcacttacgtgagagggagagatttccaacaattggtatcagagcctgttgatcttggaggagatttttgctgcccggtgcgatgtanagattggcgacgtcggttgtcaaggcagcggtgcaacgctacagcaatattgcaagttttgcgtgacgagatgctatggtgttatggcaatgcccagccataagaagatgttgccatgaactatggtgtgaagccgtgttcatgcaaattgttgtgtgaagctgcatggtgat

SEQ ID NO: 2720 - DNA, 427 bp, Zea mays
  Clone ID: LIB143-016-Q1-E1-D8
aggggaaaaaactcgcctttttctctctgctggttcaagaacgccatggaaaatctcgagcgctcgctgtgattcctgcgaatacccaagcccaaccaaaccctagcccggcagccattctcttcgttccctctttgctctgcgcgccacaccgcacgacctccccgaagcagacgtgcccgctgcccgtccgtcccccgtggccatggccgcgacgtggtcttcgtcttgctgcgccgcgaccgcgtcgagcagcgctctgcttcgtcatgcccgcgtcaagagcgcgccttgggtagccggtgccagccggagtagctacaggcagcggcggcggcggcgggagctgtccatccgcgccacggccgcggcgccgccgccgcccgtggtctacgcggacgccggcgccgacaacgtggcctcgctg

SEQ ID NO: 2721 - DNA, 363 bp, Zea mays
  Clone ID: LIB143-016-Q1-E1-D9
atgcgctgcgcctcggttttacggcccttccctcaccgccccgcgcgagcgaaatcatgaagcttgaggtcatgcccaagcagcgggtgctggaggcggagcagagggaggaggccatggagatgagtggcctggacctgtggaagcacgagaagcccccaaggatctgccccttgcccccgtcgctcccggcgccgccagcgtgcgacgaggcggcgctcgtgccgccgctcaacttcgccatggtcgacgacggcatattccgctccggcttcccggagaccgccaatttccggttcctcaagtccctcaacctccgctccatcgtgtacctgtgcccggagccgtacccagagacgaaca

SEQ ID NO: 2722 - DNA, 413 bp, Zea mays
  Clone ID: LIB143-016-Q1-E1-E10
acgcttctcccgctcgtcctcctcctctcctcctggacagcagagcacagcacaacacaccgagaaagaacaagcagccgccaccggagctcggaaccaccatcagcagcagcacacccggtcaaccttccacacgcgcacacacacacacacatggcgtcgcagcagaggcaacagcaggcgggagcggcggcggcgtcctccgccgtgggcttcgaggactacctgccggtgatggcggagcggctgggcgaggacgggctgatgcgggagctggcgagcgggttccggctgctgatggacccggcgcgcgggctcatcaccttcgacagcctccggcgcaacgcgccgctgctgggcctgggcggcatgtcggacgccgacctccgcgggatgctcgccgagggcgactt

SEQ ID NO: 2723 - DNA, 393 bp, Zea mays
  Clone ID: LIB143-016-Q1-E1-E11
cccacgcgtccgcccacgcgtccgcccacgcgtccgagaaaacttaaggtttgacttggacgatgaaagagtcattgtcctgaagtaccagaacgcaaggcttgccacatcccgggtcctcaaacggcacaggataccgtcagccatatcgagcgaccttgtcgaagatcaagtaactgatggcgaggttgagacgtcatgcaccagctaatgctagactcttttttagacctaattgggagttccctgctgtagctcagctcaagaagcgagctgcattgttggcgaggcaagcgcacctgcctgcctgcctgcctggagtacatggtatcactttcctcctttaaggccggtttaattttgacataagggagaatttccttagaaaataag

SEQ ID NO: 2724 - DNA, 203 bp, Zea mays
  Clone ID: LIB143-016-Q1-E1-E12
tatagtttgagttggagcatgatggagttattgtcctggagtaccactcctcggcgcttgccataacctgggtcagcgtacagtgcacgcctgcgtaatcgatatctttgcaaattgtctagaatcagtttactcaacgtcaggttgagacgtcatgctccagctaatgcgttcatcaattggacacctcgttgtcagttcca

SEQ ID NO: 2725 - DNA, 429 bp, Zea mays
  unsure at all n locations
  Clone ID: LIB143-016-Q1-E1-E2
gaagcatatagcaccagcggaacacgggaacggcggaagcaaacaactagaaattccccagcccggttctttgcgtgcggttgatctcgtcggaggcccggccgcggttccccaatccgccatcgaattcgatggcggccaacgccgggaataagatccgcaacgccaagctggttcttcttggagatgtgggcgctggcaaatctagcttggttcttcggtttgttaagggacagtttgttgaattccaggaatcaacaattggagcagccttcttttcccagaccttagcggtcaatgatgagactgttaagttcgaaatctgggatactgccgggcaggagaggtatcatagcttggctcccatgtactatangggtgcagctgctgccattgttgtctatgacatcacaaatccggcctccttca

SEQ ID NO: 2726 - DNA, 408 bp, Zea mays
  Clone ID: LIB143-016-Q1-E1-E3
ggcatataggagtttgtagtgatggcggcggacacagagcctctcgagatcctgctccacctccccttgttagctgaggataataacgtgccatatgtgtttgttccatcgaagcaagctcttggccgtgcttgtggtgtgacaagaccggttattgcttgctcagtgaccagtactgacggtagccagctgagactacagatacagggtctcaaggactccattgagaagcttctcatctgatctgccgaagacctttcagtgtgatgggcctcatcgacacatttttcagatgcttggactggtgatggtgtcctgtttactttacgcttttcagactatatttgaacactgttaagtccatcatacctgaattgtaccgcatcctacgtctgtgattgtcatgta

SEQ ID NO: 2727 - DNA, 419 bp, Zea mays
  unsure at all n locations
  Clone ID: LIB143-016-Q1-E1-E4
agcagacatggccaccattccgaccaccgattctggcctcgtcctcagttcctccgctctcctccggaggactaagagggccgcctcatccgtcaccgccaggctgccagccgtcgcccgccgtcgcccgcagctcctcgtgcgtgcctccgccaaggagatcgcctttgaccagggctccagagccgcccttcaggccggcgtcgagaagctcgccgccgcggtcggcgtcaccctcggacccagaggaaggaatgttgtcttggatgagtttggaacccccanagtggtcaatgatggagttaccattgcccgcgctattgagcttgctgattccatggagaatgctggtgcttccttgattcgtgaagttgccagcaagacgaatgactcggctggtgatggaaccacaactgcct

SEQ ID NO: 2728 - DNA, 429 bp, Zea mays
  Clone ID: LIB143-016-Q1-E1-E5
gaaaaaggaaaggaaaggacaaaggagcggcggcgaggtctatggcgtcgacggcggggtacctggcgcggcgggcggcgcagaaggagcgggtgcgcctgctctaccgcagggcgctcaaggacacgctcaactgggccgtccaccgccacctcttctaccaggacgcgtcggatctccgggacaagttcgaggccaaccgacacgtggataacctggacgtggtcgataggctcatcgacgatgcggaggctcagtacaggaacttccagcaccccgatccctacattgttccatgggcaccaggcggcactaaattcacaagaaagccccctccacctcaagggatcgagatcatctacaattatggcaaggaggaacagtaaacaagagtcctgcaagcgggggcagaacttccaaagttccaaa

SEQ ID NO: 2729 - DNA, 431 bp, Zea mays
  Clone ID: LIB143-016-Q1-E1-E6
gcagaagctacaatcctaaaaccatctgcttcagccttcagctagccccaagtttagtcggccgatcgatcactgaagtagtaatggcctccgccaacagctggaccctcgagatcgcgtcgccggtggccccgcagcgcctgttccgcgccgccgtgatggactggcacaccctggcgcccaaggtcgcctcccacgtcgtcgccagcgcgcagcccgtggagggcgacggcggcgttggcagcgtcaggcagttcaacttcacctcagtcatgccgttcagcttcatgaaggagcgtctcgagttcctcgacgcggacaagtgcgagtgcaagaacacgctcatcgagggaggcggcatcggcgtcgccatcgaaacggcgacgtcgcacatcacagtggagcccgcggccggcggcgggagcgtggtg

SEQ ID NO: 2730 - DNA, 383 bp, Zea mays
  Clone ID: LIB143-016-Q1-E1-E7
agcaagagatatgctgcagcacttgtggacaggtccgatctcaaatgcagctgttgatgttgttcaagggagtcgatcagttgaagttcggtctgttggagttaccaagggtgctgcaattgatcgtattttaggggagatagttcacagcgaaaacatgattactccaattgactatgtcctgtgcatagggcatttccttgggaaggatgaggacatctacgtcttctttgatcccgagtacccttctgaatccaaagtaaagccagagggcggctcagcatcacttgaccggaggccgaacgggaggccaccatcgaatggcaggagtaactccaggaacccacagtccaggacacagaaggcccagcaggctgcatccg

SEQ ID NO: 2731 - DNA, 176 bp, Zea mays
  Clone ID: LIB143-016-Q1-E1-E8
agccagtgcttagattggcaattttggcatcggtggtctgaagccacgcactcatcagtggaacattcgcagtcaataagtagaacctgtctctgagctgcttcccacgagtgaaagttgtactcacatctgaggggattcatggccaagtatacatccccgagatccattggatg

SEQ ID NO: 2732 - DNA, 433 bp, Zea mays
  Clone ID: LIB143-016-Q1-E1-D2
cagagccactctgccgacttcaaagttggaagtggcgagcctgctccaatgtttgtcacaggaccctacgccattgctcaccaccttatctcgtcgtgggctttcgagggagtaccgaagctgcctagttcattctcaaacctataagcctggctgcctggaccctggtgttcagacaaaacgatgacaggaactggatccctgtgctgccgtgagtgtaattctgatagtgtccgttgccggttgtgataaaatacaatagcaatagagtactgggtacagaagacttgccggaggattcggcatcaatggacatgtatatccattgcctttttatatgttgatcctttttgtatcacacgtaatgttgcatagatacaacaatgatgtacaacacacagtgtactcatgcatttatacatgtattcagata

SEQ ID NO: 2733 - DNA, 153 bp, Zea mays
  Clone ID: LIB143-016-Q1-E1-B2
attaaacatacccagctctcgccatgcgaactcagttacatccagggagtaaatgagatttagagcgatgacggagctgttcgacactgccgtcaccagcctccgccatctgccggaggtgcagtactgcctcgccaccccagactgctaccg

SEQ ID NO: 2734 - DNA, 429 bp, Zea mays
  Clone ID: LIB143-016-Q1-E1-B4
agaatgaaggccgtggtgatcacgtgcgccggcgggccggaggtgctggaggcgcgggaggtggacgaccatcccgcgctaggcgaaggagaggtgctcctcgaggtcgccgccgcgggcgtcaatcgcgcggacaccgtgcagcggatgggccggtacccgccgcctgccggcgcgtccccttacccggggctcgagtgctccggcaccatcctcgcgctcggccccaacgtcccctcccgctggggcgtgggcgataaggtttgcgcgctcctcagcggccgcgggtacgcggataaggtggtggcgccggcagggcaactgctgccgatacccgatgggggttcgctgactcacgcaaccggcttgcccgaggtggcctgcaccgtctggtcaaccgtattcatgaccagtcacctctcccccggt

SEQ ID NO: 2735 - DNA, 423 bp, Zea mays
  Clone ID: LIB143-016-Q1-E1-B6
accaagcagcgatccgaagctcaatcaattcactcaaacctcttccccaaatcttcgattagattctcgttgacaagaagactagaaccgaacctgaccatgtcgctgatccgccgcagcaacgtgttcgatcccttctccctcgacctctgggacccctttgagggcttccccttcggctccggcagcagcagcagtctcttcccctcgttcccgcggaccagctcggagaccgcggccttcgctggcgcgcggatcgactggaaggagactccagaggcgcacgtgttcaaggccgacgtaccggggctgaagaaggaggaggtcaaggtggaggtcgaggacggcaacgtccttcagatcagcggcgaacgcaacatggagcaggaggagaagacggacacctggcaccgcgtggagcgg

SEQ ID NO: 2736 - DNA, 313 bp, Zea mays
  Clone ID: LIB143-016-Q1-E1-B7
acggacgcgtgggcagacatcctggtggagatccacatgtgttgtctggactccttgttgacaagacgaacttcacgaaaaccaacaaatgggcgaaatatatgtgaaacctcccgtcgtgtgcagtttgcaggtaagccctcaatatatagagtgcttgatgcatcaggcggaagaggtggctcaggtctgccaccatatcccgtcgtgtgcagtttgcaggtaagccctcaatatatagagtgcttgatgcatcatgcggaagaggtggctcaggtctgccaccatatcccatccctctgctggtccatac

SEQ ID NO: 2737 - DNA, 375 bp, Zea mays
  Clone ID: LIB143-016-Q1-E1-B8
accaagcatcgatccgaagctcaatcaattcactcaagcgtcgtccccaaatcttcgattacattctcgttgacaagaagacgagaaccgaacctgaccatgtcgctgatccgccgcagcaacgtgttcgatgccttctccctcgatctctgggacccctttgagggcgtcgccttcggctcaggtagcagcagcagtctcttcccctcggtcgcgcggactaactcggagaccgcggccttcgctggcgcgcggatcgactggaaggagactctagaggcgcacgtgttcaaggccgacgtaacggggctgaacaaggaggacgtcaaggtggacgtcgaggacggcaacgtcattcagatcagcggcgaacgc

SEQ ID NO: 2738 - DNA, 401 bp, Zea mays
  Clone ID: LIB143-016-Q1-E1-B9
ggagaagatgagccaggtccaaagattggtgaaaggctcctatgtcgtcaccctttcaatgaatcaaagagagcgtacgttgttccacagcatgttgaggaattattgaagtgctactggcctggaaattcatcgaattcacgggaggagcttccatccatccatgagattaggactcggtgtattcaccatctggaccgaatgaggccagaccatatgaggcggctgaacccgacgccttacaaggtaagcgtgagtgctaagctgtatgacttcatccatttcttgtggctcaacgaagcgcctgtcggagaactgcaatgatgaaatgaagtggcggtagggtcggatcccaaacctaactctaataagctgctccgcttatgggtcctaataaactg

SEQ ID NO: 2739 - DNA, 259 bp, Zea mays
  unsure at all n locations
  Clone ID: LIB143-016-Q1-E1-C1
ctgacatctcagttgctgaacgcctgaaccgcaagtcatccatgacctcttctattccgaagctgcttctcctcctcttctttctcagccatcgctctcccattgctcgcgcaggcgatgatggcagctacaaggttctgtccatgggctctccgagaactgactccgtctgtttccagtccanagcggttccttcgtcctccgcccggtgccgccacggtgcccttgcatcaccgtcacggcccatgctcgccgttgc

SEQ ID NO: 2740 - DNA, 347 bp, Zea mays
  Clone ID: LIB143-016-Q1-E1-C10
gcgcagcgcagggccagtggcgacctccagctccagctccagctccacacgcgggcgccaccaaggagctgagccgagcccggcactgtcggcggccatgtccgcgccgcgtcgccgcatggccactgcctccccgtcgctccgcttcctcggcctgctcaagcaacccgacgacgccagctcccagtcccacggcgtccaggagctggagctcgacgagcgcgacgtcgtctggtcctccggcagcgcgacctcctcgtcctcgacctctgcggcctcctcgccgtccccgatcgcgtcctcgaccgcgagcctcgtggaggcagatttccgccgcgtcccgccat

SEQ ID NO: 2741 - DNA, 240 bp, Zea mays
  Clone ID: LIB143-016-Q1-E1-C11
ctcgaagcttgcgttcttgtactagaggtcggcagcaagcggtggtagagcgagaggtcgagaagatgaagagcagcactctgttggcgattctagttctccaggccctttctgtccctgccggccttgccaaaaggacctccagggccaacaacaacaaaccattcctgttccggcaattgcacagctggtccggccgtgttgaactgcgacgaactcctcaacaagtgcgccgccaac

SEQ ID NO: 2742 - DNA, 199 bp, Zea mays
  Clone ID: LIB143-016-Q1-E1-C12
gatccaagcgtccagacgaagccgtggtgcctgtagacgacattggcagtatgaggaggtataacgagacgttgagcggatgccaaacaccactcggttggatatgcgacctcgcgagatccatcgagtcgctgacgacatagacatcggatcatcaggggttatcacgatgaatcagtgcatacgctgcgaatgcaga

SEQ ID NO: 2743 - DNA, 397 bp, Zea mays
  Clone ID: LIB143-016-Q1-E1-C2
cccacgcgtccgccacgcgtccgcggacgcgtgggcggctggctgccggagaaggccgtcacgttcgtcgacaaccacgacaccggctccacgcacaactcgtggccattcccctccgacaaggtcatgcagggctactcctatatcctcacgcacccaggaacaccatgcatcttctacgaccacgttttcgactggaacctgaagcatgagatcagcgcgctgtctgcagtgaggtcaatgaacgggatccatccggggagcgagctgaacatcctcgccgccgactgggatctctacgtcgccaagattgacgacaaggtcatcgtgaagatcgggtcacggtacgacgtctggaacctgattccctcagacgtccacgccgttgcgcatggca

SEQ ID NO: 2744 - DNA, 295 bp, Zea mays
  Clone ID: LIB143-016-Q1-E1-C3
agaggaatcagctgctgacgctcctccgatggcgggtcgcatggtctatccagatcatctgcgtcatctcgacacggcacgccgccaactacgagctgtcatttcaataatcggatgagcacctatcatgctacgcatcgcatggcaagagactggtacttagaacctgagcacacgtattggtggtacacatggttcgattagatatgatgaagagtatactcacggttcacatcatcgttgacagattgctaacgatatccgagaacctatcactgtacagaatccacacatt

SEQ ID NO: 2745 - DNA, 288 bp, Zea mays
  Clone ID: LIB143-016-Q1-E1-C5
attccaactggcgtagttgaaccgggggaagatattaatgttggagccataagagaagtaaaagaagagaccgggattgatgcagaatttgttgaagtgctggccttcaggcagagccacacagctttttttgataaaccagatctatttttcgtgtgcctgctacgaccactgtcatatgacatctacgaagcaagactcggacctataagcatgccagtggatggcagtacaggaccttgcagcacacccatttgtccagacacatgatcttgtgaactacatcct

SEQ ID NO: 2746 - DNA, 149 bp, Zea mays
  Clone ID: LIB143-016-Q1-E1-C7
aggggctccctcgtgaagcggatgcccttcttccgccgcagcaggtcgcgtcctcgctcaagggcggcgtcgtccaaagatggcctcatcgtcgtcggtgacggaaaagagagcgacggcggcagcgcagcagcggatccagcgccgcc

SEQ ID NO: 2747 - DNA, 431 bp, Zea mays
  Clone ID: LIB143-016-Q1-E1-C8
gacacagcagcccctcttgtaccagtaaaccgtgctgctatcccccgctagccgccgcgctgctgcggctcgcctccctcctccccagtccccgcgccccgccgccgccgccgccgcctcctctcgctccctccttttaccccgagcttaagctcgcgcgtacctgcctacctatccgtaagagaggaagaggggacaaggcccggtcggtcggtcggtcggggggctctcggatctcgccgctgcctccccgttcgttcgttgggatctcgcgccatggccgccgtcgcgccgcccccggcccccgcgccggcaccggttccggctcctgctcctgccaccgtccctgtcgcggattaaaccacggatctgctgcagaagctgtcgctcgactcgcagcccaagccggcggacgcaacacagcctgctgc

SEQ ID NO: 2748 - DNA, 359 bp, Zea mays
  unsure at all n locations
  Clone ID: LIB143-016-Q1-E1-C9
caggaatccgcggctgaggcgccggcgatggcggctcccatggtcgacgccgaatacctgcgccaggtcgacagggcgcgccgccacctccgcgccctcatctccaacaagggatgcgccccgatcatgctccgcctcgcatggcatgatgctggaacttatgacctgaagacaaaaactggtggtgcaaatggttcgattagatatgaagaagagtacacccatggttcaaatgctggtttaaagattgctatcgatctccttgagcctatcanagcaaagaatccanagataacatatgcagacctgtatcagccttgctgagtggtttcagtcgaagtgactgggggggcaactgt

SEQ ID NO: 2749 - DNA, 381 bp, Zea mays
  Clone ID: LIB143-016-Q1-E1-D11
atttcattttttaatcgtgccaaggtcgggctcaaacctgatggtttttttgttctgaaagaaaacaattcaagaaaagggtttgtgttagaataaggggaaaacaatggccctagattaaacccctaccttaaggaaccaattaaaaagtgttgaataaaaaaccctaatgttaaagacccaaagaggaatccccaaaggaacaatttccggccaaaatgtatccactggtaacaattcacccaaaaatccaaaatagtggaaagagaacacggcctagaaatacacctcgtaagatccgctcttgaaaaatgcccggtacaaggtgcccattgacctgctgggcctgtcgggccatgtatccccacgggattgcccaaa

SEQ ID NO: 2750 - DNA, 382 bp, Zea mays
  Clone ID: LIB143-016-Q1-E1-B12
gacaagcctcagcctagccaacgatgcacgaacaagacgcagtatggctagagagtcgggtgatgtatccaccgatttttaggagtgcgctcaggttacgctaattgacgcacatggggtttctcgctaggagcgaactagacgaagctcctaaagatacagatcctcgggacaggagtcagtatagtggtgctatagtattggcttaggtaggcttattcggtctgagccccttgtgggtgctgctcaagcagctcacgacgcgtgatgctcaaagacataggtagaacgagtaccatgtgcggcgtccacatcaaggactactggtacgtcatgttcggatctaaaggaaagatgatcaacgttactcaaacagtgggga

SEQ ID NO: 2751 - DNA, 412 bp, Zea mays
  unsure at all n locations
  Clone ID: LIB143-016-Q1-E1-D12
cttgtatagtgtttcctgatcaacctgaaaaacgtagggcatcagagttgttcaagacagctatagacacgattgagggtgtaaccatcagctccctggatgatgtacccactgaccctgtcaacagcttcttcaaatcaataagaaacaccctggattttgacttctcagatgacaatgaaggtagatggaaatctgatgaaccaccatcgttatatatcttcatcaacagcagcacgcgtgaccttgcttctatagagaagtatgtggaaaagttcgccacatctgttccagcccttctattcaatctcgaactagatacattgcgttctgacctgnggcttctcgggttccccccaaaagatctgcactaccggttcctttctcaattcaccccagtattttatatcag

SEQ ID NO: 2752 - DNA, 383 bp, Zea mays
  unsure at all n locations
  Clone ID: LIB143-034-Q1-E1-G4
tcccgggccagcntccgagtccaggttgctcccccttggatccttgtttgcttcctgctgcctggccttctctcctccccaaaatcaatccctcgccgagaagggagaaccagccaaatcttccacctcctccagttccagccccgtccccacagcagctcgcgtaacctcctccccatggctggaggcggcggctcaggcgcaggctcgtcgtccggcggctgcggaagggcggcagggagggcgactgggaatgcaggagctgcggcaaccgcaactacgcgttccgctcgctttgcaaccgctgcaagcatccgcgcatcctcgtgcgaggccaacaccccacgcgagtccaagtggctaccccggcgccggggactgga

SEQ ID NO: 2753 - DNA, 378 bp, Zea mays
  Clone ID: LIB143-034-Q1-E1-G5
acttctttggcctctcaggtaccgggaagacgacgctgtcgacggatcacaacaggcttctgatcggcgacgacgagcactgctggagcgagaatggcgtgtccaacatcgagggcggctgctatgccaagtgcatagacctgtcgcaggagaaagagcctgatatctggaacgccatcaagttcggagccgtgctggagaacgttgtcttcgatgagcatactcgtgaagttgactacgccgacaaatctgtcaccgagaacactcgggctgcctacccgatcgagtacatccccaacgccaagataccatgcgtcggcccacaccccaagaacgtgatcctgctggcgtgcgacgccttcggcgtgctccgccggt

SEQ ID NO: 2754 - DNA, 379 bp, Zea mays
  Clone ID: LIB143-034-Q1-E1-G6
ggagagctttgaggggaggggagctagctagctactgcctactggaggagggcttcctccgacgccggacatgggggaggtgaagcacctgtgcctggccaagttcaaggagggcgtcgtggtggacgacgtgctcaagggcatgaccgacctcgccgccgggatggacacggtcaagtctttcgagtggggccaggacgtgctgaaccaggagatgctgacgcagggcttcacgcacgtcttctcgctcaccttcgcatccgccgccgacctcgccgcctacatggcccacgacagccacaccgccttcgccgccaccttcatggccgccatcgacaaggtgctcgtcgtcgacttccccgtcgtcgtcgccaagcct

SEQ ID NO: 2755 - DNA, 399 bp, Zea mays
  Clone ID: LIB143-034-Q1-E1-G7
acacgcacatcagaggcagtcgaatcctttgccgtaacgtctcttgcggcgatagggcgctgacatgcagagtcggtctggatctggcggcccgaacattacggcagaggaaatgcttccacatcagagatatggtggctttagtctccttctagggagccttagtttttcttttaccaataatttcagatggcgctcagtgaagagatgtcacacatgagtctcaagaccgacaaggatgctgccgacgagatgagctcaacttcgtcgtacggaagagaaatgccctaaatacacgttgggtctttggggttaacaatagcttaactgtttgtgatttcagcgtgtcaccgttggcttgacaccttttcccctttaactccatcaccaatgtcctgt

SEQ ID NO: 2756 - DNA, 386 bp, Zea mays
  Clone ID: LIB143-034-Q1-E1-G8
ggtcggatcaaagtctgaagctagtggaattgccaaagctggagcaaagatggtcatggcagtttcctgtgctaaggttcctaaaattacaataattgttggtggaagttttggggctgggaattatggaatgtgcggacgtgcatatagcccaaactttttatttctttggccaactgctaggatatctgttatgggtggcatccaggcagctggagttctcgctcaaatagaagagaacaacaaaaggagacaaggagtggagtggagcaaggacgaggaagaagccttcaaagccaaagtcgtggaggcttacgacagagaaggaagcccgtactactccactgctaggctatgggacgacggggtcatcgaccctgctgaca

SEQ ID NO: 2757 - DNA, 367 bp, Zea mays
  Clone ID: LIB143-034-Q1-E1-H1
atccgcggctccacgcccaaaaccccaaattccctatccctatcccgcgcgccctgttcttcgtctatctctctcccgactcggaaggaaaccctaggcgccacgctagggttctcgaaccttcgctccccaccccccgattcggaagccctagcctggaaggttccgggaccttctggcgcgggaggatggcggtcgtggaccagtcgctgctgccccagatccatgccctcttctccgacccgcttcgcgtggtttcgtacaaatggctcagtcggaacttctctgtgtcatcaaatgatgccaagaggttgcttcaggactttgtcaacaaacatggaactgacctccaagtggattacagtgt

SEQ ID NO: 2758 - DNA, 396 bp, Zea mays
  Clone ID: LIB143-034-Q1-E1-H10
cccggtttctctccggttcgtgggagggccaaagcttcgaggaaggaaaaccctaccgctgtgggagtagcctccggcgatggctgcggcggcgatcctgccggagctggcgacgcaggtgctcatcccggtcgcggcggccgtgggcatcgcgttcgcggtggtgcagtgggtgctggtctccaaggtgcgggtcacccccgagcgccgcgcggacggcggggccgtgaagagcgggcccagcgactacctcatcgaggaggaggagggactcaacgaccacaacgtcgtcgtcaagtgcgccgagatccagaccgccatctctgaaggagctacatctttccttttcactgagtacaagtatgttggattaatcatgggcatctttgcaatccc

SEQ ID NO: 2759 - DNA, 428 bp, Zea mays
  unsure at all n locations
  Clone ID: LIB143-034-Q1-E1-H11
gcagaaacgagagggccggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaataactaccacagggccgacggtcagaacaccggaaacttccttacggaccgtcctttcgacaaggtcaacgctgctcctgncggtggctcttccctgngatacctgtttggtggcaactgatgcc

SEQ ID NO: 2760 - DNA, 349 bp, Zea mays
  Clone ID: LIB143-034-Q1-E1-H12
acaagactctagagtgaatcgtaggatctgttccacctgccatcctggaattgacaacaacttcttcacctacctggttgcatgcaacagatctgaaattctgaaatgctgtgactgtgactgtgaggtatgaaaaaacagtgtaaataacgcggttgcctccgtacatgtgtgacattttatacacgtgcaagaaagcatcggtgtccaccgttgtccgtgaaaaaaaacaaactgatgagaaaacacctgcagcaaaaacctgatagcagcagtcacattgcagcaaggggttaccacccaaaccaataactaccacaaaggacgacagtcagaacaccaggaaact

SEQ ID NO: 2761 - DNA, 371 bp, Zea mays
  Clone ID: LIB143-034-Q1-E1-H2
caataaccaacgacaagggccgtctctccaaggaggagatcgagaagatggttcaggacgctgagaagtacaagtctgaggatgaggagcacaagaagaaggtggaggccaagaactcgctggagaactactcctacaacatgcgcaacacgatcaaggacgagaagattgcgtccaagctgccggccgatgacaagaagaagatcgaggacgccatcgacgcggccatcagctggctggacgccaaccagctcgccgaggcggacgagttcgaggacaagatgaaggagctggagagcctctgcaaccccatcatcgccaagatgtaccagggcgcgggtgaagacatgggcggcgctggcggcatggac

SEQ ID NO: 2762 - DNA, 384 bp, Zea mays
  unsure at all n locations
  Clone ID: LIB143-034-Q1-E1-H3
ctcgcacgtggctgccctgctcatactgcttgccctcgccgtatcgtccacccgcaacgcacaggaggattccatggccgacacaccgggacgttggcgggcggcatcaaggacgtgccggggaacgagaacgaccttcacctccaggaactcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtgaagaagctctacgaagctaaggtctgggagaagccatgggagaacttcaaggagctgcaggaattcangcctgttgaagagggtgctaccgcctaa

SEQ ID NO: 2763 - DNA, 321 bp, Zea mays
  unsure at all n locations
  Clone ID: LIB143-034-Q1-E1-H4
aactttgcctcctaacaaatccaccaccgggtaagggtccctaagggtttgtggaagggcgatggccgcggctgatgtggagtaacgttgcctcctccgggggcctgcctgggccaacaacaacgaatccctggagaatgccttcgcctcctacggcgagattctcgactccaaggtcatcaccgaccgggagacggggaggtcncgcggcttcggcttcgttaccttctcctccgagaactccatgctcgacgctatcgagaacatgaacggcaaggagctcgacggccgtaacatcaccgttaaccaggcccagtcccg

SEQ ID NO: 2764 - DNA, 361 bp, Zea mays
  Clone ID: LIB143-034-Q1-E1-H5
aggcaaactggttggagggatcttatcagaaatgtagcggcggactactcatctctttggagagcggaaacagccttactttccaacttgataagcgaggttacaagtcacctgaagattatcctggtacctggaatctcatgtctcaggagaagaacatgtggttcaagaggagccatacatcgaggagttcgattcgatctaggtggcgtctcccagttgactttatggcaacaaggatgatccttagttcattttatatttatcttttatttttgtaaaacttccgctatgtaataagtactctgatattattgtgacatttagctctatacactctgttattatatatgttgtcttc

SEQ ID NO: 2765 - DNA, 414 bp, Zea mays
  Clone ID: LIB143-034-Q1-E1-H7
cccacgcgtccggccttcccggttacttgttcactaacaaggtcgggacggcatggcccttggagctgcgtaccatcactacctgcagctcgccggcgaccatggcaccgccacacacgcactgctcctcggcgtacttatcttcctcgtcatccgcctagtatccgcaaggcgaaccggcacaacctcagccaacaaacgtaagcagcaacagcggcttccgctcccgccttcgcccccgggcaagctgcccatcatcggccacctccacctcatcggcgccgagacccacatctcgatccgggacctggacgccaagcacgggcgcaacggcctgctgctcctccgcatcggcgccgtgcccaccctgttcgtgtcctcgcccagcgccgccgacgccgtcctgcgcaccca

SEQ ID NO: 2766 - DNA, 397 bp, Zea mays
  unsure at all n locations
  Clone ID: LIB143-034-Q1-E1-H8
ccaaatttgtggacattagcaaggaagatttggatttaggtgataacaatgaggaaagagagaaggagataaagcaggagttcagccaagcctgtgactggataaagaatcgcttgggtgacaaggttgcacgtgttgacatatctaatcgtctcaggtcatcgccatgtgttcttgttgcagcgaagtttggttggtcagccaatatggaaaggctgatgagagcacagtctatgggtgatacagcctctttggatttcatgcgttcgangaaagtttttganatanacccagagcatgagataatcaaggccttgaatgtggcatgcangaataaccctgatgatcctgaagccctaaaggctctggatgttctctttgaaactgctatgatttc

SEQ ID NO: 2767 - DNA, 395 bp, Zea mays
  Clone ID: LIB143-034-Q1-E1-G3
atacacggttgctcccccttggatccttgtttgcttcctgctgcctggccttctctcctccccaaaatcaatccctcgccgacaaaggagagccagccaaatcttccacctcctccatttccagccccgtccccacaccagctcgcgtaacctcctccccatggctggaggcggcggcgcaggcgcaggctcgtcgtccggcggcggcggaggggcggcagggagggcgactgggactgcggcagctgcggcaaccgcaactacgccttccgctcgctttgcaaccgctgcaagcatccgcgcctcctcgtcgaccccaacaccccgcgcgactccaagtggctaccccgcgccggggactggatctgccacgaaagaactgcaaaaagtgtggc

SEQ ID NO: 2768 - DNA, 325 bp, Zea mays
  Clone ID: LIB143-034-Q1-E1-F1
tacacacacgtctgcgcagcaacgaacacgaaccttggcagaacgaagctgaagtagttcgttgtgaacccagtatggcaaacgcgccgaggatcctggccctcggcctgctgctagcgctcctgtgcgctgccgccggcccggccgccgcgcagaactgcggctgccagcctaacttctgctgcagcaagttcggctactgcggcacgaccgacgactactgcggcgacgggtgccagtcgggcccgtgccgctcgggcggcggcggcggcggcggcggaggcggaggcagtggcggtgcgaacgtggctaacgtggtcagcga

SEQ ID NO: 2769 - DNA, 388 bp, Zea mays
  Clone ID: LIB143-034-Q1-E1-F11
agcgagcacatttgactgaccgccatagcaacgagaggaaacaaagcggcgaccgacgagccaagcaagcagcagagcatggacgcgggcgaggtgcggcactggaacgcggacgtcaacggcgtctccatccacgtcgccgagcggggccccgaggatgggcccgcggtgctcctaatccacggcttcccggaactctggctctcgtggcgccaccagatggccgcgctcgccgcccgcgggttccgcgcgctggctcccgatctccgcggctacggcgactcctccgtgccgtccgaccccgccgcctacaccatcttccacatcgttggcgacatcgtcgcgctccttgagcacctccaactcacaaatgtgttcgtggtggggc

SEQ ID NO: 2770 - DNA, 393 bp, Zea mays
  Clone ID: LIB143-034-Q1-E1-F2
gcgtccagtttataacaacacttctagtcactttagtaatggttatgatatggaagacaagcctgctgtggattgcactctttctagtaataattggtggagcagagctcgtatacttatcttccgcattctacaagttcactcaaggtggctacttgccattagcttttgcaggaattttgatgtttataatggccacatggcattatgtccatgttcatcgatacaactatgagctccagaacaaagtatcaagtaactatgtggcagaattgtccgcaaggagaaatctggccaggttgccaggaatacgctttttgtactctgagcttgtacaaggcatcccacccatacttcctcacttgatagaaagggtaccttccatccattcag

SEQ ID NO: 2771 - DNA, 392 bp, Zea mays
  Clone ID: LIB143-034-Q1-E1-F3
gcgaagtcggcgtaccaggtcgagggcgccgcgtccaccaacggccgaggcccctccacctgggacgcgttcgtgcacaccccaggaaacattgtatacaatcagacggcagatgtcgcagtggatcaatatcatcgctacagggaagatgtcgacctcatgaaaagtttgaattttgatgcctaccggttttcaatctcatggtccaggatcttcccagatggcgagggaagagtcaatccagaaggtgttgcctattacaacaatctgataaactacctgcttcggaaaggcattacaccgtacgccaatctttaccaattccgatctccctcttgcgcttcagaacaagtatggagggtggttaaaggccaagatggcgaaactgttca

SEQ ID NO: 2772 - DNA, 301 bp, Zea mays
  Clone ID: LIB143-034-Q1-E1-F4
cctcctcccttcgcctgtgatcatgtcctcttgctgaggccgcaagtgccggtgcggctccagctgctcctgcggcagcggatgcatcagctgctgtatgtaccctgacgtggagaccgccgccaccagcagcgtcaagaccacggtcctctccgcgccgaccaccagggccatctccggcggcttcgaggccgccaccgagggcggcggctgcgactgcaacacctgcatgtgcggcaccagctgcggctgctcctgctgcagctgcaactgatctggcccggcccggtcatggcgcacc

SEQ ID NO: 2773 - DNA, 413 bp, Zea mays
  Clone ID: LIB143-034-Q1-E1-F5
ggaggagacagagatttcagatttggtgcaaatcctattgaacatgagcacttcatcagactggtgtaccaggcatggtgctttgttatcgttctcatacatatcaatgcattctccatcaaaattgtgtcatttggcatcctttccatctctggtcgatcttttgaaaggttctctcaaagatgacaagttccctgttcgtgaagttgctacaagaactctgggaaagatactctgttttgagctgcagccagaagctggcaccttgcaacttgttcagctgcttatcttggccttgcgtgatgattcaagtgaagttaggacaagatctttgtcgtgtatcaaagctgctgcaaagacaaatcattcagctcttgctacacatcactctatattgggcccggcaattgctg

SEQ ID NO: 2774 - DNA, 382 bp, Zea mays
  Clone ID: LIB143-034-Q1-E1-F6
aaaaagcaacaaggcaacagcacaagcaagaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgaggcggccaccgagggcggcggctgcgactgcaacacctgcaagtgcggcaccagctgcggctgctcctgctgcagctgcaactgagctggcccggcccggcgatggcgcacgagagtcgagaggaggaggacgacgacgaggcgtataaatataat

SEQ ID NO: 2775 - DNA, 417 bp, Zea mays
  Clone ID: LIB143-034-Q1-E1-F7
acccttgcaagtatagtctcggcggctctagaagacgatgggcaaggacgacgtgatcgagagcggcgctggcggcggcgagttcgctgccaaggactacacggaccctcccccggcgccgctgatcgacgcggctgagctggggtcctggtcgctgtaccgcgccgtgatcgccgagttcatcgccacgctgctgttcctgtacatcacggtggccaccgtgatcgggtacaagcaccagacggacgcgtcggcgtcgggtgccgacgcggcgtgcggcggcgtgggggtgctgggcatcgcctgggccttcggcggcatgatcttcgtcctcgtctactgcaccgccggcatctcggggggccacatcaaccccgccgtcaccttcggcctcttcctggcgcgcaaggtctccct

SEQ ID NO: 2776 - DNA, 381 bp, Zea mays
  Clone ID: LIB143-034-Q1-E1-F8
acccacgcgtccgccagagtcttggtcagtaaaaccatcaagccctgcatttatccatgccacgcctggagttcagatggtcgcaggaggagatgatcttgggcaacaatacaacactcccgaatctgtgataaactacaggggcagtgacataatcatagttggccgtgggattataaaggcgagcgatcctatgaagaaggcgtgggagtaccgcttgcaagggtggcaggcatacaagaacagcttgctatgaaggaaggggggcgccatgagcatccccaagtataagggcgaatccagtcagtttggcgaaataagcgcatgcggaaaggttttcctgcagttgagtcaggacctaattgacatcagattcactgc

SEQ ID NO: 2777 - DNA, 428 bp, Zea mays
  Clone ID: LIB143-034-Q1-E1-F9
agcgccatcttaagaagcgccctactgagtttcgtgtggaccgtgtgctccagccgtttgaccctgccaaattcaatttcacaaaagttggccaggaagaggttctcttccaatttgagaatagtggtggtgatgacagctatttcctgaacaacgctccaatcattgctgttgatcgggctccaaatgttattgctatcaatgtaagcccaattgaatatggacatgtgcttctcattcctcgtgttctggaccgcctgcctcagaggattgatccagagagcttcttgcttgcactgcaaatggcagccgagggaggtagcccatacttcaggcttggttacaatagcttgggtgcgtttgccaccatcaatcacctccactttcaggcgtactacttgtcagtgccctttcccggttgaaaagga

SEQ ID NO: 2778 - DNA, 306 bp, Zea mays
  Clone ID: LIB143-034-Q1-E1-G1
cgcagctcctaactggtacacgactgtcctgagcgtcaatcaatttacaatatatgggacatcagtccgttctgggccgttgtcacgtgagattccctcaagtccatgtcgatttaggaaggatatcagatcacccaagtggactgcacacgtgatgcgatgtcgcagctccacgcggacagagtactcctcaccgcccatgactcatagtatgagttgccccactggtacttgcacagattgagcaccattgactgcgtctaaaacacgagctgggccacactgagcctgatcaatgaccgaaaa

SEQ ID NO: 2779 - DNA, 354 bp, Zea mays
  Clone ID: LIB143-034-Q1-E1-G10
tgttgcatcagaatgttaaagcatatctacggcgtggttttgcaagggaagtaactttgaattacaaagaagcacttcaagatttcaggcatgctttggcattggagccacagacggtattcacagtaaggatttgatgttgccataacagcacaagatggtaacgatgtcagaaccatccaggactatccaataaacctttggaactcctctcttagggttgacaatgcttcagacatgtcacccgtagcagcacaggaatattgcatctacaaaaatctattacctttctatccaacagtaaggcccggtcacaatctgcttcggcctgcttaaaacgttcctagatcgcga

SEQ ID NO: 2780 - DNA, 428 bp, Zea mays
  unsure at all n locations
  Clone ID: LIB143-034-Q1-E1-G11
caagcaatccgaattctctgcgatttctctagatctcgaccacccctactagttttggttcctcctttcgttcgagagagcgtttctagtggcaatggcgaagagcgagggtccggcgatcgggatcgacctcggcaccacctactcgtgcgtcggcgtgtggcagcacgaccgggtggagatcatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgacccgtcagtgcagagtgacatgaagctatggccgttcaaggtcattccagggcctggtgacanacccatgattgtagtcaactacaagg

SEQ ID NO: 2781 - DNA, 416 bp, Zea mays
  Clone ID: LIB143-034-Q1-E1-G12
acgcttcaaaagccatggccggtccgccgctcttgagcttccccttcttcttccttctctgcgtcgccctcgcctggagcgaggcgtatggagcaagcggtggctacgggctcggcgtcaactacggccgggtggcggacgacatcccttcgccgtggcgctccgtggagctgctccgcgcggcgggggccgggtcggtcaagatctacgacgccaacccgggcgtgctccgcgcgctggctgggacgcgctggcccgtctccatcatggtgccaaaccaaatcataccggacctcgccgcctctgctgccgcggcggaccggtgggtcgccgagaacctggtcccctactacccggcgacacgggtcaagttccttctcgtggggaacgagatcctctccgacttgtccatcgcg

SEQ ID NO: 2782 - DNA, 339 bp, Zea mays
  Clone ID: LIB143-034-Q1-E1-G2
tctacactgagtcgtactagtaccctgactgtccttagcttcaatcagtttacaatatatgggacatcagacgtttctgggcggtggtcacgtcagattacctcaagtccatgtcgagttgcgaaggacatcagttcacgcaagtagactgcgcacgtgacgcgaagtcgcagctgcaggcagacggagtggtcctcaaggcccataatccatcttgtgagtagacccagaagttgttcaacggattggtgcacgagtgtctgcgtcgaaagagggaccgtgggacagactgtggctgatcagtgacgggaaagactggctggtctgcctctaaagttc

SEQ ID NO: 2783 - DNA, 364 bp, Zea mays
  Clone ID: LIB143-034-Q1-E1-E9
cccacgcgtccgcccacgcgtccgcccacgcgtccgaatggttcttcttacgctgagcctgtgtaaatccaggttcgggattgagcaggagtacacccttctccagaaggacaccaagtggcctctcggttggccgctgggcggctaccctggccctcagggaccttactactgcgccgtcggagcggacaagtcctacgggcgggacatcgtggacgcgcactacaaggcctgcctctacgccggcatcgacatcagtggcatcaacggggaggtcatgccggggcagtgggagttccaggtcggccctgccgtcggcgtctcggccggcgaccagctctgggtggctcgctacattcttgag

SEQ ID NO: 2784 - DNA, 424 bp, Zea mays
  Clone ID: LIB143-034-Q1-E1-D11
acatgattgatgaggatgaaccaattttggagaaagccattggtactgaaattgaatggtaccctgggaagtgcttgacacaaaaggtgctaaaaaagaagccacggaagggttcaaagaacactaaacctatcacaaaaactgaagattgtgagagcttcttcaacttcttcagtccacctcaagtccctgatgatgatgaggaaattgatgaggatatagctgaacagttgcagaacgaaatggaacaagattatgatattggatctaccatcagagacaagattatcccacatgctgtctcgtggttcactggagaggctgctcaagatgaggagtttgaagttatggatggtgaggatgacgatgatgaagacaatgatgatgaagacgaagataacgaagatgatgatgatgatgatga

SEQ ID NO: 2785 - DNA, 412 bp, Zea mays
  Clone ID: LIB143-034-Q1-E1-D12
tccatccccttcccttcccttccttcgtgccccgccggctctccagcgcgccgtctctgcccagatccaggagatatgcctcgctatgatgatcgctatggaggcacgcgcttgtatgttggcagattggccccccgtactcgttctcgtgatttagaatatctcttcggcaaatatggaagaatacgagaagtggagttgaagcgcgactatgcatttattgagttcagtgaacatcgtgatgccgatgaagctcggtaccaactagatggcagggatgtcgatggaagtcgcattgttgttgagtttgctaaaggggtcccacgtggtccaggtggctcacgtgaatatatgggaagaggccctccaccaggcacaaggtcgttgttcaactgtgggaatggatggtcac

SEQ ID NO: 2786 - DNA, 414 bp, Zea mays
  unsure at all n locations
  Clone ID: LIB143-034-Q1-E1-D3
gttaagcgaaggcgaagcggagtagtggaagcagaggcggcagccatggccgtgatggagaagctcaagatctttgtcgttaaggagcccgtagtcgcggcctcctgcctcatcgctggattcggtctctttcttccagcagttgtccggccaatcctggattcatggcagaccgcggaacaagttcctccacctcttctaaatgatgtggttgcaggtgtcaccggcaagaaaaagtagtgaacttgcattgttttctcatgccaatgttgccccacattttcttccccgtgttttttctggcgaccagattggaaggcttttcccaagagtcacggtcttgaactctagatggtatccgcggnataatcattgtacctgaatcatatactgcaatgtggcagttttgaaaat

SEQ ID NO: 2787 - DNA, 326 bp, Zea mays
  Clone ID: LIB143-034-Q1-E1-D4
acccaaattacaatggaacaatgggctgaaatggctaatcctggtaaccaaatggcaaaagaaaataataacggcgggaatggaaccaattggaaaaggcaccatgaaattccccctgaagggttgggtaaccattggaacccttgatggagctaatgttgaaataagaaaggaggttggaaaaaataatttcttccttttcggtgccaaagccgatgaagttgctgggctgaggaaggatagagaaaatggtctgttcaaaccagacccacgttttgaagaagccaagcagtttataaggagtggcgcttttggcagctatgact

SEQ ID NO: 2788 - DNA, 411 bp, Zea mays
  Clone ID: LIB143-034-Q1-E1-D5
acacactgcaacagccaagtgcaagtgatcgagctcccccctcctcatcagtcgctaggcacagcgcacttgcaggatggcgcaggtctctaagacgcttctccttgtggccctggtgttcgtgtcgtcggcggcggtggagctgtgccgcgcgatcgacttcgacgagcgggacctggcgtcggacgaggcgctgtgggacctgtacgagcggtggcagacgcaccaccgggtgcaccggcaccacggcgagaagggccggcggttcgggacgttcaaggagaacgtgcgcttcatccacgcgcacaacaagcgcggcgaccggccctaccgcctccgcctgaaccggttcggcgacatggggcgggaggagttccggtccacgttcgccgactcgcgcatcaacgacct

SEQ ID NO: 2789 - DNA, 369 bp, Zea mays
  Clone ID: LIB143-034-Q1-E1-D6
ccgggccgacccacaagtcaaggaccatcctcgctaccctgcaggccggcactgcactgcactgcagtctacagaactcgtcagtcacagatcggtgcaggcggtctgcacctgcatcacctaaccaattcctcgattagtctgctgttgcgatttgcgaggcaggtcaggtactgacgtattgcatttgcatgcttagctagctgatagatgatctttgtttcgtctctgctttgctctgtgtatgtgtttactgcaggacaatttgtaattgcaaatcgtctcacaaattggtactgactgaaagatgatcttgtgtttcttcattctgtttgcacgaagctgcaatctttttgcagcagccactaa

SEQ ID NO: 2790 - DNA, 378 bp, Zea mays
  Clone ID: LIB143-034-Q1-E1-D7
aagcctactaccgctaacaactcagcagcaaataagcgcaggcggaagaaccagtacaggggaatccggcggcggccctggggcaagtgggcggccgagatcagagaccccagcaagggcgtccgcgtctggctcggcacatacagcaccgccgaggaggcggccagggcgtacgacgccgaggctcgcaggatacgcgggaagaaagccaaggtcaatttccgggacgaagcggcggcggcaggtgctcagaagccaccagccgcaactactccaactgcttgtgccagcgcagcgaggctagctcctccacctccaccgccgaagttccgtgctgacgaggttttcgggaacatggaccgtggcagcaacgatctg

SEQ ID NO: 2791 - DNA, 390 bp, Zea mays
  Clone ID: LIB143-034-Q1-E1-D8
accaagccaaagcaagttgctaggtcctttgaaccagcaactgaagcttcctcgtctcatcatcgagaccagtaagcaacatggcggctaatctcaagtgggctcctgttctagccctcctcgtcgtcgttgctgccatggttggcaccaccagcgccggcaacatcgcagtgtactggggccagaacggcaacgaaggcagcctggcggacgcctgcaactccgggctctacgcctacgtcaacatcgcgttcctcacaaccttcggcaacggacagaccccagttctcaacctcgccggacactgcgaccccggctccggcagctgcaccggccagagcagcgacatccagacctgccagtcgctgggcatcaaggtgctcctctcca

SEQ ID NO: 2792 - DNA, 402 bp, Zea mays
  Clone ID: LIB143-034-Q1-E1-D9
accacgcgtccggaatatatgaaggtgcacgagatgcgtctgagatcttccggtacatagaccatgtccgaacatatcctaccataatgtttggaggaattgagggctctcaagtctgcactgtggcctttcagcgggtgtgactgaaagctgaggcacacatagttcttggcctgacgtgtcacgttgggtccagaagaaatggataaaaaattttgtgcttcgcctgtgggactgttcctaccgtattaaggaacagtccaaactgtgtcttcttctgttgttagctcatctatccaggatggtcgtgtaattttagatggaccagactatgagacgaatcagtcctgtattgttgtcaccgtgaacatttccttgtatttccgttcctcttatacatac

SEQ ID NO: 2793 - DNA, 419 bp, Zea mays
  Clone ID: LIB143-034-Q1-E1-E10
gagacttccagccatcccttctacgctctccccgttcccgtgtcgtcctcccgacaaagagggagccgctagggtttagcggcttccgcttctgggcgagggcttacccgcgagggacggcgcgacgcggcggcacttgagctagggtttccctccgatcccgttcctttcccggcgaggcgatggacgaggcggcgattgacgacttgatccggcggctcctcgaggcccgcggcgggcgcaccccgcgcaacgcgcaggtgactgacgccgagatccggcgcctctgcgccaccgccaaggacgttttcctctcccagcccaacctcctggagctcgaggcccccattaagatatgcggggatgtccatggccagtattcagacctccttcgatttattgagtatggtggctatcca

SEQ ID NO: 2794 - DNA, 304 bp, Zea mays
  Clone ID: LIB143-034-Q1-E1-E11
ccccggttcccgtttccgtcctcccgacaaagagggaaccgctagggtttagcggcttcagcttctgggcgatggcttacccgcgggggacggcgctacccggcggcacttgagctagggtttccctccgatcccgttcctttcccggcgaggcgatgcacgaggctgcgattgacgacttgatccggcggctcatcgaggcccgcggctggcgcaccccgcgcaagccgcaggtgactgacgccgagatccggcgcctcagccgcaccgccacggacgttttcctctcgcagcccaagctcct

SEQ ID NO: 2795 - DNA, 396 bp, Zea mays
  Clone ID: LIB143-034-Q1-E1-E12
agctccttacagtaaagccacaatatggatttggtgagaagggtagaccagcagctggagaggaaggtgctgtgccgccaaatgcttcgctgctcattgaccttgagttgatttcatggaagactgtcacagaaattggggatgataagaaaatccttaagaaggttctcaaggagggagaaggttatgagcgtcccaacgagggtgctgttgttgaagtcaaaattatcggaaagcttcaggatggcgcggtgtttacaaagaaggggcatgacgaagagccatttaaattcaagaccgatgaagaggaagttattgccggtcttgatcgtgctgtgttgaacatgaagaagggcgaggttgctcttgtcacaattcctcctgaatatgcatttg

SEQ ID NO: 2796 - DNA, 382 bp, Zea mays
  unsure at all n locations
  Clone ID: LIB143-034-Q1-E1-E3
ccctagcccaaatcccccacctactcgccgccggcgccgtctcagcctcatccntctccgcaagccaggccgccgcgggtcccgggctctactccgagatcgggaagaaggccagagatctcctatataaggactaccacacggaccagaagttcacgctcaccacctacgccgccaacggagctgccattactgctgcaagcacgaggaaagatgaagctatctttaatgaaatccagagccagctgaagcacaacaatgtgactgtggatgtgaaagcaacttcagaatcaaatgtgataactacaatcacagttcatgagctgggcacaccaggcttgaaggcaattttatgcgttcctttcccgtaccagaaatctgc

SEQ ID NO: 2797 - DNA, 373 bp, Zea mays
  Clone ID: LIB143-034-Q1-E1-E5
acccgctgaagcttcaaggagcttctcgtctgagaccgagctaacgagctcaccggcgggcaggatgctggcggcgtccaccaaggtcggctctaggctggcctctcctcacgcctccttgtccgtcggtgctgcggcggcggcactggcgagctcccccgtgctgggctctgggatgctcccaggcgccgggttcggcgagacggggagtcaccacgcggcagacgcgccgccggcgctgccttgcagttcctcgggcgattcaagggaatattatcagtggaagagactggtgaatcaaacgcagtcaacgctacattggaggcaaagtgcctgctgcatttggccaccatgtgtttggtgcgggctgttc

SEQ ID NO: 2798 - DNA, 392 bp, Zea mays
  Clone ID: LIB143-034-Q1-E1-E6
agtcatctccaagtgcgtgcgccggacgccccctatcccgccggccctgtgtgtgttccccgctaccagctatggcgtcgccgttctccgtgccttcgcagatcatggacgaggaaaggcggttcgacgcggacgtggcggaggtggagtcctggtggggcacggagcggttccggctcagcaagcgccactacaccgcccgcgacgtggtcctccaccggagcacgctcaggcacagctacgcgtcgggggagatggccaagaagctgtggcgcacgctcaaggcgcaccaggccggcggcaccgcctcccgcaccttcgagcgcgctacgaccccgtccaggtcaccatgatggtcaaacacctggacaccatctacgtctccgggtggc

SEQ ID NO: 2799 - DNA, 361 bp, Zea mays
  Clone ID: LIB143-034-Q1-E1-E7
acgagccttggttcagagaaacagggcactgggtttagagcccttcggatctagtattgtcgttcaccggcggcgaccaggccaaaccctagaaccttgccaagatgaggtcgttgcgagcggcgcagaccctagtctcccgttcccttttctcagcgcgccatctaagcggcgcagcctcccccgccacggccgccgccgcgggcgcgcggtggtgtgcagcgccggcgccaccgccccgttcgccgcttccatcctcgagggtgatgcctgccggggttgccggcgcagtatccttctcccttaccttcgctactgtagcggcggcggaggccaaggccaaggagcgaccgcaaccgga

SEQ ID NO: 2800 - DNA, 290 bp, Zea mays
  Clone ID: LIB143-034-Q1-E1-E8
aaacgagccttggttcagagaaacagggcactgggtttagagcccttcggatctagtattgtcgttcaccggcggcgaccaggccaaaccctacaaccttgccaagatgaggtcgttgcgagcggcgcagaccctagtctcccgttcgcttttctcagcgcgccatctaagcggcgcagcctcccgcgccaccgccgccgccgcgggcgcgcggtggtgtgcagcgccggcgccagcgccccgttcgccgcttccatcctcgagggtgatgcctgccggggttgccggcg

SEQ ID NO: 2801 - DNA, 174 bp, Zea mays
  unsure at all n locations
  Clone ID: LIB143-034-Q1-E1-D10
acaccagccgccgtcatgtcgaagcgaggtangggaggttcggctgggaacaagttccgcatgtcactgggtctaccggtggcggccacggtgaactgcgcggacaacacgggcgcgaagaacctctacatcatctccgtcaanggaatcaagggccgcctcaaccgcctcccg

SEQ ID NO: 2802 - DNA, 365 bp, Zea mays
  Clone ID: LIB143-015-Q1-E1-H5
agaagaaggagcttgctgagactgattcagtttatgatactgagaaattggctgagagaattgctaagcttgccggtggtgttgctgttatcaaggttggagctgcaactgagactgagcttgaggaccgccaactaagaattgaggatgcaaaaaatgccacttttgcagctatagaggagggcattgttccaggaggtggtgcggcatatgtgcacctatctacggttgtccctaagatcaaagaagcaattgaggaccctgatgagcgtcttggcgctgatattattcaaaaggcattggtagcacctgcttcattgattgcacacaatgctggagtagagggtgaagtggttgtcgagaag

SEQ ID NO: 2803 - DNA, 403 bp, Zea mays
  Clone ID: LIB143-015-Q1-E1-H6
aagacggactcgacgtatgactctgagaagttggcagagagaattgcaaagctttctggtggagttgctgtggttaaggttggagcatcgaccgaggcagagctagaggaccgcaagctccgcatagaggacgcgaagaatgcgacttttgcagcaatagaggaaggtattgttccaggaggcggtgcagcatatgttcatctatcgacattcgtaccggctatcaaggagacgttggatgatcctgaggagcgcctaggtgctgatatcattcagaaggctttggtggcacctgcagcgctgatagcccataatgctggggtggaaggtgaggtgattgtggataaaatccgggaaagcgagtgggagttcggttacaacgccatggcgggcaaacaccaaa

SEQ ID NO: 2804 - DNA, 401 bp, Zea mays
  Clone ID: LIB143-015-Q1-E1-H7
aagggaagggatcgagagcgcggcggaggcgatggcgagcggagggaagggactcaacgcgactggggagttcttccggcggagggacgagtggaggaggcaccctatggcggggaaccagctgcgccacgccacacccgggctcggcatcgccatcgtcgccttcgggatctacctcgtcggcgaggccgcctacaaccgcctctaccgcccctccggcgacaaccaccactagatcgccggcaggatccgtgactcggtcaagaagctggagccaactttaccaatcactggtgctgttgatgtttttacagttttgagctcataaggtcagccatgaccatattgtaatctgtgaccaggtagacttgcccactggtccgtccaactattgtcttggg

SEQ ID NO: 2805 - DNA, 377 bp, Zea mays
  Clone ID: LIB143-015-Q1-E1-H8
gacgcgtgggtggggagtctggatctcaagcaaccagcccaagaactgttctgctccccagttgtatacgatcgaaggaaaaaaaaaggatcccaaaccctagcatctctcatggacgacggcgacggcggactgagcttcgacttcgagggcggcctcgactctgccccggcggccgggggccccgtgccgtcctccaccgaccctggcgcgggaggcggcgacgggccgggtatgcacgggcgcggccgacgtcgcgggagctaccgccagacggtgtgccgccactggcttcggggcctatgcatgaagggcgaggcgtgcgggttcctgcaccagttcgacaaggcccgcatgcccgtctgccgtttcttccg

SEQ ID NO: 2806 - DNA, 75 bp, Zea mays
  Clone ID: LIB143-016-Q1-E1-A1
tcgaaagtatacaactaaggcccacgttgaactttttggcgccggaatttccgcaatggggttcaaaaaccaaaa

SEQ ID NO: 2807 - DNA, 408 bp, Zea mays
  Clone ID: LIB143-016-Q1-E1-A11
agctactccgatccgtccggttcccagcacctgagcagctacgtatacctactagctacaacgggcctgccgcagatgcatgccagctaggcactagctcggcctccgggcggtcggccggcccacaatattgtccttgtccatctccgattctccataaatcctcgctcgcctgccaccagaaacgaccttctgcacgtacgcacggtggctgcaggccggccatgagacgacctcacgccgccgctaccgctctcgctgccctcctcctcgtcctgtgcctcgccgccgcgttgacccgccacggcagcggaatctgccagcaggcggggaggacgccgacgaggaagatgctgctggccatgacaagcttcgacgacgacgacgctgccgcctcggcctcgccat

SEQ ID NO: 2808 - DNA, 407 bp, Zea mays
  Clone ID: LIB143-016-Q1-E1-A12
ccgctgcgtaaacgaatccatcgccatggcgtctcgtctcgttgcggcggcggcctcctcctcctccctctcctcagcgtcccccctcgctcgcctaatctctcgccgcggccttgccggtgccgcagacggccatgggtctgcgaaggtgcccttgtggaaagatccgttgagcccgagcaagtggaaggaagagcactttgttctagcaagcctctcaatgtggggggttattttttatggtggttacaagctttttagtggaaagaaggaagccaagactgaggcggcatcaccacaggcataggtggcggagatggagttatacccgtatctgtggcctggcaacaatgttaaataaaaggaatgctttatgttgtgctttcaagttgataaattgtggcaac

SEQ ID NO: 2809 - DNA, 418 bp, Zea mays
  Clone ID: LIB143-016-Q1-E1-A2
gtggtcaatgagcagaggtatgtcccagatcacagatatgtgctccatgacattgaccatgacgccaaagaacatgcactgctgtacacagtgagacgctggcaattgcttatggtctgattagcactccagcacgaactcgacttcgtatcattaacaacctgatgatatgtggtgactgctacaacgccatcaagatcatgtcaacgatcattgggacagagcttattgtgatggacaacaagacgttccaccacttcaaagatggaaagtgctcctgtggagattattggtgataatggattaaagccgctcttcgatcctttatatggagctgctggcatccatggtttcagttgataataagcaatatgaacgtatccaatgggtgttgctagtattttgtcatccctaaata

SEQ ID NO: 2810 - DNA, 341 bp, Zea mays
  Clone ID: LIB143-016-Q1-E1-A3
tctgtttatacagctggtccgtttcgtgacgtcacgcgagaagagaaccccgtggcccctggccgcgacggagcggtcagaagcagcagcggccggcgcggtttccgtttcctggttggcccgagaattccgattcctctcctgatttgtgtacatatagttgcctggaagccccgtcgctgtccccgcgctctctgtctcctcacgcttggctgttcgccgcggcgccaccgtcagaggcagctgctaatcgcgcgtccggtggccgccttgcagcggcggaacgtctcttgttgtgcaatcctgcaaccgattgtctcggcctgcccgcggtgaggccg

SEQ ID NO: 2811 - DNA, 346 bp, Zea mays
  Clone ID: LIB143-016-Q1-E1-A4
gcacccgatcgctcccttctgtccgcccaggccgcagccgaggcagaggccgtggccgtggccgtggccggcctgcagcgcctcccgcttgacgacggcgggcttgatgaggtccagctcgtcctcctcctcctcgccgtcgtcctcatgctggcacggcgggctgatgcagacgtccatgttgaggtcggggcacctgggcgccttgacggccgccgtctcctcggccttgatcggcgcctgcgctgctgtttctgccgcggctgcgacggctgtgttggggctgggctggaacgatatggtggtcgcggcgccccccgcgacgcggcggtgcgtgaccgggtcg

SEQ ID NO: 2812 - DNA, 402 bp, Zea mays
  Clone ID: LIB143-016-Q1-E1-A5
tccaggcaccacacctcttcctcctcttcctcctcctagcacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcgaggcggccaccgagggcggcggctgcgactgcaacacctgcaactgcggcaccagctgcggctgctcctgctgcagctgcaactgagccggcccgcccggcccggcgatggcgcacgagagtccagaggacgacgacgacgaggcgtataaatataatagcagcgtctaaat

SEQ ID NO: 2813 - DNA, 428 bp, Zea mays
  unsure at all n locations
  Clone ID: LIB143-016-Q1-E1-A6
cttatgaacgagagccattacagctgcagcgtgctatacgaatgcagttgccctgagctggaggagcttgtgaaggtctgcagagacaacggagcactgggagcacgtctgacaggagctgggtggggtggctgcgcggttgctctggtcaaggagcccatcgtccctcagttcattctgaaactaaaggaaatgtactacaaatcaaggattgacaggggagtaatcaagcagggcgatgtgggcctgtacgtgttcgcatccaagccgtcgagcggcgcggccatactgaggttgtaggcaggcaggaaggcagaggcagccgctattcttttcacgagtgtggtggccctgtaaaacatggaataaagttgccatgaacaccgaacccttgtantagcgttgaattatctcaagacacacgcgca

SEQ ID NO: 2814 - DNA, 381 bp, Zea mays
  Clone ID: LIB143-016-Q1-E1-A9
aacatcgaggaagagatgcgcaggaagcaagctcacgctgcccaggaggcgtacgaggaggacgacgagatgccgggcggagcccagagagtgcagtgcgcgcaacagtaagcagactatcatcaaggcaattgggaggggtggtgcccttaaagcatgggagtgatctctggttttgctgtcgccgagctgggaaataggaagctgaatcgacctcacaagcggggaatgtatccttttttgctgcaacataaaaaatgctacccaggcatagctgggtaccttttaacttctgtttgtgggatttgctagagtgatggtttcgatatatagggggacttgaatgtctggaatgctacggtataacgcacatttgggtgc

SEQ ID NO: 2815 - DNA, 411 bp, Zea mays
  unsure at all n locations
  Clone ID: LIB143-016-Q1-E1-B11
gattattcgcatcgttgcttaggtgctctaacaagccgcaattggttagagattggatcaagttccaggctttttaaaaagtgccttccagcttacttaattgactcgcatgggctttctcgctataaacgaactaaacgaagcgcctaaagagagagatccgcgggacaccagtcaataaagtaaaaagagagtattctcttatgtagtcttattccttcccacccccttgtgggtgctgctcaagcagctcaggaggcgccaaccccacaaccacaggtagaaggagttccaggtgcggcgtccagatcagggactagtggcccgtcctgttcggatgtanaggaaagatgaaaaacttttctcaaacagtggggaaagggccccatacgtcanagccagataaagaat

SEQ ID NO: 2816 - DNA, 385 bp, Zea mays
  Clone ID: LIB143-015-Q1-E1-H4
gggtcgagtcaggcgtccactggcgcgtttgtggagagtatggttaccgattttatcaaacccacccatggtggagggggcatggggatgagaatagtcgaaaggcctgatgaatttgtggattctgtactgagcgctcaacgggaagctgcagcatcgtttggtgtaaacacactattgattgagaagtatattactcaaccaagacacgtagaagtccaggtatttggcgaccaacatggaaatgcgatatacctttatgagagagactgcagtctacagagaaggcatcagaagatcatcgaggaagctccagctccaaatgtgccagctgagtttcggtctcatattggtggagctgctgtatctgcagcaaaggcagttg

SEQ ID NO: 2817 - DNA, 400 bp, Zea mays
  Clone ID: LIB143-015-Q1-E1-G11
aaagaagctgaagaaggtgctagaggtgtacgaggcacgcctgaccaagtgcaagtaccttgctggagacttcctcagcctcgccgacctgatccatgtgtctgtcactctctgcctgttcgctacgccctacgcatctgtgctcgacgcctacccgcatgtgaaggcctggtggtctggtctgatggagaggccgtctgtccagaaggtcgctgccctgatgaagccatctgcttgaaatggttgccctgtcaatcggtgaatggaatagtccaagtctgttctgggttgtttgcttgttcaatgatgtgtcttctatgacgacagttgactgcctatgtgtgagcatgcatgcttgtaacgagacattgaattgttcggaaatgagcattcctgtgct

SEQ ID NO: 2818 - DNA, 415 bp, Zea mays
  Clone ID: LIB143-015-Q1-E1-G12
acgacgagaaaggacaatctgcggcggacctacccgaagtcggaggcagggcaaaaggcccgatcccccctccccgccggttgccgcgctcgtgccacggtgcgctagccccgtcgacgccggcggacagcgtgcactatgggttgctcctcctccgtgccagctagaaatactggagggctgaacactatcagcaacgatagctctccagacgccagttcaaaggacttgcgtgctaagttggtattgctgggagactcaggtgttgggaaaagttgcattgttcttcgttttgttcgtggtcagtttgatcctacttccaaggtaactgttggcgcatcctttttatcacaaacattggcattggaggattcaacaatagtgaagtttgaaatttgggatactgctgggcaag

SEQ ID NO: 2819 - DNA, 318 bp, Zea mays
  Clone ID: LIB143-015-Q1-E1-G2
cgattccccctccccgccggttgccgcgctcgtgccacggtgcgctagccccgtcgacgccggcggacagcgtgcactatgggttgctcctcctccgtgccagctagaaatactggagggctgaacactatcagcaacgatagctctccagacgccagttcaaaggacttgcgtgctaagttggtattgctgggagactcaggtgttgggaaaagttgcattgttcttcgttttgttcgtggtcagtttgatcctacttccaaggtaactgttggcgcatcctttttatcacaaacattggcattggaggattcaaca

SEQ ID NO: 2820 - DNA, 403 bp, Zea mays
  Clone ID: LIB143-015-Q1-E1-G3
aatgaagtgtgggcaacatgttgacagcagatggggacatcaagggatgagacttgggttactttagccaccctgtgaggagacacacgtcccagtatgcgatttcatgcctgctcctgcagtgccgtgacataacagtttcagctgatggaccgacgtgatacgtaagactgctctatgtctatgtactattgcaactttttgcactttcgtaggctgcactattgccatagccctgtgattgttgttgtgttgcaatgctgctttgcaaatgggcgtcttgttcaatatctactccctagatactaagttgcaagatgctttgacttcgcgagattagtagctttgactatgcacttagatatacaccacgtcaagagtaatcagtaatgtatctgggaaa

SEQ ID NO: 2821 - DNA, 392 bp, Zea mays
  Clone ID: LIB143-015-Q1-E1-G4
acagcctacaaagccactcccaaacccccgcttccagaaccttctcgaagctccccgccgcctcctccactcgcaccgatggcgaaggaaccaatgcgcgtgctcgtcactggcgccgcaggacaaattggatatgccctggttcccatgattgctaggggtgttatgcttggtgcagaccagcctgttattctgcacatgcttgacattccgccagcagctgaagcccttaatggtgttaagatggagttggttgatgctgcgtttcctcttctgaagggagttgttgctacaactgatgttgtggaagcctgcactggggtcaatgtggccgtcatggttggtggattccccaggaaggagggaatggaaaggaaagatgttatgtccaa

SEQ ID NO: 2822 - DNA, 333 bp, Zea mays
  Clone ID: LIB143-015-Q1-E1-G5
acaagactggaccgatttggagaagagttagaagaatcaacataaaggatgtataaatatacctgggattgctgcctcgtatgataagatagcagcaggagcttagttgtattttgcctcattcataggttgggtctttcctttgcccgattgacatcagaaagaaaaaaagttattcgatgtcagttatgagccatgagcacgtcgtttgttgctgcaagcctgcagctgaaagaggttcattgtttccgatgctaacatgtaacacctgccatttagtacggagcagtacccagcttgttagttgattattgttttacacttttgaggaag

SEQ ID NO: 2823 - DNA, 388 bp, Zea mays
  Clone ID: LIB143-015-Q1-E1-G6
acggtcgcttcaccactccactcgccgcaggccgccgggcgccgccgaggggatcggagcaagatgttcttccacatcgtgctggagcggaacatgcagctgcacccacgacacttcgggccgcacctccgcgacaagctcgtttccaagctcatcatggacgtcaagggcacctgcagcgggcggcacgggttcgttgtggcgatcacgggtgtggaggacatcggcaaggggctcagccgggaaggcacgggatacgtcaccttcaccgtcaagtaccagtgcgttgtctttagacccttcaagggcgagatcctcgaagctgtcgtcagcatggtgaacaagatgggcttctttgcggaggctgggccggtgcagatcctcgtgt

SEQ ID NO: 2824 - DNA, 354 bp, Zea mays
  Clone ID: LIB143-015-Q1-E1-G7
agcctgcagtcacgaattcacgttctccatgtccagccatggcggtgtcgatatagctcaacaatgagtatcgatatctcgtgctggtgctggaggcctatgtcttcatcaacctttggatgggcttccacgtcagcatcgtttgcagaatcaacaaggtgttctacgccaccatgtacgccatcgactcggacaatagtgacatcaagctcttcaactgacatcagaaggggcatcagaactcactacactggatacctgttttcatcgtcatactgcaactggtcggtctgcaacacctgaccatcgacatcggtcaggccgtcatctacatcgtcacgaggttcgtctact

SEQ ID NO: 2825 - DNA, 366 bp, Zea mays
  unsure at all n locations
  Clone ID: LIB143-015-Q1-E1-G8
aaattagcttcatcatgctatggggtgacagacagatatcaactgtcatcaataggttcaagtaggtaactttgtggcatttttatttcaccaggatcgtgagagtacatgcggtaacagtgcgctttagtaccagaaggacctcatgggtgtagtcaggaaaacgctatcccactagatnactgtgctacatttttccgcagacatcagttttcgcacgttaccggatatgatcgttgaattccatacagctgcgcaatctttactagactcaaataatccatctgctcatcagcgacaggtcttacatcgtttgagaaaagatattattcctctacttgcggtttcagaaccacctttgccaac

SEQ ID NO: 2826 - DNA, 402 bp, Zea mays
  unsure at all n locations
  Clone ID: LIB143-015-Q1-E1-G9
acgttgtgctctctctctttattcgttccccgcctcaccccgagccagccgtctcgctagggtttctccgccgccgccgccgccgccatgcctcgccgcagctcaggaaggtctgccccacgcccagctccccgtgctgctccagtgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgatgctgtattaggtcnccggaccattcagcatgagactgttgcctcagaagctgctgctgctgcccctgcccctccagtgatgaatgctgatgcctgcagcatccattct

SEQ ID NO: 2827 - DNA, 359 bp, Zea mays
  Clone ID: LIB143-015-Q1-E1-H1
acagatatgcagaaattgaaggaaagcgattctttgaagagttggacagagatggtgatggccaagtcactctagaagatctcgaaattgcaacgaggaagaggcggttaccaaggaggtatgctcgagaattgttccgccgtacaagaagcaacttcttttcgaaatcaattgggtggaagcaatttttatccttgatggaacagaaggaagcaaccattctccgagcgtataccacgttgtgtttgagcaagtctggaacacttcacaaaagtcaaattttgacttctttgaaaggtgctggacttccagccaatgaagataatgccgctgccatgctacgttatctaaatgctgat

SEQ ID NO: 2828 - DNA, 441 bp, Zea mays
  Clone ID: LIB143-015-Q1-E1-H10
ggtcaggggtccacggatccgtcaagtctagatgtcctgatttagtgatttatactcatgaatatgtcagccaagctgtaagaaacctaatttctcataagaacaaagtgtatagaacttacaagtgtaatatgaatgaactcatgcatgagttttcttctgccatattaggaatcgaatattgcaagtcagcttgatctacattttgtttgggctcatggtatcttgtagaataattctgttcatttctgaaataaagggtttatcgctcttttgaattttatttcagttctctcgagttatagtttgtattgccctgcattttaacaacgatcttgtttaccagttatgttctggttgttttttattacattgttattgatgtgtaggtttgatgggaagcctgaagatgttctaaatccaaagaaaaagcagctggac

SEQ ID NO: 2829 - DNA, 411 bp, Zea mays
  Clone ID: LIB143-015-Q1-E1-H11
gggagacgttcaagctgtggaggctgaacgacacgacgttcaacttccgcacgtccggcaaccagttcgtgggcatcggcgccagcgacggcatcatcgtcgcgacggccaccacgccgggcctgccggagacgttccagatagtgcggtgccccttcgacaagaacagggtccggatcaaggcggcgaacggctacttcgtccaggcgatagcgaccggcgaagtgatagcggactacggcgagcccacgcggtggtccgacttcgacgcgtcagtgttcctgatgaccaccgtcgggcagcagctgcaaggggagtaccagctctgcaacggctacggcgccgacaaggccgcgccgctgctgagggagcattggagcacgtacatagtggaggacgacttcaagttct

SEQ ID NO: 2830 - DNA, 427 bp, Zea mays
  unsure at all n locations
  Clone ID: LIB143-015-Q1-E1-H12
acggacccatccacattggtagactgcagtcaattggggtagattcaatcgagaagtttcgtggaaaattaccatcattacgagctgagctaaaagatgacaataaattccgtgatatatacaactttgcattcacttgggcaagggaaaagggtcaaaagtctctctcactggagacttctattggaatgtggcagttgctatttgctgaaaggaactggcctcttctggatcattggtgtcagtttttacaggtcagacacaataaagccatatctagagacacatggtcccagctgctggaatttgtgaagacgaccgatccacagttatccaactacgacgacgaaggtgcctggccctacctcatagacgaatttgtggaatatctgactgagaacggactcgtccagcgtanaagatgaac

SEQ ID NO: 2831 - DNA, 179 bp, Zea mays
  Clone ID: LIB143-015-Q1-E1-H2
cccgtccggtcgcctgcagtgcaagtccggccggcagtcgggctgactgcctgacgtcggtacggggcgacggcgatctatatctgtcgatgggctactggtgggaccgcgtcgtgctgccggtgccgcgggcctggctcagcgtcgcgtctcgcttcggcgttcgccagaccgggctg

SEQ ID NO: 2832 - DNA, 398 bp, Zea mays
  Clone ID: LIB143-015-Q1-E1-H3
gactcgctcccactcccagacgaccggccgccagcgccgccgcgttgatgggcgccgcaccggaggagcgcctcgacgtcctcaacgccgctggggacaagatcggcgtctccaagcccaggtcggaggtgcacagggacggcgactatcaccgggcggtgcacgtgtggatctacagcgagagcaccggggagctgctgctgcagcgccgcgctgactgcaaggactcgtggcctggacagtgggacatctccagcgccggtcacatctccgccggcgaatcctcgctcttctcggcacagagggagcttgaggaagaactaggcatcaaccttccagtcgatgctttcgagcttatatttgtatttcttcaggaatgcgttatcaacaatgggaca

SEQ ID NO: 2833 - DNA, 395 bp, Zea mays
  Clone ID: LIB143-015-Q1-E1-G10
accagcagcagaagagcagccccagagctccagcaataatggccgagaagggcgtgaaggtgttggggatgtgggcgagccccatggtgatcagggtggagtgggcgctgaggctgaagggcgtcgagtacgagtacgtcgacgaggacctcgccaacaagagcgccgacctgctccgccacaacccggtgaccaagaaggtgcccgtgctcgtccacgacggcaagccggtcgcggagtccaccatcatcgtggagtacatcgacgaggtctggaagggcggctaccccatcatgccgggcgacccctacgagcgcgcccaggcgaggttctgggccaggttcgcggaagacaagtgcaacgctgctctgtacccgatcttcaccgcgaccggc

SEQ ID NO: 2834 - DNA, 379 bp, Zea mays
  Clone ID: LIB143-015-Q1-E1-E3
accacgcgtccggcaacgccagggcgcaaccatgggtcagcagcagcaagggccggcggccaggcggatggccacgctcgcctcccacctgcgccatccctccgtctctcaccctcagatggaagatgttcccctcttgaggggatccaattgccgtgcaaaaggtgcggcgccaggcttcaaagtcgcgatcttgggtgcagcaggtgggattgggcagccacttgcgctattgatgaagatgaaccctcttgtttcggtgctccatctatactatgtcgtcaacgcacctggtgtcacagccgacatcagccacatgaacactggtgctgtggtacgtggcttcttgggccagccacagttggaaaatgccctggct

SEQ ID NO: 2835 - DNA, 366 bp, Zea mays
  Clone ID: LIB143-015-Q1-E1-E4
aatttattgcgtgaaattattgggtatcatgctgatatcatctgtcttcaggaggtacaagtagaccactttgaagattttttttcacctgagcttgacagacatggatatcaggcgctttacaagagaaggacaacagaggtgtattctggaaatcctatggccatagatggctgtgctacttttttccgcatagacaagttttcgcatgttaaaaaatacgaggttgagttcaataaggctgcacaatccttaacagatgcgattattccttctgctcagaaaagactggctttaaatcgtttgattaaagacaacattgcactaattgcggttttagagccaaatttgctaatcatggagctg

SEQ ID NO: 2836 - DNA, 370 bp, Zea mays
  Clone ID: LIB143-015-Q1-E1-E5
acatgattccaacggtaggcttcaatatgcggaaagtcaccaagggaaatgtcacgattaagctttgggatcttggtgggcagcggagattccgcactatgtgggagcgctattgccgtggagtttctgctattctgtatgttgtggacgctgctgaccgagatagtgtcccaatcgcgaaaagtgagttgcatgatctgctgacgaaacagtctttggctgggattcccttgcttgtccttggcaacaaaattgacaagtcagaagcgctttcgaagcaggccttggttgatcaacttggactggaattgataaaggaccgggaggtttgttgctacatgatctcgtgtaaggattctgtgaacataga

SEQ ID NO: 2837 - DNA, 380 bp, Zea mays
  Clone ID: LIB143-015-Q1-E1-E6
cgcagagacaggcgtcttcgtactcgcctatctccgcgactcaaagctttccccaattcccccccttctcccatttctcaccaccgccgccgctccccccgttcaacaacaccatgagggagtgcatctcgatccacatcggccaggctggtatccaggtcggaaacgcgtgctgggagctgtactgcctcgagcatggcattcaggctgatggccagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctaccgccagctcttccatcct

SEQ ID NO: 2838 - DNA, 355 bp, Zea mays
  Clone ID: LIB143-015-Q1-E1-E7
ctcttttccccaaggcaaccaaaccatctcgattctcgactcgtggggaagtttcgctctcgccggcgtcgacggcctagggttcgaggaacgtccgtccgtccgtccggggaaggagcggtacggaggcggagatgatcgaggtggtgctcaacgaccgcctggggaagaatgtgcgggtcaagtgcaacgaggacgacaccatcggcgacctcaagaagctggtggcggcgcagacggggacacgccccgagaagatccgcatccacaactggtacaacatctacaaggaccacatcaccctcaaggactacgaggtccacgacggcatgggcctcgagctctactacgactg

SEQ ID NO: 2839 - DNA, 387 bp, Zea mays
  Clone ID: LIB143-015-Q1-E1-E8
cgagaaagagatcgttgtacagttcattgattcttctttgccgagtgttacattaggtttgcaagctttcccgagtgctttgcgccacccagtagtgatgtacaatacccatagtaaattgacgtcacattataaaccagttcagtaatgataacagaagtttcaacaccttaacagcaacatactgcagccgagagccaagtgcctaaacagcataacataaatctagcgccagtaacaaactcggcaataactagcagcaaccataactcctcaacctttcatagctttcgaaataaacaaaaggtaatattttcgagaagcataattcgtcagattcggccaatctccaaatcaagagcttaatcttcctcctcagcctcctcg

SEQ ID NO: 2840 - DNA, 343 bp, Zea mays
  Clone ID: LIB143-015-Q1-E1-E9
acgccgtctccgctcaagtgaggttcggagctcagagccttgcgatatctcggctgcgcgcgcgcaagatggctgacccagaattggaagctatcacgaagagaaggatggaataactaatggcaaaacacggtggcggtggggcaaatcaacaaaatgcatgccaacagaaagctcatgaagacgcgaaacatgaagctgaggaacgccgacagatgatgcttgctcagatattatcttctgaagccagagaaaggatctcccgcatagctttggtcaaacctgacatagcaagaagggtggaggatgttctgctgacagctgctcatactggtggaatatc

SEQ ID NO: 2841 - DNA, 414 bp, Zea mays
  Clone ID: LIB143-015-Q1-E1-F10
agtctgctcaagaagtacttgacaaagttgctcaagagactccgaattttggaacagaacaggataaggcccattgtccgtttcatctcaagacaggggcttgtcgctttggattgcgctgcagcagagttcacttttaccctgataaatcaatcacattgctaatgaaaaacatgtataacggtccaggccttgctttggagcaagatgaagggcttgaggtttgttagaggaaattctctaatgcataactttgtatccttaaactactgtttatttacgtttaaggatgctcaattttggtttcatgggcagtgccattttaagttgtgatagtttaatactaaagcaagctcatgtcaaaataacaagtattccactttaagcttgtaagcctttataagaagacatgag

SEQ ID NO: 2842 - DNA, 405 bp, Zea mays
  Clone ID: LIB143-015-Q1-E1-F11
agagcaatcggcggcgatgggcggcggcggcgcacatggcggcaccacctacaagggctacaccatcccgcacaacaagcgctggcacaccgtcgccggcaagggcctctgcgccgtgatgtggttctgggttttctacagggctaagcaggatggtgctacgctcttgggtttgcgtcatccttgggagggacatgatgaccactctcatggtcatggacacgggcatgaggcatcatcatcgtcatcttcacattaagttccttactggctgcggacgatgtttggcatgttccaacaactaaagtttgagttaataaattctatcaccctgcatgggactcatgttgtttgcaactggtttagcacgaactggtcttgttactattgtgctaatgtatttga

SEQ ID NO: 2843 - DNA, 376 bp, Zea mays
  Clone ID: LIB143-015-Q1-E1-F3
actgcaacagccaagtgcaagtgatcgagctcccccctcctcatcagtcgctaggcacagcgcacttgcaggatggcgcaggtctctaagacgcttctccttgtggccctggtgttcgtgtcgtcggcggcggtggagctgtgccgcgcgatcgacttcgacgagcgggacctggcgtcggacgaggcgctgtgggacctgtacgagcggtggcagacgcaccaccgggtgcaccggcaccacggcgagaagggccggcggttcgggacgttcaaggagaacgtgcgcttcatccacgcgcacaacaagcgcggcgaccggccctaccgcctccgcctgaaccggttcggcgacatggggcgggaggagttccggt

SEQ ID NO: 2844 - DNA, 378 bp, Zea mays
  Clone ID: LIB143-015-Q1-E1-F4
acctagagcagccaagaaaagcacatacccgagtcgccgaaacaacaacaatcccaatcccccctcgtcactcaaaactcgaccaacaatgtcgctgattcgccgtggaagcgcattcgaccccttctcccttgacctctgggaccccttccagggctttcccttcggctctggaagcagcagcagcagcagcctgttcccctcgttcggaggcaccaccagctctgagacggccgccttcgccggcgctcgcgtcgactggaaggagacgccggaggcgcacgtgttcaagaccgacgtgccggggctgaagaaggaggacgtgaaggtggagctggaggacggcaacgtgctccagatcagcggcgaacgcaacaa

SEQ ID NO: 2845 - DNA, 378 bp, Zea mays
  Clone ID: LIB143-015-Q1-E1-F5
aggcgcgcagcagcagcagcaacgtcttcgacccgctgtcgctggacttctgggcgtcgttcgccgacccgttcggcgtcgtccggccgctggcggagcagtgccccgtcctcaccaacgtgcgcgtcgactggaaggagacccccgaggcgcacgtgttcagggccgaccttccgggcgtcaggaaggaggctgccaaggtcgaggtggaggacggcaacgtgctcgtcatcagcggcgagcgcgccagggaggaggaggaggccggcaaggacgaggcgtggcgctggcgcctcgccgagcgcagcagcggcaggttcaagaggcggttccgcctgccgcgcggcgccaggctggaccaggttcacgcgtccatgg

SEQ ID NO: 2846 - DNA, 402 bp, Zea mays
  Clone ID: LIB143-015-Q1-E1-F6
agcgggcgccaacgccacgctcttcgaggtggcgcacggcatgtccccgtggagcttgacgaacaacgacgccctgtacaacaagaccttgaacgacgggtgcgcggcggacagcaacttcgccatggacacgctcctgagagagccccgggccgctggtatagtccgcgggctcggctcgctcgtcgacgtctgcggcggccacggtgccgctgcgatggccatcgctaaggccttcccacacatccggtgcagcgtgttggacctcgagcaagtagtcatcggggcagctgctgatggcacggtgaagttcatcgccggcgacatgttcgagtctatcccgggtgcagattgtgtcctgcttaaataggttctgcattgctgggaacgacaaagcaacgt

SEQ ID NO: 2847 - DNA, 300 bp, Zea mays
  Clone ID: LIB143-015-Q1-E1-F7
acatccaccgcctccgccgccgacaacagcgtagtgtagtgtaattccggagagggttggggagagtaatagtgatccgcaatgtcaactgaggaggctgttgtggctgaggtcccggtgaccgaggtgccagcggatgtcccggctgaccaggtggccgaagcgcccaaggcgaataaggcgcccaaggagaataaggcgcctaaggacaagaatctttccgcggcgaatatcccagcggcgcaacctccctacgctgagattattgtacaggcgatcgctgccctcaaggagaggaag

SEQ ID NO: 2848 - DNA, 359 bp, Zea mays
  Clone ID: LIB143-015-Q1-E1-F8
gagagagagaatccacacggagagagacaatcgagagatatggcacactgttttggtgacgtcatggacaattataagctatatacactgccaaggtatatcgggaagaagaagactcgagaagaccgggcacgagaggcctcgtatctcagtaatgagaatgagaagtacaagaaagctggagactatgtgaacatgctgaaagactggtacggcaatggagcgtcgacgctgtgcgtgatctacaaccagacgggcagaaccctgcggtacctctaccagaaggactggctaggctagcctgggccgacgcgctacccgacggatatctggaacggacagtgggcgtccttcctcca

SEQ ID NO: 2849 - DNA, 66 bp, Zea mays
  Clone ID: LIB143-015-Q1-E1-F9
acgaagtcacactcctgacgctctgtggttgcatgtcatctccagctcttgtctatgacgcgcagg

SEQ ID NO: 2850 - DNA, 424 bp, Zea mays
  Clone ID: LIB143-015-Q1-E1-G1
aaactaccagatttcggttccccacaatgagattgataaagttgataaaggtggtctggataaaatgacacttattgaggttggccccaggttctgtttgaatccaatcaaaatatttggtggtagttttggtggtcctacatggtatgagaacccatactacatttcccccaatcagatccgtgcactagagaagaggcagaaggcaggcaaatatgccaagaaggtgaaggccaaggtgaggcggaagatgcacgagatggagaacacgctggagcctgatgagtttgctgagctctggaaaggggagtaactggtctttgatcgaccctgttaaagtcgtgaagcaccagcaactccttccaccaagcgcggattttgtttaccagtgtggcaattcccactgtccaaggtgttgcaattt

SEQ ID NO: 2851 - DNA, 401 bp, Zea mays
  Clone ID: LIB143-015-Q1-E1-E2
agacgacgattcatccatcttaaagcaagcagagacatggagtcgtcgccgctgctgcagctgccggcggcacgcgtggaggctctgagcctcagcggcctctccgccatcccgcccgagtacgtccgccccgccgacgagcgagccggcctcggggatgccttcgacctggcgcgcacccatgccaacgaccacaccgcgccgaggatccccgtcgtcgacatctccccgttcctcgacagcagcagccagcagcagcagcgggacgaatgcgtggaggccgtgcgtgccgccgccgccgactggggcgtcatgcacatcgccggccacggcatccccgccgagctcatggaccgcctgcgcgccgcaggaaccgccttcttcggcctccccgttcagga

SEQ ID NO: 2852 - DNA, 378 bp, Zea mays
  Clone ID: LIB143-034-Q1-E1-B11
acttctccaggaaagggttcgtactcatggcgccgccgcagccaaagtcgggcctcttcgttggcatcaacaagggtcatgtcgtcaccaagcgcgagctgcctccccgcccgtgccaccgcaaggggaaatcaacgaagagggtgtctatggtcaggggcctgatcagagaggttgctgggtttgctccttatgagaagcgtatcactgagcttctgaaggttggcaaggacaagcgtgccctgaagcttgctaagagaaagcttggaactcacaagagggcaaagaagaagagagaggagatggcgggcgtcctcaggaagatgaggtcggctggtacgcacactgacaaaaagaaatagagagcatttcaagttc

SEQ ID NO: 2853 - DNA, 422 bp, Zea mays
  Clone ID: LIB143-034-Q1-E1-B12
agaaagagctgctggcatgtactcagctttcccatacccgtttggcaaggttgtcattgaccttcaaaacccacgggcccaggataccctttacggtgtcaaattgtacccaaggaaagggttcgattggacggctgctaagtccttcgggtacctcttctttgggtacttcacgctgctctacttcacattctacggcatgatggccgtggggctgacacctaactaccacatcgccgcgatcgtctcctcggcattctacgccatctggaacctcttctccgggttcatcatcccccgaccgaaagtgccgatctggtggaggtggtactgctggatatgccccgtggcgtggacgctgtacgggctggtggtgtcacagttcggtgacgtcatgactccgatggacgacggaagggccg

SEQ ID NO: 2854 - DNA, 370 bp, Zea mays
  Clone ID: LIB143-034-Q1-E1-B2
aggcgaagtcatgcctggacagtgggagttccaagtcgggccgtccgttgggatctctgccggcgacgagatatgggtcgcccgctacattctcgagaggatcactgagatggccgggatcgttctctccctcgacccgaagccgatcaagggtgactggaacggcgccggcgctcacaccaactacagcaccaagtcgatgagggaggccggtggctacgaggtgatcaaggaggcgatcgagaagctggggaggaggcacagggagcacatcgccgcgtacggcgagggcaacgagcgccgcctcacgggccgccacgagaccgccgacatcaacaccttcaaatggggcgtggcgaaccgcggcgcg

SEQ ID NO: 2855 - DNA, 305 bp, Zea mays
  Clone ID: LIB143-034-Q1-E1-B3
gcccacgcgtcaaatccccagcagcagggatggagacaggacaatcaccggagcacgccgagtgcggtgcagcagcgctgcgagtctgcagcgatcaggacatcacgggacatgacctacgatctgcgactgcgaagcggagatggcaacacccgagatgcaacatctgctgcagggcttcaaacgggtacagcatgaccctccggcagggatcagtggtgctcggcaccacaacaacatgatactctgaccagcagtgatatacggacatgctcatcagcagtcagatcaaggcacatgcaggc

SEQ ID NO: 2856 - DNA, 221 bp, Zea mays
  Clone ID: LIB143-034-Q1-E1-B4
gcttgttgtgttttttttttgtttttttttttctggtgggtttgttgttggttttgttttttgttgttttgtttggttgttttgtttttgtttttttttttttttgtttttttttgtttttttttttttttttttttttttttttttttgtttgtttttgtttttttttgttttttggttttttttttgtttttttgtgtttttgttttgttgttttttgt

SEQ ID NO: 2857 - DNA, 421 bp, Zea mays
  Clone ID: LIB143-034-Q1-E1-B5
aatccccatcaccggcaccggcatcaacccggcgaggagcctgggagccgcggtcatctacaacaaggacaaggcctgggacgaccaatggatcttctgggtgggcccactgattggcgccgccatcgccgccgcctaccaccagtacgtgctgagggccagcgccaccaagctcgggtcctaccggagcaacgcctaagttccggccggccgcccgcccgaacgcgccaggagctgggcaccgttacaattctgttcctccacatgacgccctgttccgtttccgtgtggccaggactccgcttgcttcctgctgttttctacttcggaccaaagtgtgacgtatcgttgctttctgtacatgtatgtaggaatgcatcatgtaacgagaatttggaatacaattgcgtgaatttttagc

SEQ ID NO: 2858 - DNA, 419 bp, Zea mays
  Clone ID: LIB143-034-Q1-E1-B7
acaatgttgaggctgatgtcttgaacaaagagctttcattagacaaagcagtagagaaaaacgaggagaaaggaaatgatgtcgccccacaggacctgaaatcatcagctgagaagtcggcaagcccaaatggctgttaaattttttttttggttagctcggccattgacagtggtatggggcgggaacctgaggctgggggttgtttgaggaaatcctgagatcccattgagcttgtttcttgcccttgttttctgtagttcataggagcttgaggattagttagttgcttgtgtgtttgggtgataggtgaggtcagtgtcctggcatggcaggtatttaggaatagaaggacgattaactgggttttacaatggtggttcatgggtttgaggttgtgtttccatctatttgccttt

SEQ ID NO: 2859 - DNA, 378 bp, Zea mays
  Clone ID: LIB143-034-Q1-E1-B8
acgtcaagaagatcaccagcaacaccaagcaactactcgtacgcggaaagagaaacccagaagccggtcttgttggattattccgttcgtcagttccgtccggagcggcggagcaaaaatgagtgacaacctgatggacaaggttagcgcctttggtgagcgcttgaagatcaccgggacagaagtcagcaaaaagatgactgccggaatgagctccatgagtttcaagatgaaggagttgttccaggggcagactccagctgacaagattgttgagggtgccacctcagaggatctggacgggcctgactggaactcaaacttggagatttgcgacatgatcaacacagagaaggttgacagtgtggaactcatccg

SEQ ID NO: 2860 - DNA, 377 bp, Zea mays
  Clone ID: LIB143-034-Q1-E1-B9
gtccagttgtgatatcattggcacccttgatggagctaatgttgaaataagagaggaggttggagaagataatttcttccttttcggtgccaaagccgatgaagttgctgggctgaggaaggatagagaaaatggtctgttcaaaccagacccacgttttgaagaagccaagcagtttataaggagtggcgcttttggcagctatgactatgaacctctcttggattcccttgaagggaattctggatttgggcgtggtgattatttccttgttggctatgacttcccaagctacatcgatgcacaggatcgggtggatgcagcctacaaggataagaagaagtggaccaagatgtccatcttgaacacagctggga

SEQ ID NO: 2861 - DNA, 265 bp, Zea mays
  Clone ID: LIB143-034-Q1-E1-C1
cgggtcgagcccgcgtccacaagcatctgaagagaagagtacgagaaatggtccaacaatgcattatttcactcagcagggaggccaaaccctaaagataagtgaattggattattacacttgttaccggactgcaagtgggtacagtatcacctttggtctcactacaattgcaaaaaacaaaggtcaacccagtgtcatatctgtttcttcaaacatagtgagtagatctgtcctggcatcaaaatgatcagctggccgacca

SEQ ID NO: 2862 - DNA, 217 bp, Zea mays
  Clone ID: LIB143-034-Q1-E1-C10
aggaaagttaacgaacagtgtagtaactgttcagctttgtgtttattcagttgttttgctgcttgaggttattcgtttctaggtgggggttggaatccttttcgccataaacctctcagtggcataaataagatggtttgcataagagtacttcatggataccgtaagggctactactgaaagagaaatgtttaagcagcatggtatgtgagcaact

SEQ ID NO: 2863 - DNA, 385 bp, Zea mays
  unsure at all n locations
  Clone ID: LIB143-034-Q1-E1-C11
acgcaagcgaccccagtaatggcgaccaaggcgctatccgtctcctcgctcacctccacggcctttgcctccttttccttgccgcggccccgcaggccttcaccttcgcctcccctcctccgccttctcggccctcgcccccgcgcctccactctctccgccgccgctcccggcgacgaggacggcgtcgacaccgtggagcagctcctccacccacgcccgcctgagacctcagcccccgccggatcccgcggccggatcgaccgcctcatgaagctccagcgccgcgccgacggcgacgccgtgcccgggggccggaggaggtggttcccttacctggacgcgttccggcccgcggncgggggcgcggagctgtccagcgggg

SEQ ID NO: 2864 - DNA, 421 bp, Zea mays
  Clone ID: LIB143-034-Q1-E1-C12
agaaatccatccccgtgcaaaaacagataagggacggcacgcgacgcaactatcctcgagagagagagagagagagaggaagcccgtcgttctggaagtttccacgctccgcgcgtccgccccctggtctgagtggtctccgctccaatggcgccctcactcctcgccgccatgtccacctcgcccttcctagccagcagcggcagcagccgcaggccgctaggcgctgcccacacccgacgggctggactgcgcgtggccgcgcttaagtacgaccctgccaaggtggcgccgcagaacgaccgggttctcgtccgtcttgagcagattcctgagaaatctgctggcggtgtgttgctaccaaaatctgctgttaagtttgagagatatctgatgggtgagattctatcgatcggtgctg

SEQ ID NO: 2865 - DNA, 420 bp, Zea mays
  Clone ID: LIB143-034-Q1-E1-C2
agaagaaaaaaaaaagagctactatacagcaatggccggaggagacgacctgaagctgctgggcctgtgggcgagcccgtacgtgctgcgggtgaagctcgcgctcagcctcaagggcctgagctacgagtacgtggaggaggatctgagggacaagagcgagctcctgctcaagtccaaccccgtccaccagaaggtccccgtgctgatccacgacggcaagcccgtctgcgagtcgcagatcatcctgcagtacatcgacgaggctttcgccggcaccggcccgtccctcctcgccgccgacccctacgagcgcgccgtcgctcgcttctgggccgcctacatcgacgacaagatgctgcccgccctggaacagtcgaggatgggccaagacggaggaggaaagggccgaggggaaaa

SEQ ID NO: 2866 - DNA, 98 bp, Zea mays
  Clone ID: LIB143-034-Q1-E1-C3
agataaaaggaaagttaacgaacaatgtgacaaaaggtcagctttgagtttaatcaattgtattgcggcttgaggttaatcggttcaaggtgggggtt

SEQ ID NO: 2867 - DNA, 255 bp, Zea mays
  Clone ID: LIB143-034-Q1-E1-C4
atggacaagatcaaggcggagataaaaaacggcgtgctaaaagtgggtcgtgccgaaaggtaaaggagcagcagcccaaagacgtgttccaagtcaacgtcgagtagatgtttccaaatagaagcaagtgccggtacgggatggaggattggagcctggaggggcactgccaaactaagattcctctctctcaatctgatctggattctggaatcagatttctctttctttcatttttctcgtccatcttctatc

SEQ ID NO: 2868 - DNA, 398 bp, Zea mays
  Clone ID: LIB143-034-Q1-E1-C5
acacggcgagaagggccggcggttcgggacgttcaaggagaacgtgcgcttcatccacgcgcacaacaagcgcggcgaccggccctaccgcctccgcctgaaccggttcggcgacatggggcgggaggagttccggtccacgttcgccgactcccgcatcaacgacctccggcggcaggattcccccgcggcgcgggccggggccgtgccggggttcatgtacgactccgccgccgacccgccgcggtccgtggactggcggcaggagggcgcggtgacgggcgtgaaggaccagggccactgcggaagctgctgggccttctcgacggtggtggccgtggagggcatcaacgccatccggacgggcagcctggcgtcgctgtcggagcacgagctga

SEQ ID NO: 2869 - DNA, 136 bp, Zea mays
  Clone ID: LIB143-034-Q1-E1-D1
aggctcggagaagcatatcaagacgcaacatgatctcctgcggtcacacggctgtatgagcgacagcagatgatgcgtgcgaagatcgcgacacctgagaatgtctacgctttgtctcgctgaaactccggatcat

SEQ ID NO: 2870 - DNA, 422 bp, Zea mays
  Clone ID: LIB143-034-Q1-E1-B10
acccacgcgtccgcccacgcgtccgcccacgcgtccgtgtttttgtgcatgtccgagaacggttgctcgacttcttcatgaatgaggtgatagacattagtggatcatgcagggttgagggtgcttcatataactaaatctagcatggcttcctaagaaaagatggaatggccacaccagtgtcgagacttgatttcatatatatttagttaggcacaacgatagcgcaaacagttgattaccaaatttgtcaattagtattttagtttggatatagagtacgcttatgcatgagctatttcacaatgtttatttatgagatatataatggtaatttagaatgatatcatcctactttcatatatttgatggacttcacatatgcatctagatttttctccaagtttcagcatgtagtacat

SEQ ID NO: 2871 - DNA, 256 bp, Zea mays
  Clone ID: LIB143-033-Q1-E1-H11
ggtcgatacacgcctctaaactgagtcatattatgagaggccgcattattatttgttttttcactcttgtagttctattatctttatctagactagctctatgtctattcaaaatcaaacaactcggtcaagtttacaacatgcatcagatcgtcgcacatagatacagctgcagtccagtctccatgcgtagtcgttatcgcggacccgtttgtcgaggcaactgcgggtctggatgcagccgtgccctcggaag

SEQ ID NO: 2872 - DNA, 291 bp, Zea mays
  Clone ID: LIB143-033-Q1-E1-H2
acttaacactctctcactctctcactctctggcgactggcatggtgcagcaacagcaccacacaatctacatcttgcagttcacgaatggcgagacggagcaggaagtggcatgcaaagtgtcgcatcccaagggcgtctggcggcgggtcatgtactactaccaggactacggcagcagctgcggtggcaatagcggcaagacggtgcaacatacggcgctcagcgtacggcgcttcttggacatgctcctgctctccttcctctgcatggggacactgttcgtggcgcc

SEQ ID NO: 2873 - DNA, 334 bp, Zea mays
  Clone ID: LIB143-033-Q1-E1-H3
agttcaagatctcgaccggccgccctttattatttctatctttaagtcataacacaaaccgcgccaagcttacttagcttgggtttgagcacagccacctactaacagtactggagtgtgtgtgtatgcactaacaacagtacatgggtaaaaagcaccaacacgcacgcacatacacacatgggtacacaagtcacggcaagtacacagtgcacacaggccggccggaaccgactgggacagtgcagctcataagcaccacaatgtccgcgccagagccggctccggccgcaccatcatggcctgctgtggataccggagcaccggcaccgcg

SEQ ID NO: 2874 - DNA, 369 bp, Zea mays
  Clone ID: LIB143-033-Q1-E1-H5
aaattattgccctttcagttcgccatcggtagccgagcaccatgagctccacaggcggcgacgatggcgccaagaagtcttggccggaagtggacgggctcagcctgcaagaagccaagagggtgatcctgtgcgacaagcccgacgccgacatcatcgtgctgcccgtcggcacgccggtgaccacggatttccgccccaaccgcgttcgcatcttcgtcgacaccgtcgcggaggctaccccacatcggctgagaatcaaatctataacatgaacaactcggacatgtcatgcgtgcatgtccgtcgccgactaatggatgtgtgtgcttcggtccaataaattgctaatacaaataatggcatcgt

SEQ ID NO: 2875 - DNA, 376 bp, Zea mays
  Clone ID: LIB143-033-Q1-E1-H6
aaactaattaccctcggtgccctccctctcggcggcggcggcgcaagtcaccttcatctccggcgcggcacatggcaggcggcacggttgcacatgctaccctcaatggccccatcgtggtgaaggagatcttcaatggtctgaccctgggtctgatcgctggaggtatctcaaaaatccaccactgttaccaacatatgaaagctatatgcttctacgacatgcttgataagggccagatcgtcgtcggccaggagtaattcccacgtgtcacctcacaagtttatttttccagttgtttttgacaactcactctggacaatacgacaccttgaatactattgagatttggcatgaaactcatcataaccatttg

SEQ ID NO: 2876 - DNA, 347 bp, Zea mays
  Clone ID: LIB143-033-Q1-E1-H7
acacgagagtgcccatgacggacatgcggatgcgcgccgacccggccacgggctaccccggccggacgtaccggttctaccgcggcccgacagtgttcaacttcggctacggcctcagctactccaagtactcccaccgcttcgccacgaagccgcctcccacgagcaacgtcgccggcctgaaggcggtggaggcaacggcgggcggcgtggcgagctacgacgtggaggcgatcgggtccgagacgtgcgaccggctcaagttccccgcggtggtgcgggtgcagaaccacgggcccatggacgggaagcactcggtgctggtgttcatgcgctgggccaacgcg

SEQ ID NO: 2877 - DNA, 357 bp, Zea mays
  unsure at all n locations
  Clone ID: LIB143-033-Q1-E1-H8
atctagacataatctggttacaggtcaagtacgagggtgtgatcctcaacaaggcccaagccaacacctcctaagcctaagcgtcaccataagatattagaccctcttggtctcttctagtgcttcgagttaatggagtatatctggcggtgggatttgtattagaagaaaaccggatgcattatcatttttgcctgtactggtcctactggagttagttggatccatgtttttgtgtgtcgaatacattgatgttattactgttctacctcgacagcagtctgggctattctttgttctgttattgaatcgtgagatctcggncgcaatggcagtgcaatttgtacaccgtttctg

SEQ ID NO: 2878 - DNA, 379 bp, Zea mays
  Clone ID: LIB143-033-Q1-E1-H9
taaagtgagtcgtgttaccgcaggcgccgccaccaccaccaccacccaggcgccaccggcatccgagaaggcagccgccgccgagcccgtcaaggacgagctgtgagcatccaaggtgtggacggctgtggctgcgtaagcatgggaggaaaacctggcgctaacgtgcctccaacgcctagtttttgcgggaccagagggagagagagagagggacggagttagagagagaggggatctgcgacgtgttttgctctgcggcggcatgtctgtgtatcccattgaggttatgtacacaattacaccgcggtcggtgggtgttttttagttaattatcaaaagtgacagtagaaaggaacagattgtgatgagggtgaat

SEQ ID NO: 2879 - DNA, 404 bp, Zea mays
  Clone ID: LIB143-034-Q1-E1-A10
agcctgccctgtcctgccttgttaagcaacacagcgagacatcacgagagctagagagagatggcggccacggtttcctccttcccggtggtgaacatggagaagctggagacagaggagagggccacggccatggaggtcatccgcgacggctgcgagaactggggcttcttcgagctgctgaaccacggcatctcgcacgagctgatggacgaggtggagcggctgaccaaggcgcactacgccaccttccgggaggccaagttccaggagttcgcggcgcggacgctggaggccggcgagaagggcgccgacgtcaaggacgtggactgggagagcaccttcttcgtccgccacctcccggcctccaaactcgccgacctccccgacgtcgacgaccgcta

SEQ ID NO: 2880 - DNA, 413 bp, Zea mays
  unsure at all n locations
  Clone ID: LIB143-034-Q1-E1-A12
acggaactgactagaactagtacgtagatccaacactcgggacgaaattaaaagagacgacgcacatcaaccagcaggcatcgcgcggtcaccaccatggcggcgcaggagggcggcatgaggctggtgtcgcacccgatcgcggcgcacgacgggcggctgccgcggcagtacacggcggaggggcaaggcgccaagaaggacatgtcgccgccgctggagtggtacggcgtgcccgagggcgcgcggtcgctggcgctgctggtgcaggacatcgacgccgaccccagcgtgccgtggacgcactgggtggtggccaacatcccgcccgccaccaggggcctccccgangggttctccggcgccgcggggcccgggggccggggcnggcccgcaacaactcggcggcctgc

SEQ ID NO: 2881 - DNA, 377 bp, Zea mays
  Clone ID: LIB143-034-Q1-E1-A3
gcgccaaagggacggcacctggtgtgcttgaaaaccatgacgaggggagacgttacgccatgcatggccctaagaagctttgtgcacgacaagactcctgagatcatgcctgcagttaacaagttcttcactgaccctaagtgaagcatgttgattggcatactactactactacttgctactggggattttacactttgctggcaactcaatatgttggggacatccatgacctctaaaagtactttgagcgcttggtgatgacttggtatatgtatgatggtggatgagtttgatcgtccatgcttgatgttcatattcatctgtcatctggatttgccgcacttcagtgataaaattgtcatttggatactggg

SEQ ID NO: 2882 - DNA, 405 bp, Zea mays
  Clone ID: LIB143-034-Q1-E1-A6
cccacgcgtccgacgtgccaaacccccaacgccatcctctataaacggcttcctcgcgggctccccctccccatcgccgccctccgatccttcatggccgctgccacagccgccgccgccgccgccgcgctcgcctccccggcggccctctccacatcgctggcgcgccgcggcctcgtcagcttcgcccccgcgctccgccccggccctgaccgcagctctcgcgccgtctccctcctcggtgtgcgaactcatgttgcggctgttgatcaagccattgtaaaaggtgatacgaagttggaaggtcctgtggttgttgttactggtgcttccagggggattggaaaagccactgcattggctcttggaaaagcaggctgcaaggtcttggtgaattatgctcga

SEQ ID NO: 2883 - DNA, 424 bp, Zea mays
  Clone ID: LIB143-034-Q1-E1-A7
acccacgcgtccgatcgtgaacccgccgccgacgcagcagcaggagacgcgccaaggagagcccgcaaggaggcgactatgagggccaagtggaagaagaagcgcatgaggaggctgaagaggaagcgccgaaagatgaggcagagatccaagtaggctgatggggattgtggatggtggtgtcggcatagttgtgttacgtttcttcgatgcgtgagttcatggagagatgtcacatcctagttcgtcgtcaccgtttgccatgggtccaatggctcgtcttggaaacctgcacttcagtaggccatctatcgtggtttctagctatatccagagttttgtgctaagacaaatcagtcagtcgttttgtgaacctattatgatggagctttatttgctgctaatatcgacctacctggttaag

SEQ ID NO: 2884 - DNA, 411 bp, Zea mays
  Clone ID: LIB143-034-Q1-E1-A8
cgggtcccgccggtagcccaccatctcctcgccgctgcctctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagccaaaccaataactaccacagggctgatggtcagaacactggcaacttccttacggaccgtccttcaaccaaggtccacgctgctcctggcggtggctcttccctgggctacctgttcggtggcaactgatgcccgtgctggtgcgctcaccaaagttatcctcccctgcctgctg

SEQ ID NO: 2885 - DNA, 431 bp, Zea mays
  Clone ID: LIB143-034-Q1-E1-A9
acggacgcgtgggtagagaggaagaacagctcgtccgagaccatgaagagcagcccacacctggtgctgatcctgtgcctccaggccgctctggtcatgggcgtcttcgccgctttggctaaagaaaatgccctggttgagagcaaggccatcgacatcaacccggggcagctcaagtgctgcaccaactgcaacttctccttctcggggctctacacctgcgacgacgtcaaaaaggactgcgaccccgtctgcaagaagtgcgtcgtcgccgtgcacgcctcctactcgggcaacaacaagttcaggtgcaccgacaccttcctcggcatgtgcggccccaagtgctagctagagaggaagaacgcgcgctgctgctagctgctatagcttcgttccttcggcggccggccggccgccggccggtgcat

SEQ ID NO: 2886 - DNA, 309 bp, Zea mays
  Clone ID: LIB143-034-Q1-E1-B1
gcccgcgtccaccacaatctgccgcctcttcctctgcgctgcgctaacaacgattcccgattccatggccgcgaccgccatgattaggattaccactttacgttgccgccacgacccgctctcctcccttccccgcaccacgtcggccgcctgctcctgtacccttccgcctcgatgtcgccaatgcagactgctccctccccattcttctggctgttccccttcctcctccatctttccgcgccgggtccgggtccgcccagcagcagcactgaagcgcatcggtggcggcaacaccagcttcatggg

SEQ ID NO: 2887 - DNA, 351 bp, Zea mays
  Clone ID: LIB143-033-Q1-E1-H10
ggccgacccacgagtccacggtcgcgtgggctgccactgcagcgtgctcctgtccgcgattctctacacctgtcaccgtctgtcgatccatggcgaagggaacggcacaggcatcttcgctacccacccaccaacttaccctcatgggtgtcctatccgtttccgttctcctcccgctgctcttgccgtcggcagctactgtagctgtagcgtctcctgcggggggctggaagcagttggcggtcggaaaggacgagggaagactggtcccggatggggatgctggtgaacgcgggttagtggtcgagaatgagttcgcgggtggcttcggcgccctcaacagcatgctgc

SEQ ID NO: 2888 - DNA, 403 bp, Zea mays
  Clone ID: LIB143-033-Q1-E1-E9
cgcccgggccgacacacgactctacactgaggtcgcatcacccagatcaccgtgtgtttcgacatggacgcgaacggcatcctcaacgtgtcagcggaggacaagaccaccggacagaagaataagatcacgatcaccaacgataagggacggctaagtaaggaggagatcgagaagatggtgcaggaggcagagaagtacaaagccgaggacgaggaacaccagaagaaggtgaacgccaagaacacgctcgagaactatgcctacaatatgcgcaacaccatcagagacgacaagatcgcctccaagctaccggtggacgacaagaaaaagatcgatgacgccgtcgagggggccatcaattggctcgacaacaaccagctcgccgaggttgatgagtttg

SEQ ID NO: 2889 - DNA, 359 bp, Zea mays
  Clone ID: LIB143-033-Q1-E1-F2
aaagcaatctcaagtgaatcaaaccgccagacttcgcagtcctcctccactaccagagcatgcgcgttgccgcgacccgaaccgccgccgccgccgccgctcaccctccgagcgccttcctgctcctcctcgtactcctcggttgcgcgtccctcgcgatcggaggagcagccatggccggccacgtcctcggcggcgtgaaggagaacccagccgcggccaacagcgccgagtccgacgggctcggccgcttcgccgtcgacgagcacaacaggcgcgagaacgcgctgctggagttcgtgcgcgtggtggaagccaaggagcaggtggtggccggcacgctgcaccacctcacgctc

SEQ ID NO: 2890 - DNA, 382 bp, Zea mays
  Clone ID: LIB143-033-Q1-E1-F3
aggcactctcctggtcctgcagccttctcaggctccagcctacgctcaaaattaccgtcaattccatccatctccagtctcaaaccctccaaatatgtggtctcctcgctgaaaccactctacctagcaccgctggatggtccgcgcactgccgagcttaagtctcggagacagccacttgagttccgttgttctgcttctgctgctgatgacaaggagtcaaagactcaggtggtgccagttcagtcggaaggcgcacagaggttgaagatctccatctatttcgccacctggtgggcgcttaatgtgatatttaacatttacaacaagaaggttctcaatgcattcccttacccctggctcatctccacactctccctcg

SEQ ID NO: 2891 - DNA, 241 bp, Zea mays
  Clone ID: LIB143-033-Q1-E1-F4
cactcgcagttgcacctgtaacagccatggtccccagcgatggctgtcacatggcgaagtctggggcggacggtcgcaatgcatgcggccctcaaaataagtcattgactcgcccctcaggccgggctgcacttcacggtcccgccgtcttcatctcatctcacaaacggccgatactcacagcgcctgtggactggctcacgcgtctacctctcacccctgctggagtagttcgccacct

SEQ ID NO: 2892 - DNA, 334 bp, Zea mays
  Clone ID: LIB143-033-Q1-E1-F5
atccacccacgcgtccgcccacgcgtccggccgcccagaccgcctccccttccccgcctccggtgcccaaggccaggccaacagttttgaggtggtaatggccgaccaggctaaccaacccactgtccttcataagctaggtggccagttccacctgagctccatcttctctgaaggtgtacgggcccgtaacatctgcccttctttctcaccttatgaaatgagatttgccactaggaactacatgatccagagcctttggggcccttcaatgtctgttaacggtggcatcaatgttccagtgatgccgactccgctttttgccaatgctcca

SEQ ID NO: 2893 - DNA, 365 bp, Zea mays
  Clone ID: LIB143-033-Q1-E1-F7
aagaacttctggaagccaaaagaattgaggagcaaaatgaaaggaaacgcatgatagaactgcgaaaacttgagaaagaggaggagaaaagagctagagaaaaaatccgccagaagttagaagaagataaggctgaaaggagaaggaaactaggactgccaccagaagacccagcagctgccaaaccaagtgcaccgcttcctgttgaagagaagaagagtgcattgcctgtccggccagctacatcggctgagaggatgagggattgcctaagaaatcttaagcaacagaacaaggatgatgatgccaaagtgaagagggcatttcaaacacgccttacttacattggaaacgttgctaaaaat

SEQ ID NO: 2894 - DNA, 364 bp, Zea mays
  Clone ID: LIB143-033-Q1-E1-F9
attcggttccttgctctgcaccgccgcctgctcatccatatcccatggtgcccagccgagcagcccatggaggcttcccacgcccagccctctctactgatggccgccgtccctactccatcttacggcactgctctctgcctctcccatggacgagctcgccctgccccccatctccttcaccacgctgctccctgcctccttgttggtcggccataccctctgctcctccccaccgtccgcagccccgacgtcgtcgccgtgtttagtcatggtgattcctaacccctttattttatttcactaattcttctaatgcgagcagatttttattgatgttgatatgcggttatgtgtatttgtg

SEQ ID NO: 2895 - DNA, 230 bp, Zea mays
  Clone ID: LIB143-033-Q1-E1-G1
aatcaaaatggactcactccgagtcaacatcaagcccaccgtaaccggggcctcagcgtatccatgtccatcaacctagtagagcagcccctcacacatctaccgaagctgtcgggcaacaattagccaaccaccgcgagtttgagcaaacgtgtctaggactgcctgaaaaagtatgactatctgagggacaaagtgttccgcttcctgttgaacaggttaccactgga

SEQ ID NO: 2896 - DNA, 419 bp, Zea mays
  Clone ID: LIB143-033-Q1-E1-G3
acaaaaacttcaccaccaaagcatatctgcaatggattttggtgacagatcaattggtcatgttggatccccaactgcatcttgtgaggtgaaacttgtggatgtcccagaaatgaattatacatctgatgatcaaccttatcctcgtggagaaatttgtgttagaggacctataatattccagggttactataaggatgaagttcaaacaaaagaagtcattgatgaagatggttggttgcacactggagacataggtcagtggctacctggaggacgtttaaagatcattgataggaaaaagaacattttcaagttaactcaaggagaatacatagctccagagaagattgaaaatgtccatgccaaatgcaagttcattgcccaatgttttatatatggcgacagtttcaactcct

SEQ ID NO: 2897 - DNA, 347 bp, Zea mays
  Clone ID: LIB143-033-Q1-E1-G4
actccctatcgagagtcgtactactaacttgaccagactaaacgggggaatattctcctcctacaatcgtacctccagtgatgtcactaccaccgccggccggcggcggcgccatcgtcagcgaagtcctcaccgacgacgagctccgcgcagtgcgcaggcggctggggcccgaggcggaacgggacccgttcgggctcgtgtgccgccgctggttccggatccacagctcggaacggcggcgcctgcgcgcgcgcgccggcccagagatgctgcgccgcgtcgctgcacgcttccctggtgtcctggatctcgagctctctcaagtcgccctcgcgctccgtcta

SEQ ID NO: 2898 - DNA, 392 bp, Zea mays
  Clone ID: LIB143-033-Q1-E1-G6
atgacagttctattaacttgacgagacaaaaggggggaaagttctcctcctacaatcctacctccagtgatgtcagtaccaccgccggccggcggcggcgccatcatcaacgaggtcctcaccgacgacgagctccgcgcagtgctcaggcggctggggcccgaggcggagcgggacgcgttcgggctcgtgtgccgccgctggctccggatccagagctccgagcggcggcgcctgcgcgcgcgcgccggcccggacatgctgcgccgcctcgctgcacgcttccctggtgtcctggatctcgacctctctcagtcgccctcccgctccttccaccctggggtcatcgacgacgacctcaacgttatccccagcagcttccgcaacctgcg

SEQ ID NO: 2899 - DNA, 413 bp, Zea mays
  Clone ID: LIB143-033-Q1-E1-G8
cacgcatctagcctaagtaagcagcaagcgtacacgtaaacgtacacctacctcggcgagcaaaaggcaaaacgctgatcggagcaaccaacgaagcccgcagccatgccgacggccacggccacggcggctcctcgccacgccgcgctcttcctgctgctgctgctcggcctccacgccacgttcgccgccgccgcgcgcgcgggcgtcgccgtggacgccgagctcacgtccaccaagccgtccccggtcccgaagaagcccagcgtgaagccgcccggccccggcgccgcgagcccgaccttcccgggcttcggcatccccgggatgggcgggttcggcatccccgggatgggcgcccgccgggtggggcggcggctacggcggggcccccgggcgggtacccccgcggc

SEQ ID NO: 2900 - DNA, 348 bp, Zea mays
  Clone ID: LIB143-033-Q1-E1-H1
gtttttcgttccaattctctatattgagtcgtactatgccttgattttgtggaacgaagcgatggctcgcagcggcgccatggtttcctgcatgctgctcctggtggtggcgcaactgctcatggtgatggccacgcatacagcggcggcggctggcgaccaacgcggagctggacgccggctgctgtggcaggtgacctgccactacagcgcctgtaactgccgcacttgcccgacatatggctgggcgtgctgcaacacttgctgctagctagctagctagtgtgagttcttccgcgcgcgcgcagccttttgcacacccctcgtgcttagctcatgcatgtccag

SEQ ID NO: 2901 - DNA, 423 bp, Zea mays
  Clone ID: LIB143-033-Q1-E1-E8
ctcgcgggccgacacacgcgtccacgctcggcccggcgaacgcgatctgttccccaacctccgcagccgctccaccgtcctccactccggctgccgaatcgacccgccccgatccagatcaggagctgagggatggacgcgaacaggcgccagagtgggatccagcagttgctggctgcggagcaggaggctcagcaaattgtgaatgccgctagagctgccaagtcagcgaggctcaggcaagcaaaagaggaggctgagcgggaaatagccgaataccgtgcccagatggaggctgagtttcagaggaaggttgcagagagcagcggcgactccggtgcaaacgtcaagcgtctcgaggaagaaacggcggcgaagatcgagcaactcaaccagcaggccgcaagcatctccccgggatgt

SEQ ID NO: 2902 - DNA, 277 bp, Zea mays
  Clone ID: LIB143-015-Q1-E1-C7
cccacacttcagcggacgcctgggtgcacccaggcggcgcgcctccttgcgctgcagtgagtctgagagcccccgtcctgcatctgtcggcgatgaacagctctcggcgacaggaccaccgatagctgcaattccgtctctgctgccgctggtggtggccacggcgatgacgttctccgccgccgctgctcgcatccccgtcgtgtacggcagcggtagctggcatatcgcgcatgccatctactacggcggcagctacacctcttgcaccatgggc

SEQ ID NO: 2903 - DNA, 57 bp, Zea mays
  Clone ID: LIB143-015-Q1-E1-C8
acacacagttccgcgaacgcctgctgtctcccacacggcgagtctccgtgcgctaca

SEQ ID NO: 2904 - DNA, 353 bp, Zea mays
  Clone ID: LIB143-015-Q1-E1-D1
gggcccacggacgatcgcgactgcgcagtctaatacgctcgaggcatctcgaatcgatagtctgccatatcgtcggataccctcgaaatggccgctcaagggaccgcaactgtggacgtggctctatctccgattcgaagagaaccgctgaagatcaggacagcgttgcaactcatctcaaggccattatctgcacacaaatggcttatgctgggatcacgtacagctgcaacaacactttctcatcatacgaccaagtccttcatactagtgccagactcggaccagtctcagaacgtcaatcaggtactggcgcacagatcggatcagaaagtcaactcgccaacggtacc

SEQ ID NO: 2905 - DNA, 401 bp, Zea mays
  unsure at all n locations
  Clone ID: LIB143-015-Q1-E1-D10
ggccgcgccgcctcctccgcccgcctcgcgctctcgctgccgtgcggcgcgtgggtcggccgaagcgggctcgtccgccgcgccgccgccttctccgggacacggccgcgtttcgcgggcgccagggcgcagatcggggccgccgtgcctgccgtcgagcagttccagcgcaggatggcaacccaagctactgtgcatgccttcaaggatattctgaccagcctccctaagcctggaggtggtgaatatggaaagttctacagccttcctgcactaaatgatccaaggattgataagctgccgtactccgtccgtattcttcttgagtcagctatccgtaactgtgataacttccaagttaccangaatgatgttgagaaaataattgactgggaaaacac

SEQ ID NO: 2906 - DNA, 311 bp, Zea mays
  Clone ID: LIB143-015-Q1-E1-D11
gggatatatatgtgtttccaggtagttggagattcgaaacgaaccagtgatgtagatttgtttcatctaaatatatgctatagttcaaaaaaaaaaaaaaaaaaaaaaaaaaaaagaagaaaaaaaaaaaagaataaagcacatgaagaaaaaaaaatgaaaaaacaaaaacacggaaagaaagacaccaaaaagcaagaacaccgaaaaatgaattcaaaaaatgtcgactgagaaaaaaatggggggaaaaaccataggctcagacaaataaatcggccattcgcaacatggacgtttcgccgggtaga

SEQ ID NO: 2907 - DNA, 391 bp, Zea mays
  Clone ID: LIB143-015-Q1-E1-D12
agtccttattcgtaagccttcaaaccgacgaatttgagcaactgcacccagagcgcgatccattgccggggaagaagcaacttgttgcgagcctcctctatggcgagctccgaccatggttccaccaccgcccccaacgacgtgccgggcagctacggcctgccgctggtgggcgccgtgcgcgaccgcctcgacttctactacttccaggggcaggacaagtacttcgagtcccgcgtggagcgctacggctccaccgtggtgcgcatgaacgtgccgccgggccccttcatggcgcgcgactcgcgggtggtggcggtcctggacgccaagatcttcaccgtgctcttcgacatggacaacgtggagatgaaggacctgttcacgggca

SEQ ID NO: 2908 - DNA, 368 bp, Zea mays
  unsure at all n locations
  Clone ID: LIB143-015-Q1-E1-D2
accacgcgtccggagctaggcagctaacagacgaagaagaagcaagccaagcagaattgagagagaggcgaggacgtggcgacgacggcagccgcgatggcgacgacgacggacctggggttcgaggcgacggagctccgcctgggcctgcccggcgggggaggtggaggggagccggcgctgggcggcgaggggaggagctcttcctccgcctccggcaagaggggcttcgccgagaccatcgacctgaagctgaagctggagccagcggccgtcgtggaggcggaggaggaggaggaggaccacggcgttgctgttgcccttgagaaggaggangaggccgggaagatgaagcggtccccgagcca

SEQ ID NO: 2909 - DNA, 379 bp, Zea mays
  Clone ID: LIB143-015-Q1-E1-D3
atcagtccgatatctattcttttgggattgtggtcttgcgccttttgacaggaaggcctcctgatggcataaagaagattgtggaggatgccatggagaaaggcgacctgaactcagtagttgataccttggcaggagactggcctgctttgcacgtccagcagttagcactccttgctcttagttgcacagagatgagccggaggcaccgtcctgatctttcagccgtggtgtgggcagtggatgaggcgatgaaggatgctacaacagtaccttcagcctcatcttctagaccagtgtcggatgaaaataacacaccgtcatatttcatttgccctatatctcatgatgtcatgagcgatccacgtatcgcagctga

SEQ ID NO: 2910 - DNA, 402 bp, Zea mays
  Clone ID: LIB143-015-Q1-E1-D5
agtccctcctgtgcctcgtcctccccctttcccctccgagtccagcccggcgccacccactcagccgcggatccgaggcgcagatccgatccggcgatggcgtccacggcggcgaggcggctgcgggagctgcaggcgcagacggggaacaagacctgcgtggactgcgcgcagcggaacccgcagtgggcgagcgtctcctatggggtgttcatgtgcctcgagtgctcgggcaagcaccggggcctcggcgtgcacatcagcttcgtgcgctcggtcaccatggactcctggaccgaggcgcagctccgcaagatggaggccggtggcaacgaccgactcaacgccttcctcacagctcgcggggttcccaaggagacgccccacgtccccaagtacaac

SEQ ID NO: 2911 - DNA, 279 bp, Zea mays
  Clone ID: LIB143-015-Q1-E1-D6
aagtcgcgcctgtgcctcgtcctccccctttcccctccgagtccagcccggcgccacccactcagccgcggatccgaggcgcagatccgatccggcgagcgcgtccaccgccgcgaggcggctgcgggagctgcacgcgcagactgggaacacgagcagcgtggacggcgcgcagcgcaacccggagtgggccagcgtctccgacgcggtgtgcaggtgccgcgattgctccggcaagcacgggggccccggcggtgcacaccaggcgtcgcgcgctcg

SEQ ID NO: 2912 - DNA, 418 bp, Zea mays
  Clone ID: LIB143-015-Q1-E1-D7
gcatcatcgatcgccgagcgtgcgtgctctagctctagcaatagcagcgaggagacggtcgaggatggatcagaacaacagcaacaggcagcagcagcaggcgccgccgccaccacccgcgggctacccgacggcaggcgcggagcagcagggaggcagcggcaggaagcagggacgccgggggaagacgacctcgcgcggggagaagggcttcatcgaaggatgcatcgcggcgctctgctgctgctggatctgcgagatgtgctgcgactaggcagcccccccttccctccgccgccaggctttgagcctttgacaggaacggagagatctgctccacccatagctgcagttgtggctgcacgtacttgttgagctgttgtgttgtgtccatctcggtactttttgatttggtaat

SEQ ID NO: 2913 - DNA, 399 bp, Zea mays
  Clone ID: LIB143-015-Q1-E1-D8
agtgtcggtgtgcagtgtgttgtcatctccatctccagctccagcgccgccttgctctgtgtgcttccgcccgctctgtgttgctattgctaaactagtgtgttctgtcgctatgggctccctggccaccgcggacgggccgttgccgccgctcaagtaccctcaggctcgccgggacgaagacatcgtcgacgactaccacggcgtcctcgtgccggacccttacagatggatggagcatgtggattcgaaggaggtgaaggagttcgtggacgcgcaggcggccgtgaccagcgccgtgctgtccagctgcgaccaccgcgggcgcctgcgctggcagctcaacgcgctcttcgaccacgcgcgcttccgcgcgcccttcaagcgccggggcagcta

SEQ ID NO: 2914 - DNA, 170 bp, Zea mays
  Clone ID: LIB143-015-Q1-E1-D9
gcgtcgtttaaccgggcgacgatatcagtgttggagccatacgagaagctacagtcgagacctggattgacgcagcgtttgtcgacctgctcgccttcaggcagaccgagaccgcgttgtgcggcacctgcgctccgcactttcaccagacgccctacaaggatctgtca

SEQ ID NO: 2915 - DNA, 388 bp, Zea mays
  Clone ID: LIB143-015-Q1-E1-E1
aggcggctgcggcggagcacggaggcgaaggaggacgagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggactgacaagacctaccctgctgggttcatggatgtcatttccatccctaagacaatggagaactac

SEQ ID NO: 2916 - DNA, 408 bp, Zea mays
  Clone ID: LIB143-015-Q1-E1-E10
acggacgcgtgggtgcttatgcaaatgcggatgtaagggtttctctggaagagattgcatctaaacaaggtcatggcgatgtctctaagctgatgccgactgatatcgcaattgagtcacttcataagatcgagagtttcgtcatcgagcacgctgctgataatccagctagcgactcgcaagctgagtcacagatccaaaggatacagaccttgtaatatcttaatccttctgttttgtaccgaagcgtaccccctagagcatcgttggtttatttgttcgttgaagtgtcacgagggagagaaaaataaaaaccctgaagtatttcttcttgtaagttgtaaaggaatggaataaaggagctaataatccgaagtgtaccgtttggctgaaacatcagtttgatac

SEQ ID NO: 2917 - DNA, 402 bp, Zea mays
  Clone ID: LIB143-015-Q1-E1-E11
acccacgcgtccgcccacgcgtccgcccacgcgtccgaggctcctatctggtataggacggagctgagcttctagcaacgtacagtgtatccgccatgagtcctttcggggcggtgatcacgccagaaaccctcaagtacatgtccaagtaccagggacgtgagatcacgcaggtggactgcgcacgggaggcgatgaggctgatccacgcggaagacaagaacctcaaggccgaggactcagcgtgggagctgaagaagaagttcggcaacggcgtgagcaccatggtcctcgtctacaacgccaccggggccagcctgagcctggtggacgacgggaaagactggatgggctccgtctacagctcgccgattccggacaccttccacaacgggcagtgga

SEQ ID NO: 2918 - DNA, 414 bp, Zea mays
  Clone ID: LIB143-015-Q1-E1-E12
acgtccgatggctctgcatatcccgcgcccgactcccgttgctgcgtgcggcggcccgactagtcgcgccgcgctgcgcttggcttgattgaaccggccgggatgggggtgttggaagacctcgtggcgagagcgggcgggtgcgcggtcatcgacggcggcttcgccacgcagctagaggcgctcggcgccgacatcaacgacccgctctggagcgccgcttgcctcatcaccaggccgcacctcgtcaaggaggttcatatgcagtatcttgaagctggtgcggacgtcatcatttcatcatcttaccaggcaacaatcccgggtttcatagctagaggaatgtctgtcgctgaggcagaagatttactgcgaacaagtgttaaactggccaatgaagctcgagatgaattt

SEQ ID NO: 2919 - DNA, 283 bp, Zea mays
  Clone ID: LIB143-015-Q1-E1-C6
agacgcctcagccccatcacaataacatcaaaggcacatcggatccatctcgacagtgaggcttgagagaccagatcaaattgaaatcatccgcgactcaccaacgcacgtttgttctctgatctctctggttcttctttgaacagcaaggattgcacagcacaatacaatgtctggttcaaaatgctcttctatatgatatttttatgaatcctcatgagaagcttgttcttgggttaggatttttttctcacctcatcatatcacacctatcgaggaacag

SEQ ID NO: 2920 - DNA, 422 bp, Zea mays
  Clone ID: LIB143-015-Q1-E1-B11
acccacgcatccgcggacgcgtgggcggacgcgtgggctagaggagaaagcaagaagtttacgtagggagatagtgaatcattggatcagtaaagaactccagaggctagaaagattaattgacagggcgagtgagaaaggttggcgcaaggaaaagtttgaataccttgataagaaacaactcttgcgcaagccatctgaacaacaacgtttacttgaagaggtgcctcaagttattccagagacagaagataataaagatactgaatttcaagttacaggacaagacaaacctattcaaaagagtactgtcgctttacaaggtaccaatggagagagcattgtttctttgaaaaaaggctcagaagaaaaatgtacatatgtgacaagggcttcttttttgaagagccacacaaggaaaa

SEQ ID NO: 2921 - DNA, 395 bp, Zea mays
  Clone ID: LIB143-015-Q1-E1-B12
acgcgttactactagttagttagagagacagagaggatcgatctgctggcggcgtctaagctggagaaaggcggcgccaccgccgagggcgacgagataggcatcgacccagcggcggagactccggagcagcgcaacaagttcctggtcctccgcctgtacgaggcgctcaacgcccgggaccacgccgccgtgcagtcgctgctggcgcccgacctggagtggtggttccatggcccgcccaagcaccagcagcacatgatgcgcctcctgacaaccaccaccaccaccaccaccggcagcttccgcttcgtgccccgctccgtggacgccctcgccgcctcgtccggcaccgtgatcgccgagggccacgagaggggttgctactgggtgca

SEQ ID NO: 2922 - DNA, 366 bp, Zea mays
  Clone ID: LIB143-015-Q1-E1-B2
cttgtccgcccggcctcttccgtctcggagcgagaaatcagcggcatcgccgcgcgcatccgaagcgcacacgacaatgcagggcggatccagcggcatcgtctatggtggcctcaagtaccaggcacggtgtatcgccgacgtgcgcgcggacgccagctcgaccaccttcctcgccgggaccctcagcctcaaggaggagaacgaggtgcacctgatccggctttcgccggcggagagtgagctggtgtgcgatggagtcttctaccaccccaacgagatctgggatctcaaatcatgtcccttcgatcacagggtcttctccacagtctacacatctggtgagggctttggtgcgtcagtttg

SEQ ID NO: 2923 - DNA, 261 bp, Zea mays
  Clone ID: LIB143-015-Q1-E1-B3
gtcacactgcacgttttggacactgaactgtgagatggcatcagcaaagcgttcccgtgaggaaaatgtgtacatggcgaagctcgcccagcaagcagagaggtacaaagaaatggttgagttcatggacaaggtagcgaaaactgttgactcggatgagctcactgtggaggagcgcagcctcctgtctgttacatacaagaacgtcattggagcccgccgtgcctcatggcgcatcatctcctccatcgagcagaagga

SEQ ID NO: 2924 - DNA, 386 bp, Zea mays
  Clone ID: LIB143-015-Q1-E1-B4
agacagcatcacttgctgctgcatctatcactatcgcaggtactgcctcgcctggggctgctgcgcgctcgaaggcgccatctgctgcgacgactactacatctgctgcccccatgactaccccgtctgcaacgtcaaccacggaacctgcctcatgtgcaaggacagcccactgtcactgtcagtgaaggatactaagcgcacgctggccaaaccgcactgtgcattccctgacaacacagctgctgacggcatgaacatcagcgcatgacaaatacgcaacatggcattaagtcaccaacagccagcatgattagagccccccttcattcacactgatcatccggtcccgtaattcaagacgaaagcatggctgggcggccgct

SEQ ID NO: 2925 - DNA, 353 bp, Zea mays
  Clone ID: LIB143-015-Q1-E1-B5
atcaattaaactggcagacaacatgagaacgagcaagatctcgagattgatttacacaaattctggtcttgctatcttggctttaacttcaagtgctgttcatctactctggaaatggccacgcagtgatcggaattctggaaaggcaagcgcgagtgtgtctcccacactatggcaaccaccaagtggcattttgatgactaatgacacgactgacaacaatcctgaacaagctgttcactgctttgctttgtcgaagaatgattcatatgtcatgtccgcttctggaggaaaaatctctctgttcaacatgatgaacttcaagacaatgacaacatttatgcctgcaccgc

SEQ ID NO: 2926 - DNA, 361 bp, Zea mays
  Clone ID: LIB143-015-Q1-E1-B6
ggctgagggccgtgcagagccaattccaacaggtgatcgtgatcgccacaagcatgctcgtcctgcgccaaattctgatgagcgagaactcgagggccactcctctggaactggaaaatgccatctcagaactcgtcaaggctctcgcggacattctggacagctcacccgattccggcacggaagagattgtgcaggcgatggtcaatgcatcagcctcagttggctcaccatcagaggagaaggttcaggccaggatgcagatgatcacccgggtgttcctcaagagcctccagcctggtgacgtggtcttcaagaaggtatcccgtgcggtctactgcgccttccgtgggatcatctt

SEQ ID NO: 2927 - DNA, 124 bp, Zea mays
  Clone ID: LIB143-015-Q1-E1-B7
aaaaaaagaaaaaaaaaaaaaaaaataaaaaaaaaaataaaaaaaaaagaaaaaaataaaaaaaaaacaaaaagattattggtggcggaactagaagttccaggcttggttccccatataggca

SEQ ID NO: 2928 - DNA, 400 bp, Zea mays
  Clone ID: LIB143-015-Q1-E1-B8
ggggaagggatcgagagcgcggcggaggcgatggcgagcggagggaagggactcaacgcgactggggagttcttccggcggagggacgagtggaggaggcaccctatggcggggaaccagctgcgccacgccacacccgggctcggcatcgccatcgtcgccttcgggatctacctcgtcggcgaggccgcctacaaccgcctctaccgcccctccggcgacaaccaccactagatcgccggcaggatccgtgactcggtcaagaagctggagccaactttaccaagcactggtgctgttgatgtttttacagttttgagctcataaggtcagccatgaccatattgtaatctgtgaccaggtagacttgcccactggtccgtccaactagtggcctggg

SEQ ID NO: 2929 - DNA, 84 bp, Zea mays
  Clone ID: LIB143-015-Q1-E1-B9
aaatatatatgttacttcatgtagaagagcttctcaactgtccatattgttgaaactgaagcttggttgcacctttttttcttt

SEQ ID NO: 2930 - DNA, 362 bp, Zea mays
  Clone ID: LIB143-015-Q1-E1-C1
aggctggtcgagcggcgccgcccttggctaggtcttcgctgggttcttcgccggcgacgaacgtccatctggggtcgactgaactgagcaggcagtaggaagagacactatgttgttcttctcctacttcaaggagctggtgtggaaggaggtgacagtggagctcaagaatgacttggcgatccgcgggacgctccactcggttgaccagtacctcaacatcaagctcgagaacacccgcgtagtcgaccaggacaagtatccccacatgctttcagtgcggaattgcttcatcagaggctcggtggtgcggtacgtgctgctcccgcaggacggcgtggacatcgacatcctccacgacg

SEQ ID NO: 2931 - DNA, 415 bp, Zea mays
  Clone ID: LIB143-015-Q1-E1-C10
acagtgagcaaatcaaacaaaactggctatgaatcactactgagggtatatagggaaaccgatctaagccaggagaaagttcgtgtgttaggttctttggcatcatcccctgaccatgatgttgtccgtgaagtattgaatttcatattgtcacctgaggtgaggaatcaggacgcaatatttttgctaagaggggtgagttcaggggcacacgaggtagcatggcaatggctgaaggaaaactgggattacatattgggagcctactctggaactctgctcacctatttcgtcaacataactgtctcgccactggccaccgatgaacatggtgatgaggcggaggagtttttcaagagcagaaccaaggcgaacatcgcgaggactgtgaggcagagcatcgagaaggtgagga

SEQ ID NO: 2932 - DNA, 348 bp, Zea mays
  Clone ID: LIB143-015-Q1-E1-C11
agcctttactctagcatgccgctggacccacaacggcttccaaaatcatctgtgtctgctgtgccaaactatgctgattccatgatgcatgctcgtaatcataacctgcttgcttcactgggtggtactactacacagcttcctgcaacatcccgcgtaggctcaatgatgcctgaaagatcgtattatgatccttccagcgttgatgggaatgaaaacgctggttcacctgcttactcaaaaaagtaccacagctcacctgatatgtctggaataatcgctgcaagtagagctgcactcttgaatgaagcaaagtggggtgctgccattggaccacagtcatacctc

SEQ ID NO: 2933 - DNA, 394 bp, Zea mays
  Clone ID: LIB143-015-Q1-E1-C12
agtgcccacctcccgttccgtcgcgctcgggtccctctcctcctctcccctcctcctccttcgcttcgtagtaatcgtaaacccggaccgccccggcaggcacccccccgctccacgcgtgcgagagagagagatagagcgcgcgccatgggagaagagaccctcgttgccatgccgcccgcgttcccccaccaccacgcccccacgccgccacagccaccgtcggggccagttgctgcggacaagggggaggaaggggaccatcgtcgtcccgcagagggcgtcgccgggccgccgcaagtccagccgcggtcggtggccccgcacgggctcggcggcgaggaaggggacgtatactacgcgcgcaagatgctccagggcgcggtgcctgcgg

SEQ ID NO: 2934 - DNA, 383 bp, Zea mays
  Clone ID: LIB143-015-Q1-E1-C2
acacgatcgataacagctaattaagctgctactgctacgctagcctcgatcgatcaagcaagcagctcacagacccaccgggccactcacccagccatatggcggcgtaccgttccgctctgatcacactgcacggccttgtgatctccgtcgctgcggcctcagcgaacacgttcaccgtcggtgacagtaacggctggagtcgtagcgtcatctacgacaactgggccagtggcaagaccttcactgatggagatcagctagtgttcatcttcgccactgggaaccaccatctcgtgaacgtggacaatagcggatatgatggttgctccagcaccaacgccgctaacacaatccaaaaacgcccggacaccgtcaacctc

SEQ ID NO: 2935 - DNA, 399 bp, Zea mays
  Clone ID: LIB143-015-Q1-E1-C3
cgtgctcgctgcctgcttcctcgcgcgattgtccccggcctcccggaatccataattgggggcggctcctcgctgttcctgtcgtcgctgctcctttcccaggatgtcggaacgttctgagagcgcaactgagaagattatgagcagcatcatggataccattgctgacaaccttcctaagcagaagtctgggaaatttgatccaggttcagtctctgacaaagtgaagaataagctgtttggtcgtcagaagaccttgcatggagttctgggtggtggaaaacctgctgatgtgctgttatggaggaacataaagatatcatcgagtgttctggctcttgcaacagctatttgggttttctttgagtggctcgactaccacttactgacaattgtttc

SEQ ID NO: 2936 - DNA, 403 bp, Zea mays
  unsure at all n locations
  Clone ID: LIB143-015-Q1-E1-C4
attcacggggccatgcacttggcataattctgacgataaganaccatctgtatgtgaacaacgtgatccttgtgcaaacagggtgtcgtctactgaccagacagtgcaacagaatgactcttggtcaaacatcatgatttctggtggagctgacgataccaatggtggctgggacaccagagtgaaatactcatcctgcactgatgggggtgtctgactacattgtgatacatggacacacaagattggttctaatgaaggtgtataacaagaaactgatccttgagccagctacatgtcttctactgtgtgtgccagatacaataaaggtagctggaacactacaccacaagtcattccatccatggaaaaggctgatgatccatcgaagagtaacgcgggt

SEQ ID NO: 2937 - DNA, 417 bp, Zea mays
  Clone ID: LIB143-015-Q1-E1-C5
acacgcctcacccccaccacaagaacaccaaagccacatcccatccatctccacggtgaggcttgagcgacccgagcaaaaaaaaatcatccgcgacgcagcgacgcaggtttgttctctgatctctctggttcttcttttagcagcagggacgcacagcacaagaaaaggtccggttcaagaggctcttctattgggtttttttagaatcctcaagagaagcgtgttcttgggttaggatttttttctcacctcatcacacctctcctaggaggaacagagatccagagaaccttttttctcttctggatccttgccgccttttggccttcgaaagggggttgttttgcaataccctctctctgtattttttcttcttcgcacaaacccacctcgtttctctacttttattgagga

SEQ ID NO: 2938 - DNA, 419 bp, Zea mays
  Clone ID: LIB143-015-Q1-E1-B10
aaagcgcaatggctcatccttgcttaattaccaaggtacctttgcaggtaggtaggtagctagccgccatagcaagctaggccgaagcagaggagtgatggccaaggtccaccccaacgccgcggagtccgtccaggcagaggccgagggagagctgcccacggtgctgacggtgtggcgcaagtcgctgctcttcaactgcgacggcttcaccgtctacgacgcccgcggcgacctggccttccgcgtggactgctacgccggctcgttccgccgccggcgccgcgccgacgtcgtgctcatggacgccacggggaagccgctgctcaccgtgcgccgcaagacgcggttcggcttagcggagcgctgggtcatctacgacggcgacgccgacgacggcacgacggccgggggccacc

SEQ ID NO: 2939 - DNA, 447 bp, Zea mays
  Clone ID: LIB143-014-Q1-E1-H6
ccacgcatccgcatgtaaccaccagctttccagggggagattctgccaaaatttcctgcactgatcatcattcttctaaggggaggttctgccgaagttttcttgtgtgacgacgacgatcagtttccagggggagattctgccaaaattttctgcactgaccatcagtcttccaggggaggttctgccaaaattttcttctctcactatcacttctccaaggccaagccctgccaaaatttccttcatatatcacatgcatcgtagacatacagacaataaactctaatttgcaaaggtaacaaaaaaaaaaaaagagtgctttcctccttggccttgatggtaggctagtagagaaaaccgcgcgcagcatctgtttacatgttgttgctcgtcctgtccgagcacctcctttccagatttatggtcggttctgccctaacccgc

SEQ ID NO: 2940 - DNA, 439 bp, Zea mays
  unsure at all n locations
  Clone ID: LIB143-014-Q1-E1-H7
aaggaattcatgtccagcttggcttcccttcttaagactattgaaagggcgatccaggttcatgaagatttctcaggtgtcgtgaaccctgcagagttattagaatgtcacttcacagggttgaaggctctggagaatgaatatggttctggtgaaattgttaagcagggaacagaaatagttcagagagctgtcaccaaatcattccagtccctacatgaagcatacaaagggaaaattgttgggctggtaatatccacaaatgaggctccatcatccttaggatccataattgacgcaccatcttcactgcacatttcaagacggctagaagaagcaagcaagactacagacatagcctctgtcgtacttgttcgaaagagcttggcatggattacanggatcatcctgcttgttttaactctcatanggggtttgc

SEQ ID NO: 2941 - DNA, 321 bp, Zea mays
  Clone ID: LIB143-014-Q1-E1-H8
cccacgcatccgaacgagaagcctggccacgattttactctgacagcgtcgtttggaagtgtggatgcttcgagctacgacgcgcttgtggttcctggcggacgggctccagagtacctggctctgaacgataaggtcatcagcttggtgaaggccttcgcggagagcggaaagccaatcgcgtcgatctgccacggccagcagatattatccgctgccggagtcctcaaggggaagaagtgcaccgcatacccagccgtgaagctgaacgtgttgctcggtggcgggacctggctggagcctgacccgattcaacgctgc

SEQ ID NO: 2942 - DNA, 419 bp, Zea mays
  Clone ID: LIB143-014-Q1-E1-H9
ccacgcaaccggagcagaaaaaggaagcagcagctttgatcgggtggagtttcttgctcactgatcgtcgagttcctgttcgatcgaagttccaggtgcgcacgtacgcactgaagcctttggggtccgtgacgatgtcgaggagagccgcagcgttgttgctcgcgtgcctcgtcgccgtgacagcggcggcgctggcggacggcgcgctgctcccgtggttcggcggcggccggcgcgggctcgacgaggcagcggtgtccgacgtgggcctcctggcggccgacccgttccggatcctggagcacgtcccgttcggcttcgaccgggacgacgtggccatggtctccatggcgcgcgtggactggcgcgagaaccccgacgcgcacgagatcgtggtcgacgtgcccgggatgcgc

SEQ ID NO: 2943 - DNA, 415 bp, Zea mays
  Clone ID: LIB143-015-Q1-E1-A1
acgacatcatccactcgatcatcgacatggacgcggacgtgatcaccatcgagaactcgcggtccgacgagaagctgctctccgtgttccgtgagggtgtcaagtacggcgcgggcatcggccccggtgtctacgacatccactcccccaggatcccgtcggccgaggagatcgccgaccgcatcgacaagatgctggccgtgctggacaccaacatcctctgggtgaaccccgactgcggcctcaagacccgcaagtacacggaggtcaagcccgccctgaccaacatggtctccgctgctaagctcattcgcacccagctcgccagcgccaagtgagcacctttttttgcctttttcgtttccgaggagggcgtcgtcgatgccaatttgtttccaataaacaggggtccccc

SEQ ID NO: 2944 - DNA, 415 bp, Zea mays
  Clone ID: LIB143-015-Q1-E1-A10
acttccttccgcggactagttttttctgaagattcggcgatggcggcgacgatccaatccgtgaaggcgcgccagatctttgacagccgcggcaaccctagagtcgaggtctacgtgttttgctcagatggaacctttgcaagggcagctgttcccagtggagcatcaactggtgtatatgaagctctggagttgagggatggtggcactgactatttggggaacggtgtctccaacgctgtgaacaatgtgaactctgttattggacctgctccgagtggcatggaccctacagcagagactgacattgataacttcatggttcaacaacttgatgggaccaaaaatgagtggggatcgtgcaagcaaaagcttggtgctaatgccattccggctgtgtcattaactgtttgca

SEQ ID NO: 2945 - DNA, 393 bp, Zea mays
  unsure at all n locations
  Clone ID: LIB143-015-Q1-E1-A11
aaatgcgaggagacgactatgcatgatgtgaacaagatcaaggaaaacatccttgccatgcacgataactcactgaagctatgcaattttgccaccggcaagttcttgaaggtatacagtggacatgtgaacagacaatactgcatacagtccgcgttttctgttacgaatggaaaatacattgtcagtggatcagaagacaactgcgtgtacatatgggacctccaagggagaaatatccttcagaaattagaaggccatacggacactgtcatctcggtgtcctgccatccaacagagaacaagattgcttctggtggccttcataatgataggactgtaagattatgggttcaagatagctaatcaacttgcangtgtggactacgctca

SEQ ID NO: 2946 - DNA, 377 bp, Zea mays
  Clone ID: LIB143-015-Q1-E1-A12
acgacacgatcatcaaagccgccgccgccgccgccgtcgcctcagctcgctccggctgcctctgcctcccctgcctctgaggatttgcttggggagagacttattatgagattcgcgggttggtacctgaagatcgcggcggtaggggcctccattggcgccgccatggagctcttcatgatccacacgggcttctacgagaaggtaactgtcttggagtcagaaaaacgagcttgggaaagcagtccagaggcccaagcaatgatagaagctctcaatccatggcgcatgcatgatgaacacgaacaacagaagtagtcaagatttatgtgtcttgtcgagtgtctgtgcccccccatccgtagacccatgaatga

SEQ ID NO: 2947 - DNA, 385 bp, Zea mays
  Clone ID: LIB143-015-Q1-E1-A2
cggacacgtggcgagggtacatgacgcggttcttcctatcgcggcaggtgaccaggacctctatcccctccttgatggaggtcggggactgggatggaggccagggactcgacggcggtgggcctggaggtggcggcaaaggcctcggcgtcgacggccgcggcgaattgaagaaatcccaattattcttgaggaagataaaatccagttccgtcatctactgtgtggagattggagaaatagcacatggatcaaagccatcaagttttttggcagcattgtttgcttacttcatggaggatgccactgttcctaaattgtcctcaaaactttcaccatctagaaatcttcttgggactaatgctggcagccatatctcaacact

SEQ ID NO: 2948 - DNA, 113 bp, Zea mays
  Clone ID: LIB143-015-Q1-E1-A3
acgacatggatcttcccatcatcacaagcgacaactcgctgtatcaccacaatctgctctctctgtgacgtgaaggtgtcacatactaggccacgcattctgacccctgtgat

SEQ ID NO: 2949 - DNA, 370 bp, Zea mays
  Clone ID: LIB143-015-Q1-E1-A4
cggagccacaccacaccacaccacccttggtccggcactagcactagctatccagtggagacgaagatggcgacggcgcggtggctgcaggttgccgccatggcggtggcgctgctggcggagtgggcgacggcggcggcgcctcggaagcccgtggacgtgccgttccagaagaactacgtgccgacgtgggcgcaggaccacatccactacatcgacggcgggcgggaggtgcagctgtacctggacaagtccaccggcacgggcttccagacgcggggctcctacctcttcggccacttcagcatgcacatgaagctcgtcggcggcgactccgcgggcaacgtcacgggcttctacctgtcgtcgc

SEQ ID NO: 2950 - DNA, 400 bp, Zea mays
  Clone ID: LIB143-015-Q1-E1-A5
cccacgcgtccgcacctcagctccgccgcttgcccgcttttgctctctccctcccggctctcggcttcttcgacacgctaccgtctcacagccgtaaacgcccctcccggatcccgctagttcgccaccgccgcccgcccgcccgccgttcgcctcatcatggccgcctcgtcgaccgccacctccgtccacgacttcatcgtcaaggatgcgagcggcaaagacgttgacctcagcacctacaaggggaaggttcttctcattgttaacgtcgcatcccagtgtggcttaactaactccaactacactgagctggcccagctctacgagaagtacaaggaccaacgctttgaaatcctggctttcgcatgcaaccagtttggtgggcaggagcctggta

SEQ ID NO: 2951 - DNA, 154 bp, Zea mays
  Clone ID: LIB143-015-Q1-E1-A6
accacgcgtccgcaactcagctccgccgcttgcccgcttttgctctctcgcacccgggtctcggcgtcgtcgacacgctagcgtctcacaggcgtggacgcccctcacggttcgcgcgatgtcgccagcggctcacgcccgctcgccgttcacc

SEQ ID NO: 2952 - DNA, 264 bp, Zea mays
  Clone ID: LIB143-015-Q1-E1-A7
aaaaaaaataaaaaaaaaaaaaaaaaaaaaaaaaaaaaaaaaaaacaaaaaaaaaataaaaaaaaaaaaaaaaaaaaaaaaaaaaataaaaaaaaagggggggcccccctaagggttcaacccttacttccgcgtgaatgcaacttcaaacctcttcaaagctgtccccaaatttcacttcatgggccttcgttttacaccttcctgactggaaaaacccggcgcttacccagcttagtccccttccagcaaacccccctttcg

SEQ ID NO: 2953 - DNA, 403 bp, Zea mays
  Clone ID: LIB143-015-Q1-E1-A8
cggacgcgtgggagcagggactacactctttcagaccctaacgtgcagctgcaagctgctgcacaaacgccagttctaaggtctccgggagtggcatggcagaacactgcatcagtaccagctgctcctttttatgcaagcacagcgacttcaactcctattggagttggacaggtggctgcttggaatcctaacatgcaggcagggagttttgcatctgcatcgactgcataccccaaccaaccattaatggccaactccatgcctcactatcctgctattggatcgagttccggtgccccaccagtatcatttcaggcttcgcagcagatgacacagtatagcatgccccctggtgctccgccgcacgcaccaccagctggccaatcaatttacttcccga

SEQ ID NO: 2954 - DNA, 424 bp, Zea mays
  unsure at all n locations
  Clone ID: LIB143-015-Q1-E1-A9
ccaccacctccatggggtcgtcggaggccgacgaggaccagctcctcaagagcttcctcgcggaggtcagcgaggccgagcgggacaacgaagtgctcaggatacttggttgcttcaagttaaaccccttcgagcatcttaagttgtcttttgattcatcaccagatgaggtgaaaaagcaatataggaagttgtcattgctggtccatcctgataaatgcaagcatcctcaggcacaagaagcttttgcagctctggcgaaagcacaacagctcctgcttgatccacaggaaagaggctacattcttgaccaagttactgctgcaaaagaagaattgagggcaaagcggaaaaaggagctgaagaaagacagtgcgtccaagataaaatctcttgtagatganggaaaatatgaagaacaatt

SEQ ID NO: 2955 - DNA, 287 bp, Zea mays
  Clone ID: LIB143-015-Q1-E1-B1
ggtccagggacgagtcagaccacgcatccgaccacgcgtccgctggatcatcgggctgcccatctcgtgcatctgcccctgctgcctctgcgtgacggtgctgctggaggtggccgtggagctcgtcaaggcgccgctccatgtcatgacctggtttacctccaagatcccctgctagctgtcccctgctttctgctgtgcggatcatacatacatcttgctttacccggagaggttgctgtactgtactgtactgttgtttcgtttcgtcgtcgcttggtccaaag

SEQ ID NO: 2956 - DNA, 413 bp, Zea mays
  unsure at all n locations
  Clone ID: LIB143-014-Q1-E1-H4
acgcaccacacgtcgagccgagcggtcgagccccaccccgttcccgccccgcgcctcgccttgagatctgtggcgtcgtcggcaccagtccgtccgtccgtcgtcggcgccggagaacgagtacagatggaggaggcggcggcggtagcggcgacggctgagaaggcggcgtcgtacaggtactgggtgcgggaggccaccggcgacgccgcgccgctccccgtcncgcgcaagctcgacaccgctgccaacgggaacgggaacccgccgcccgtcggctccgtctggaatcaggctggaacatgggaggaaaagaacctcaactcatgggccaatagtagaataaaggatttgatgggctctttaggttcattggccttccctacanggaaggcatctattgacgaagtgtc

SEQ ID NO: 2957 - DNA, 277 bp, Zea mays
  Clone ID: LIB143-033-Q1-E1-D12
ccgggtcaatacaataccctagactgattcgtaatacgtgaatgccacctcaaagatcttctacagtatgatcgaggttatcttcagcgtcggtctgtttacatagtcgaaagagtagggaacgtcgcgtctacataacttatgcggtctagcacacaacggcatttctcgatctggcttataaggtcaggtgccagctgagattgaccctgctctcagttactcagattgaaagtgaaatgagacgtgtcctgtagcagagcattatgctcaaggg

SEQ ID NO: 2958 - DNA, 418 bp, Zea mays
  Clone ID: LIB143-033-Q1-E1-D2
tcgcgggtcgacccaagcctctagagatagtctgatcatgaagatgatcctattgcaaaacgagacttagttcctagcatcgattcaaacagcaaacctagcactgtgactgatgataaccagcaattgaacctaaaggagtcacaagctctagaaaatccaataacagaattggccaaacgtctggggattgcactttctgaagaagtttcagcaagttttgttgacgaagccaatgataaagaacttgtggaattgtcatctagacttgctggtcaatcgcttccagctagtgaccaggttgcatcaattcaggtacttcgtgatcattggaaaagttctccagcaagctcactacaactgcaggaactaggacctttgctgagggactaacaacgccctcatcctgcgaacacta

SEQ ID NO: 2959 - DNA, 420 bp, Zea mays
  Clone ID: LIB143-033-Q1-E1-D3
acaacctctactaaggaggaacgaacggacaggttgttgcacagaagcgacatggctttcgcgcccaaaacgtcctcctcctcctcgctctcctcggcgttgcaggcagctcagtcgccgccgctgctcctgaggcggatgtcgtcgaccgcaacaccgagacggaggtacgacgcggccgtcgtcgtcactaccaccaccactgctagagctgctgcggctgctgtcacggttcccgccgccccgccgcaggcgccggcgccggcgccggtgccgccaaagcaagcggcggcacccgccgagaggaggagccgtccggtgtcggacaccatggcggcgctcatggccaaaggcaagacggcgttcatcccgtacatcaccgcgggcgaacccgacctagccacgacggccgaagcgctg

SEQ ID NO: 2960 - DNA, 337 bp, Zea mays
  Clone ID: LIB143-033-Q1-E1-D4
gcgggtcgacccaagcctctatagagactcgtagtatcgctcgtggctgccctgctcatactgcttgccctcgccgtatcgtccacccgcaatgcacaagaggattccatggccgacaacacctggacgttggcgggcggcatcaaggacgtgccggggaacgacaacgaccttcacctccaagaactcgcccgcttcgccgtcgatgagcaccacaacaacgccaatgctcctcaggggttccagaagcttgtgaacgccaacacacaactggttgctggcacgatgtactatctcactattgaactgaaggatcgcgaactgaacaagctctacc

SEQ ID NO: 2961 - DNA, 422 bp, Zea mays
  Clone ID: LIB143-033-Q1-E1-D6
agggaaacacatcgggtggcggcaaccggtagccggttcggctggcacgatgggcggcgaggccgagggcggggagcggcggctggggcgggtcctgagctttgggatcccggacacggcgctggggctagtgatggggtacgtggaggacccctgggaccgcgacgccatctcgctggtgtgccgccactggtgccgcgtcgacgcgctcagccgcaagcacgtcacggtggccatggcctactccacaacacccgagcgcctgttcggccgcttcccgtgcctcgagtcactcaagctcaaagcaaagccccgcgcggccatgttcaacctcatctccgacgactggggctggtctgcgtcgccgtggaatcgacagctctcgggcacttttcagtcccctcaagaagctccacctgcgc

SEQ ID NO: 2962 - DNA, 371 bp, Zea mays
  Clone ID: LIB143-033-Q1-E1-D7
acccatccgcgcccgccgcggctcctccggcagctccgccacgcgcccaaccgcaacctgcccgcacggccaccgctgcctggtagtatctatcaaatcagccacctgtcctctttttcttcaaatcaagtccgtttccctttcctttctaccctctccctcgtctccggcgggcggtggcctcacctccctctccccgtcgccctgatggctccctccacagctctcgctccggtggccttccgctccgccttctcgacgccgctcgcgtcgaaacctacccgtaatagaatgaacatatatggcgctttctgtctgccgtgttccacaaggaagagagcaagttatagagctttccgagtgtacagttt

SEQ ID NO: 2963 - DNA, 343 bp, Zea mays
  Clone ID: LIB143-033-Q1-E1-D8
ctcgcgggtcgacacacgcctctacaattcgtcttctaaacctcgacctctatccgtccgacccttattccgcacccttctctctcgcacctccgcactcgaatgccgccggctcacaatgatcattctcgacagaagcaccggatgaaccaggatggaagatgacaccccgctcacaagaaccatcaacggtacagtcaccagcatcaccaccagggacatctggggcacagtcatcaccattatattcaaactttgattgtattgaacacaacatctcgctccctgttgtcaacacgtggcccgatacctgctgcatctatggcaccagtatcaccaccat

SEQ ID NO: 2964 - DNA, 356 bp, Zea mays
  Clone ID: LIB143-033-Q1-E1-D9
gtcgatacacgactctatactgacgtcctattagctcgtcggctccaggtcagcaatcatgcaaagcagcggtccgagagatggacacgacgatgttccggctggacaaccgcctggtggcggctctgcatcacctgctggacgtgcccgatggcgacaccagagcgggtggctacaaggcgggcggcggcgccacgcgcacctacctccgcgacgcgcgctccatggcggcgacgtcggccgacatcaaggagctcgcgggagcgtacgcgttcgtcgtggacatgctggggttgaccacggaccacatctgggtgcaggtggtggacgagcaggttcttgtgatcaactgcgag

SEQ ID NO: 2965 - DNA, 229 bp, Zea mays
  Clone ID: LIB143-033-Q1-E1-E1
tcgcgggtcgacacaagcctctagtgtcactcgcctaatccatcgaacacgctaggcatctgaagctaccaccttccttgatcttccttcattttgtttctcaaacctggcttttaaccttttatcttcatccagtagctacttctggtattgcgagtgtaaaacagtgaggtctgggtgtcctacatcttattcatctatagcatatatagtactacttgttgcatac

SEQ ID NO: 2966 - DNA, 445 bp, Zea mays
  Clone ID: LIB143-033-Q1-E1-E2
tcgcgggtcgacccaagcctctagagtggctgctcggacggacaaggagcaggcggaggaggagttgtgccaagccacaatgggtatctcgcgtgactcgatgcacaagcgccgagccaccggtggaaagcagaaggcctggaggaagaagcgaaagtatgagcttggtcgccagccagccaacaccaagttgtcaagcaataagacggtgaggagggtccgtgttcggggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaaaagtgccattggtggcagttgatgctgccccatttcaagcagtgggacctcactcactatgggagtgaca

SEQ ID NO: 2967 - DNA, 386 bp, Zea mays
  Clone ID: LIB143-033-Q1-E1-E3
acccacgcgtccggccccctggaaccttcctgctgcctcagctacgtcccgccggagtccacggagcggccggcggcgtttgcgccggccgacctcaggcttctgctggacgggcacgacctgcccacgcgggactggctcttccgcgccatggaggagagcccccttttccgcagccggagttcgcggacgggatccagggtgttcgtggcgccggacttcaacgacggcaaggaatggcagcgggaggccaccatgcggcggatcgcgtacctgaatcggcgcggcgtgttccgcgggtggctcaccgaggacggcgctgccgccgagctccgcaaactagcgctcctcgactgcatcgccatctatgaccactctctcgccat

SEQ ID NO: 2968 - DNA, 378 bp, Zea mays
  Clone ID: LIB143-033-Q1-E1-E4
agctgactgtttggtgtgagcagggtcagagagacttgaaagaagtgcactggcacccacagataccgtcgatgatcatatcgacggcaatcgacggcttcaacgtgttgatgcctagcaacatcgatacaaccattcctggcagcacagatacagcaatgccgcctgctgagccataggttaggtgtttctggtagctcatgattccaggttcatgcggtggtgagtgtagttgccatttgtcatgtgtcgacagtgctatgctgtcgtgttggagcatgatgggaaaattttgattggctggcgttctatgataatatgattaggatttaataaaagaaaaaaccggccgacaaaataaaaaaaaggggcggcgct

SEQ ID NO: 2969 - DNA, 383 bp, Zea mays
  Clone ID: LIB143-033-Q1-E1-E5
tacccacacgtccgcgcctgtgtgataaactacgattttccagagtcggctgctgcctatattcacaggatagggcgatccggaagagccggtaggtccggggaggctatcacgttcttcacagaggaggacaagccattcttgaggaatatcgccaacgtgttggtatcttcaggctgtgaagtgccttcctggataatggcactgccaaagctcaagcgaaagaagcacagagtggatagggacccaatctcctacctacctgacgaagtttgagagcggcttggtaagatgctctatttatttatttttgtggggagggggggatatataacacaggctgtccagagtggtactttaaccatgcacttccgagaggtggc

SEQ ID NO: 2970 - DNA, 428 bp, Zea mays
  Clone ID: LIB143-033-Q1-E1-E7
actcgcgggccgacacacgcctctagacagcagtcgcacgacacctccaatcaacaaattcccaatccgccgcttcccatcccgcgttcgccgctccatttgatcgaattcccgatggcgcccaaggccgagaagaagcccgcggagaagaagccgacggaggagaaggccgagaagaagcccagggcggagaagcgcgtgccgggcaaggagggcggcgagaagaaggggaagaagaaggccaagaagagcgtcgagacgtacaagatctacatcttcaaggtgctcaagcaggtgcacccggacattggtatctcgtccaaggccatgtccatcatgaactccttcatcaacgacatcttcgagaagctggctgctgaggccgccaagctcgcccgccacaacagaaggccaacaataacctcccg

SEQ ID NO: 2971 - DNA, 334 bp, Zea mays
  Clone ID: LIB143-033-Q1-E1-D11
actctatagggactcaatataatcatcctccactgcctcatgatgtcacacctaacactgggacaccatctcttgtggtaatatccagcagtatcgtcacatgacattgtagatcaaacagcgcatagcgaacctcacgcacttggaaatcccctaaggtcgaggttcgtcacgtcaacaatgatcaagttacagtcctcgccgtctcacagcatattggtactacttcagaggacgatgttgccatcgaaggttgaggataccactttaataactgcacatgcggcactaccgttggttgctcctgctgaacctctgtgtcaaaccctcaagc

SEQ ID NO: 2972 - DNA, 395 bp, Zea mays
  Clone ID: LIB143-033-Q1-E1-B10
ctcgcgggtcgatacacgaatctagcataaatcgatttactcctcatgtggagagcctccagagtcgcacatgtactcttacacgcaccgcaatggaaatttgaccgttctagtgaaacgtctggtgccccaacaccatttgcctggtgaatctgaaggaaaagtatggatgtggactaggtgctcaagatgtgatcatgaacatggggtatccaaaccaactccaagagtactaatatcagctgaagcgcgtaacctctcgtttgggaaattcctggaactcagtttttcgagccactctgcagcaagaaggttatctatatgtggacatctggtcaacagggattgcttgcgtttttttgggctgggctctaaagttgctatgtttcggtact

SEQ ID NO: 2973 - DNA, 393 bp, Zea mays
  Clone ID: LIB143-033-Q1-E1-B11
cccaggccaatacaacactctataatgagtcatattaggtgaccatcaaatttgctgctcgcgctgatctccaccatctggctatgtttcttgctgggaggcagccagatgcccctcaagaggctcttcaagtacttgacatcgtgctacgtgaaatgcctactgccaagtattgtcctgttggtagatcattttattctcccaagttagggagacctcagcaacttggtgaaggtttggaaacttggcgtggtttctaccaaagcataaggcccacacagatgggtctttctctgaatattgatatgtcctctactgcattttttgaggccctccctgtaattgattttgtttctcagcttcttaatagagatatctcagttagaccattgt

SEQ ID NO: 2974 - DNA, 182 bp, Zea mays
  Clone ID: LIB143-033-Q1-E1-B3
agacagaaccgagcgtaagctgctgaggtaatgagcgaacccattcgtgatccgggcgctcatcgcgctcatcctcaagcgccgcaactcaccgtaagccgaggagaagcacatgcagaaagtgactgatcgcgaagctcgagccttctgctaaaaaaagatggggtgcagctgcagcacca

SEQ ID NO: 2975 - DNA, 374 bp, Zea mays
  Clone ID: LIB143-033-Q1-E1-B5
ctcgccggtcgatacacgcatctacactgactcgtgctaacgcgtccgcccacgcgtccggaaacatgaaacctgcgaggctgccatcgcaatgtacctgaacctctcctgcatccccgaggcacaggcgatcatcggctcgagcgtcgccatccatttcctcgtcaacagcctaggggaaggtggcccccggagcgacacctgccgcatggacgcgctgctcaccctgtacaacctgtccctgcacgcgcccaacatcccacccctcatggcgtccggcatcatcgagaacctccgccgcgtgctggtgccgtcctccccgtggacggacaaggccctagcggtcctgctgaacctggcgctgacccggaaga

SEQ ID NO: 2976 - DNA, 402 bp, Zea mays
  Clone ID: LIB143-033-Q1-E1-B6
ctcgcgggccgacacacgcctctagactccatccaactagttttccccaccccgcttgcgcttccatccgtgagctcatccgcccagctggaaaacaagaatcctcatgagttctagaagggaagtcgcgatctctgggtgaggtgtccgtttcctcccgttgctggatccgctgactgaccgatcggcagagccgccatggcgtcgtcgtgcatcccggccggcggcatccggctgccggacctggagatggtcaaggccgcgccgccggcgcactccgcggcgtcctccacgctctcggagtcgtccagcgcgtccgcagtctcctcgtcggccacctcgtcatcggtggcgtcgctgtcgctcaagcgcccgcgcacgccgcggaagcggtccagccag

SEQ ID NO: 2977 - DNA, 111 bp, Zea mays
  Clone ID: LIB143-033-Q1-E1-B7
aaaaagttgcgaaaaaaaaaaaaaaaaaaaaaaaaaaaaaaaggcagaagcacaaaaggataaaaaaaataaataaacatgcaagaaaaagatcaataaatcttcgggagg

SEQ ID NO: 2978 - DNA, 396 bp, Zea mays
  Clone ID: LIB143-033-Q1-E1-C1
gtcgacccaagcctctacatcgcgtcgctatacagacaagccacccccacgccacgaaacccgcaatcccagccgaagccggacgatgaagagggagggatggcagcacggcgccgtccgggccagccgcagcaaggtgcttaggacggccgccggcgacgacaactccgacgccgccgcggtcgtggaaacggcggcggcggcggcggcggcgaggaagccgacgaacgcgtcccggagcacgggcaagtgccggcgggcccggtgcgcgggctgccacgcgcacccggtctccaaggcgcgcgacaaggccaagggcccgcgcaagctgcgcgcctgcgacgtcgcgctcaaccaccgcctcgtgtcctggcgcgtcctcgacagggccccggg

SEQ ID NO: 2979 - DNA, 397 bp, Zea mays
  Clone ID: LIB143-033-Q1-E1-C10
gcgggtcgatacaagactctagattgagtcgtagtaaaaaagattattgtattgcaaaggagctacaatgtggcggactttccaggatactatgttttccctggaggacactcggagccgcaagaaattggaatcatgggtcatcaaactgatgaagaagactttgctagtctcaatgaacgagtttcacaagaaatgtttgaaggagtcatccgtgaagtggttgaggaaactggagttcctgctagctccctaactgatcctgtcttcattggagtttcccgccgagaagttaacgctaggccgactgcgttcttttttacaaaatgtaacattgattccagtggcgtaagcgagctttattctagagctcaagatggctatgaatctaataaac

SEQ ID NO: 2980 - DNA, 363 bp, Zea mays
  Clone ID: LIB143-033-Q1-E1-C2
aagaaaactcactccactctctctctctcctctcgcctccgtcggccgtcgccatgacccgcgtcctcctccccctgcttctgctgttggcgctgcctggtgcgtatgcacgcccggcgcggcagtatttgggacagtgtccggggctggagtacaggctgccgccgttcgccgccgcgctccgggcaacctgccccgtctcgacggaggggtactcgtccccctacgaggttgttagtggggaggagcttctgaggatgttggatggcaaggaagagcacacggctgtccttttctatgcatcatggtgccctttctcgcaaagaaccagatcagtctttgatgatctgagctcaatgtttc

SEQ ID NO: 2981 - DNA, 362 bp, Zea mays
  Clone ID: LIB143-033-Q1-E1-C3
tagaaacagtctggatagttctgggtttgcccaaatggcggcaaagagtgccattacaggcatgcccttccgcctggatacgtactgaaatcacaaatgaaggccttactagaggaagagagtgagaagatagctattgaagatgagattgaagatcagcgtaaaaagacaaagactacaacccctatgacaacggaattgttcatggaatggaagaggaggaaggcagaagaaagagaagctggtcaggctgccttgaaagcagagagggctaagaatgatcgcatgattggccgtgagttgttcatggctgacgcaagtgtgtttgttgatgatgctgaagcatatgaagtatatgagag

SEQ ID NO: 2982 - DNA, 384 bp, Zea mays
  Clone ID: LIB143-033-Q1-E1-C4
tactcacggtcaccagagtgaccgcgatcgtgagcgcgcggcggcgcggaagcccaacggcaaggggccccaggacgggctcaccccggagcagcgccgtgagagggacaagaaagcgctggaggagaaggcggccaagaaggcgcagcaggcagcggccggcggcaccgggacctccacggacaacaagaataaggcaggtggcaagaagtaggccgcagcggcgagcggcgccacctctgtacgattatcgatccatgcctttagcttgtaacctgttcgcatcctcgtagatgcgatgcttgttgggtcataaactcgttttctgttactctgatatcaaaatttggtgatgagaataatacgtggtgttccggttttgtg

SEQ ID NO: 2983 - DNA, 193 bp, Zea mays
  Clone ID: LIB143-033-Q1-E1-C5
actgtcatgggatcccagccaccgccgctagaagaagagctcggcgattctcaggtcccgcgagaatatgccgaagcagatccatgagattaaggacttcctcctcaccgcgaggacgaacgatgcccgctcagtgaagatcaagaggagtaacgatgttttcaagttcaaaggtccgctgccccaagtacct

SEQ ID NO: 2984 - DNA, 396 bp, Zea mays
  Clone ID: LIB143-033-Q1-E1-C7
actgctgcacagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctggacagtgtggccgagctgatgggtacatccttgagggtaaagagcttgagttctacatgaagaagctacagaggaagaagggcaagagcgctgtagcttagagcattctcatggattgtcttgcaccgaaatgtgtgtcctgatgagtacactttttttggttagtcgtctcaagttcagagcgttatgccatgttttcagtcctgattagtaca

SEQ ID NO: 2985 - DNA, 406 bp, Zea mays
  Clone ID: LIB143-033-Q1-E1-C9
cccgggccgatacacgactctatagagattcgtaccatcttacttcagatggcaacactaaggatgatcttagactcccaactgatgagactcttgtggcccagatcaaggaagggtttgaaagtggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatgtcaaacacaagtgcagggatcgctgggtgttgcaccgtgtctgcattatctgtggttacattctggaccctgtattttctatgcttttatgcccc

SEQ ID NO: 2986 - DNA, 317 bp, Zea mays
  Clone ID: LIB143-033-Q1-E1-D1
acgcctctagaatgagtcgtattaatcaacaagcaacatgaagggatcaacccaacaacagaagaccgaggtaaagattccgtgcacgacctctatattctgaggactgaaggaccgagcagcagccatgcgtccgggacaccttcaaccatatgacgaacccacgcgatcgtcggggcgcacaatatctcggtggaggcctgccacgcgcaactcacgccgctgcacctgcccgcactgctggctgccgacaaaggctgcatcccgccgcacgccgtcacagcggcctctgggggcgacagatcggcccgggactc

SEQ ID NO: 2987 - DNA, 405 bp, Zea mays
  Clone ID: LIB143-033-Q1-E1-D10
gggccgatacacgactctagactgcctcctagaaaccctgcacggctcgccgagacttcagtttactggagcacgcaccgcaacgtctcccccttctgctcatcctccgtccctccgtcggaagggctggcgctaagggacgatccctccgtccgcccgtccgttcgacgggacctcggttggtttcgtcggtcgctgggaggacaggtgacggaacggtgatatgaggcggtggttatgttgtaactgccactatgacgttgaggaagatgaccacgccaaggaacaggccaaagctcagagcaataagaccgactccaagcagaagtcttcaaagcctcctggtagtcaacctgagccagagttctcccctcctacaattgatgtccctgaattgtccttgga

SEQ ID NO: 2988 - DNA, 351 bp, Zea mays
  Clone ID: LIB143-033-Q1-E1-A9
ggtcgatacacaactctacaatgagtcgtactacgcctgggatcacggattcacatccatcagcacagaatcgatcacatatgactgcatttgtccagaacctccttgggaagatgcaaacaacgttcaagtcgatgtcacatgacattgtgtcaaagataaatgatatgggaaccaatattgatgagctcgatgagagcatcaacgatctgaacgctgagatgggcaaggatactccggtcaagaagcctgatgagccaacgcctgctgacgctgcctaacatgggtgtaaccctgagattgttgtgttaggatttgataatcgtgtgacgaatttcagcaggacgtgat

SEQ ID NO: 2989 - DNA, 455 bp, Zea mays
  Clone ID: LIB143-032-Q1-E1-H5
gactcgcgggtcgatacaagcctctaaattaatgcccattaagttcgccatcggcagccgagcaccatgagctccacaggcggcgacgatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccaaccgcgttcgcatcttcgtcgacaccgtcgcggaggcaccccacatcggctgagaatcaaatctataacatgaataactcggacatgtcatgcgtgcatgtccgtcgccgaataatggatgtgtgtgcttcggtccaataaattgctagtaaaaataatggcatcgtcggtatgcatgactaaaatgtatcagaatgttcatcctttcacgattggatatatgaaaatg

SEQ ID NO: 2990 - DNA, 391 bp, Zea mays
  Clone ID: LIB143-032-Q1-E1-H6
aacgaattaccctcggtgccctccctctcggcggcggcggcgcaagtccccttcatctccggcgcggcaaatggcaggcggcagggttgcacatgctaccctcaagggccccagcgtggtgaaggagatcttcattggactgaccctgggtctgatcgctggaggtatgtggaagatgcaccactggaacgagcataggaaaactatatccttctacgacatgcttgacaagggccagatcgtcgtcgtcgaggagtagttcccacgtgtcacctcagaagtttttttttccagttgtttttgaaaactcactctggacagcacgacacagtgaatactgtggagatttggcttgaaaataagcataaccatttgataacatgtaattgcc

SEQ ID NO: 2991 - DNA, 438 bp, Zea mays
  Clone ID: LIB143-032-Q1-E1-H7
agcctctacactaaatcgcccaagacggacatgcggatgcgcgccgacccggccacgggctaccccggccggacgtaccggttctaccgcggcccgacagtgttcaacttcggctacggcctcagctactccaagtactcccaccgcttcgccacgaagccgcctcccacgagcaacgtcgccggcctgaaggcggtggaggcaacggcgggcggcgtggcgagctaccacgtggaggcgatcgggtccgagacgtgcgaccggctcaagttccccgcggtggtgcgggtgcagaaccacgggcccatggacgggaagcactcggtgctggtgttcatgcgctggcccaacgcgacggacggcagcggacgggcggccagccagctgatcgggttccagagcctgcacctgagggcgacgcagacggcgcacgttgag

SEQ ID NO: 2992 - DNA, 321 bp, Zea mays
  Clone ID: LIB143-032-Q1-E1-H8
gactcgcgtttcgatacaagcctctaaactgagtcttgttacagatcaaaataaaaaaggtgtgatcctcaaaaaagaaaaaaaccaacaactccaaagcctaaaacgtcaccagggagatattacaccctcttggtctcttctattgcttcgagttaatggagtatatctggcagtgggatttgtattataagataaccggatgcattatcatttttgcctgtactggtcctactggagttagttggatacatgtttttgtgtgtcaaatacattgatgtaactactgttctacctcgacagcagtctgggctagtcttt

SEQ ID NO: 2993 - DNA, 431 bp, Zea mays
  Clone ID: LIB143-032-Q1-E1-H9
ctcgtgggtcgatacaaccctctataatgagtcgtgataccgcaggcgccgccaccaccaccaccacccaggcgccaccggcatccgagaaggcagccgccgccgagcccgtcaaggacgagctgtgagcatccaaggtgtggacggctgtggctgcgtaagcatgggaggaaaacctggcgctaacgtgcctccaacgcctagtttttgcgggaccagagggagagagagagagggacggagttagagagagaggggatctgcgacgtgttttgctctgcggcggcatgtctgtgtatcccattgaggttatgtacacaattacaccgcggtcggtgggtgttttttagttaattatcacaagtgacagtagaaaggaacagattgtgatgaggttgaatggatgaaaaaaccgctagtccgcccaaaaa

SEQ ID NO: 2994 - DNA, 400 bp, Zea mays
  Clone ID: LIB143-033-Q1-E1-A1
ctcgcgggtcgatacaagactctagactgagtcctctaaaagtacctataatggatccctcaaaagcatcaaaaaggcctgttggaattctacttgtgaaggttgtgagagcccaaaatctgcggaagaaggatctgctgggtaaatctgacccatacgtgaaacttaagatgtcagatgataaacttccatccaagaagacaactgtaaagcgcagcaatctcaatccagagtggggtgaagacttcaagtttgttgtgacagatccagaaaaccaggctcttgaagttaatgtcttcgactgggaacaggttgggaaacatgaaaagatgggaatgaacatgatcccacttagagaactcctaccagaggggactaaagttactaccctcaacttgct

SEQ ID NO: 2995 - DNA, 375 bp, Zea mays
  Clone ID: LIB143-033-Q1-E1-A10
aaagaaagctagcaccatgagcttgtttttcaaaagcagtactggacagatagtttcattcagtggtcccctctgggaacctacatggcaacggttcataggcagggatcacaggtgtggggcggtgaaaatggcttcgagcgtttgatgcgttttgctcattccatggtgaaactgattgacttctctcctggtgagaggtatttggtcacatacagcagccatgagcccagcaaccctagagacacacatagagttgtcctgaatatatttgatgtaaggactgggaaagtgatgcgagactttaagggaagcgctgatgattttactactggcgggaatattggggtttctggtgtttcatggcctattttc

SEQ ID NO: 2996 - DNA, 392 bp, Zea mays
  Clone ID: LIB143-033-Q1-E1-A2
aaattctttcagtcaaggatctttgactattaacaagctacctgaaaaaatattagaaaacaattagaaatgaaaaaggcaaaaaaaatacataaaatacagtgaaaatttagtagaggtaacaagataacttgcttgatattttgtctgtttcaactttcaacttctcatgctggcagcctatagtatctccttgtgctcaaggtggctgatggcatcagtgtctaatgtcacattgtggacagtgttgcaaatcattggattagttttttgtataaacgtctagaatgcatcctcttggatatagtttttgttcttttttaacataagaaaggttgaggcgtgatgcttgattgattcgtttgcgtaatgtgccagaaaaagtggttttg

SEQ ID NO: 2997 - DNA, 410 bp, Zea mays
  Clone ID: LIB143-033-Q1-E1-A3
aaaaccctcttcttcacccttcccgtgctcgacccagatcgagggctcgatccgtcggccatggcgctggagtgggtggtgctgggctacgcggcgggcgcggaggcgatcatgctgctgctgctgacgctgccggggctcgacggcctgcgccggggcatgatctccgtggtgcggagcgcgctgaagcccatgatgtcggtggtgcccttctgcctcttcctgctcatggacatctactggaagtacgagacgcgccccacctgcgacgacgagcacgcctgcaccccctccgagcacctccgccaccagaagtccatcatgaagtcgcagcggaacgcgctcctcatcgccgccgcgctgctcctctactggattctcttctccggtcaccagctcgtcgtcaggct

SEQ ID NO: 2998 - DNA, 378 bp, Zea mays
  Clone ID: LIB143-033-Q1-E1-A4
cccacgcgtccgctcgaaagctcgaaagatcccgcggcgcagcagccacccttctctcctctccgctcccaatcttatcgtcgcctccctcgaagtcgccgctgccttcattccaccatggcgcttcacgccccggtccacgtgatgaaggactcgctgaagcgggagtctggcgcgaaggttcaccaagccaacatccaggcggccaaggctgttgctgacatcattcgcacgacattgggtcccagatccatgctgaaaatgcttctggacgctggtggaggtattgtggttactaatgatggtaattctattttgagggaaatagacatcgcacaccctgctgccaagtctatgattgaactaagtcgtacacaa

SEQ ID NO: 2999 - DNA, 418 bp, Zea mays
  Clone ID: LIB143-033-Q1-E1-A5
agcacaggccgcacgtcgtcccgaccccggccccgccgcctccaccgcacgtccaccagcacgaccacggcgtcgtcgtccaggacgacgtgaagaccgggaccccgccgcatgcaccggaggaggagaagaaaggcctgctggacaagatcaaggagaagctccccggtggccacaacaagaagcctgaagccgctgccgctgccgcaccggctccgcccgtccacgcgccggcgccggcgccgcaggcggagaacgtgagcagcccggatggcaaggagaagaagggcggcttgctgggcaagatcatggacaagatacccggctaccacaagagctcagctgaggaagcagaccacaaggcggacgccgcccggcagcacaggaacagctcctaaggtcgcagtcccagcgcgtg

SEQ ID NO: 3000 - DNA, 221 bp, Zea mays
  Clone ID: LIB143-033-Q1-E1-A6
actactggctcagagtgttcatggagtccggcgacgcgcacccagaactgccgcagatttagaccgctcgcgcgagaattttcggctcctaattgattcatcgttcttttgtctctatctctctctgcacgtcttgcatcggaggggacggacaaggacagcagcagctgattaacagagaaggaaatcaggcagaaacaacgcgacacgccgttgcaact

SEQ ID NO: 3001 - DNA, 412 bp, Zea mays
  Clone ID: LIB143-033-Q1-E1-A7
ctcgcgggtcgatacaagcctctacacttcgtcctgccaccgccgcgtccgcctcgcccagcgcagcagccgccgcagcacatcgctatctcgatctcagccatggcggaggtggagcagcaacaggacacgccgaagctgttcaaccgctggaccttcgatgatgtccaggtgaacgacatctcgctgaacgactacctcgctgtgaacgcgacgaagcacgcgatgtacctgccgcacaccgcggggcgttactccaagaagcggttccgcaaggcgcagtgcccgatcgtcgagcgcctcacaaactccctcatgatgcacgggcgcaacaacggcaagaaggtcatggctgtccgcatcatcaagcataccctggagatcattcacctgctcaccgatgccaacccca

SEQ ID NO: 3002 - DNA, 424 bp, Zea mays
  Clone ID: LIB143-032-Q1-E1-H3
acaatacgacttaatccccaatcaacacagcaagtcagcaacaagcaaagcagcgacccgagagatggacgcgaggatgttcgggctggagaccccccgggtggcggcgctgcatcacctgctggacgtgcccgacggcgacaaggcgggcggcggcgccacgcgcacctacgtccgcgacgcgcgcgccatggcggccaccccggccgacgtcaaagagctcgcgggagcgtacgcgttcgtggtggacatgccggggctgagcacgggcgacatcagggtgcaggtggaggacgagcgggtgctggtgatcagcggcgagcggcgccgggaggagcgcgaggacgccaagtacctgcgcatggagcggcggatgggcaagttcatgcgcaagttcgtgctgccggacaacgccgacgtggac

SEQ ID NO: 3003 - DNA, 395 bp, Zea mays
  Clone ID: LIB143-014-Q1-E1-G10
cacacgcgtccgctcacaacccagtcgctcaaaaccctagagctctcgcctgctcgcctccgccgccggagcgagctccccatcttcatccgtcaaccgtgggctctgtgccatcgcgcaggccgagtccctccgttacaagctcctcggaggccttgccgtccgcagggcttgctatggtgttcttcgttatgttatggagagtggtgccaagggttgtgaggtgattgtgagtggaaagctcagggcccaaagagccaagtccatgaagttcaaggatggctacatgatctcatctggtcagccagtgaacgagtacattgactcggctgtgagacacgttcttctcagacagggtgttctcggtatcaaggtgaagatcatgcttgactggg

SEQ ID NO: 3004 - DNA, 426 bp, Zea mays
  Clone ID: LIB143-014-Q1-E1-G11
aatcgattccatcccatgggttggcgttggcacgacgacgacggtgacagcggccggggcctcggcggtgtccctgacctcgctggtggcgggggcgatggggcgcagtgcgccacgcgacgggtggtgcagtcccgctgccacacggaggaagtcgagcccggccgatttgtccgcaagtgcgagaagacggagcagctcctccgcgactgcgtcggcaggccctctgaactggtggaatccaaaactgaaaacactgaagaagatgtcacagaagaaatgaagagcggttcactttctcttgggtttccaagaaacgagcccttcgcattccctggactccgcagtgacatggaagcccttgagaaagacttctttgggagcctagggaacgtcctggatgaagctgagcggatggccaacagc

SEQ ID NO: 3005 - DNA, 411 bp, Zea mays
  Clone ID: LIB143-014-Q1-E1-G12
gggccatagacgcgtccgaatccgcatcaacccagctgtgactttcgggctgttcttagccaggaagctgtccctgactagggccctcttctacatcatcatgcaatgcctgggtgccatctgtggagctggagtggtgaagggcttccagcagggactttacatgggcaacggtggtggcgccaatgttgtcgcacctggctacaccaagggtgatggccttggcgctgagattgttggcaccttcatcctagtctacaccgtcttctcagccaccgatgccaagaggaatgccagggactcccatgttcctatccttgccccactgccaattgggttcgcggtgttcctggtccaccttgccaacatccccatttatggcactggcatcaacccagctaaggacccttg

SEQ ID NO: 3006 - DNA, 436 bp, Zea mays
  Clone ID: LIB143-014-Q1-E1-G2
gaaaataaatgcctcttcttcttgctctcgtcgtcctcgtctccgtcccaatggagttgagcgccgtcacctgtcgcactgccgctgctccagttgcagcctgggcgccatttgggcgtccaagggagcagacgacgaagcgaacaagcctcacagacaggcgaggcggccggccggcgagcagctcgcgttgagccctctcgcaccactacatacgctgttgcatgctttgctgcgagctgtgcgcgcgcgcgcggagcatggagatgcatggaggcggcagaggtggtacggtgcagtgggtgtgagcgcgtacgtggggaattgaggcgtcatggtccgagatatatacatgtctctcttgctaggtaccttagattattcttagttctgttgttagtacgtacttcgtccgacgatcctggaatattgtgtt

SEQ ID NO: 3007 - DNA, 418 bp, Zea mays
  Clone ID: LIB143-014-Q1-E1-G3
ggggccacgcacgcgtccgaaaaagacgtacaccaagcccaagaagatcaagcacaagcacaagaaggtaaagctcgcagtgctgcagttctacaaggtggacgacgccaccggcaaggtgacccgcctccgcaaggagtgccccaacaccgagtgcggtgcgggtgtcttcatggccaaccacttcgaccgccactactgcggcaagtgcggcctcacctacgtctacaatcagaaggcgtaatcccatgcgccgctttgcttcacccgcctacctatcaagcattcacctgttggttactcgatttgaatatcatttagatctgtttgaggttggaacataaatgcagcagtagtttctgtcttattatattggtacctctgttactgagttgatgtggtcctggttcctgagctt

SEQ ID NO: 3008 - DNA, 330 bp, Zea mays
  unsure at all n locations
  Clone ID: LIB143-014-Q1-E1-G4
acgcgtccgcagacgcatgggtttgggacataattgtctgcaccttctattttaggttgtaagttcaaatgggaaacgggtcaagaggttacatccattgccacacaaagaattganagattcaaagaaaagcactgttttggtcgaaaatctacctccagatttctcaatggagagtattcaagaaaaattcgcaacagtgggcaaagttgtgaacataacaattaatgatccagaatcagtgaaagaattttcaactgctaagaagcctgacttcaatttaagttttaaggctcatgtacttgttgaatatgaagcaatggaggctgc

SEQ ID NO: 3009 - DNA, 436 bp, Zea mays
  Clone ID: LIB143-014-Q1-E1-G5
catcatttgcatttatattacttacgtttgtttcaatgaacttgatactatctgtcacactcacacatctgcttcttactgacctggctgatgactgatgagaagtcttttcgttttttagacggatcctgattttgacttggatattagagatgatgtccaagatgaatgttccaagtttggtgcagtgaagcatatttttgttgacaaaaatactgcaggcttcgtgtatctgcagttcgatagtgtaactgcagcagggaaggcccaacaagcacttcatggaagatggttcgccggaaagatgattacagcgacatttatgtccgatcaggaatacagtactaagttcccaaacttgtgagcatatgcggggaagagttggtcagacccgcatagttcgttcggagagtttgctagtgctgtatcgttggat

SEQ ID NO: 3010 - DNA, 427 bp, Zea mays
  Clone ID: LIB143-014-Q1-E1-G6
gacgccgccgccgccgcctaaggagaagagggtccggccgtctccttgccccgatggcgtccgagaagaagcagtccaacccgatgcgggagatcaaggtgcagaagctggtcctcaacatatccgtaggggagagcggcgaccgcctcacccgcgccgccaaggtgctggagcagctcagcggccagacccccgtcttctccaaggcgaggtacacggtgcgctcgttcggcatccggcgtaacgagaagatcgcctgctacgtcacggtcaggggcgacaaggccatgcagctgcttgagagcggcctcaaggtcaaggagtacgagctgctcaggaggaacttcagcgacaccggctgcttcgggttcggcatccaggagcacatcgaccttggtatcaagtatgatccatcaacaggcatcta

SEQ ID NO: 3011 - DNA, 440 bp, Zea mays
  Clone ID: LIB143-014-Q1-E1-G7
cacgctctcctcgcgttcgggaaggtcgtttcgccatggcctcggagacggagacgttcgccttccaggcggagatcaaccagctgctctcgctcatcatcaacaccttctactccaacaaggagatcttcctcagggagctcatctccaactcctccgatgccttggacaagatcaggtttgagagtttgacggacaagaccaagctggatgcacagccagagctgttcatccacattgtccccgacaaggccaacaacacgctgacaatcatcgacagcggcattggtatgaccaagtcagaccttgtgaacaaccttggtaccattgcgcggtcaggcacgaaggaattcatggaggcacttgctgctggtgctgatgtgtccatgattggccagtttggtgtcggtttctactctgcctaccttgttgcagagagg

SEQ ID NO: 3012 - DNA, 202 bp, Zea mays
  Clone ID: LIB143-014-Q1-E1-G8
ccacgcgatccgcacatccgcacctctctccagctccctgctcctccgcctacgtcgtgagttcaaatgggaaacgggtcaagggggtaaaaccaatggcaaacaaagaaatgcaaggatccaaggaaaacatggtttggccaaaaatcaactccaggattcccaaaggggaagtatcagaaaaaatcccaaaatgggcaaa

SEQ ID NO: 3013 - DNA, 362 bp, Zea mays
  Clone ID: LIB143-014-Q1-E1-H1
cgtccgcaaccaaatccatccccatcgcgtgacccgtgcacgccgccgcttcaagtcctaacaagccgcatcgcatcgcatgcgtgtgctgtccgaccgccatctccgcagccggctggcctagctaactcacctcatctcacgcaggcacactgcacacacacccatggtggtcgcggcgatgctgctgccgtgcgctgtgccagcgctgctggtggcggcggcgaccgcgacgccagtgcgtctgctgccgccgtcaacgtctagcgcgcagccggtgccctcgccgagcgcagagccaggcctcgcggggcgggatctggatcgactcggagtgcctgaactcgctgcgcaacatgtcg

SEQ ID NO: 3014 - DNA, 435 bp, Zea mays
  Clone ID: LIB143-014-Q1-E1-H10
catccggaacatcccgcaccgggtgcccgacctgcccgccaaattcaagtccatgctcgtgcccggcaagatccaacacatcatctgctctggcaacctctgcatcaaggaagttcatgactacctgaaaagcctttgccctgatctccacattactggaggtgaatatgatgagtatgctcgatacccagagactaagacacttacaattggtcagtttaagcttgggctgtgccatggtcatcaggttgttccatggggcgacctggactccctggcgatgctccagcggcagctggacgtggacatcctggtgaccgggcacagccatcagttcaaggcatataagcacgagggaggcgtggtgatcaaccctggctctgccacgggcgcctacagcagcatcacttacgacgtgaacccaagctttgtgct

SEQ ID NO: 3015 - DNA, 413 bp, Zea mays
  Clone ID: LIB143-014-Q1-E1-H11
cccacgcgatccgcacacgcgtccgcccacgcgtccgcccacgcgtcaggaacaactccaactcccatctctcactacggcaacacattgccagctcagccatcatcggtctcggcggatagcggggcagccggagatcactatggactgggtgcaagcggcgggagactcagcatcgtggagcttggcgctgtcgctggaggagatgctggtggtggtgtgcactctgggcacggctgaaggacggggcggagctcctgtggtggtgatacgcggagctgcgctgtcagcgcggacgtgcgatgaaatctacctagtggttcgaggcgacacactgctcagttatcaggacatctgcagtgagcctctcatcctgtagcggcacttgcatgtacacgatcccaacgaagtct

SEQ ID NO: 3016 - DNA, 434 bp, Zea mays
  Clone ID: LIB143-014-Q1-E1-H12
ccggggccacccagcatccgcagacgagcaaaccctagcgagcgagagagcccggagccgagagaccagccagccatggcgctgcgtgccctgtacaacgagatccggagcatgaacgtccgcgacgtgccggcttacctgaagccgcgcttgacctgtgacaacgtcaagaagagcgacgaccaagccgtcgaccgctacatcgagaagtacatcgacacgagctcgccggaccctctctaccacgtctgcatcggagggatgatcttctcctacttcgtcaatctgccctgggagcgcgcccacctcgcccacctcgaggagatggagaggaccggtgggaagcactagatccgctgccccgtccctcgccggcagcgcgggaggacgggtgactttcatggggtccattcatgctgatggcttccgttttc

SEQ ID NO: 3017 - DNA, 454 bp, Zea mays
  Clone ID: LIB143-014-Q1-E1-H2
gggacacgtccgaaggaaaccgatccatccaagccaagccaaggcagagaagaagaagaagaggaggaagaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacgccatctacgccatcaccaagaacaactagctagtcatccttgccgacgacgatccatgtctctgtatctgcgtctgttcatatgcctgatgccgacttgtgctgtatgtagttgcttgaattcagtcgtgttttgctaccgtacccaccccatgcatcatctgtcaccgcgacgcaataatcatagtaataacaagttcagagattgattcattcgctgc

SEQ ID NO: 3018 - DNA, 365 bp, Zea mays
  Clone ID: LIB143-014-Q1-E1-G1
aagggaagtgcgcgttgtggtagttatgctgatgctgatggtcggtggccgattacatacactgcaacttctggtgtatgctcttctcttctggggacacgtaatgtaaccacaaagactgtgtcactgtagcctgtggtacaaaccctgctgtgtatcagcctgtctacaaaatacagcgatgagttgtgacgttacgtttctgacaattcagctactaatgagcacatctttgcattactagagctaagagaagttgatgaactgtcagccatctgcagcacagatcctcactatgcatcagaatcactcttgtttggattatctggatttatgatcgacttaagaatggtggagtttctgca

SEQ ID NO: 3019 - DNA, 442 bp, Zea mays
  Clone ID: LIB143-014-Q1-E1-E7
cccacgcgaccgcagacacgtgggtgccgcaagagatacaatagcggtatccaagcatatttctttctccgactccgagtgatttgcgctgaacgatcagtttccagagcgagcggagctgagcgagcttgcgttgcttgagagaccctgccatggcttcccaccaggacaaggctagctaccaggccggcgagaccaaggcccgcaccgaggagaagaccgggcaggcggtgggggcgaccaaggacacggcgcagcacgccaaggaccgggcggcggacgcggcggggcacgcggcgggcaagggccaggacgccaaggaggccaccaagcagaaggcgtccgacaccggcggctacctgggaaagaagaccgacgaggccaagcacaacgccggcgaaacgacgggggcgaccaagcagaaggccagcgagacgacgga

SEQ ID NO: 3020 - DNA, 433 bp, Zea mays
  Clone ID: LIB143-014-Q1-E1-E9
caccgctccgcctccactcctcgcgccgctgccgcatctcctctacaggtaagaaggagagaaagagggcgaaatggtgaagcacaacaacgtcatccccaacgggcacttcaagaagcactggcagaactatgtcaagacatggttcaaccagcccgcccgcaagcagaggcgccgcatcgcacgtcaaaagaaggctgtgaagatattcccacgaccaactgctggccctcttcgtcccattgttcaatgccagactctcaagtacaacatgaagtcaagggctgggagaggctttacccttgaggagttgaaggctgcgggcattccaaaaaggcttgctccaaccattggcatttctgtggatcaccgccgcaagaacaaatcccttgaggggctgcaggccaatgtccagaagcttaagacatacaag

SEQ ID NO: 3021 - DNA, 460 bp, Zea mays
  unsure at all n locations
  Clone ID: LIB143-014-Q1-E1-F1
ggggccacccacgcgtccggagcgagagagaacccaaacggagagagacaatcgagagagatggcaaactgttttggtgacgtcgtggacaattacaagctagacacaatgccaagatatatcggcaaaaagaagactcgagaagaccgggcacgagaggcctcctatctcagtaatgagaatgagaagtacaagaaagctaaagactatgtgaacatgctgaaggactggtacggcaatggagcgtcgaagctgtgcgtgatctacaaccagacgggcggaaccctgcggtacgtcgacgacaaggactggctgggctacccggggccgacgccctacccgacggagatcggcaacgggcagtgggcgtccttcctccacgtccacaagaccggcgcctcgtcggggtccatggccgctgtcgtctaccgcggcaaggacngcngcggcagcgagcgcg

SEQ ID NO: 3022 - DNA, 432 bp, Zea mays
  Clone ID: LIB143-014-Q1-E1-F10
ttcccggggtcacccacgcatccggagccgcctcccccagacacttcgccgccggcaagatgggccgcgtgattcgcgctcagcgcaagggtgcggggtccgtgttcaagtcccatacccatcaccgcaagggccctgcccggttccggtccctcgacttcggcgagcgcaacgggtacctgaagggcgtggtcaccgacgtcatccacgacccgggccgcggcgcgccgctggccaaggtcaccttccgccatccattccggtacaagcaccagaaggagctgttcgtggctgctgagggcatgtacactggccagttcgtttactgcggacgccgtgctacactctccattggcaacgtcctgccgctcagggggatccctgagggtgccgttgtctgcaacgttgagcaccacgtcggggatcgcggtg

SEQ ID NO: 3023 - DNA, 87 bp, Zea mays
  Clone ID: LIB143-014-Q1-E1-F11
ggtcctcatgggcatgttgttgcgcacaagcgagtctggatttcgcgcgcataacgtcatcgtcctcctcgctctcttcggagttgc

SEQ ID NO: 3024 - DNA, 414 bp, Zea mays
  Clone ID: LIB143-014-Q1-E1-F12
gaaccacggcggcgtgcgcgacggcaccaacatcgtgctctggaagtggtgcgagggcgacaaccagcgctggaagatcgtcccctggtaaatgtgctgttctgtggctgcactggtcatcaccatgatctggagctttgaaggcatagccacctgtggtcagcagctgctgccgtgttgctagaataaagttggtggcgatcgatcgatcgatctttggtgatgggtgtccctccctgtgtgtttgtgtttagttccagtcgtttgtgaggaagtcagttatgtttgagtgagaggggtacttcgctcttcggttaactctgtacttgtcatgaggagagttttcatacccggagtgtagaactctgtactgtactcggatccttccttttccatccaagtgggttttatttt

SEQ ID NO: 3025 - DNA, 462 bp, Zea mays
  unsure at all n locations
  Clone ID: LIB143-014-Q1-E1-F2
ggggccagcccgcgtccgcatcccattcccatctccgccgccgccgccccttcctcctccagagtcgcgcctcttcctcctcctctccagtcgcgcggtcgcgccgtcncattgcgccccttcctcctcgcagtcacggccgcgcggcacgtgctccgcttcgccgtcgccgtcgccgttgccgttgccgtcgccgccgccaagtaaagagagactgggaagcgcagtcgacgggggcgtggtgaggagggagttactcggaggaaggaaggaaggaagggggactgcggccggcggcggactaccatgtcgtctctgggaacttccaaggggatcctggagatcgccaagttcggcgtctacgtctccgtgcccgtcgcactcacctacctcgtcgccaccgactccaagaccctcaagaagctcatgggcctccgcccttacgtggtttacccgcctgaa

SEQ ID NO: 3026 - DNA, 424 bp, Zea mays
  Clone ID: LIB143-014-Q1-E1-F3
gcccacgcgtccgcccacgcgtccgcccacgcgtccgggcgattgttagtgcatttggcccactggctgcatatcgctttctttttaacaatgagctcggtggaccctgtgcatttcttgagtacgccgagcgcgcgcgttacgtctaaggcatgtgctggcctcaatgggatgatgcttggtggccgtgtactgactgctgtgcatgtgtttcctaatcctcatgtggaggctgctaatgaggcttccccattttatggtattcctgacaatgctaaattgcttctgaaagaaccaacaaaggtcctgcagctaaaaaatgtgtttgaacgagaagagtatatgctactttcaaaatctgagctggaagaaacattggtagatgtacgtgttgaatgtttggggcagtcaaatctgtaaatgt

SEQ ID NO: 3027 - DNA, 233 bp, Zea mays
  Clone ID: LIB143-014-Q1-E1-F4
tgtccaatgtccacgctgcagaagagagagatgggggtgcgggcggcggcggcagcagtggcgctggtggcggtgatgggcatgctggcgccccgagcggcggcgcagacgccgaactgcgcggcgaatctggtcccgtgctcgtcgtacatgaacactacagggacgccgccggagacctgctgcggcccgctcaatgacgccgtcaagaacgagctcaagtgcctctgcga

SEQ ID NO: 3028 - DNA, 446 bp, Zea mays
  Clone ID: LIB143-014-Q1-E1-F5
ccacgcgaccgcacacgcgtccgcccacgcgtccgcccacgcgtccgcccacgcgtccgggagattgttagtgcatttggcccattggctgcataccgctttctttttaacaatgagctcggtggaccctgtgcatttcttgagtacgccgaccgctccgttacttctaaggcatgtgctggcctcaatgggatgatgcttggtggacgtgtactgactgctgtgcatgtgtttcctaatcctcatgtggaggctgctaatgaggcttccccattttatggtattcctgacaatgctaaattgcttctgaaagaaccaacaaaggtcctgcagctaaaaaatgtgtttgaacgagaagagtatatgctactttcaaaatctgagctggaagaaacattgggagatgtacgtgttgaatgtttggagcagtcaaatctgtaaatgta

SEQ ID NO: 3029 - DNA, 448 bp, Zea mays
  Clone ID: LIB143-014-Q1-E1-F6
ccacgcgaccggacgatcgtcgccggatccatccaccatgggcggtggcaacggccagaagtccaagatggcccgcgagcgcaacttggagaagaacaagggggccaaggggagccagctcgagaccaacaagaaggccatgagcatccagtgcaaagtgtgcatgcaaacattcatgtgtaccacgactgaagtgaagtgccgggagcacgccgaggccaagcatcccaagacagacgtgtaccagtgcttcccccatctgaagaagtgaaaggcctgaacttagcaaccagtgctggtttggtcactacgatcgggccagggggcgttccttgtgttgagggtgttcattccgtgttatcttcccgtcagtcatgcgtcctgtcctatgttaacctacataagaaagtgatgtggtgtccacttctagtgaaactactgtctgctg

SEQ ID NO: 3030 - DNA, 445 bp, Zea mays
  Clone ID: LIB143-014-Q1-E1-F8
cccacgcgaccgcagtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctgtgtttggctgcaggaaccctgaggagatcccgtggggttcggttggtgctgaatatgttgttgagtctactggtgttttcactgaccaggagaaggctgcagctcacttgaagggtggtgcaaagaaggttgtcat

SEQ ID NO: 3031 - DNA, 410 bp, Zea mays
  Clone ID: LIB143-014-Q1-E1-F9
gaaagaccatgcgtagaaaagagaagcgtgctcggatagaacagatcagggtcatccttggcctttctgattctcaaaggactccagtgcctggagaatcactgagagatttctacaagaggacaaatatgtactggcaaatggctgcctatgagcacactcaacacactggaaaggagctccgcaaagacggttttgatcttgccgaaactcgattcaaggaactgaaaccgatacttgacgagctggctgtgctggaggccgagcagaaagctgaggaagaggccagtgcgtcgactagttccaagagggacaccaagaaacccaagcagaagagcgcacgaaggtagctttggttctgaacgagtgtgtaagcggaagccagctttagatgaagttgctccaggaag

SEQ ID NO: 3032 - DNA, 444 bp, Zea mays
  Clone ID: LIB143-014-Q1-E1-E6
ttcgccggtccacccacgcgaccgcagttacttctccctccgccgccactcccgtcacattcaccgccaccgccaattccatacggtcctccgccacctctgctgatagccacaacagatggcaagcaatggtgatgggcctgcaatcggcatcaatctctgcacgacgtattcttgcgtcagcgtctggcaacattaacgtgtcgacatcatcgctaacgacgatcgtaacggcaccacaccctcgattggtcgccttcacatactccgctcgcctcatccgtcatgcggccaaggatcatgtcgccatgaacaccatcaacaccgtctttgatgcgaaacgtcgcaatggcatgatgtttatttctgactctgtccagagtgatattacactgtggcccttcagtgtcaatccaccgcccggtgagaatccaatgacacttg

SEQ ID NO: 3033 - DNA, 449 bp, Zea mays
  Clone ID: LIB143-014-Q1-E1-C8
acacgccactgcagccgtgcactccatcggcgtctgctacggcacgctgggcaacaacctgccgtccagcagcgacgtggtgcagctctacaggtccaagggcatcaaaggcatgcgcatctactcccccgacgccaaagccctcgccgccctgcgcaactccggcatcgcgctcatcctcgacaccggcaacggcggcggcgtcctgggccagctcgccaggagcgcctcgttcgcggactcgtgggtgcagagcaacgtgcggccctactaccccgccgtcggcatcaagtacgtcgcggtgggcaacgaagtgcaaggcgacgacacgcgcagcctcctcccggcgatgcgcaacctggacgccgccctggcgcgcgccggcttcccgggcatcaagtgctccacgtcggtgcgcttcgacgtggtcgccaactcgttcacgccct

SEQ ID NO: 3034 - DNA, 455 bp, Zea mays
  unsure at all n locations
  Clone ID: LIB143-014-Q1-E1-D1
gggtccacgcacgcgtccgaaggttatcgcgccgccgccgccgccgccgccgcagccgcaacaatgccgtcgcacaagaccttccggatcaagaagaagctggcgaagaagatgcgccagaaccgccccatcccctactggatccgcatgcgcactgacaataccatcaggtacaacgccaagcgcaggcactggcgccgcaccaagctcggcttctgagcgtcgggattggccggctgctgcgtcggaaggctanggtctaagagctatcttccttctgttttatcaatgtgtcagtttttctgtaagctagcaagtgttgctatgacgcttttattaagattctggtgagcggtgatgttaagagaaaattggcactactgtggtgtaccccaagattccttgcagcattgctatgctaagtaaagaaccctttatcttagtatatatgtagt

SEQ ID NO: 3035 - DNA, 417 bp, Zea mays
  Clone ID: LIB143-014-Q1-E1-D11
cacacgcgtccgcccacgcgtccgctctgctcccggctcccccacggtactccagccgctaccctgcgattccgccagtacgccaccaccaccgagcctggactaccgccgccgcccttcgccgatatcttcagcggcgaacagcgcccaccagatcccgcccctgcgatggagtccgtggtgaacccgaaggcatacccgctggctgatgcgcagctgacgatgggtatcctcgatatcatccagcaggccgccaactacaaacagcttaagaagggagcgaatgaagcgacgaagaccctgaataggggcatatcggagtttgtagtgatggcggcggacacagagcctctcgagatcctgctccacctccccttgttagctgaggataagaacgtgccatatgtgtttgttcca

SEQ ID NO: 3036 - DNA, 213 bp, Zea mays
  Clone ID: LIB143-014-Q1-E1-D12
atagtgcattgatagtcatacctctttgaaagtagtcaggtaattgtatttcaagggccatagtgtgaaaacttcgggattgggaaaattagggcgttagcaaaacaaaacgctttgaagaacaggccctttacggaagatgtcgtaatggataggaggtcgaaactgttggccaatctcaagagttaaggaggaaggaaagggtaaggggac

SEQ ID NO: 3037 - DNA, 446 bp, Zea mays
  Clone ID: LIB143-014-Q1-E1-D3
ggggccacgcacgcgtccgcatcgcagagccagatcaagggaagacgacgcagatctcgccacgcgaacacagttagatcgagggagtaagtgagagtgagagccatgacggagctgttcgacacggccgtgaccagcctcctccacctgccggaggtgctggaccgcctctccgccgcagacggcgaccggcggtcggccggcaaccacgcggcgcacgggcacggccacggacgcgtccacgggctcggcggcggcggcggagcgccggtggacatcgtggagagcccccgcgagtacgccttcgtgctcgacgtgcccggcctctccaagtcagacatccacgtgacgctggaggaggaccgggtgctggtgatgaagggccggaacgggaagccgaagcgcgatgaggaggaggacatgaacggcgaagggtgccgatacat

SEQ ID NO: 3038 - DNA, 451 bp, Zea mays
  unsure at all n locations
  Clone ID: LIB143-014-Q1-E1-D4
gggtccacgcacgcgtccggaagccacccttttttttttttttttttttttttttttttgcctcaacgagaataaagtggttgacaaaccaccaaaactcagtataaaaatcattgtatcagaatatcaccatcttcccgttgatctacaattcccctcactagcttatacttctggctatgattccacgaatattaaagtaatggatctagagacatcttcttttacaggcctgtacatgtatttgagtgttcatgttcgtgaaatctccttatttacatgttctcatgcagaatcggcagcgaaattccatttanactataaaaaatgctaaatgaaatagcttctgctatatttcactatatcttttattgggatcctggaggatttgccacgccatttgcatgttcatatgaatgccggagctcactggaaggaccactgtatctct

SEQ ID NO: 3039 - DNA, 427 bp, Zea mays
  Clone ID: LIB143-014-Q1-E1-D6
gatcgattgaacaaattggagcggcactacactcctccacgcctccacctccagcctcccactgatctggcctctctcgaggaatctatggattcgatgtgaagtcccaaagggtagcttttagggagggggaatgatgagatgttggaagttcacaagttgtgtctttcttaaaggctggtaaccttaatcctagatcaatatgagaaggggctacagttacagtccttcaccaccaaggggctacaggagaagggcgcgcagtccaagtcctcatgatcattatggtggtcgtggtaaggatctcccaaccagtcttctggtcaggaatctccgtcgggactgcaggccagaagacctccgtcgcccatttggacagtttggtcgagttaaagatatatatcttccaagagattattacactggg

SEQ ID NO: 3040 - DNA, 437 bp, Zea mays
  Clone ID: LIB143-014-Q1-E1-D7
cccacgcgaccgaaaaatatctgcctcttcttcttgctctcgtcgtcctcgtctccgtcccaatggagttgagcgccgtcacctgtcgcactgccgctgctccagttgcagcctgggcgccatttgggcgtccaagggagcagacgacgaagcgaacaggcctcacagacaggcgatgcggccggccggcgagcagctcgcgttgagccctctcgcaccactacatacgctgttgcatgctttgctgcgagctgtgcgcgcgcgcgcggagcatggagatgcatggaagcggcagaagtggtaccgtgcattgggtgtgagcgcgtacgtggggaattgaggcgtcatggtccgagatatatacatgtctctcttgctacgtatcttagattaggcttagttctgttgttagtacgtacttcgtccgacgatcctgg

SEQ ID NO: 3041 - DNA, 429 bp, Zea mays
  Clone ID: LIB143-014-Q1-E1-E12
gaagactacttagacgacaagaaaaactttacagaatggctcgaggctcactctccggtgaaagctgcggaagacgctaagccactgttcgccgctttgaagaaggaagggaagtccgtcgcggtgggaggctactgctggggagggaagctgagcgtggaggtggggaagaccagcgacgtcaaagctgtgtgcctttcgcacccgtacagcgtcactgccgacgacatgaaagaggtgaaatggccgatcgagatcctgggggcccagaacgacacgaccacgccgccgaaagaagtgtaccggttcgtgcatgtgctgcgtgaaagacacgaggttccctactacgccaagatcttccagggagtcgagcacgggttcgcctgcaggtacaacaccaccgaccctttcgccgtcaagaccgcagag

SEQ ID NO: 3042 - DNA, 337 bp, Zea mays
  Clone ID: LIB143-014-Q1-E1-E2
ggggccacgcacgcgtccgcacgggacacggagagaccgcgcagcagcagagctagttcgttcaggcagctttatttgagcagacatatataggagaagatccgaggagaaagatattagcttgctaagagatctcgccatggcgtccatgatgggaggagacttggtggaggcgtacgtgctcaagaacgcgtgcaaggagaagctccggcgcatggaggcggcggcggcggcggccgacgataagacgagcaagcagggccgcctcgcggagaagaaggtctcaggcagaggacgacgcctgcttgggctcctgaagaagaaggtgcacccaaaa

SEQ ID NO: 3043 - DNA, 430 bp, Zea mays
  Clone ID: LIB143-014-Q1-E1-E4
cgtccgcaccttacccctgactcgtgcgtctgtttctcctgcctgggtctggggttgtccagttgccattgccaccaccaaccgagcctagagggaaagaaatcttggaaaggtgtggtgtgacccctgctgctgctggtgccagatttgctcgcgttcgaggcctccttttgtttccgctagattctgccaagatcagcgattccctccgccagcagaatcgctcgctctctttccatcgagcgtgcattcttttctgctgctgagtcgggcaggatcggcgtaacccctccatccaaaccccagacctttgtccagcagcctcgcgccctcgccgcatcggtatggtttttccttgccccccgtcctagttgctctgttcgctttatttcctggtcgaggttctcgtgcgctgttccaatttcgagct

SEQ ID NO: 3044 - DNA, 92 bp, Zea mays
  Clone ID: LIB143-014-Q1-E1-E5
caaagttttgttatgcttaactagtgactgagtgaaggtctacatgtaattgatttgaattctgtgttgccagtcatggatttgcagctttt

SEQ ID NO: 3045 - DNA, 442 bp, Zea mays
  Clone ID: LIB143-014-Q1-E1-C7
cccacgcgtccgcacacgcgtccgcggacgcgtgggatggaagcgaaactttacttccaatcattgttttggagatgccaagtgtacttctgatggcggctattcgtaatgtccacattgcacgaccaaccatatatcaagttgtcaaggaaatgattgataaaatgggctatgaggtaaaacttgttcgggtaaacaaaagaattcaagaagcgtactgtgctgaactttgtctaacaaagattgatgattctacagacagcatcaccttcgatcttcggccttcagatgccataaacattgctgttcgttgcaaggttcctgtacaagtccatagaagtcttgcatacagtgacggcatcagaccagtcgagccagcaagaatggcagtagcagctggcctatcagatgggttgttatttacagagcttgacagacccga

SEQ ID NO: 3046 - DNA, 407 bp, Zea mays
  Clone ID: LIB143-032-Q1-E1-G1
tagactcactcgtccggccgccgtcgccaccgcccgcctgcctgggcccgctgcaccgactctgacagcgcacgtcctgcttcctgtagcggcaggcgagggagaggactcagggagtgtgatggcggcaatgccggcgccgcttctgcctctgcttctgctggtggtggccgcggcgatgacgctctcccccgccgccgcccgcattcccggcgtgtacggcggcggcggcggcggcggctggcagagcgcgcacgccacgttctacggcggcagcgacgcttcgggcaccatgggcggcgcctgcgggtacggcaacctgtacagccaggggtacggcgtgaacaacgcggcgctgagcacggcgctgttcgacgaggggctcggctgcggcgcgtgcttcgaga

SEQ ID NO: 3047 - DNA, 407 bp, Zea mays
  Clone ID: LIB143-032-Q1-E1-G10
ctcgcgggccgacacacgcgtctagcggaactgctaggagcagaagggaacggggatgggaagcacaggggcgctgctttggcacccgtcgccgcaggtgcactccggtggcgtcctcttccgccagagccggcgcatcgtacgccagcgcaacttgcctctattatcgctagctgacgcggcgcttgagctcgagcgccgccgcgggcagcgtctccgctgcgctgccggcgacggggccggcgggccccgggaggctcagaaggagtctccgagcggcatcggcgcagcactcgaggatccgtctccaggacctcctgtggaaaacggtgccttcagaagcccctcacaggaagaacagagtgctctgtataattttctctatccaagcaaagacttacttccag

SEQ ID NO: 3048 - DNA, 418 bp, Zea mays
  Clone ID: LIB143-032-Q1-E1-G11
ctcgtgggtcgatacaagcctctaaagtcagtcgtagtagtctctgaagacgaaaagaagaccagaatgggctctttgaagaaaaaagcaatagatgcatcaactaagattaggcattcattaaagaagaacaggaggaagagtggtagccgagtcctttctgtgtctattgaggatgtgcgtgatctagaggagctgcaagctgttgaagcatttagacaagcactactcttggatgagctgttgcctgcaagacacgatgactatcatatgatgctgagatttctaaaagcaaggaaatttgatatcgacaaagcaaagcaaatgtggatggatatgcttcattggcggagggagtatggcactgatacgattttggaggacttcgaatacactgagttggacgctgttttgcaat

SEQ ID NO: 3049 - DNA, 384 bp, Zea mays
  Clone ID: LIB143-032-Q1-E1-G12
tacgctgctcctcaccagtcgccgccggaaatcaggaagcccaagtgctcccttgggtgcgctcgtcgccggtggcagtgagccagtgatgcaccttcatctccggcttccttactaggatcagcccgtcgatcgatcatggcgtcgtcgagctcggctgctactaccagtggcgacagtcagggcctcaaggctcgagatgcctgcatcgtcggcgtcgcccgcacgcccatcggcgcacttctcgggtcgctgtcgtccctccccgccaccaagctcggctccatcgccatccagggtgctctcaagagggcgaaggtcgacccggcgctcgtgcaggaggttttcatgggcaacgtcctcagcgccaacctcggccaggct

SEQ ID NO: 3050 - DNA, 431 bp, Zea mays
  Clone ID: LIB143-032-Q1-E1-G3
atgagaagccagagtttggtgaatggacatggatgacacccaaggaagttatcgaaaaggcagttgatttcaagaaacctgtatatgaggaagcattgaaacactttgccccctacctgcagtcagatccagccgcttcatcatagaagatttggccaatttgcttgcatccctgctgtatctggacccccaataatttgacacgacgcaatgtagccatgaggtgtgctatacaatttgatagtgtgtggcctgtttgagtcaattatatatgccagcattggatcctcgccctctacttagtcacataagtatacaataagtggtggaaacagtttactgtaatgaccgctacagatgcaccgtcgcatgattgggcctgtggctctagtttcagccaatctggaacatggtggccagtgtatcttgtc

SEQ ID NO: 3051 - DNA, 409 bp, Zea mays
  Clone ID: LIB143-032-Q1-E1-G4
agttaaaccctcgtgacaccagaacgtggtgagagaccaaagcaccgactccagtgactcgccctatccaacccctctggtgctcaggggtgacatccagactcctggcaccgtatacgccgccgctcacaaggaggcttggaagcctgggaagcgcgcgagggcgttcatctaccctgtcctgcgccccatcgagaacaagatgcagtggatggaactgaaagccgccgagtctcctactgtgctatcacccaaccctccaaaaagaaggaacctgagcgcagcaggttccggcgacaaggctcaccagccgcctacacgttcagcgttcgccggatcttcagagcacggatccttcccaaatacttacagccgtgcagcgcaggacggagtgatgtcgcccgatgaa

SEQ ID NO: 3052 - DNA, 414 bp, Zea mays
  Clone ID: LIB143-032-Q1-E1-G5
ggaagttgtctgggcatgacattgttaaaaatcacatcatggtgtccttgcgtaacggtttagatgctaatgtggctgatatagtgattagagagtatgtgagctttattatggttcatcttcagtcttcttgcaccagctgtaactttgaaagaggagagatagtgtcagaactacggaagagtcctatattccttacaaaccatggatacaagagcccagctgatgaaacaatttcacttcagtaaagattatggaaattccgtggatgctactagactcttcagaatgtagaaataagttggattgaacttgatagtacctatttgcagcatcatggttcacagtcgtcatcatttgcactggaaaaatggaggcaattttttgaagaaatgggtgtgactgattttgtgc

SEQ ID NO: 3053 - DNA, 438 bp, Zea mays
  Clone ID: LIB143-032-Q1-E1-G8
atgaattttcactggcatttgcaaggattgaaaaccactactttgtgaataagggatttttaccctcggactcattcctattggacaatgttgataagatccgacatattaaaggttttattgtacagggacgttatgatgtttgttgccctatgatgtctgcttgggatcttcataaggcttggcctgaagcagaattcaaggtggtagcagatgcagggcactcggccaatgaagttggcatcgctgccgaactgaggtcagccaccgataaactgagagacttgctgcgcaaatgagccggcgaaaggcaacctgcacctctatctgatcatggaactcagaggcccataataattacatagctgtgtaacggttagcactgtgccgttaaacaatgtcattgtcaccatcgatatgttgtttgtttgctcgctg

SEQ ID NO: 3054 - DNA, 426 bp, Zea mays
  unsure at all n locations
  Clone ID: LIB143-032-Q1-E1-G9
tcgcgggccgacacacgcctctaatccgtgtctcgaaatgccccaaggagactgatgccacctactctctccaagatcccactgaggtcatggagttcttggtccgtctggggcagtggaatccactgcgatcaccatcgccggcggcgcgcccaagggggcgaaagcagtaacagacgacgacaacaacagatcgctaagcgtgtttaatttaattatagttagttagttagtttattaattgttgcactactctaggagtaataaccctcctcgacgatctacatacattaccccatcgtctcagctcagctcccggccccagatgtgaactctggccggccaacctgctgattgtgttcgatcagacgttcttccatatgggttttagaggcacaggcangcatccatgtgcaaagctgcctg

SEQ ID NO: 3055 - DNA, 401 bp, Zea mays
  Clone ID: LIB143-032-Q1-E1-H10
tcgcgggtcgacacacgcctctacagtgactcgtattacgactgcagcgtgctcctgtcctcgattcactaatcctgtatccgtctgtcgagccatggcgaagggaagggcacacccgtctaagcgacccacccaccaacttatcctcgcggctgtcctatccgtttccgttctcctcccgctgctcttgccggcggcagcaactgtggctgtggcggtggctgaggggggctggaagcagttggcggtcgggaaggacgagggaaaactggtcgcggagggggatgctggtggacgcgggttagtggacgagaatgagttcgcgggtggcttctgctctctctacatcatgctgcagtgtgcgatcggaaattctgatccggacaaactgaatgaggggg

SEQ ID NO: 3056 - DNA, 374 bp, Zea mays
  Clone ID: LIB143-032-Q1-E1-H2
gtcgacacacccctctaaatcgcatactcgcacccacgcactcgctggagcctggcgtggaccagcaggacttcaacacatacggtatccgtcatggcaaggatgacgtaacggcacagggaacgtttgcaaacattacgatcgtcaacaactttttgcacggagaagttggccccaagaccattcatgttcctactggggagaaactttctgcatttgatgccgccataagatacacatctgacggccatgctactataatccccgctgctgctgactatgcaagcggaagttctcctgattgcgctgctaagggtctcatgctcctgagagttaaagctgtgattgccaggagctttcagcgtatccacaca

SEQ ID NO: 3057 - DNA, 398 bp, Zea mays
  Clone ID: LIB143-032-Q1-E1-F9
acagaaccatatgtcctgtcaggaggaaaggacaaatttgttgtcttgtggagcatccaagaccacatatctgcccttggggattcctcgtcttctcccggagcatctggcagcaagcagtctggcaaaattgcaaatgaaaaggagagtcctaaagttgatcctagaggtatattccatggccatgacagtactgttgaagatgttcagttctgcccttccagtgcgcaggagttttgtagtgtgggtgatgatgcttgtcttattctgtgggatgctcgaactggcactgacccagctgttaaggttgagaaagctcacagtggagatgttcattgtgttgattggaatccccttgatgttaactatatcttaactggttctgccgataactctgt

SEQ ID NO: 3058 - DNA, 473 bp, Zea mays
  Clone ID: LIB143-032-Q1-E1-D8
cacaggtctaggactcgcgggtcgacacaagcctctagaattcgtcatacaaatgtcgaatgatcttaaaaccacagatgttctggaccgttgcttcatggagctgctaaaggccataaacagcagtctgaatgatttgaagaaactgcagcaaaaaatagaacagcataagaggaaacagcaacagcagaagaagcagcaacagcagaagcagcagcaacagaagcaacagcaattgcaaaaacagccagaagattatattcaagctctgattgcactggaaacagaacttaacaacaaattgtctatacttggtctgatgccatcttcatctttggcagaggtactaaagcaattgaaggacaaatcattaaagcgagcaaggctgactgaagaacaattgcaagagcagattgagcagagaaatgtcgcaaggaagaataagcagtttgagatatctgatggaatcagga

SEQ ID NO: 3059 - DNA, 426 bp, Zea mays
  Clone ID: LIB143-032-Q1-E1-E10
ctcgcgggccgacacacgcctctacatttcttggttatacagctagggcaatattgccatattctcaggcacttgagaagttggcaccacatatacagcagcttagcatggagagtaacgggaagggtgtttccattgatggcgcccaactttcctttgagacaggtgaaattgattttggtgaacctggaactaatggccagcacagcttctatcaattaatccatcagggaagggttatcccttgcgactttattggtgttgttaaaagtcagcagcctgtttacttgaaaggggaaactgtgagtaatcatgatgagcttatgtccaatttctttgcccaacctgatgctcttgcttatggaaagactcctgaacagttgcacagtgagaaagttccagaaaatcttatccctcataagactt

SEQ ID NO: 3060 - DNA, 436 bp, Zea mays
  Clone ID: LIB143-032-Q1-E1-E4
tcgatacaaccctctaaagtgagtacgctataatcagatcagatcgtagcagccaaggattccgcgctccgggggtgccatgaagctgaagctcctctctccctgccttctcctcctcgccttctttgccaccgcggcgtacgcggcgtcggcgtcggcgtcgcgcgcggcggccgtcgtcaggggcgcgggcgccccgtcgcagtcggagttggagtcggacccggagaaccagtgcgtgtacacggtgtacgtgcggacggggtccatctggaagggcggcacggactcgaccatcggcgtgacgctgctgggcgccgacggcacgggcatccggatccgggacctggcggggtggggcggcctcatgggcgccggccacgactactacgagcgcggcaacctggacatcttcagcggccggggcccctgcatg

SEQ ID NO: 3061 - DNA, 455 bp, Zea mays
  Clone ID: LIB143-032-Q1-E1-E7
ctcgcgggtcgacacaagcctctaggataagtcgcaagaatggcgcactaccagcaggggaggcggcagcaagtggacgagtacggcaacccggtccctgggggccacggtgtccagggccagcagctgggtgaagccgccggcgggtacggcgtcgcaggcaccggcagctacggcggccagcagcaggccgggtatggccccacgggcaccggcacgcatgacgccgggggctactgcggctcgggccatccgggttacggggctaccggaacgggcgtccacgacgccggtggcccaggtgcgtatggagcagtcacaggcacgagagcccacggcactcatggcggcgtgaccgggatccaggacggcgccgccggcctcaccggtggtggtctgcatggcgcaacaagcatggggacgactaccggtactggcgcgcacggtgccaccgg

SEQ ID NO: 3062 - DNA, 453 bp, Zea mays
  Clone ID: LIB143-032-Q1-E1-E8
gactcgcgggtcgacacaagcctctagagagatcccatatcaaacattgtggttattggccacatcgactctggcaagtcgacaaccaccggccacctgatctacaagcttggaggcattgacaagcgtgtgatcgagaggtttgagaaggaggccgctgaaatgaacaagcgatccttcaagtatgcttgggtgcgtgacaagctcaaggctgagcgtgagatgggtatcaccattgatattgctctgtggaagtttgagaccaccaagtactattgcaccgttattgatgcccctgaacaccgtgactttatcaagaacatgatcactggtacctcccaggctgactgtgctgtccttaccattgactccaccactggtggttttgaggctggtatctccaaggatggccagacacgtgagcatgctctccttgcgttcacacttggactg

SEQ ID NO: 3063 - DNA, 332 bp, Zea mays
  Clone ID: LIB143-032-Q1-E1-F1
ggtcgacacacgcctctagactgactcgtatgaccacagtctccatcacccgcctgcctgagcccgctgcaacgactcagaaagcgcacgatcagcttcctgtaacggcaggggatgcagaggacccaaggaatgtgatagtaggcatgcacggcaccactttcggatctgcttctgctgatcagtgacatccggactgatctctctgacgtagctgcacgtaatcactgtgtgtacagcgatcgagttgatggctccgtgtacaaccagcacggcatcttctaccgctgcagcgatgcttcaggaatgatgtgccgtgcatgcggatacgg

SEQ ID NO: 3064 - DNA, 440 bp, Zea mays
  Clone ID: LIB143-032-Q1-E1-F10
ctcacgggccgacacaagcctcaagaggacatctgagcatcgcttctgatgaccactctaactctgtaaggttacaaagctgcagcagcagttcaacagcttgtgtaaacctgctcgctaaggctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccccccaaaaggttcaaacttaagttacccttaaatgaaatttaaaacccctccaaaagggccaccaaatttaatttaaggggccttcttttaaaaagtcctaaacgggaaaaacccggggttaaccaaattaaacccctttgaagaaaaaccccttttcccaaacgggggtaaaaacaaaaaggccc

SEQ ID NO: 3065 - DNA, 325 bp, Zea mays
  Clone ID: LIB143-032-Q1-E1-F12
ctcgcgggccgacacacgcctctatggtggctcggaagaccggcgacgggctgaagcatgcgggacagctccccggccttgggagcatggagctggatgacattgatgttgacgacatagacgttgaggacagtggcgactttgtatgtgccttgtgacgcggttcaggctgtccggcaccgttgctgcggtggactctcccccactctcctggtctttgtgtcttgctgttattccatgttgtttgtttcagcgagctccgagctcccattttgttgttgtaatatcacatgttttgtgtaaccaaggtagtgacgctgtggat

SEQ ID NO: 3066 - DNA, 421 bp, Zea mays
  Clone ID: LIB143-032-Q1-E1-F4
acgccgaaagcatgctcatcaacggcaacttcgagacggcgccgcggaggctgaacaagaccctcatcgtggggcgccactcgctgccggggtggacggtgcaggggcacgtggagtacgtctcgggcggtccccagcccgggggcatgttcttcgcggtgccgcacggcgtgcacgcgctgcgcctcggcagccgcgcgtcggcgtcgcagaacgtgacggtgcggccgggggcgctgtacgcgctcacgttcgcggcgacgcggacgtgcgctcaggacgaggccctgcgcgtggcggtggcgccgtcgatctcggcccccgccgacgtcgccgtgcgcacgctctacagcggcgcgtccgccgacacctgggcctggggcttccgcgcctcctcgcccgtcgcccaagtcacgttcgc

SEQ ID NO: 3067 - DNA, 430 bp, Zea mays
  Clone ID: LIB143-032-Q1-E1-F5
attcgcacctgcccgcgcggccccgacccctagtcctccccacccatggcgcggcgatccgctcctctcctgcgccgcctcgtctccgcctcctccccgcccgcgcttcagtccctcacggaccacgtcggcgtcctcgcgcggcgcacggtgacctacatgccccggcccggggacggcgcaccacgcgccgtcacgctcatcccaggcgacggcatcggtcccctcgtcacgggcgccgtgcggcaggtcatggaggcgatgcacgcgcccgtctacttcgagacctacgacgtccacggaggacatgcccacggtcccgccagccgtcatccaatccatccggcgcaacaaggtctgcatcaagggcgggctcgccacgcccgtcggtggcggggtctcctccctcaacatgcagctgcgcaaggag

SEQ ID NO: 3068 - DNA, 423 bp, Zea mays
  Clone ID: LIB143-032-Q1-E1-F6
agccgaattcgcagcagcactccagggtccaggcccagcagcctcttcggctcttcgttgggggtgcgtggacaccggaaattgcctcggggattgcgttcctgatctaagcccggcatgaagggctgctcagagcgtttgctgctcctgctgctgctggcatcgtcgttgttactgtccgtcgtggttgccgcgcagcagacttgccctgccgacctcgacagcaaatgcgacggtggcgcgcctgatgactgggagggggaattcttccccggcgtcccgaaaatcaagtatgagggtccaacaagcaagaaccctcttgcttataagtggtataacaaggaggaagtcattctcggaaagaagatgaaggactggatgcgcttcagtgttgcgttctggcacacgttccgtggtactggt

SEQ ID NO: 3069 - DNA, 430 bp, Zea mays
  Clone ID: LIB143-032-Q1-E1-F7
actccgtggaatgcacctgaacttttcgatctttacatctttgagggtgagtctatcagagaatggttgttttttgacaaaccaaggagggcatttgttagtggaaatcggaagcagcggtccttgccagattacggcggccgtggttggcatgaatctaggaagcaggcgatgaaggactttgggggtctgaagaggtcctattacatggatccacaaccatccaacagctacgaatggcacctctacgaatatgagatcaatgagtgcgatgcttttgccttatatcggcttgagttcaagtctttagatgcaaagaagattgtgaaatccaaattagcctgtaatccactgaatgaaattcagcagcaaatggttagactcagtgcagacagtcctgtagacaacaaacggacggcccggggcaggc

SEQ ID NO: 3070 - DNA, 372 bp, Zea mays
  Clone ID: LIB143-032-Q1-E1-D7
acacatccgcgcccgtcgaggttccacgggaagctctgccaagccctgactcacatgctgcgcgtagggccaatgttgactggttactatctatcatatcagcaatgtgtcctcgttttcgtcagatcacgtccttgtcacctccggttctaccatcaccctcattgccagagggtagtgacatgagatcattcacaccgtcatattgatgactgacgtcataactctcactgcgctgggattccgcactgcattgtctactgcggtcgcgttcactcataatcgtattactgcgcacatatatcgtgctgtcggtcttccgtgtaccatggggaagagagcacattataaaggtttccaagtgtacagttt

SEQ ID NO: 3071 - DNA, 396 bp, Zea mays
  Clone ID: LIB143-032-Q1-E1-C11
ctcgcgggccgacacaagcctctattgtgagtcctggcaccagatctgaaacctcttgtgttgtgcctttggtagttcggtgtagcattgagctagcagaggtgctgttctagttccaggatgagcaaggaggatgtcctcaaggtgcagacattgatgctgagagtgaacatacactgtgacgggtgcgagaagaaggtcaagaagaccctccacaagatcgacggtgtctaccagagcagcatcgacgcggaacagggcaaggtgacggtgtccggtttgctggatccggataccatcatcaggaagctcaacaaggccggcaagccggctcagctgtggggttccaagcccggcatcactcagaacgcctaccatggcggcggcaaggcccat

SEQ ID NO: 3072 - DNA, 452 bp, Zea mays
  Clone ID: LIB143-032-Q1-E1-C3
ggtcgatacaaccctctaatctgtctcgcgatatagccgctcagcgaccgggattcaaggtacgtcctgctcaccttcgggaaccctcttcctcgtttgcccccttctcttctctcatgtggaccaggaataagacgcaagcttgtcccccaccatggtcccccagacccccaccatggttcatcgttgccctgagtatatcgtgccgtctatttccgatctgtggacgaggcagaaaaggcttttcacggatcatccagcttgcaaactgaagcagaaatgcagggattgttcttggcgtttccatggacggcgacaagtctaagcagcttctctgtccgtgacatgcgattatgtgaagtaaatcgccttctctgtttagctagtacaaaaccttggtttgtgtttccttattccgttgacgcggaacacgtacgatacaatcagaaacg

SEQ ID NO: 3073 - DNA, 455 bp, Zea mays
  Clone ID: LIB143-032-Q1-E1-C5
gactcgcgggtcgatacaagcctctaggcagtctcctaccaagacgtctaaaccccaatccctaaatccccgacgcagaccacacgacgcgcacctccgttcacgaggcggaagcatgagtcgccacccgatcactaagtgggcacagaggtccgacagggtgttcttgacgatagagctgcccgacgcccaggatgtgaagctgaacttgaagcctgaaggccatttcaacttctcagctaagggctcagatgacttgcgctatgagtttgacattgagctgtttgatgctgtgaatgtggaggagagcaaagcagctattgccccaaggaccatatgctagctgataaagaaagctaagagcgggtggtggccaaggctgctgaggcaggagggcacaccacctgtgttcctgaaggtttattgggacaaatggcaggaacaggatgatgaag

SEQ ID NO: 3074 - DNA, 433 bp, Zea mays
  Clone ID: LIB143-032-Q1-E1-C6
agcatgtttgtccatacgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactatcccggtacgtaagaaaggccagtagtaatcacgcatcatgcatatactcatgcatcgatatgcatggcgcgcctctgatgc

SEQ ID NO: 3075 - DNA, 429 bp, Zea mays
  Clone ID: LIB143-032-Q1-E1-C7
agtggaggagtaggagtagcggcagtcaaagcgtggcgggcggacgggcgggcaagctggaacccgttggatcggtggtatcaaggaatcggaagagggacccggctctcccctccccaccccgcgtcccacgtcggttcccctaatctgcgtccgcggcgtgatatgagacgtttgagtggaagcagcatattggtgaggctgaggcgaatccaacagctacacgaaggaggcaacaggcgcttggaaaggaagatgctgttaaagagaaagtaatattggcacaagagaaaaacattcagcagcttaatgagcttattcagagccttcagcttcagctattgcattgccggggcagtaacagttctgctcagaccgcctcaagccacagcgaagtggagggacatgaaatgattggtgactgataac

SEQ ID NO: 3076 - DNA, 431 bp, Zea mays
  Clone ID: LIB143-032-Q1-E1-C8
actctcgattcgattcctaagcagctagccagtgactcgatctcagcgtgctacaatggcggcagctgctattgccctgctcctcctgctctgctcagccttctgctcccttgcccaccgggcggccggcgtcgactacggctcgtggcagagcgcccacgccacgttctacggcggcggcgacgcgtctggcacgatgggcggcgcgtgcggctacgggaacatgtacagcacggggtacggcaccaacacagcggcgctgagcacggcgctgttcaacgacggcgccgcgtgcgggtcctgctacgagctgcgctgcgacaacaacgggcagtcgtgcctgccgggcaccatcaccgtcacggtcaccaacttctgcccgcccaactacggcctccccagcgacgacggcggctggtgcaacccgccgc

SEQ ID NO: 3077 - DNA, 382 bp, Zea mays
  Clone ID: LIB143-032-Q1-E1-C9
aagctgcatgaggcggcgggccacgtcgtcacggtcgagctcaagaccggcgaggtctaccgcggctccatggtcgagtgcgaggacaactggaactgccagctcgaaaacatcaccttcacggcaaaggacggcaaggtgtcgcagctggagcacgtcttcatcagggggagcagggtcaggttcatgattatacccgacatgctcaagaacgccccaatgttcaagcgccttgaggccaggattaggggtaaaggctcagctgttggtgtcggccgaggccgcgcggtcgccatgcgggctagggctgctgctggtcgtggcggtggtcctgttggacgaggtggtgcaccccctgtgaggaggtagatctgtcgcgcta

SEQ ID NO: 3078 - DNA, 385 bp, Zea mays
  Clone ID: LIB143-032-Q1-E1-D1
gtcgacacgcccctctagactaagaaatactattccacaagcacctggtgggatcatctcatcatcagagaccaagagagagattccgtgcccgcttgtagattgtgaggactgaggaccgagaagcagccatgaatccggacaacttcacccacaagacgaacgaggcgatcgtgggggcgcacgagattgcggtggaggccggccacgcgcagctcacgccgctgcacctgaccgcagtgctggctgcggacaagggcggcatcctgcggcaggccatcacgggggcgtccgggggcgacggagcggccggggactcgttcgagcgcgtgctgaacaagtcgctcaagaagctgccgtcgcactccccgcccgccggactccg

SEQ ID NO: 3079 - DNA, 371 bp, Zea mays
  Clone ID: LIB143-032-Q1-E1-D10
acaagactctagactgagtcgtattaaccctgcacggctcgccgagacttcagtttaactgaagcaagcaacgcaaacttcccccccttcggccaatcttcgttccttccttcgaaagggttgcgccaaaggaacattccttcgttcggccgttccttccaacggaactccgtttggttcctccgtccccgggaagaaaagttaacggaccgtgaaaaaaaggcgttggtatattttttatgtgccacataaaactttaggaaaatatccccacccaaaggaacagcccaacgctcagcacattaacagagactcaacacaaatctctaaagccccctggagtcaacaacaggcacagttttcccccccta

SEQ ID NO: 3080 - DNA, 425 bp, Zea mays
  Clone ID: LIB143-032-Q1-E1-D11
actcgcgggccgatacaagcctctatagtgactcatcataaagaacctacagtgccgaaggaggtcaaacctaagagtgggaaatcatctttgaagggaagaatcacgagtttcttctcaaaacgtaagagagcagagaaggagaagcctagcccatctcccttgggaaccctgaacggtcgaggttcgtcagtcagcactgtagcagttgctaaaccagacgttccacagcatgtttgtgctagttcacaggatgatgtttccttcgaaagtttagaagaccagtttaatcacggaccaatcggagctccggttgatgaacccgaagcaccctctgtgtctaagcctccagcttcgcttgagaagacgctatcatttgagattcgagcttcccacttcgaccagcccagccctacatcgggttt

SEQ ID NO: 3081 - DNA, 419 bp, Zea mays
  Clone ID: LIB143-032-Q1-E1-D2
aaacacgcgtccgcactgaagaagctacaattgcaaatcgagacttagttcctaacatcgattcaaacagcatacctagcactgtgactgatgataaccagcaattgaacctaaaggagtcacaggctctagaaaatccaataacagaattggccaaacgtctggggattgcactttctgaagaagtttcagcaagttttgttgacgaagccaatgataaagaacttgtggaattgtcatctagacttgctggtcaatcgcttccagctagtgaccaggttgcatcaattcaggtacttcgtgatcattggcaaagttctccagcaagctcactacaactgcacgaactaggacctttgctgatggactatcaactcctcaccttgcgacactatacgggaaattcattgtcagatttt

SEQ ID NO: 3082 - DNA, 298 bp, Zea mays
  Clone ID: LIB143-032-Q1-E1-D4
tcatcttcttcttcctcctcctcctatcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaaaaccacggtcctcgccgcgccgaccacgaaggccaccgccggaggcttcgacgcggccaccgagggcggcggctgccactgcaacagctgcaactgcggcaccagctgctgctgctcctgctgcagctgc

SEQ ID NO: 3083 - DNA, 445 bp, Zea mays
  Clone ID: LIB143-032-Q1-E1-D6
acaggtccaggactcgcgggtcgacacacgcctctacggtgattcatgagagcgggagccccgatacgctgcgcgacccgcgcgggttcgccgtcaagttctacacccgggagggcaactgggacctgctgggcaacaacttctccgtcttcttcatccgcgacggcatcaagttcccggacatggtgcacgcgctcaagcccaacccgcggacgcacatccaggacaactggcgcatcatcgacttcttctcgcaccacccggagagcctgcacatgttctccttcctcttcgacgacgtctgcatccccgccgactaccgccacatggacggatccggggtgcacacgtacacgctcgtcagccgcgccggcaccgtcacctacgtcaagttccattggcgccccacctgcagcgtgcgctcactgatggacgacgaggccgt

SEQ ID NO: 3084 - DNA, 403 bp, Zea mays
  Clone ID: LIB143-032-Q1-E1-B9
cgcgggccgacacacgcctcaaggctcagacctggtataggacggagctgagcttctagcaacgtacagtgtatccgccatgagtcctttcggggcggtgatcacgccagaaaccctcaagtacatgtccaagtaccagggacgtgagatcacgcaggtggactgcgcacgggaggcgatgaggctgatccacgcggaagacaagaacctcaaggccgaggactcagcgtgggagctgaagaagaagttcggcaacggcgtgagcaccatggtcctcgtctacaacgccaccggggccagcctgagcctggtggacgacgggaaagactggatgggctccgtctacagctcgccgatcccggacaccttccacaacgggcagtggatcgccttcctccacgtc

SEQ ID NO: 3085 - DNA, 443 bp, Zea mays
  Clone ID: LIB143-014-Q1-E1-B12
ggggccacccacgcatccgcacacgcgtccgcacgtgacagacggggacgcttgttcacgcggtgccgacggcggcggcggggctgtcgccctgccacgcccagacgatctccgtgagccccgggcggacgtcgacggcgcagaacttgttaaagtccagcgcgtccccggcgtcgtgcacgaactcgaccacggtcacgtccacggccacctcgagcacctcggcggtggccgcgagccgtccgttcgtgccctcggccttggcctccatcctcaccttccagcctttccccctggtgacctcgaatcctagggcgcgcgccacggactccagcttctccaccacggtggccgccggcgcgcgggccgtgaacacggtcgcggtcttctgctcgctctcgaacagccccgacaggtcgaacccggaggacatggacgagatg

SEQ ID NO: 3086 - DNA, 412 bp, Zea mays
  Clone ID: LIB143-014-Q1-E1-B2
gcacgcgtccgcaagttatagatcgcgagcggccgcccgcgatctagacttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaatgagctggaccgccgcaacatcaccgtcaacgaggcccagtcccccggcggccgtggaagcggcggcggcggc

SEQ ID NO: 3087 - DNA, 135 bp, Zea mays
  Clone ID: LIB143-014-Q1-E1-B3
cacctcgatccagacagcaggcagcagccatgtccaaggtcttcaccctcgacgcggtcgccaagcacaactccaaggaggattgctggctcatcatcggcgggaaagggtttgatggtgacaaattttttggaa

SEQ ID NO: 3088 - DNA, 437 bp, Zea mays
  Clone ID: LIB143-014-Q1-E1-B4
cacacacagcaaataccccacaaggccactccaaagagctagtagtggaaccgaagatgttcgggaacatcggaaagatccccatcatcggcgacctgacgggcagcaacaagaatgcgcacctcaagggcaacgtggtgctcgtgcgcaagaccgtgctcggcttggacgtcaccagcatcgccggctccctcctcgacggcgtcggcgagttcctcggccgcggcgtcacctgccagcttatcagctccaccgtcgtcgaccctaacaacggcaaccgcgggaagttgggcgcggaggcgagcctggagcagtggctgctgaacccgccgccgcttctgtccagcgagaaccagttccgcgtcaccttcgactgggaggtggagaagcaaggcatcccgggcgccatcatcgtcaagaacaaccacgcctccgag

SEQ ID NO: 3089 - DNA, 459 bp, Zea mays
  Clone ID: LIB143-014-Q1-E1-B6
ttcgcccggccacccacgcgaccggaggccatacgcaacaagcaaagcatacccccaaatccccaatccccaatccccaatccccaaaccctaggttatctcggcgcggcagcgatggcggcggcgggcctgaggaaggggaatgcgcgcctcccgccggaggtgaaccgggtgctctacgtgcggaacctgccgttcaacatctcgagcgaggagatgtacgacatcttcggcaagtacggcgcgatccggcagatccgtctgggcaacgccaaggacacgcgcgggaccgcttacgttgtctacgaggacatctacgacgccaagaacgccgtcgaccacctctccggcttcaacgtcgccaaccgctaccttatcgtgctctactaccagcccgccaagatgtccaagaagtcggatatcaagaagaaggaggacgagatcaccaggctccaggag

SEQ ID NO: 3090 - DNA, 363 bp, Zea mays
  Clone ID: LIB143-014-Q1-E1-B7
ccacgcgaacggactcctatctggtataggacggagctgagcttctagcaacgtacagtgtatccgccatgagtcctttcggggcggtgatcacgccagaaaccctcaagtacatgtccaagtaccagggacgtgagatcacgcaggtggactgcgcacgggaggcgatgaggctgatccacgcggaagacaagaacctcaaggccgaggactcagcgtgggagctgaagaagaagttcggcaacggcgtgagcaccatggtcctcgtctacaacgccaccggggccaacctgaacctggtggaccacgggaaagactggatgggctccgtctacagctcgccgattccggacaccttccaaa

SEQ ID NO: 3091 - DNA, 422 bp, Zea mays
  Clone ID: LIB143-014-Q1-E1-B8
caaatcctagtgttatgcttggtgctggtcttgtagctaagaaagcttgcgagttgggtcttgaggttaaaccatgggtgaagacaagccttgcccctggatcaggagttgtcacgaagtacttgcttcagagtggtcttcaagaatacctcaaccagcaaggattccatatcgttggctatggctgtaccacttgcattggaaactctggtgatctcgatgaatctgtatcaactgccattacagaaaatgatgttgttgctgctgctgttttgtcgggtaaccgtaacttcgagggtcgtgtgcaccctttaactcgggctaactatcttgcttcgccacctcttgttgttgcttatgcacttgccggaactgttgatattgattttgagaaagagcccattggatttggaaaggatggc

SEQ ID NO: 3092 - DNA, 430 bp, Zea mays
  Clone ID: LIB143-014-Q1-E1-B9
ggggccacccacgcgatccgtaccgaaggacaggagctcccgcgtttcctcttacgagagccgccgggctggtgcctccccatacttctcatcgtctcatggacagagcagttcttctcgccggtcagaggagtcttgtgtggcagcagcggcggcagcagcaaagcaagctgcagagtgggaggatgttcggtgcccggtgtgcatggaccacccgcacaacgccgtcctgctggtctgctcctcacacgagaagggctgccgccccttcatgtgcgacaccagctcgcggcactcgaactgctatgaccagtaccggaaggcatccaaggattcaaggacagagtgcagcgagtgccagcagcaggttcagctctcgtgcccactgtgccgtgggccggtcagcgattgcatcaaggactacagcgcg

SEQ ID NO: 3093 - DNA, 425 bp, Zea mays
  Clone ID: LIB143-014-Q1-E1-C1
gaacaaggcctactgcgagatcggcaacgtcggctccttccagtcgcagtgggacaatctctacaaaaaactcaacaaggccggatacactaccaacgcaagtggtaccagctcgtctatttccgccgcaactgccaagggcagctcccccgacttcaaagcatatgtgaagatcccttacagcgcatgatgtcaaatcggatccgtcatccacatcgtatcgcgtcgttctgcttgtactctgcttcttcctctatgtattaataatcccagcagcttgaaataataacaatgcatgcatgcatccatgatgaaaattagaaataatgtttatgtccccaaccacgcctacttatgctctcgagttacttatttgctgctgtctctcaactgcatgcctatgtaatatatatacaataaaagag

SEQ ID NO: 3094 - DNA, 429 bp, Zea mays
  unsure at all n locations
  Clone ID: LIB143-014-Q1-E1-C10
cacacgcgtccgcccacgcgtccgatccaccacaccacaccatgagcgggagcgcctccaggaagctcttccagaccgccaggtccatcgtcctctccgcttctcaacgctcctccttctccgtcctcgccgccgagggccgcaccgccgcgctcgccaactttggcaggaagatcctccccagcgcctgctcctaccacaggcagggatcccacgccgcgtcgggatggggagccatcgctgccgcagtccccgccgcagtttacatgctccaggaccaggaggctcatgctgcagagatggagcgcactttcatcgccatcaagcccgacggcgtccaaagaggcctgatttctgagattgtgaaccgattcgagagaaaaggctacaagcttgttgccatcaagctgattgtcncatccaaaggat

SEQ ID NO: 3095 - DNA, 420 bp, Zea mays
  unsure at all n locations
  Clone ID: LIB143-014-Q1-E1-C11
ccacgcatccgcacacctgccggaaacattcacccagacagcccagctgcaaaatatctgaaggagcgtggcgttgaaaggaaggacttcaactcatatggtagccgaagaggaaatgatgagatcatggctaggggaacctttgccaacattcgtcttgtgaataagttcttgaagggtgaggttggacccaagacaatccatgttccatctggggagaagcttgcagtttttgatgctgctatgaaatacaagaatgaagggcatgacactattatcctggctggtgccgagtacgggagtggaagctctcgggattgggctgcaaagggcccaatgctgcaaggagtgaaggctgtgatagcaaagagcttcgagaagattcancgcaacaatcttgctggcatgggaatcatccct

SEQ ID NO: 3096 - DNA, 391 bp, Zea mays
  Clone ID: LIB143-014-Q1-E1-C12
tggagttggagctctatatggtcctctgcatggcggcgcaaacgaggcagtacttaaaatgttaaatgagattggaagcatggaaaatattccagatttcattgtaggagtgaagaacaggaagaggaagatgtccggttttgggcaccgtgtgtataaaaactatgaccctcgtgctaaagtcataaggaaattggcagatgaggtgttctcaattgttggacgggatccacttattgaggtggccattgccctagaaaaggcagcgctgtcagacaaatattttatcaagaggaagctgtatccagatgtggatttctactctgggctaagttagagggcaatgggattgacctaagaaatttttcctgtgctgtttgctagtcctcgg

SEQ ID NO: 3097 - DNA, 318 bp, Zea mays
  Clone ID: LIB143-014-Q1-E1-C2
cacgggtcacggagagaccgcgcagcagcagagctagttcgttcaggcagctttatttgagcagacatatataggagaagatccgaggagaaagatattagcttgctaagagatctcgccatggcgtccatgatgggaggagacttggtggaggcgtacgtgctcaagaacgcgtgcaaggagaagctccggcgcatggaggcggcggcggcggcggccgacgataagacgagcaagcagggccgcctcgcggagaagaaggtctcaggcagaggacgacgcctgcttgggctcctgaagaagaaggtgcacccaaaa

SEQ ID NO: 3098 - DNA, 304 bp, Zea mays
  Clone ID: LIB143-014-Q1-E1-C3
cgggtccacgcacgcgtccggaccaggaaagttactgagaaccctcctgtgcgacattgtggcaactggactgaagattgaggaccagctctcccttgggaagaggttgtcactagttgctagcactggcgcgatgcgagcccaaggggacactgcatatggagctaacctggaggcacgcttgaaggacaaagactatccgatagcccagtccctctcaaccttgggtctctctctgatgaagtggcgtcgggaccttgctctgggcgcaaacttgcagtcccagttttccatcggaagggag

SEQ ID NO: 3099 - DNA, 454 bp, Zea mays
  unsure at all n locations
  Clone ID: LIB143-014-Q1-E1-C4
ggggccacgcacgcgtccggaaatttgcgtaatacctcccatttgtgttttttataatccacattttttgctgttataacaccatgtacaccaatctttcatgtgcacaagatatgttctcttattatttatcagcaacttttttattcatgaaatactcaatgctatgttaccttgttctttatcttagtttgccttcgtagcgtaaatcattttgttctagagaccctgtatcatgcanagtcaaacgttgcagaaattgaaattctgaagagtttcacatagagtatgttaaaaaagttggttttataaataatggaacatttttttgcccagttgcctttcacttgaggtgttagtaatcatttcttattccagtattggtgtacanacaattgacagaaatattatttggcatggaaatattttgatggcacagtacgctttttctgcc

SEQ ID NO: 3100 - DNA, 269 bp, Zea mays
  Clone ID: LIB143-014-Q1-E1-C5
gggtccacccacgcatccgatcatattgcctgcattggatcattctactatgacgtttgtgccaatgtattcatagatccacgtttggtgcctgcagtgccacattgctagaatcgtgacatctgcagatggaataacttgagagcttgttcggtactgattgctcttttatcaccagtctatttagcggatgagagtttttttttgttcgggtatggtcagtggtcacgatatattgcagagtatgagtaattgtgtgtatttaaggt

SEQ ID NO: 3101 - DNA, 64 bp, Zea mays
  Clone ID: LIB143-014-Q1-E1-C6
gattcatttttgactacgtcagtatgaaacttattgcagacactatcagctacttctacaatca

SEQ ID NO: 3102 - DNA, 369 bp, Zea mays
  Clone ID: LIB143-014-Q1-E1-B11
ccacgcatccgcacacgcgtccgggctcatccttgcttaattaccaaggtacctttgcagctgcaggtaggtaggtagctagccgccatagcaagctaggccgaagcagaggagtgatggccaaggtccaccccaacgccgcggagtccgtcgtcgccccagcagtagcaccagtaggctccgcccaggcagaggccgagggagagctgcccacggtgctgacggtgtggcgcaagtcgctgctcttcaactgcgacggcttcaccgtctacgacgcccgcggcgacctggccttccgcgtggactgctacgccggctcgttccgccgccggcgccgcgccgacgtcgtgctcatggacgccacgggga

SEQ ID NO: 3103 - DNA, 280 bp, Zea mays
  Clone ID: LIB143-013-Q1-E1-H5
gcgcgccaggcaagtcttccggccggccgcgaatagcggagtcatcgcagcacacgatggggaagctcgccttcggaagcgtccgcgactccttcagcgccacctccatcaatgcctagctagccgagttcatcgccaggctcctcgtgatcgtcgcctgggtcggttccgcgatcggctaacggcagactggcaatgggggtacactggactacgagggcctggcggggatcgggatagcgcatgcgctggggctgttcgtgggcgtgtgcgtcccggg

SEQ ID NO: 3104 - DNA, 464 bp, Zea mays
  Clone ID: LIB143-013-Q1-E1-H6
cccacgcgtacgaaagaaagaaagaaaaaaaaactaggcattctgcttgcttgcttggggcgctctagtgctcgcttgctgcacctgcaccggtcgcgcacagcctgggaagaggcgagctgaggtctgaggaagccgagaagccgggctcagcgtgcgtacagggacagagacggcaagccggagcatcgatccgttggtgcaagcaggaccggaggatcaccactcagagccatgctgcagcacggcgaggagaagaaggggaaggtgaagaaggggtggctggcggtgcgcgtcggggcggcggagggcgacggctcccagcagcgcttcgtcatccccatcgcgtacctgtaccacccgcagttccggcgcctgctggaggccgcgcgcgacgcctacggctacgactactccgcggggccgctgcgcctgccctgctccgccgacgagttcctccgcct

SEQ ID NO: 3105 - DNA, 355 bp, Zea mays
  Clone ID: LIB143-013-Q1-E1-H7
gacgagcttctcaccaagtatatcagccgggtgctgctgctccgatatcctcaactgataagccaatatcatcaagatggaggatactgatgcccgatggatcctatggcaagtatccaactccgaggcgcctagccacatccgagataccagaaattgttgagcaataccgtcaagcagccataaacgccatcaaagcaggtttcgatggcatcgagattcatggcgcccatggctacctcatcgatgagttcctcaagggcggtatcaacgaccggactgacgagtacggtggctcactctccaaccgttgccagttcctcctggaggtgacccgagccgtggtctctgcgat

SEQ ID NO: 3106 - DNA, 440 bp, Zea mays
  Clone ID: LIB143-013-Q1-E1-H8
cacccacgcgtacgcacaccccaccaacccatacccataccagaggctcgctgatcttacttctcaacggtagatcggatgatcgaccgaacgaacgatgcagacggcgctagcttcacagagcacactgctagctcagcagcatgtcggacggtacggcgacctgcatcttcatcatcctcaccattatcctgccaccgctcggagtcatcctcgtgttcagctgctcggtgctgtaactaccacatcggctgccgctttctgacttccttgctgcagtgcactgccaatcgacagataactgttgttgcttactcgcatgctgcaggctgatcttcggatctgtcttatcactcagcttcttcggctacctcgccagcatcatctacgctgtcagggccatcagcatctagcaggccggtgcgtaagcatccaatgca

SEQ ID NO: 3107 - DNA, 433 bp, Zea mays
  Clone ID: LIB143-013-Q1-E1-H9
cagacgcatgggcggacgcgtgggcggacgcgtggggactcaagaaagtgctgaggagattgagacatatcagcggtataagtaccctactatgagcaaaacacaggggaatttcaagcttactgttgttgagggtgaatttaccgattctcagattgttgttatgcttggtgaaaacgggacagggaaaactaccttcattagaatgctggctgggttgttgaagccagacacagtggaaggaactgatattgaaattcctgaattcaatgtgtcttacaagccccaaaagattagcccgaaattcaagaacaccgtgaggcatttgctacaccagaaaattcgggattcctatatgcaccctcagtttgtgtctgatgtaatgaagccactgcaaattgaacaactcatggaccaagaggttgttaattta

SEQ ID NO: 3108 - DNA, 444 bp, Zea mays
  Clone ID: LIB143-014-Q1-E1-A1
caacgcgtccggaagagacgccaaaggaggaagagacggcaaaggaggcggagccggagccggagccggcggcggctgaagaggtgaaggaggaagcggcagcgcccgctgccgagacagaagcagaaccggcagccgctgagcccgaggctgctgctgctgctgaggagcccgcggcggctgagccggccgctgaggagcccgagaaggccgagccggccgctgaggtggccgagaaggccagcgagtgaggccgtgcgccgtacgcgcactgcggcggcggacagcgggtcgggagatcgatgtctcagcgtgcgcgcgtggcgtgccagtcgcgtcgcgcgcgctggcgcctactgttcagtacaacgcgaacgcgacggtttctctccatctctccgtgtgtgacagtgtgtgtgtcgtagctatagcagtgcccggtgc

SEQ ID NO: 3109 - DNA, 442 bp, Zea mays
  Clone ID: LIB143-014-Q1-E1-A2
caaacgcgtccgcccacgcgtccgcccacgcgtccgatgggctgtgataagcaaggttattttaccttggatgaatggagaactggcttgaaagctcttcgagctgacagtattagtaaactgaagaaagcatttccagaactggtccaagaggtgattctgtctccccaaatattatcttatgttcaagtgagccatgcatatcagagatttaatttatggagtgaagaacttccatctaacagatatatcatgatatattgccaccttgtgactgtaatggacaatgagctatcattaattgttgatatttttttgttgaagtgtaaccttgctgaccacttcatgtgtttataaatccaggttacaaggccatccaatttccaggatttctacatatatgcatttcgttattgcctcacaagagataagaagaaatgta

SEQ ID NO: 3110 - DNA, 295 bp, Zea mays
  Clone ID: LIB143-014-Q1-E1-A3
cacgcgtccggatacgcatcggcttacgagtctgcccacacatctcatgggtcgtgataaacaatgttatgttaccttgggtgctcgcacaactgctttacaggcgcctccagctgccagtagcagcagacgtaagaaagcatttcgagaactgggcgagaacgtgattcagtctctccagagctgagcctaggttcatgtgaaccatacatatgagatactgaagttattggctgaagtccttccagctaacatatatatcatgatatagtgccactctgagactgtcatgttc

SEQ ID NO: 3111 - DNA, 437 bp, Zea mays
  Clone ID: LIB143-014-Q1-E1-A4
gattcagcttgtattcccactctgtcgcacagcgtcgcccgtcgccgctgagatcctaggaagaaatggagctctctcgcaagctcttcacggtcgtcctcctcgtcatgctgctgctgctgtccgcacgtacgttggtgcggccggctgaccgtcttacatgtcttctgtgctgtggactcggtactgatgatgagatgtctgagatgctgctgcgtgctgcagaggtcgggccggtggcggtggcggaggcgcggacgtgccagtcgcagagccacaggttccggggcccctgcctccgccggtccaactgcgccaacgtctgcatgaccgatgggttccccggcggcaggtgccgcggcttccgccgccgctgcttctgcagcacgcactgccactgattcgctcgctcgcgcagcggccggctggcgtcgccg

SEQ ID NO: 3112 - DNA, 451 bp, Zea mays
  Clone ID: LIB143-014-Q1-E1-A7
gccacccacgcgtccgcaaagaagaatcgccatcacagcaagctacgcgcactgaaatcctccaatccacaggacacagctctacttccacagttcgcagactcgcacgcaccgagcggctagcgatcaacgagaaatgtcgctggtgaggcgcagcagcgtgttcgacccattctctgtggacctcttcgacgccttcgacagcatgttccgctccatcgtgccgccgtcgttgtcgtcgtcggcggcctccgagaccgccgccttcgccagcgcccgcatcgactggaaggagacgcccgaggcgcacgtgttcaatgccgacctccccggcgtgaagaatgaggaggtcaacgtggaggtggaggacggcaacgtgctgctcatcagcgggcagcgcagcagggataatgaagacaacggcgacaagtggcaccgcgtggagcgcaac

SEQ ID NO: 3113 - DNA, 289 bp, Zea mays
  Clone ID: LIB143-014-Q1-E1-A8
ttcgccggtccacccacgcgaccgcacacgcgtccgcggacgcgtggggaatttcttcaatctgctggtcaatgacgctaatcccaacgccgcttagcccattgcatccatcgccgtccccaagccgaatcccttgatcaaggtcaatgtcaagaccgttgcaatacccaatgcggcgtcctcaatgtcaaggtcatcgtcaacgtcaaggtcatggtcaagcctatcgctcctgcctcctcgtcatccatgccccgcctgcgcaatctcaacgttgccaatatctccg

SEQ ID NO: 3114 - DNA, 303 bp, Zea mays
  Clone ID: LIB143-014-Q1-E1-A9
ccacgcgtccgcatcgcatcccatcccactaccacccatctcgtcgtccgccgattcgatccggttcttccaacccagggtgagtctccggatccgtcgccgtctggtatccgtgtgctctcgtcgccgtcgccgtcgccgccgtctgactgcccccctcgcctcccgcggcgtcgggtctctggtgctgctgctgctgctgctgctgctgcgtgcagggcagtgatggcgacgaagaggagcgtgggcaccctcggcgaggcggatctgaaggggaagaaggtgttcgtgcgcgccgacctc

SEQ ID NO: 3115 - DNA, 438 bp, Zea mays
  Clone ID: LIB143-014-Q1-E1-B1
cgtccgtactgaaattaacatatatggcgctgctcattatacacttatgtaagtcgtataatctctcataaattaccttcatggacttggatcgtttaagggaatactgatcagcttttgatattaacagattcggattttacatttctataaatcctataatctctcttaaatcacctccatggacttggatcgttagcgatggtatcattttgtttgtcatggtaatgtcataaaatgttttttagaattcaatttggatgcctcttatagatcacataatttgtttgtgcacatttctatagcctcgttattttggtcttttaattggcttactcttcgatataagaaaaacaaacggatacattttttgaaacattagctaaccttttggcttcgtcaaatatagacatcacattacacctacgactgatgtta

SEQ ID NO: 3116 - DNA, 318 bp, Zea mays
  Clone ID: LIB143-014-Q1-E1-B10
cagacgcgtgtgcgggcgcgtgggtcgacttaatacagtcatacacagtcatatcagcaggccatgcattcacaatgcgagcttatctgcagcactatttggttgattttttaatcattgcctgcggccgaacatattgccgttgactcattcgatctcgtcatcactagctacgatgatgtgctgcgacgcctggctgatgacgatgccatgattgacctcaagaccggtatggtcgatcaggactatgtgccaccgacaattaatgttgcagaggagaaggagatcgggatcgatgtgctcatgaataatcttgtc

SEQ ID NO: 3117 - DNA, 438 bp, Zea mays
  unsure at all n locations
  Clone ID: LIB143-013-Q1-E1-H4
ccaagcctctcttactctcggccgtcgccctgctcgcccgaagcagctgccggcaaaatggccccgaaaaaaggcggtagggcgccggtccccgccaagaaaaaggcggtggtgacaaacccgctcttcaagaaaaggccgaagcagtttgggatcngcggcgcccttccgcccaagaacgacctccaccgcttcgtcaagtggcccaaggtcgtgcgcatccagcgccagcgccgcatcctcaagcagcgcctcaaggtgcccccggcgctcaaccagttcacacgtaccctcgacaagaaccttgcaacaaacttgttcaagatgcttcttaagtaccgccccgaggacaaagctgccaagaaggagaagctcttgaagagggcccaggctgaaaacgaagggaaaactgttgagtcaaagaaaccaattgttgtg

SEQ ID NO: 3118 - DNA, 424 bp, Zea mays
  Clone ID: LIB143-013-Q1-E1-G11
gaccaaagtcgactacgagaagattgtcagggagacatgccgcaacattggtttcgtgtcgaacgatgtcgggcttgacgctgaccactgcaaggtgcttgtgaacattgagcagcagtcccctgatattgctcagggtgtgcacggccacttcaccaagcgccccgaggagattggagctggtgaccaggggcacatgtttgggtatgcgactgacgagacccctgagctgatgcccctcagccatgtccttgccaccaagcttggtgctcgtctcacggaggttcgcaagaatggaacctgcccctggctcaggcccgatgggaagacccaggtgacagtggagtaccgcaacgagggtggcgccatggttcccatccgtgtgcacacagtcctcatctctacccagcacgacgagacagtc

SEQ ID NO: 3119 - DNA, 438 bp, Zea mays
  Clone ID: LIB143-013-Q1-E1-G12
cacggggccatgcacgcgtccggaggagaacccgccacaccagcaatcacagcagcccggagaacgccctggtccaacaagatgcagatcttcgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgctccacctcgtgcttaggctccgcggtggaatcattgagccctctctgcaggcgctcgctcgcaagtacaaccaggacaagatgatctgccgcaaatgctatgcacgactgcaccctaaggctgtcaactgccgcaagaagaagtgtggtcacagcaac

SEQ ID NO: 3120 - DNA, 437 bp, Zea mays
  Clone ID: LIB143-013-Q1-E1-G2
aaagggcagcaccacaatcagagaattacacctcctcccttcgcctgtgatcatgtcgtcttgcagcggacgcatgtgctgttgcagctccaactgctcctgcagcagccgctgcaacggctgcggtatgtaccctgacatggatcaccgacgatacttaacaagtactgacatccgacgtcgccaccccgaccaccataggtagcgcctgctgcttcgacgcagacaccttgggctgcagctgcgactgcaatacctgtaagtgccggactagctgcagctgcacatgctgcagctgccactgatctggtccagatcgtctatggcgcacgagagtctacacgaggacgtctactatgatgcgtataaatataatagcggcgtccagtaaataagatcctgtcaactgcacccgccattatccatggtcgctcgct

SEQ ID NO: 3121 - DNA, 466 bp, Zea mays
  Clone ID: LIB143-013-Q1-E1-G3
gggtccagccacgcgtccgcaagaaccctgagctgatgcccctcagccatgtccttgccaccaagcttggtgctcgtctcacggaggttcgcaagaatggaacctgcccctggctcaggcccgatgggaagacccaggtgacagtggagtaccgcaacgagggtggcgccatggttcccatccgtgtgcacacagtcctcatctctacccagcacgacgagacagtcaccaacgacgagattgctgctgacctgaaggagcacgtcatcaagccagtcatccccgagcagtacctcgacgagaagacaatcttccacctcaacccgtctggccgcttcgtcatcggcggacctcacggcgacgctggcctcactggccggaagatcatcatcgacacctacggtggctggggagcccacggcgggggcgccttctccggcaaaggaccgaccaaggtggaccgcag

SEQ ID NO: 3122 - DNA, 433 bp, Zea mays
  Clone ID: LIB143-013-Q1-E1-G4
tcaccaattggccccggtaccgcccggtcatcgccgatttcatcgcaaggcggcccttcttcaaaatcaccgtggcaaccgtgatcgggtacaagcacaagacggacgcttcggcgtcgggccccgacgcggcgtgcggcggcgtcggcatcctcggcatcgcgtgggccttcggcggcatgatcttcatcctcgtctactgcaccgccggcatctcaggtgggcacatcaacccggccgtgaccttcggcctgttcctggccaggaaggtgtccctcgtccgcgcgctgctctacatcgtggcgcagtgcctgggcgccatctgcggcgtgggcctcgtcaagggcttccagagcgcctactacgtgcgctacggcggcggcgccaacgagctcagcgacggctactccaagggcaccggcctcgccgccga

SEQ ID NO: 3123 - DNA, 430 bp, Zea mays
  Clone ID: LIB143-013-Q1-E1-G7
aagtggtgatcataccggccggcgtcccgaggaagcccggcatgaccagggacgacctattcaatatcaacgctggcatcgttaagaacctcagcaccgccatcgccaagtactgccccaatgcccttgtcaacatgatcagcaaccctgtgaattcaactgtaccgattgctgctgaggttttcaagaaggctgggacatatgatgagaagaagttgtttggcgtgaccacccttgatgttgttcgtgctaagactttctatgctgggaaggctaatttaccagttaccgatgtgaatgtccctgttgttggtggtcatgcgggtatcactatcctgccgttgttctcacaggccacccctgcaaccaacgcattgtctgatgaagacatcaatgctctcaccaagatgacacatgatggtggaactga

SEQ ID NO: 3124 - DNA, 444 bp, Zea mays
  Clone ID: LIB143-013-Q1-E1-G8
aacgatttcaaagatatattcgacgtcgaccacttcaaggagtcgttgaaggaagacattgtgatcgtggattccctcccaccacattacagaagggtgaaaccgtacgtgagagcacccacctcctggtccagggcttccttctacagagacttcgcgaaaatcctgatgaagttcaaagtggtgaggttgacgcacacggattcacggatcgtgaacaacggcctcgctccttcgctgcaaaagcttcggtgccgcgcgaactacgaggcgctccagtacaggaaggagatcgaagagctcggcaacacgctggttgatcggctgagaaacgagtcgcagcattacatcgcgcttcacctgagatacgagaaggacatgctggcattcaccgggtgcaaccacaacctgacgctggatgatgcggcggagctgactgacatg

SEQ ID NO: 3125 - DNA, 387 bp, Zea mays
  Clone ID: LIB143-013-Q1-E1-G9
tacacgactctatagtgaatcgtgttatggaacgactcccataatgattgctacagaacttcctgcaattggattcaggcgtgacttacgatcattccctctactgtggggtatcactacgttcattgcaggatactccaccatccaaatttaaccagtagcgatacgtcagctatctgcgtgcaatcatatcacgatatctatgttagattgcgattcaactcctatgttccagtaccaaaataatatctactgtaatgtgaacagcataccatgttgtcagtctctgtggattcagtcggatcgtggccatggcttaatttccaccggacatgctgggcttccacaggacataatgcaaactaatcgtacttatgttgacttgtc

SEQ ID NO: 3126 - DNA, 447 bp, Zea mays
  Clone ID: LIB143-013-Q1-E1-H1
cactcgagttcagatcgagcgcgcgccaagcaagtcttccggccggccgcgaagagcgcaatcaagcaagacaagatggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgcctgctcctcgggtttcgtcaccac

SEQ ID NO: 3127 - DNA, 66 bp, Zea mays
  Clone ID: LIB143-013-Q1-E1-H10
cgtccgaaatgaaacgtattaaaaaaaaaaaaaaaaaaaaaaaaaaaaaaaacaagaaaaaggaaa

SEQ ID NO: 3128 - DNA, 438 bp, Zea mays
  Clone ID: LIB143-013-Q1-E1-H11
acacgtctctagagggaatcctattatatctctaggaagactctcaggagctcagccgagaagtttgagttccaagctgaggtttccagactcatggacatcatcatcaactcactctacagcaacaaggatatcttcctgagggagctcatatctaatgcctctgatgcgttggataagattaggttcctttctcttactgataaggaagttctaggtgaaggggacactgcaaagcttgagattcagattaagttggacaaagagaagaaaatcctctccattcgggataggggtattggtatgaccaaggaagatcttattaagaaccttggaacgattgctaaatctggcacttcagcttttgtggaaaagatgcagtctggaggtgacctcaatcttattggacagtttggtgttggcttctactctgtgtac

SEQ ID NO: 3129 - DNA, 447 bp, Zea mays
  unsure at all n locations
  Clone ID: LIB143-013-Q1-E1-H12
catacaccactctacagtgagtcgtcatagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcncacccggtcaagctcgcgcctttcagcccggaccaggaggacgcgtcggtgctgtggacggagagcaaggacgtgggcaagggcttccgctgcatccgcatggtc

SEQ ID NO: 3130 - DNA, 467 bp, Zea mays
  Clone ID: LIB143-013-Q1-E1-H2
gggtccagcacgcgtccggatcgacctgccccccatctccttcaccacgctgctccctgcctccttgttggtcggccataccctctgctcctccccaccgtccgcagccccgacgtcgtcgccgtgtttagtcatggtgattcctaacccctttattttatttcactaattcttctaatgcgagcagatttttattgatgttgatatgcggttatgtgtatttgtgtgcgagtgtggcggagagaaagatctcaggtttttggatggagaagaagcgaggccagtgcgacgctcgctatgtgctcgacgtaaggtctaaacattagatcgtcgctatgtttgctttcatccgagtcaacttagtagtggtacgctagctgatcacgtgaggcggagttcaagagccgagttgatctcaagatgatgaaatgatgaactactccgacaaacaatgttgacgaatcgac

SEQ ID NO: 3131 - DNA, 447 bp, Zea mays
  unsure at all n locations
  Clone ID: LIB143-013-Q1-E1-H3
gtgctctgttctcatcttctgctcgctggtgtcccctccctctcacccatggcttcngcggcggcggcaactcaggtggggacttacttcctgcggaactactacaacctgctgcaacaaacccccgatgtcgtccaccagttctacagcgaagccagcaccatggtccgcgtcgacgacctcaccggcacgaccgcggctgccaacaacatgatggacatacactcactcatcatgtctttgaacttcacccaaattgagatcaagactgccaattttgtgaactcatggggcgatggggtgctagttatggtctctggtctagtgcagaccaaggagtacagccaccaaaggaaatttatccagatgttcttccttgcncctcaagagaagggttactttgtcctcaacgattactttcacttcgttgaccaagaacatgtgcag

SEQ ID NO: 3132 - DNA, 436 bp, Zea mays
  Clone ID: LIB143-013-Q1-E1-G1
gccaccgacggccgacgtcgagcctccgcggccgagcctccgcctagcaccaactccgtcgtcgatcgtcctatgcgaccacgcccccgtccgccttccgtctcctgcctccactgagtcgcgggcgcgacatcggggaacgccaaggctgagcttcgcccatacgcctaccgccctgttatgccccgaaccgccgtgctgaggtccgcccaggccgggccaggagcttctcccggcagacccacccccgcccaacggagctccatgcctccgcccagggccattgtccgagctacgccccacgctcctgtccagtgccctggccacttagatggttctgctcagtcatgtttagtgtctggttcaacaacttcaacttcaaccaagggacgcatctatcacaagacgtatggttgccaaatgaatataagtgaca

SEQ ID NO: 3133 - DNA, 271 bp, Zea mays
  Clone ID: LIB143-032-Q1-E1-A3
tgctgggcattgcggtgcgcgggactggcggtgcgccgtgcggactgtcagggtcttgcgtgactgctatcctgagaagttggggcttgcaatccgttaggagtctcctaggggatttgaatcattctggaagatagtgaagccgttccgacaccatgagacccgcatgaaggtgaggtttgtgtggtccaacgacaaggagagccatgagatggtggcagaagtctttgacgtggaggagctcgagtcgggcattctgggggacagagcc

SEQ ID NO: 3134 - DNA, 451 bp, Zea mays
  Clone ID: LIB143-032-Q1-E1-A4
gtcgatacaaccctctaaatgcagtcttattacgtgatatgggctacaacgttagtatgatggctgactccacctcacgatgggctgaggctttgcgtgagatctcagggcgtttggctgaaatgcctgctgatagtggttacccagcttacttggctgcgcgtttggcatccttttatgaacgtgctggtaaggtgaaatgcctgggaagtccagacaggactggcagtgtcacaattgttggagccgtctctcctccaggtggtgatttttcagaccctgttacctctgcaaccctcagtattgttcaggtcttctggggtttagataaaaagcccgctcaaaggaagcatttcccatctgtgaattggctcatttcctattcgaaatactccaaggcccttgagtccttttatgagaggtttgatccagatttcattgatattaggac

SEQ ID NO: 3135 - DNA, 429 bp, Zea mays
  Clone ID: LIB143-032-Q1-E1-A5
agtcagtcgcccatggcggatgaggaggtcactgatccaaaggcgctcctagaggatcgttcaaaagctaagtgtgtgtcgcagtggtatgattatcagaaatgtgttaaaaggattgaggacgatgagactgggcacaagcactgtaccggtcagtactttgattactggaaatgtgttgacaagaatgttgcagagaaactctttgagatgttaaaatgacaaattttccctccatttatccacttaaagttggtaataattgtatcacttgtgaggcctatagactattaaggcacttaatatttgtcagagaacttttgcctcttgggtaacacaaattttccactgccagtttgcatttcatttctgctactagtattgaaccagcaaggtttcctccattgctggataaaaatcaatggaata

SEQ ID NO: 3136 - DNA, 431 bp, Zea mays
  Clone ID: LIB143-032-Q1-E1-A6
aatcgctcatcaatcgccagaggagttgttgatcgaggtgagtgaggttgaaaagcacaccatcgtcatggacggcggatactacggcggtcgcgatcagcgctacagcggcgggtactacggcggcggtggcatcgcaacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgacgggaaggtggtgctggcgccggcgaaccccaaggacgagtaccagcactggatcaaggacatgcggtggagcacgagcatcaaggacgaggaaggttacccggcgttcgcgctggtgaacaaagcgaccggggaggccatcaagcact

SEQ ID NO: 3137 - DNA, 442 bp, Zea mays
  Clone ID: LIB143-032-Q1-E1-A7
actaaacttcgaagcgcatcagcgcaaagtaggacagccatggcgacggcggcggcgcagtcccatccggcatcgatggacgcgcgccggtgggacgagtcatcgtaccgccgcggcatcctccgtgcccgcgacctctcgtcccgcaccctcttccgtgccgtcttctttgaccacagcgacgacgcggataccgacatcctactcgccgccgcctccagcgacggctccctcgcttccttctccctttcatcctgcatctccgcatgttccgctacctcccaggtggagaccgccgccactctggtagatcctgtctgcatcgtgcaagcgcacagcggacctgcctacgacgtcaggttttaccccgatcaacagcagccgctgctcttcagctgccgggacgattgccgcatcaagggttggaggtggcacgagatgc

SEQ ID NO: 3138 - DNA, 431 bp, Zea mays
  Clone ID: LIB143-032-Q1-E1-B1
agaacgaggaacttccatggttatgctcaaaaacatttcagaagccaagttcaagcatatcttaaagcctatagctgatgcctgcatcagagaggaacaaaaggaatatgttgatttcgagccatattatacacatatagtctgtcatgaatgctgccatggaattggacctcattctatcacccttccaagtggtaaaaaaacaacagttagaagggaacttcaagaattccattcagcattggaggaggcaaaagctgatatagttggtctctgggcactgaatttccttattaagaagggattgcttcctaagagcctgtcacaatctatgtatgtctctttcctggctggctgcttccggtcaatccgctttgggctggaagaagctcacggaaaaggacaagctctgcagtttaactggttgtatg

SEQ ID NO: 3139 - DNA, 410 bp, Zea mays
  Clone ID: LIB143-032-Q1-E1-B10
acgggtcgataacgcgtctagtatgactggagctagccatgattgtggatcttccatggtatgaaaaatgtgtctacgtctaaaaagatccgtgtgccaggatttgtgcatacacttgcactgtcagtcatcgtgaggatgaccagtctatgccaccatcgtgatgcatacagtacttcgaagtatagccagtttgctctcgcgggacacgctggacgcaacggacaacctctggcgagcttgatgtatgaatctacagctttatactgtaaatggacactatagaatcaacatgctactcagtgtgtgcaacgctaggtatgctcgtgcggcgtcatcacttagattcaatttacgcactacttaacgtgtcacacgcttccattaaccgtacctccatggggattcag

SEQ ID NO: 3140 - DNA, 394 bp, Zea mays
  Clone ID: LIB143-032-Q1-E1-B12
acacccccaccgctacataccgccgctagctggttcaagtgcggcgagcggagccggagaccggtagaggaaattaagaggcgtcgatcgggcatggggtgcgacgacaagtgcgggtgcgccgtgccgtgccccggcggcaaagactgcaggtgcacgtcggggagcggcgggcagcgggagcacacgacttgcggttgcggggagcactgtgagtgcagcccgtgcacgtgtggccgggccacgatgccgtccggccgcgagaacaggagggctaactgctcctgcggggcgtcctgcaactgcgcatcctgcgcctcggcctgatccgtgcgcctcgccctcgtgctaccgcgctgcctagtggagggagttgtctagtgaggctggagac

SEQ ID NO: 3141 - DNA, 324 bp, Zea mays
  Clone ID: LIB143-032-Q1-E1-B3
ggtcgatacaaccctctagaatgcatcgtaccaattgatatatatagtgaatggattgatgagtgtgagcgtgtcaacactgttgaaggcgacgatgatgcgtgagcttgccccatgtgatgaaactgttacctacaatcgtaatgtaatgtgctggtattctcgaatgccatagcccatagtcagccatggcttggaataacgtagtggctgactgatatgccagtaggcaccttatctagtacttacagaactacaaaaagtttgtactatacatatatggacaaccttataagtggctatgtgtgtacctatcctaacgct

SEQ ID NO: 3142 - DNA, 418 bp, Zea mays
  Clone ID: LIB143-032-Q1-E1-B5
acacgacgcgtcgagcggtcgagccccatcccgttcccgccccgcgcctcgcctcgccttgagatctgtggcgtcgtcggcaccagtccgtccgtccgtccttccgtcgtcggcgccggagaacgagtagagatggaggagacggcggcggtagcggcggcggctgagaaggcgtcgtcgtacaggtactgggtgcgggaggccaccggcgacgccgcgccgctccccgtcccgcgcaagctcgacaccgctgccaacgggaacgggaacccgccgcccgtcggctccgtctggaatcaggctggaacatgggaggaaaagaacctcaactcatgggccaatagtagaataaaggatttgatgggctctttaggttcattggccttccctacagggaaggcatctattgacgaagtgt

SEQ ID NO: 3143 - DNA, 434 bp, Zea mays
  Clone ID: LIB143-032-Q1-E1-B6
aaagaagggttacatcccgctcaccacgtacctgcgcacctacaagatcggcgactacgtcgacgtcaaggtgaacggcgccgtgcacaagggcatgccgcacaagttctaccacggccgcaccggtcgcgtctggaacgtcaccaagcgcgccatcggcgttgagatcaacaagcaggttaatggccgcatcatcaggaagcgtatccatgtccgtgtggagcatgtgcagccctcccgttgcacagaggagttccgcttgaggaaagccaagaacgatcagctcaaggttgatgccaaggaccgtggcgaggtgatcagcaccaagaggcagcctgtgggacccaaacctggcttcatggttgagggtgctacacttgagaccgttactcctattccctatgatgtggtaaatgatctcaaggggggttact

SEQ ID NO: 3144 - DNA, 428 bp, Zea mays
  Clone ID: LIB143-032-Q1-E1-B7
agtctgccgctgcacacccctgctgcgtttttaccacaaaaatgtcgaaacatacaacccagtagcaaaaaagcacgaaaaaaaaacggttttacaagaccatttgcgggatatactttcttcaagaaatcttccccacttgttccctcgcgtccatggccttgctccagcctactcttctcactcctcccccgctctgctgctgctcgcatggcctcctctacccagggttcctgaaactgcctcccaaattctcaaatggggcctgctgttccacggcgagggcgtcggaccggagcgagctggcgggtaaaagcgggggcttggcttggagagcggcggggagaaaggggcggctgcttggcgtcaccggagctgggcgaggccccttctttggcggcggcgggaggcgtatggacaagggcact

SEQ ID NO: 3145 - DNA, 460 bp, Zea mays
  Clone ID: LIB143-032-Q1-E1-B8
cacaggactaggactcgcgggtcgatacaagcctctagattgagtcatataatagcagtcgaccggttcctcggagcacgatgaagtttgttgctgcctacctgcttgctgtcctcgctgggaacgccagcccctccgctgacgatttgactgccattctggagtcagttggctgtgaagttgacaatgaaaagatggaactcctgctgtcccaactgagcggtaaggacatcaccgagctcattgccgcgggcagggagaagtttgcttcagtcccatgtggtggcggcggtgtcgctgttgcggcagctgcacctgctgctggcggagctgctcctgcagctgacgcaaagaaagaagagaaggtggaagagaaggaagaaagcgatgatgatatgggcttcagcctcttcgactaggctgcacagtcatcacagtattgttttgggcagtgaaacca

SEQ ID NO: 3146 - DNA, 456 bp, Zea mays
  unsure at all n locations
  Clone ID: LIB143-032-Q1-E1-A2
ggtcgatacaagcctctagagaaaatcgtatgactgacagatttccagtgctggacattgggaagcacaccactgaaggtgacccgtgagactgtcaatgtcttgcaagactgctatcctgagaggttggggcttgcaatcctttacaaccctcctaggatatttgaatcattctggaagatagtgaagccgttcctagaccatgagacccgcaagaaggtgaagtttgtgtactccaacgacaaggagagccagaagataatggcagaagtctttgacatggaggagctcgactcggcattcgggggaaagaacccagcgacatttgagtacaacagctacgcagagcagatgcaggacgacgacaagaagatgggatcttcgcacggctcagccaatagcttgcttggatcagctgggaaagangctaatggcgcagactcggacgcctcaagc

SEQ ID NO: 3147 - DNA, 356 bp, Zea mays
  Clone ID: LIB143-031-Q1-E1-G3
agcacgactgacaaaaatatggcagggaaagccggcggactcaaaggggttgccctcatcggcggcagcgccaacagcacggtcgctggggtcattcacttcttcgaggacccctccaccaggtacaccgaggtgaggggcaaggtcaccggcttgactccgggaaggcatggattccacatccacgtcttcggcgacactaccaatggctgcaactcaaccggtccccattttaaccctcataataaaccccatggagctccatttgacgacgaacgacatttgggcgacctgggaaatatagtagccaatgaagatggagatgcataagtgttcataagagacttacagatttc

SEQ ID NO: 3148 - DNA, 333 bp, Zea mays
  unsure at all n locations
  Clone ID: LIB143-031-Q1-E1-G4
taccttgactcgtacaagtacggcaacgaggcgcagctcaagtccctgatccangcgttccacagcaagggcgtgaacgtcatcgccgacatcgtcatcaaccaccgcacggcggagcaccaggacggccgcggcatctactgcatcttcgagggcggcacgccggactcccgcctcgactggggcccccacatgatctgcagcgacgacagggcgtactccgacggcacggggaaccccgacaccggcgccgacttcggcggcgcgccggacatcgaccacctgaacccgcgcgtccagcaggagctcaccggctggctcaactggctcaag

SEQ ID NO: 3149 - DNA, 370 bp, Zea mays
  Clone ID: LIB143-031-Q1-E1-G6
actcaggctgtttcctgagtacctctccgtaaggatctgtttgttgagagaccacccgggataatagtacaaccatgagggtagaatgggacaccattagctgattaattagatgaacttgggggtgtagttggatttgccagagggccatcaatgggggctagggcatagtgctcgctctgctaaggttgggtgccgaggttcatttgatttggttttgttagtcacccaccttagggaggagtgctgtgtttgtacgactggtgaaaccaaacgagcaactatgcactaggggaatctttgtaaaggctacatagtgtatccctggtggttcacctcggtagtgaagatcgggtcctgcaaacgcaag

SEQ ID NO: 3150 - DNA, 336 bp, Zea mays
  Clone ID: LIB143-031-Q1-E1-G7
ggaaaaatctgttccaatggaaactgatgcaaaggttgagccatcgaaaaggaaaattaagaaaacttctgttccgatccatgagttggtctacggcgcattgtctgccactgacctgcagaaggctgtagagaaagagtatgagatggctctgcaggacagagtaatggaagagaccaaagaaaagaaaaatgctgtggaagcttatgtctatgacatgcgtaacaagctgtacgacaagtataacgattttgtcacacccgaggagaaggaagggttgattgcaaagcttcaggaggttgaagattggctgtatgaagatggtgaggatgagac

SEQ ID NO: 3151 - DNA, 385 bp, Zea mays
  Clone ID: LIB143-031-Q1-E1-G9
caccgacactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcacacccggtcaagctcgcgcctttcagcccggaccaggaggacgcgtcggtgctgt

SEQ ID NO: 3152 - DNA, 383 bp, Zea mays
  Clone ID: LIB143-031-Q1-E1-H1
acaacgtctacgcgcacgaccaccagttcatagtcggcgccaccaacccgggcctcaggggccagagcctcgcggccgtgctctcggccggcatgtcggcgggcaagagcggaagggagctccaggccatcgaggacgagtggctggccgcggcgcagctcaagaccttctccgagtgcgtcagggacgccatcgcgggcctcggcgtcgcggcccaggagaagcagcgcaggctccaggagtgggaccgcgccacgggcggctacgacaggtgcgtgtccaacgaccaggcgcgcgacatcgccgccagcctcggcgtcacgtccgtgttctgggactgggacctgccgcggaccaaggaaaggttccaacgcctcaagggg

SEQ ID NO: 3153 - DNA, 390 bp, Zea mays
  Clone ID: LIB143-031-Q1-E1-H12
gcactactctaaattgaatcgtattacgctacacactatttcatgagtggccatctggatctgatcgatgaacgacttgcaaagttagtaactgatgatccatcagttattgattcgtcccttgcacaatatggagacatggtttatccggacaaaaatagcattgttcataggctggaggtgattgataaatgcttcagccatgacacagttgaagagattgttgatgccttggaaagtgaagcagccagctcaaatgaagaatggtgtatcttggcgctgaaacgattgaaagaggcctctccgttagctttgaaggtctcactgcgatcgatacgcgagggtagatatcagacacttgatgagtgccttgtccgtgagtaacgcatg

SEQ ID NO: 3154 - DNA, 334 bp, Zea mays
  Clone ID: LIB143-031-Q1-E1-H3
caaagatcagggaagagtaccctgaccgcatgatgctgacattcccagttttcccctcaacgaaagtatctgatactgtggttgagccatacaacgccactctttctgtccaacagttggttgagaacgctgatgagtgtatggttcttgacaacgaaggcctctacgacatttgcttcaggactcttaagttgaccacccctagctttggtgatttgaaccatttgatctctgcaaccatgagtggagtcacctgctgcctaaagttccctggtcagctgaactccgacctcaagaagctggcagtgaacctaatccccttcccccgcctcca

SEQ ID NO: 3155 - DNA, 361 bp, Zea mays
  Clone ID: LIB143-031-Q1-E1-H4
gggtcgagcacgcgtccgagggggtattagattgtaggaaccatccgtaaagactcggtggcaacttctccagatcggcaaatccgtctttctgggcgatttggagcaaagcccccaagtagtttgttacagaaagcagcggattttgcgtcgctcctgcgtcagtgtacctgttgcgttcgtcgatcctgaccccggccttcggatcatatatatcgagctaggaaaatgggcactttgcatttactctttggacccttcggagatcgccctcgtcaacatttggtgggaaaccaattcgctgggattccctgtggaaaagcgccgctttggttcctgtttccccacagctcccaactct

SEQ ID NO: 3156 - DNA, 315 bp, Zea mays
  Clone ID: LIB143-031-Q1-E1-H5
acaagcagtgatccgaagctcaatcaattcactcaaacctcttccccaaatcttcgattagattctcgttgacaagaagactagaaccgaacctgaccatgtcgctgatccgccgcagcaacgtgttcgatcccttctccctcgacctctgggacccctttgagggcttccccttcggctccggcagcagcagcagtctcttcccctcgttcccgcggaccagctcggagaccgcggccttcgctggcgcgcggatcgactggaaggagactccagaggcgcacgtgttcaaggccgacgtaccggggctgaaga

SEQ ID NO: 3157 - DNA, 386 bp, Zea mays
  Clone ID: LIB143-031-Q1-E1-H8
aaattagcaacatgttggactgagctgatcagagcaattacttgcgaactgaaaacactggagtgtagcctgtgctcagctgccacaagatagcctgaagcaaactgctgtacaataagcaagtgattgttctgccatcaacggtggcatatcactgtacaaatgagcaccattgactaacgcacataagtcgccttgtctgaaactggtcattttctttgaaattcaccctccagttcatgtgctttggtggcagacgtcgtggcatggtatatggtacctgagaacattctttgggtggcaactggttttggctacttagtcctctgttgcctgtaatatgagatgtgaagttaattccaatccaaccaatggtggaaattttt

SEQ ID NO: 3158 - DNA, 384 bp, Zea mays
  Clone ID: LIB143-031-Q1-E1-H9
ctcgatcgccaataatggagtttccgcaccaccaccaccaccacggccatcgccgcgacgacgacgaagacgaccgcagaggcccgcctcccccggtctacggcggctacggccagccaccgccacccgacccgtacggccgcgcgcccgtcgaccccgatccgtacggtcgacctccgccccagtccgcgtacggtggggccggggacgcctacggccacagcggccaaggctacgcgcccccgccggcctacggcgccgggggcgggtacggcaacgtcgtccacgtcgcgcacgatgtcggcgacgagaggccttactacggcggcggcggcggcggtcttggtggcgcctacggaggcggtggctccgagtacggccacg

SEQ ID NO: 3159 - DNA, 359 bp, Zea mays
  Clone ID: LIB143-031-Q1-E1-G2
taggccgtctctctccgcgcccccacgcctccagtctgtgaccccaaaagccttcttttcatgtttggaatggagctggactacagcgacgccctcattggtggccgcttcttgttccagaatccaaacgcaacaaaaacctgtgggtgcggcaaatctttcgcgactggaaaggagaccgaggccgcggcaaccacttgcaacaactagagtagagaaatattgttagctaaacgtgatgtggcatgttgtatagcttgctcatgttgaagccctgtggctacaccacagatacataaagaggcatagttcaaaggaattacaccattaccaatggcctaattcagattttcctggtt

SEQ ID NO: 3160 - DNA, 366 bp, Zea mays
  Clone ID: LIB143-031-Q1-E1-D8
taccgagtgtcaagcgatcggcaggctgtgccacatgagacctatgtttacttcatggaccttctcgccaagacagttagagatgagatcgctgggtgcagcgaaaaggggtatgattccctatctgtaagtgatgcaaaacaaatgcttatgttcagttctgaccaagatctgcacgagtacatcacagaggagcacccggaatgggagtttaagaatggcgccgtcttcttccagaaggcaaaggaatcacagccctacaaggagatcccatccttgcagctcatcaaccagacgctcagctatgcgagggagctggagcgtattgtatgatttaatttcacagtaatccctggtggatgttta

SEQ ID NO: 3161 - DNA, 348 bp, Zea mays
  Clone ID: LIB143-031-Q1-E1-E10
tgagtcgtattaattgagacttatcaagtgttcttccggaagatacagagcaatcacaaatggacgctcctgcggcggcggcccagggttgcgggggcaagcagatcttgctcgtcgacggcacgtgcctgagcggctggtcctggttcaaggtggtcccggcgctgcgggacgtgcccatgttccgggactacacggggccgctgctggagctcctggcgtctctgccggacggggatcacgtgatgctcgtgggccacagcctcggcggattgagcgtcgcactggctgccgagacgttcccggacaacgtcgccgccttggtcttcctctgcgtcttcaagcccg

SEQ ID NO: 3162 - DNA, 375 bp, Zea mays
  Clone ID: LIB143-031-Q1-E1-E12
cgggatgctcggagggatggcggtggccgtcctcccgttggtgctccgcgggcaagcgccggtgccgggcaagtactaaccgaacccgtatcaactgatgaaccccaagcaaagaccgtggcaagttgaaggaaaaaaattcctggaacaaataagggtcctcctccgcctgttccttgggccttgccttgccctggtccgaatttcgaaagaaggaaacaatcctgcgcctgcgggcacgagacgtgctctgtacatagcaaagggtgagatatggatatggtgctggtgcggcagtgacctatatttggtgattgcatgacggggcgttcaagatgttaaattgagaagcagctgagttgtggttctagaaag

SEQ ID NO: 3163 - DNA, 371 bp, Zea mays
  Clone ID: LIB143-031-Q1-E1-E4
acatattgtgacattgcagcaaagtacactgtgaagtcctttgggattcggcgcaatgataagatcccatgctatgttaccgtgccgggtgataaagcaattcagctgctggagaatggcttcaaggtgaaggagtacgagctgctgaggaggaacttcagtgacactggctgctttggatttggtatccaagagcacattgatcctggcatcaagtaagatgatctcatgtcttatcgtaaataagttgaatgacgcctgtttgtttctgtgaacgggtgttttatgatgggcactgttgcgtgcctgggaaaagatatgtaactttgtaatcatgtagcctgttcccactatgggagtcacctactggg

SEQ ID NO: 3164 - DNA, 388 bp, Zea mays
  Clone ID: LIB143-031-Q1-E1-E7
acgcggctccaacacctgcctgcctgcctgattcttacaccaaccaaccacgcgcgccaagccgaattcgtcttccaccgatccgccccgcccgtttcccattgcttagcttgctatggcgcagcagcagccggtgcggcggattctgaaggtggcaccgccggggaagggggacggggaatccttccccacggtgcaggcggcggtcgacgcggtgccgctgggcaaccgggcgcgcgtcgtcatccgcctcgcgccgggggtctacagggagcctgtctacgtcgccaagaccaagaacttcatcaccgtcgcgggggcctcgcccgaggccaccgtcgtgtcatgggacaacaccgccacgcgcatcaggcactcgcagtcatcc

SEQ ID NO: 3165 - DNA, 379 bp, Zea mays
  Clone ID: LIB143-031-Q1-E1-E8
actcctgcacgctaccccggctcatctcaccagggttatgggagcagccactccgggggccacatggggacgggggcaatgctagctggaggtgccgccgccgccgctgctgcttacggagcacacaagctttctcatggccatagcggacacggtggacatgggccctttggaggccatggtcgtggtcgtggtggttatggccgtggtcgtggccaccacggcaagttcaagcatggcaagcatggacacggcatgttcggcggcaagttcaagaagtggaagtgatgtgttgatcgtagctagcggtggtaatggatcacgatttaaatgtttcttcacaatatgttagagaccgtaaataattttaattttaaaa

SEQ ID NO: 3166 - DNA, 204 bp, Zea mays
  unsure at all n locations
  Clone ID: LIB143-031-Q1-E1-E9
tgagtcgtattaaacggagggngcgctggtggcgtcgttggcgatacagcgttttttgagcatcagatgatacgtgaggagactggtgctcaaaagctatccagatggggtgatctggattcaatgtatgcgaaatcaaatcgccgaggattgacttcattgccgatgggcgcacaggtttggagattccaaggagttgtgcat

SEQ ID NO: 3167 - DNA, 383 bp, Zea mays
  unsure at all n locations
  Clone ID: LIB143-031-Q1-E1-F10
tctagaatgagtcgtactagccgccgcggggcgcgcgcactgtggacggtctgcggctcaacgtccgcgtgggcgtgcaatacctcgcggggtggctgggcggctccggctccgtcccgctgtacaagctgatggaagacgccgctaagggggaaattaagcccgtccagaactggcagtggctgccccacggaacggctctggacgcccgcggcctggaggtgcccgcgacgccagagctactcgcacgcgtcgtcgaggatgagatggcgacggtcgaggctgangtcggccccgacaggttccgaaacgggcggtacgcggaggcnggcaggatcttcagccggcagtgcatcgcgccggagctggacgacttcctcacg

SEQ ID NO: 3168 - DNA, 144 bp, Zea mays
  unsure at all n locations
  Clone ID: LIB143-031-Q1-E1-F12
aaagggaaagcctgacctttaganagaaggtgatgccagctgttattgtgaggcagcgcaagccatggcgccgaaaggatggtgtctacatgtactttgaagacaatgctggagtgattgtgaacccaaagggagagatgaaag

SEQ ID NO: 3169 - DNA, 256 bp, Zea mays
  Clone ID: LIB143-031-Q1-E1-F4
tcgccgcagcatcggcagcgggctacagattcaaggccgacgacgacgttgtcagcctcagggcgacagagctcaggcttggcctgccgggcacggaggaggaggaggccgaggagtcccagaacaaggcgccgccgccgccgccgtcgacgcccagaggcaagaagcgcgacgtcgtcgccagcagcgggcccgacgatgcgcccaagaagcgcgactgcgagaccgacaccgatgccgcgccgccgcccggcgc

SEQ ID NO: 3170 - DNA, 351 bp, Zea mays
  Clone ID: LIB143-031-Q1-E1-F5
agagtgtttcgcgcaaagaatccccatgcatacaaacagggtagaggtagagggagatgagaggagaggagaggataggagaggttgggtctgggacaccatgatctccgattaagctgtacggggcggtcatgtcttggaacgtgactatgtgcgcatcagtgctggatgaggctgggtccgactacgacatcgtgccgatcaacttcggcaccgccgagcacatgatccccgagcagctcgtccgcaacccgtttggtcaggttccagctctgcatgattgtgacttgtacctcttcgcatcacgcgctttctgcatgtacgctgttcgcataaacaaggcaaatctgt

SEQ ID NO: 3171 - DNA, 359 bp, Zea mays
  Clone ID: LIB143-031-Q1-E1-F6
atctgtggataattcatgctttgtttctgattgttaagagaacaccgtcagcaggattcttttcagcaaaaccacattgtaggccacgctgcgttctgatcatcctcattatatggttcctttcaagacagccgaccttgtatttaagaagccacaggatgatggagagaaattcatagaactcttacgagcattggaagcatatgcagaaggttcctcagtaaatccaatcatcacaagagcagcgtatctttggaacaaacttaaatcatgatgacactgatgttttcagcgttgactaaacaagaattttgtcaatgctgacagtttgggttcaaagcttggtgtcgtaatgctca

SEQ ID NO: 3172 - DNA, 366 bp, Zea mays
  Clone ID: LIB143-031-Q1-E1-F7
gagaaattgcaaacctgtcactagcgaagcatacttcgtcgagcacactcttgcaattaatccaccgagttcggtttagtagcatagcatcgacaataaatgtcgctcgtgagtcggcgcagcagcaacgtgttcgaccccttctccctcgacctctgggaccccttcgacatgttccgctccatcgtcccgtcggcggcctcctccggcggcggttccgagaccgccgccttcgccaacgcccgcgtggactggaaggagacgcccgaggcgcacgtgttcaaggccgacctccccggcatcaagaatgaggatgtcaaggtcgaagtggacgaccgcaacgtgctcgtcatcagcggcaagcgc

SEQ ID NO: 3173 - DNA, 126 bp, Zea mays
  Clone ID: LIB143-031-Q1-E1-F8
taaaataagtcatattatgtaaaaaaaaaaaacataaatcaacaaaaaaaaacaataaaattaaacaaaaaaaattaagtggactgccgcaccatcggttcaaagcgtcgctcgtcatgtcaggct

SEQ ID NO: 3174 - DNA, 407 bp, Zea mays
  Clone ID: LIB143-031-Q1-E1-D7
tacactaccatccatgatatagcagaactctctcgacctcatcggcgttggcggagcgcgtgttgaccggagatggcgccgagcgggtggaggaggagcgcggcggcgcgggtcgcctggcgcccggccacggtttgcctgtggctcgcgctcgccgccgccgcactgacgctcgcccaggctaagaaggacctgacggacgttacccacaaggtctacttcgacatcgagatcgacggcaagcccgcaggccggattgtcatggggctttttgggaagactgttcctaagacggcatagaacttccgagctctttgcacaggagagaaaggggtcggcaagagtggcaaagccctccactacaagggaagtaagttccacagaatcatccccagcttcatgctcca

SEQ ID NO: 3175 - DNA, 444 bp, Zea mays
  Clone ID: LIB143-013-Q1-E1-E6
cactaaggtggtttatgatgagtacaatcatgaaagatatcctcctggagatcccagcaagcgtgcatttgcttactttgtcctgagtggtgggaggttcatatatgcatcactgctgcgtctcctcgtattgaagtttgtcctgagcatgtcagcaagtaaggacgtgcttgcccttgcttcactcgaggtggacctctccagcattgagccagggaccacggtgactgtgaagtggcgcggaaagccagtcttcatcaggcgccggacggaggacgacatcaagcttgccaacagtgtggatgtggcatccctgcgccacccagagcaagatgcagagcgtgtgaagaatcccgagtggctggtggtcattggcgtgtgcactcacctaggctgcatcccactaccgaacgccggagactttggcggctggttctgccatgc

SEQ ID NO: 3176 - DNA, 228 bp, Zea mays
  Clone ID: LIB143-013-Q1-E1-E8
ggtcactttcgtaacatggtgcatcatctaggaggtttgcaacgttcgcctttcgtaccagttacttatcccttctggatcctaggacgcactgtgtatcggatcattatgagcagttagtgtggtggtcacgctcaatcttgctcactaacatgactacgtatcaccgccagtaccattgatggtcataccgtcccggtgcatcataatgggcgagatggcagggga

SEQ ID NO: 3177 - DNA, 446 bp, Zea mays
  unsure at all n locations
  Clone ID: LIB143-013-Q1-E1-F1
catgagagaagtgcaccaagaaggagagatagattaacgaggccactggtcagtgatttgaaaggggattggtatcctgcagatatgccagaaagcagcatgagaagcctgcaaggttacaaggccttcatctgcatagcgctcctcttgggcgatggtctttacaattttgttaaggttgttgcattcactgttaagagtctacttggcagatcaagactgaagaatgcaaagaaagaggaagacattccagtgcttgatgaaattcagcgcaatgagatttttacaagagacagtatccccacatggctagcctactctggatatcttgcactatcagctgttgctgtgtttgccattcncttgatgttccatgagatgaaatggtactatgttattatagcatacttattggccccggcattgggtttctgcaatgcctatgg

SEQ ID NO: 3178 - DNA, 417 bp, Zea mays
  Clone ID: LIB143-013-Q1-E1-F10
gatttgatttatttttgtggaggagagaaccccgtgttttgcgtggagaagaaggcaagccgctcgacgctcgtcgatgtgcggagcgatgcacaaagccgaatcgccatcatcctcacaaacaccgtttggttttgtttatggaccgagagatgctgaccgtgcaagtgatgtggtgccacccacaagatgcagtcggtggacgacccaaggaaggatggacataaccagtggatgctcgccaagcgagtacccccccagcaaacactatctaagtgttaaaataaaggaccgagagatgctgaccgtgcaagtgatgtggtgccacccacaagatgcagtcggtggacgacccaagtaaggatggacataaccagtggatgctcgccaagcgagtaccccccagcaaacactatc

SEQ ID NO: 3179 - DNA, 455 bp, Zea mays
  Clone ID: LIB143-013-Q1-E1-F11
ggtcgaaatcacgggtcgacgacgcgtccgtcgacgaaggaggaacgaacggacaggttgttgcacagaagcgacatggctttcgcgcccaaaacgtcctcctcctcctcgctctcctcggcgttgcaggcagctcagtcgccgccgctgctcctgaggcggatgtcgtcgaccgcaacaccgagacggaggtacgacgcggccgtcgtcgtcactaccaccaccactgctagagctgctgcggctgctgtcacggttcccgccgccccgccgcaggcgccggcgccggcgccggtgccgccaaagcaagcggcggcacccgccgagaggaggagccgtccggtgtcggacaccatggcggcgctcatgggcaagggcaagacggcgttcatcccgtacatcaccgcgggcgaccccgacctagcgacgacggccgaggcgctgcggctgctgga

SEQ ID NO: 3180 - DNA, 443 bp, Zea mays
  Clone ID: LIB143-013-Q1-E1-F12
ggggccacggacgcgtccgcacacgcatccgcggagccgccgcaacccagcgtcccccgaagtctaaccctagatccggaccggccatggcgtcccgccgggtcgtctcctcgctcctccgctccgcgtcccgcctgcgggccgcctcgcccgctgcgccacgcccgcgcgcgccaccgcaccgcccgtccccggccgggtacctcttcaaccgcgctgccgcctacgcctcttccgccgcggcccaggcggcacctgccaccccgccgccggccaccgggaagaccgggggcggcaagatcaccgacgagttcaccggcgctggcgccatcggccaggtgtgccaggtgatcggcgccgtcgttgacgtgcgcttcgatgagggcctcccgcccatcctcacggcgctcgaggtgctcgacaacaacatccgcctcgtgctc

SEQ ID NO: 3181 - DNA, 407 bp, Zea mays
  Clone ID: LIB143-013-Q1-E1-F3
gggtccagccacgcgtccgcaaaaacgtccgcccacgcgtctggcaccccgagctgtatagacgagctagtcggtagaacttgcacgagcggcgcagaacgaagtgcagataacaggacatatggctacgcctgcggtgaacgtttactgctgggctatctcaccgttcgtatcgcgggctctgctggccctggctgacgccggcgtcgactacgatctcgtccacatgaaccgccatgacggcgaccaccgccgcccggagcacctcgccagaaaccctttccggaacgtgccggtgctcgaagatggagacttcacgctcttcgaatcacgtgctatcgcgaagcatgttctccggaaacacaagccggcactgctgggcggcagcaagctggagcagacagtga

SEQ ID NO: 3182 - DNA, 149 bp, Zea mays
  Clone ID: LIB143-013-Q1-E1-F4
ttaccctgacaatcggaaaagttaaccaatatgggaaggatgcaaccaaacctaacaggaaacggtccaccagcacaaacatcatccccatatcgataaactgttgcttagcctgacaatcggaagagtttaaatgttaaagatttgat

SEQ ID NO: 3183 - DNA, 436 bp, Zea mays
  Clone ID: LIB143-013-Q1-E1-F5
gacgcggcgcggctcaagaccttctccgagtgcgtcagggacgccatcgcgggcctcggcgtcgcgggccaggagaagcagcgcaggctccaggagtgggaccgcgccaccggcggctacgacaggtgcgtgtccaacgaccaggcgcgcgacatcgccgccagcctcggcgtcacgtccgtgttctgggactgggacctgccgcggaccagggaagggttctaccgcttcagggggtccgtggcggcggccgtggtccggggccgcgccttcgcgccgcacgccgacgtgctgtggatggagacgtccagccccaacgtggccgagtgcaccgccttcgccgagggcgtcaaggcggcgtgccccgaggcgatgctcgcctacaacctctcgccgtccttcaactgggacgcgtctgggatgacggacgccgaga

SEQ ID NO: 3184 - DNA, 457 bp, Zea mays
  Clone ID: LIB143-013-Q1-E1-F6
acacgcctctaaatcgacatcgtgaccagcgtagcggatattgcgagttacgacggggaaggagaggaagatccgtcgatccgcgcagattcgtttcgatcgtggtttggtgacttggtaagaggggaggggagaagcggcgatgtcgggcgtgttcggcagggtgttcgggaagtccaaggagcagagccaggcgaccgcgctggcctcgctcgacaagctcaacgagacacttgaaatgttggaaaagaaggaaaacttgctagtgaaaaaggccaatcttgaggtcgagaaggctaagaattttaccaaagccaagaataaaagagctgcaatacagtgcttgaagaggaaaagactatacgagcaacagattgagcagcttgggaatttccagcttaggatacatgatcagatgattatgctggaagcagcaaaagctacaacagagaccgtg

SEQ ID NO: 3185 - DNA, 445 bp, Zea mays
  Clone ID: LIB143-013-Q1-E1-F7
acacgcctctggatttactctgaacaagtgagtatgtgcggcatacttgctgtgctcgggtgcgccgacgaggccaagggcagcagcaagaggtcccgggtgctggagctgtcgcggcggctgaagcaccggggccccgactggagcggcctccggcaggtgggcgactgctacctctctcaccagcgcctcgccatcatcgacccggcctctggcgaccagcccctctacaacgaggaccagtcggtggtcgtcgccgtcaacggcgagatctacaaccacctggacctcaggagccgcctcgccggcgcaggccacagcttcaggaccggcagcgactgcgaggtcatcgcgcacctgtacgaggagcatggagaagagttcgtggacatgctggacggcgtcttctccttcgtgctgctggacactcgccatggcgaccgcg

SEQ ID NO: 3186 - DNA, 328 bp, Zea mays
  Clone ID: LIB143-013-Q1-E1-F8
cgggcggtcatccacgcgtaaggatttactcttatcaagtgagtatgtgcggcatacttgctgtgctcgggtgcgcctacgaggccaaaggcagcagcaacaggtcccgggtgctggatctgtcgcgttggatggagcaccgtggctgcgactgcatcggtatccggcatgtgagcaactgctacatctctcaccaccgcctccccatcatcgacgctacctctggcgacatcctcgtctacaacgaggactagtccgtcgacttcaatatctgcgactacatctacaaccacctgtgcttcaggagcagcttctcctgtgcatgcca

SEQ ID NO: 3187 - DNA, 343 bp, Zea mays
  Clone ID: LIB143-013-Q1-E1-E5
acgcacacgcgtccggcatcgagtactttcagtgatctgaaggttactggaatccttcctctgaaggaaggcaaccctccgaagttttcccagcgggctcgtttgctcacagctaactatcaagttgtttaatggttgtaccgttgtccgagtgttgatccacttaaatatattcgaatagcatatttttgtgacatggtatgctactggcatgaacttttgcaagtcatgggatggaagatcattttgggttttgaaaaaaaaaaaaaaaaaaaaaaagaacaaaaaaaaagaaaaaaaaaatagagaagagtggaagaaaagacacaaggcgatgaagaga

SEQ ID NO: 3188 - DNA, 429 bp, Zea mays
  Clone ID: LIB143-013-Q1-E1-D12
cacctgcgtctacgcctcgcttgcggcgactagggcgactgccgccgccgcccttcgcccaagctgcccaggtcttcgtcgggcgctttaccgctgaagagcgcccaccataccagattggccaccagaggattgctacatttgggaaggatgagcaaaggccctgttccattcgccaacattgggaagagagcaaaagatctcttgtacaaggactacaactttgatcaaaagttttttttgtcgacatgttctaactctggtttgaatctcacagccactggtgtgaagatcaatgaagacttcattggtgatatacggacacagcataaaagcagcagaaccactgttgatgtcataatcgatagtgattctaaagtgtcaaccacagtcactgttgatgaagcactaactggtttgaagacttca

SEQ ID NO: 3189 - DNA, 450 bp, Zea mays
  Clone ID: LIB143-013-Q1-E1-D2
gggtccgcccacgcgtccggagaaagacggagaacgaaaaggaggggggcaacgtcgccggcggtcggaggcaacggggatgattcggaaggaggcggacccggaaggacaggatgggtcttcttcgtcggccactgatgggggaggaggaagtggcagtggccgggagctggcagatgcgctggcgcggcgacgtttgtaccgggaggtgacgctggcgctgcactcagggttgcgcgacgccaaggcggacttctccttcctccgcgcgcgtgggctccgcagcctgctcggattccttcgctccaccgcctccgcggccgacgacgcgctgctgctccttttccgccactcccaatccatccccgatctccaagttattcctgttctctttcagaattcgttgcatcaaccaaagcaagatcctgttgtgacattggatcatatatt

SEQ ID NO: 3190 - DNA, 290 bp, Zea mays
  unsure at all n locations
  Clone ID: LIB143-013-Q1-E1-D3
ggggcaaggaccgggagcgangggaagaagcggggcgcgtcgcggagctggatcctgctcgacgcggccggggaggagcagctgctggacgccgataagtacgccatcatgcgccgcgtcgacatcaacgcgcgcgacctccgcatcctcgacccgctgctatcctacccctccacaatcctcgggcgcgagcgtgccatcgtcctcaatctcgagcatataaaggcgatcatcacttccaacgaggttctgcttanggatccttctgatgagaatgtaatccctgtagt

SEQ ID NO: 3191 - DNA, 463 bp, Zea mays
  Clone ID: LIB143-013-Q1-E1-D4
ggggccagcccaggcttcgggacaactctcttcttcttcaatcccaaccgctaacaaccgggaacaaaaggccaggcaacctggttcccgtcggaaattgccctcggcttcttcgaacggctgcaatggattacaacgaatcgaaccgcaagttgcccaaggaattgcggctcatggaaccaaggctgtctgaaaatttcgctggtcgttgcgacagcataaagcggcccgtggaggagcggtgcgatgaactcaactcccacttcacgacgcgctgcgacaagatccaagatcaagtcgatgttgctgcactccgtggcgaggagcgtcttatcgccttggaggaaatgcgcaccgacatcgagcagtggcgccccgatctaatcaagcggatcgaggacgtggcgttggaggtggtgcgcgtcaacaagttcttcgagcgggaacgtcgagcggagcccgt

SEQ ID NO: 3192 - DNA, 387 bp, Zea mays
  Clone ID: LIB143-013-Q1-E1-D6
gaggaggccgtgtcagcggcggaggcggcgggtacggtggatgcgccgtcgtcgcggcgtcactgcggttgcgtgcgccgtgatggctgccgcggctactgcggtcgcggtggctaccgtggtggcggcggtggctacagtggtggtggctgctgctactgctgctaccgccgctacggcagctcctactggaactggcggaactgagctgtggtgcccgcgccgacaacttatcctgttcgctaccgtgttgtttaccctagtccagagtgtttatcttcgttcgtctcgtgtttgttgttgctcatctgtgtatttgatctgcatgtctctctgtgtcagttgttagtgctgtgttcatcctcagctccatcagacccatgcatc

SEQ ID NO: 3193 - DNA, 464 bp, Zea mays
  unsure at all n locations
  Clone ID: LIB143-013-Q1-E1-D7
ctcgcgggtccacacacgcgtctgcaatatgtcaattaaccttttccaataaaatacatgcttaaatcgtggctgctaggcgaatggtcctactttggtcatcaaatgcaggaattccactactatatgtgccacttgaagttgttatgtcaaaataatatggtgaaaacgagcgtctattgggatctattttttatcttgcaaatgatcttcctgaaggagattgatatgtcaagatacgcttgtttcatttgagctcaatgttatctgaaaatatatagactgccttcgtccccttcatcactgctaatgaccgtgacttggagacccgacagcggccctcgacgttgtcgccgccgagcccatgctggttccaccagtggtccaccacccggatgtggtccgccaagacgagcagtaacggtggcagcgaagcgaagtggtagattcagcancgcttctgc

SEQ ID NO: 3194 - DNA, 394 bp, Zea mays
  Clone ID: LIB143-013-Q1-E1-D8
aatccgcatcacgcaccccaccccaccgcccgcaaccgcaagctcagattccctcccaccccaccccaccgtcgcgctcactccagcccagcccgcgtccccacagcccagcgacagcgagcaccggcggcatccagccatgtgcggcggcgccatcctgtcggacatcatcccgccgccgccgccgcggcgtgtcacggcgggccacctctggcccgagagcaagaagccgaggagggctgcagccggcaggaggagagcccccgtggagcaggagcaggaggaggatttcgaggccgacttcgaggagttcgaggtggagtccggcgagtcggagctcgagtccgaggacgagcccaagcccaagcccttcggcgcccccagcagcgcgctc

SEQ ID NO: 3195 - DNA, 409 bp, Zea mays
  Clone ID: LIB143-013-Q1-E1-D9
gggtccttgcacgcctctacaatgagtcggattaacgacgccgtgactcggattctgcgcgtcaagttcaccatgggcctgttcgagaaccccatgccggaccccagcctcgcggaccagctggggaagcaggagcacagggacctggcgcgggaggcggtgcgcaagtcgctggtgctcctcaagaacggcaagccgggcgacgcgccgctgctgcccctgcccaagaaggccgccaggatcctggtcgcagggagccacgccgacaacctggggtaccagtgcggcgggtggacgatcgagtggcagggcgacacggggcgcaccaccgtcggcaccacggtcctggacgccgtgaaggcggccgtggacccgtcgacggaggtggtgttcgcggagagccccgacg

SEQ ID NO: 3196 - DNA, 440 bp, Zea mays
  Clone ID: LIB143-013-Q1-E1-E1
aatgctactccgtacctatttctctcgccggcgacgagcctccgcggaaaccagtgccaagccagaggtgcttctttctccgccagactgctgctccgcgcgagaagagccaccacggagtctgcgtgactagggacagtggagaaaatcagcggcacagcgtgggtctcgcgacctccagcgaacggtgagtcggtgagtttatctccttccggtcttacctattctcgatctgctctgctcccttagttcttgttcctttattttccttgttccccactgtctcttcctgattagtgttatttcgcttgagtcagagatccctaagtttcgatccactgtcccagtggatttgggactgcgatggaggagcagttcatcctccgcgtgccgccatccgtcgcagagcggatcgagcgcctcatgaatgaatccgccgc

SEQ ID NO: 3197 - DNA, 421 bp, Zea mays
  unsure at all n locations
  Clone ID: LIB143-013-Q1-E1-E11
cggacgcatgggtgggtgcagaagcgcctcagcttactaagcgaggagatgcagctcgcggaggcacacatggagacgatgaggcgcgagtttgcctggctcaggtcttacctggagagactgcagaggacgcggggcagcacatgacggcggcgcgtgtacatggcacaggggcacgagttcgctacgcgaattcggaggtgtatacaaatacaatacaatacaacccggaggtggtgttcagtgtttcttctgttgttacagatggtacagatgcaaacagagagaggtggattgttgtttgcagaggtatttgccgtaaggcagaactgcaagatcccggtatagcgttcgatgtaaatagctggagcttccccattgcgctggggtgatgtacaatgtcanggacgagtcactgcga

SEQ ID NO: 3198 - DNA, 430 bp, Zea mays
  Clone ID: LIB143-013-Q1-E1-E12
gggtccacgcacgcgtccaaacttcacctcaatatctctcgtgagactcttcagcagaacaagatcctgaaggtgatcaggaagaaccttgtgaagaagtgtgttgagctcttctttgagattgctgagaacaaggaggactacaacaagttttacgaggctttctccaagaacctcaagcttggcatccacgaggactcgcagaacaggaccaagatcgccgagcttctgagataccactccaccaagagtggtgatgagctgaccagcctcaaggactacgtgaccaggatgaaggagggacagaatgacatatactatatcactggtgagagcaagaaggcagtggagaactcccccttccttgagaagctgaagaagaggggctatgaggttctgtacatggttgatgccattgacgagtatgctg

SEQ ID NO: 3199 - DNA, 439 bp, Zea mays
  unsure at all n locations
  Clone ID: LIB143-013-Q1-E1-E4
ggaaagtcaaggtctaactcgcgaccgaaagccacagagaaatggggggccctggccgtccctggcgccggaacgtcttcctcgtcgtgtcgctgcagcttctccttgtggcgccatggcaggacgagacggccgctcgagctctcaatttcaccaggcaggatttccccagggccttcgtctttggtgccggcacgtcagcttaccagtacgaaggggcaaccgatgaagacggaaggagcccaagcatatgggacaactttactcatgcaggtangatgccggacaagagcactggcgacctaagggcggacggctaccacaaatacaagggagacgtgcagctgatgagtgacactggcctggaggcctaccgcttctccatttcttggtccaggcttattccaagaggaagaggagccatcaacnccaagggcct

SEQ ID NO: 3200 - DNA, 439 bp, Zea mays
  Clone ID: LIB143-013-Q1-E1-B4
cggtccgtactatccgggggccacccacgcgtcggcacaagcgtccgcggacgcgtgggcggacccttggggagctgcactgcacgctcctcaaattcccacgccgcatcgccacccattgccctgctcaccgccgaacggtttcaatggccgcaagcacagcggcgccatgctacgacgcgcccgagggcgtggacgtccgcgggcggtacgaccgggagttcgcgggcatcctcacccgcgacgcgctggacttcgtggccggcctgcagcgcgagttccgcgccgccgtccgctacgccatggagcagcggcgggaggcccagcgccggtacgacgccggcgagctgccgcggttcgacccggccacgacgctcgtgcgcgagggggactggacgtgcgcgcccgtgccgccggccgtcgcggaccgcaccgtgga

SEQ ID NO: 3201 - DNA, 319 bp, Zea mays
  unsure at all n locations
  Clone ID: LIB143-013-Q1-E1-B6
agcagacgcgtgggcggacgcgtgggtcacaaagcgcctagcaaaagcatacttcccgaagcactcttgcaatccactgagttctgtttgttgagacgcatagagctagctgctagcgtcgacaatgtcgctcgtgaggcgcagcaacgtgttcgaccccttctcgatggacctctgggatcccttcgacaccatgttccgctccatcgtcncgtcggcgacctccaccaactccgagactgccgccttcgccagcgcccgcatcgactggaaggagacgcccgaggcgcacgtcttcaaggccgacctcnccggcgtc

SEQ ID NO: 3202 - DNA, 413 bp, Zea mays
  Clone ID: LIB143-013-Q1-E1-B7
ccaattagctagcttcttctagctctagctaggctcgtctgctgcaagaaggtaacagtaacagcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctaaatctccatcctcaccgtcatgggcgtctccaagtccacctccaagtgcgccaccgtcggcatccagggcatcgcctggtccttcggcggcatgatcttcgccctcgtctactgcaccgccggcatctccggcgggcacat

SEQ ID NO: 3203 - DNA, 326 bp, Zea mays
  Clone ID: LIB143-013-Q1-E1-B8
acggaaccatataatatatcacaagagtgagggaggattttttggatgtccttcacacaaatgcaagcaatgatagaagcagaagatgaagaatgttagctcggcgtgagacagatcggaattgggatagaaacatccatggtctcacatgagatgtacattcttgactacagtaatatatcatacatgtaccactagactgacggttgcttcaatctactccatgtgattgcactatgtactgtaagtgagactctgtgttgcacttcatctacatcgccatcgtcaccgtcatgggcgtctcaaagtcaacctccaagtgcgcc

SEQ ID NO: 3204 - DNA, 439 bp, Zea mays
  unsure at all n locations
  Clone ID: LIB143-013-Q1-E1-C1
gactcgctcccactcccagacgaccggccgccagcgccgccgcgttgatggccgccgcaccggaggagcgcctcgacgtcctcaacgccgctggggacaagatcggcgtctccaagcccaggtcggaggtgcacanggacggcgactatcaccgggcggtgcacgtgtggatctacagcgagagcaccggggagctgctgctgcagcgccgcgctgactgcaaggactcgtggcctggacagtgggacatctccagcgccggtcacatctccgccggcgaatcctcgctcttctcggcacagagggagcttgaggaagaactaggcatcaaccttccagtcgatgctttcgagcttatatttgtatttcttcaggaatgcgttatcaacaatgggacatacacaaacaatgagtacaatgatgtttaccttgtgactac

SEQ ID NO: 3205 - DNA, 453 bp, Zea mays
  Clone ID: LIB143-013-Q1-E1-C10
cgccggtccgagactcacggggccacgcacgcgtccgcaacggtactccagccgctaccctgcgattccgccagtacgccaccaccaccgagcctggactaccgccgccgcccttcgccgatatcttcagcggcgaacagcgcccaccagatcccgcccctgcgatggagtccgtggtgaacccgaaggcatacccgctggctgatgcgcagctgacgatgggtatcctcgatatcatccagcaggccgccaactacaaacagcttaagaagggagcgaatgaagcgacgaagaccctgaataggggcatatcggagtttgtagtgatggcggcggacacagagcctctcgagatcctgctccacctccccttgttagctgaggataagaacgtgccatatgtgtttgttccatcgaagcaagctcttggccgtgcttgtggtgtgacaagac

SEQ ID NO: 3206 - DNA, 431 bp, Zea mays
  Clone ID: LIB143-013-Q1-E1-C11
acgcctctaaagtcaaacgcagtattttttgatgaggtacattcattgacaacacaaacaggtaaagagggtgggtgggttgttgaacgtctcctaaatcagtttcctatcgaacgtgatggtgctggtcagcgtaaacgtgtctacatgataggagctacacacagaattgatatgatagatgatgctatgctacggcctggtagattcgggaagaaacattatgtacctatacctggtgctcgcgaaagggtttcaatattaaaggcactagccagacgcatacccgtttcatcaaccgttgatttggatgtgttggcacttcgagaagagtgcagcaatttcactggcgccgatctagcatcactggtggatgaggcagccatgttagctatggcagagagatggatgtacctcgataacaagacatc

SEQ ID NO: 3207 - DNA, 422 bp, Zea mays
  unsure at all n locations
  Clone ID: LIB143-013-Q1-E1-C12
gatcttactggtggagttggagctctatatggtcctctgcatggcggcgcaaacgaggcagtacttaaaatgttaaatgagattggaagcatggaaaatattcaagatttcattgtangagtgaagaacaggaagaggaagatgtccggttttgggcaccgtgtgtataaaaactatgaccctcgtgctaaagtcataaggaaattggcagatgaggtgttctcaattgttggacgggatccacttattgaggtggccattgccctagaaaaggcagcgctgtcagacgaatattttatcaagaggaagctgtatccaaatgtggatttctactctgggctaatttatagggcaatgggattccctacagaattttttcctgtgctgtttgctattcctcgcatgggtggctggctagcgca

SEQ ID NO: 3208 - DNA, 423 bp, Zea mays
  Clone ID: LIB143-013-Q1-E1-C2
cacccactgacccaccccacgccgccgcctctcccagtgggtcctccgcatctcccatctcgcatctcccgtctcacctcttcctcctcgcctgcgatcttctccaccgcatcacctccctcgaagccgagacccaggcacgcgcccattgccttcggtcgccatgtccgctgctcagcttctccgtcactcacgcaagctgcggagtttgcacaatgctgtaggttgtgagaattttagttttgttcggcatttctccagcggttctgggtcctttatcgccagggaaaatggcattggaaaaagaaccagaggtaccagattgttccagcataaccagcctgcataacagctcgagacattctcagcatgagtaaatggaagctgcacttggagaatagcatccaacagcctttacccaag

SEQ ID NO: 3209 - DNA, 302 bp, Zea mays
  Clone ID: LIB143-013-Q1-E1-C4
cctgttacggattttagcttcgatgatcgttctgctccaatttacacacaacctagatatttgcctccttcaaaggttcttgatgctgatgtgacagacagtgttattggagaagggtgtgttattaaacattgcacaatcaatcattccgtagttggactccgttcctgcatttctgaacgtgcagttatacaggactctttgctaatgggtgcagactattacgagactgagaatgataagaatgtcctttctgacactggtggcattcccattggtaatgggaaaaattcacatatcag

SEQ ID NO: 3210 - DNA, 461 bp, Zea mays
  unsure at all n locations
  Clone ID: LIB143-013-Q1-E1-C5
ggggccacccacgcgtccgcaacctctctcncctcgactgttgggtgtggtggatttcctccgctcccgccgaacggtcgatcttttgcatggcagcagcggcggctagctccaaggggcgggcgatcgctgggagcttcgtcagccgcgtcctggccggcaaggccgcctccccgaggagggccgtgcacgcctcgtcgtacgacaagaacccggaggagcaggtgcgcccggcgttcgtgccggacgatgtgatcggccgcggcgcggggagccccgacaagtactggagcccccaccccaagaccggcgtgttcggcccggcggcggtggaccccaaccagctgggcgtcgccgctgacgctgcagcagcaggaggcacggttctggaccagaaggtgtggttccgcccgctcgaggacgtcgagaagccgccccccgtcgcctgaaccgcgccacgc

SEQ ID NO: 3211 - DNA, 456 bp, Zea mays
  Clone ID: LIB143-013-Q1-E1-C7
tcgcgggtcgacacaagcctctaaacagaggtcatacaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgca

SEQ ID NO: 3212 - DNA, 471 bp, Zea mays
  Clone ID: LIB143-013-Q1-E1-C8
tcgtaggtcgttacaagactctatactgacgtcgtattacaccacacctcttcttcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactgagccggtcaggcgatggcgcacgagagtcgagaggacgacgacgagtcgtataaatataatagcggcgtctaaataagattctgtcaactgcacccgccattatcgatccatggtcgctc

SEQ ID NO: 3213 - DNA, 392 bp, Zea mays
  Clone ID: LIB143-013-Q1-E1-B3
cggggccagcacgcgtccggacttatttgcacgaccgcgatgcagccgcagccgcggatctcgctgccagcgactgatcggggacaccgcgcaagggctcagccccgcaacccacgttaagtccgccttcgggatgagtcgtctccgggccggcgcgggccggccatcgccctcgactgcaactgcgactggcgcatagacctgtcatcaccacgagatcgttccgccctatgtcggtaaagatgctctgttgcacacctcaagctgcactctgacggactctgatgactcgaagtttggctatggcgcaacgtagctcactggtgcagtcgatttggtgggccactacaagctgctgtcaaatcatgatttcttttgcaagaaacctttgc

SEQ ID NO: 3214 - DNA, 377 bp, Zea mays
  unsure at all n locations
  Clone ID: LIB143-031-Q1-E1-C1
gggtcgatccaagcctctaggattgatcgttctacaccagagccttggaggggctgttggtagctgtcagaggcttcagtatgcatatgatgaggtgtccacaagggcatcacatcttgagatacttaagaggagtcagatggagcagattgatcagctagagcagaaaaacacagaaactgtggagaaacatcggcttctggaagaggaaaagttatctgcaaataaggagaatattaagctacaaaagcatgtccaagaccttgaagttcagctccagctagcanagcagaagcttaaagttactgaggcagaaagcaaatgcaaagaagagagatatgaagcgtcagtggaagcactgcgggcagagatctgtc

SEQ ID NO: 3215 - DNA, 385 bp, Zea mays
  Clone ID: LIB143-031-Q1-E1-C11
tctaaagtgactcctattaacgcgtgggtttttttttttgaagcaaactcagtttgtattcatgacatgttggacaacccaagtccacaagctacaagcactggagaaattatttgtacaatgccaggataaggggaaaaactatgcaggaaaagtgaaaaatgataaaaaagaagatttctagtaaaacaaggcggcacacagatggagcctctggtttagaagcaaagtctcgtggttggaaggatgataaaagaccacgggcaggggcaggggcaccggcgaacgggttgcaggcagcgcagtgtacatggcaaggctagatctactagatggcttcgtcccaggcggcccagttggcggcgctgccaacacggggcatgga

SEQ ID NO: 3216 - DNA, 398 bp, Zea mays
  unsure at all n locations
  Clone ID: LIB143-031-Q1-E1-C12
gtcgatacaacactctaaactgactcgtatcattcncggcctcaccccgagccagtcgtctcgctatggtttcgccgccgccgccatgcctcgccgcagctcaggaaggtctgccccacgcccagctccccgtgctgcttcactgaggaacccgccacagccagcacgccaggctcctcctccagctcctgttccagatggtggtggctccatgtttggaggaattgggtccaccattgctcaaggtatggcgtttggcacgggtagtgccatggcacacagggctgttgactctgtattaggtccccggaccatccagcatgagactcttgccacagaagctcctgctgctgcccctgctgctccagcgatgaatgctgatgcttgcagcttccatt

SEQ ID NO: 3217 - DNA, 372 bp, Zea mays
  Clone ID: LIB143-031-Q1-E1-C2
tatgatgagtcgttatacagatcaaatgctgatccttttaaaaacgggttgggttttaacaatggaaatggtatttactctggtgagcaagggttcgctattggtggtgaagagaggttaagcagatcaaatggctatctttctgagttggtcgcggcagcatatgtgtgccatggatgtttatgaaggaacaaggatggctacagcggaagatcttcctggcattagaaaaattattcggccgctggaggattctggtgttttggtgcggagaacagatgcacagcttcttgaagcgctagagtcattctatgttgttgaaagagatggttcaatcaatgcttgtgctgctctaattccaatccctgagga

SEQ ID NO: 3218 - DNA, 364 bp, Zea mays
  Clone ID: LIB143-031-Q1-E1-C3
gtgggtcgatacaagactctagactgagtcgtaatatggaggtaccacgactgacgactacatggcggtcagcagcatcaattcgtcttcgacctcgagttcagagcagcgggtaacaattggagccctgctcgtggtcgtgtccgtcatggtggtgggcgcggccgtggtgtccgacatgatcatctaacacttcatgttctgccagaccacggctgacatagagatggggatgccagtcgccccgtcgcacgtgttctgcaacttcctggtcagggcggatctcaagtgcctgtgcggctacaacatctcgacgtggatgggcctctacaacatcgaccccaagctcgctatggagcttccg

SEQ ID NO: 3219 - DNA, 205 bp, Zea mays
  Clone ID: LIB143-031-Q1-E1-C4
ccgttgcagtctgcgacggaatgggtggtcaattccaatctccgggccgtccggacgctgtggctcagcggcatcctctgctccattgcctagaattggtccacgcccggcatgaagaccagcgtcaatatcatccacgccaggctgcatgctcatgctctcacgctggctgccttggctgggtccgcgctggtggagttccagg

SEQ ID NO: 3220 - DNA, 343 bp, Zea mays
  Clone ID: LIB143-031-Q1-E1-C6
agtgtaattcctggaacacgcccaagtcatgcatcccaagacagacgtgtactaatgcttcccccatctgaagaagtataaggcctgaacttagcacccagtgctggtttggtcacgacgatctggccacggggcgttccttgtgttgagggtgtacattccgtgttaacttccagtcagtcatgcgtcctgtcctatgttaacctacataacaaagtcatgtgctgtccacttctaatgaacctactgtctgcagtgaacacctgtttggtttcataacgatgaatttcgtgtgcacaacacattactggtccgtgggaattgggccaatttgcattgtctt

SEQ ID NO: 3221 - DNA, 392 bp, Zea mays
  Clone ID: LIB143-031-Q1-E1-C7
agatcgctgctgacctgaaggagcatgtcatcaagcctgtcatccctgagcagtaccttgacgagaagaccatcttccaccttaacccatctggccgctttgtcattggtggacctcacggcgatgctggcctcactggccgcaagatcatcattgacacctacggtggctggggagcccatggtggtggcgctttctccggcaaggacccaaccaaggttgaccgcagcggagcctatgtcgcaaggcaggctgccaagagcatcgtcgccagcggccttgctcgccgcgccatcgtccaggtgtcttacgccatcggcgtgcccgagcctctctccgtgttcgtcgacacgtacggcaccggcgcgattcccgacaaggagattctcaag

SEQ ID NO: 3222 - DNA, 348 bp, Zea mays
  Clone ID: LIB143-031-Q1-E1-C8
tacacacacgcctgacaagttctagatcgcgatctagaactagtcccacgcgtccgcggacgcgtgggtttggatatgtctaatctgtggccatgttggctgtggaaggtacaagggtggacatgctattgaacactggaaggaaactcaacattgttattcacttgagttagagacacaaaaagtgtgggactatgctggggacaactatgtacatcggcttattcagtcaaaaacagatggaaagctagttgagtacaatttccatggtgatcacacagcagagagcacgtgttcactatgcagtggtgatgccgcaatggatgaagctctactgaacagttaatt

SEQ ID NO: 3223 - DNA, 335 bp, Zea mays
  Clone ID: LIB143-031-Q1-E1-C9
tgagtcgtattagtctgtcgcgactatccttgctccctacagtggcggaagcagatattacgcgcgctcaaaaagatacctgcttaggttatcttatgaggaatgcctcttcgggaggatacattgcgcgaaacggcactttgcagtcgtcgatggaatgggtggtcaatgagaagctcctggccgtcaggaccctgtggctcatcggcatcatcggctttatcacctacggtctggtctacgcctgggatcataacgatcgtgaatctcatcaatgcgcatgctgtatgctcacgctcgtcacctcgctgttgtggctcagtacgcgctggtgg

SEQ ID NO: 3224 - DNA, 400 bp, Zea mays
  Clone ID: LIB143-031-Q1-E1-D11
cgggtcgacacaagcctctagaatgagtgcatcatacacaagcaagaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgaggcggccaccgagggcggcggctgcgactgcaacacctgcaagtgcggcaccagctgcggctgctcctgctgcagctgcaactgagctggcccggcccggcgatggcgcacgagagtcgagaggaggaggacgacgacgaggcgtataaatataatag

SEQ ID NO: 3225 - DNA, 396 bp, Zea mays
  Clone ID: LIB143-031-Q1-E1-D12
gggtcgagacacgcgtccgaatctatcgcgtggacgacactgggccaactccccggccccggcggctctaaccaagtggccaagttctcgtccggcccctccgcgaagaaccagcaacaaggttcccggccgccaatttaaaccagggcggaccacttgcctccattctccggaattaaaaaggacagggtcaacggcccttttaactccaaattggggctgtcgtcatggggatcgctgctctcgtctgcacaacaggccaactatatcaccaactcttgtgcttgctaacatgtatcagcgccctgatatgataacccctggagttgatgctcaaggccaacctattgaccctgagaagatgcaggagcattttgaggacttctatgaggacat

SEQ ID NO: 3226 - DNA, 388 bp, Zea mays
  Clone ID: LIB143-031-Q1-E1-D3
gggtcgtaccacgcgtccaagcgagcacatttgactgaccgccatagcaacgagaggaaacaaagcggcgaccgacgagccaagcaagcagcagagcatggacgcgggcgaagtgcggcactggaacgcggacgtcaacggcgtctccatccacgtcgccgaacggggccccgaggatgggcccgcggtgctcctaatccacggcttcccggaactctggctctcgtggcgccaccaaatgggcgcgctcgccgcccgcgggttccgcgcgctgggtcccgatttccggcggtaccgggaaccctccgttgcggtcggacccggcgccctacaccatcttccacatcgttggcgacatcgtcgcgctccttgagcacctccaactcac

SEQ ID NO: 3227 - DNA, 149 bp, Zea mays
  Clone ID: LIB143-031-Q1-E1-D4
cgccctgatctccgaattcatcgctacgctgctgtccgtgtatattaccgtggccacagtgatccgctagaagcacgagactgacgcgtccgcgtccggtatcgacgcggcttgcggcagtcttcgggtccttgggatcccctgggcca

SEQ ID NO: 3228 - DNA, 416 bp, Zea mays
  Clone ID: LIB143-031-Q1-E1-D5
gctacgacgacatccagggcatgtacagcggcctcgacatgctgccgccgcccggcgaggacttctactcctcgctcttcgcgtcgcccagggtcagggggaaccagcccaccggagccgcggggttgggccccttctgagtgagctcaggcgaggatggaggcatggagatgaggagagaagacggacggcgttgcgaactctgtaaatacagcataggactaggagtcgaacctggtcggggttacaagtcgagtgtgtcggtgtttcgtacatgggagccggcccggtctttggcttggcgctggctcattctttagtttcacttcctgcgcagacggtaggtagatgtgtatgcgtagctgtgcactatcacttcctcttcaacagaaccgattcactccgaatggcaatgt

SEQ ID NO: 3229 - DNA, 327 bp, Zea mays
  Clone ID: LIB143-031-Q1-E1-D6
ctcgagctaagctcagcctcacacagcctctcctctcgagctagctagagtgctactagcttataagaagcagcagcttacagctgaagctgcagcagtggcgaaatcttacaccttactgttcgtcgcactggtcgttctggcccttctagtgagccccattgcttgctcccgcaagctcgccaagccgaacaagcccaagccgacccacaagccggcggccagggtcacgcccggcagcaaccacaccggtatccccgcagtgtccgccgcctacggttccggcggctggttgtctgccggcgcgacgtactacggcgccccaaa

SEQ ID NO: 3230 - DNA, 383 bp, Zea mays
  Clone ID: LIB143-031-Q1-E1-B9
aaagagagtctttcccagttctggtctctctttcccgtctccgagcgctgccgccgcccgccgctagcgccggtgcgcgagaaacaagaggaagaagaagccaaccgatccagcagcgatggtggtcggtggcctgttggggggcgctttctgggcgacacgggcgctggaagtggtcaagcggaacgattcaccgggcctgctgtggaagcgcatcaagctcaccaccacccgcaagaacaacgccaacaagcgccttaagcggctctggcagaatgaggcggttataaaggcttgtggtgaatcataatccaaatcagcgtcgaacgtggcttccaccactgataaacaacagtaacctttgactatttcccccagtttgc

SEQ ID NO: 3231 - DNA, 393 bp, Zea mays
  Clone ID: LIB143-031-Q1-E1-A11
ccattacaacaccctagtctgagtagtattaaccaagagactgcagatcgagggtctggcagcgggccgtggcagttgggtgattacgacgaagagagatgggcctcctcgacaagctgtgggacgacaccgtcgcaggcccgcgcccggacaccgggctcggccgcctccgcaagcagcctgtgcgtcccgccgccgtcaagatcagtgatccggccggggacgctgcggcgttcgtgccgccctcgccggcttcgggtagcgaggagacgccggtgaaggtgacgcgcagcatcatgatcaagcgccccgcggggtacccgtcgtcgccgaggagcgcggcaagcacgccgccggcctcgccactggggactaccccgcccatctcgccgt

SEQ ID NO: 3232 - DNA, 379 bp, Zea mays
  unsure at all n locations
  Clone ID: LIB143-031-Q1-E1-A12
cgggtcgacacaagcgtctaacatgcgtccgcataataaagagtgaagatttaagatgaagtggttgttgaagaggagtttactccagtgcctgttcatcaagtggatggagccatctaactgatcatcgtgttagaagtatctagaacctcttctctgcaacaaaggcaagccccggtgcatttgccccttccttgtgttttaaatgctttatcaccttaaatgatgcattaggtgatangagttgtgtgatgaacaactgatgcattaccattccttggaatttaaatactataccttgattcctgatttataaaaagaactgataatgcttaaccctgcttagaaactgaaaaatccattgttttcaaaaagaatg

SEQ ID NO: 3233 - DNA, 377 bp, Zea mays
  Clone ID: LIB143-031-Q1-E1-A5
gcgggtcgatacacgactctacactgacgtgcatactagggggcaggggcaccattactgagtagtttaattagtgctagttgtattaccattgttagtgacttaattaggctcacgcgatgcaccttacctctgctagtctgcgtgagtctcatcacgtcgcttaatcttggtcggtgattgtggtcttcacttcttgcgcgcattgcacatggtgctcggtctgcagctatgttacgttatggactcgagtgtggtcaatcgatgtcgatatactactactgctctgttaatatcagcgggaaggaggaagattacggtgagtccactgatgatgtgtgagcgaccggcggttgacggtgggcaggtgtaccgtg

SEQ ID NO: 3234 - DNA, 367 bp, Zea mays
  Clone ID: LIB143-031-Q1-E1-A6
tcgtgggtcgatacacgcctctacactcactcgtgataaggcaaggcaagatggtgcagcaacagcaagccgcgaaggaggtgatcccgctgctgacgccttacaagatggggcagttcgagctctctcaccgggtggtgctggcgccgctgacgaggtgccgctcctacggcaacgtgccgcagccacacgccgccgtgtactactcgcagcgcgccaccaggggtggcctgctcatcgcggaggccatgggggtgtctgccaccgcgcaggggttcccggagtctcctgtcatctggacgcaggatcaagtccaggcgtggaaactcatcgtctaagccgtccaccgcaatggcgccatcttcgt

SEQ ID NO: 3235 - DNA, 397 bp, Zea mays
  Clone ID: LIB143-031-Q1-E1-B1
actcttccctcagaacgctgcaagactgccaggcttccacacgtgtgtgggcagcggtggagagagactacttcctgaatggtactctgagaaaggcattgaactgatcctgagtactgagattgtgaaggccgaccttgcttcaaagactctgaccagtgcagctgcggaaaccttcacatatgagaccttgctcattgctacgggctcctcggtcataaagctcactgattttggtgttcaaggagcagaatccaacaacatattgtatctaagggacattgcggatgccgacaagttggttgcagctatgcaggcaaagaagggtggaaaggctgtgattgttggaggtggttacataaggcttgagcttaaccctgccttgaaaatcaacaac

SEQ ID NO: 3236 - DNA, 224 bp, Zea mays
  Clone ID: LIB143-031-Q1-E1-B10
cgggtcgatacaagcctctaaattaagtcataataattgggccgtcgggagaacatctgcacgcgggaccgggcaacatttcccgctgctgccaacaagcaaaaggggcgacgatatataaccaactgcagccgttactggattcggcaacctcctcgattgggaagtcagaccatagatggggttccacctgctggcgttcgtggctgccacgggcctcatgc

SEQ ID NO: 3237 - DNA, 300 bp, Zea mays
  Clone ID: LIB143-031-Q1-E1-B11
ctccggtcctcatcaatcactaagcaaaacacacttgcaagatggagctggtctcgaagacacatctccttgcggttctggtgtccgtgtcgtctggagctgtggtaatgtgacccgcgatccaattcaacgagcgggacatgtgcgtcagacgaggctctgtgggacgtgttcaagcggtggcaaacggactgacacgatgaaacagggtcacagttaaatgggcatgcggttcaggacgtacatggagatcattggcttgaacttggcgcaagagcaaactacgtcatgctggaactg

SEQ ID NO: 3238 - DNA, 372 bp, Zea mays
  Clone ID: LIB143-031-Q1-E1-B3
gggtcgatccaagcctctaaatagagtcatattactaaggtgtgctttgataacttcggcgacaatgtgaagaattggttgacctttaatgagccccagacatttacttccttttcctacggaactggggtctttgccccaggtcggtgctcacctggactaaactgtgcctacccaactgggaattcactcgtcgagccttacactgctggccataacattctcctagcccacgctgaggctgttgatctttacaacaagcattacaagcgcgacgacacccgcatacggcttgcgtttgacgtaatgggtcgtgtgccatacggaacatcgtttctggataaacaggccgaagaaaagtcctgggacatc

SEQ ID NO: 3239 - DNA, 391 bp, Zea mays
  Clone ID: LIB143-031-Q1-E1-B5
tcgcgggtcgatacacgactctatatcgagtcatactatcctcgagcacactgatgtggctatcctgctggacaacgaggccatctatgacatctgccgccgttcccttgacattgagcgcccaacctacaccaacctcaacaggcttgtgtcccaggtcatatcatccctgactgcctccttgaggttcgatggtgctcttaacgtggatgtgaatgagttccagaccaacttggtgccctacccgaggatccacttcatgctttcctcctatgctccagtcatctctgctgagaaggcctaccacgagcagctgtctgtggccgagatcaccaacagcgccttcgagccatcctccatgatggccaagtgcgattcccgccatggtaag

SEQ ID NO: 3240 - DNA, 389 bp, Zea mays
  Clone ID: LIB143-031-Q1-E1-B7
aggccggcacgcatggcggcagagaagcaggcggcgatggacgggcggaaggacggggtggcgcgggaggtcatccggatggaacgggaggccgtcatccccatcctcaagcccaagctcgtcatgcgcctcgcgtatctcatagagcatgaagctgatcggaacgagttcctgaagctgtgcaagaaggtggagtacaccatccgggcctggtacctcctccagttcgaagacctcatgcaactgtactcactgtttgatcctgtttctggtaaggagaggttacagcaacagaacctgacgccggaagaaatcgagaccctcgaattcaatttcatgacatatcttttccaggtgatggaaaagagcaacttcaagttgctatcaga

SEQ ID NO: 3241 - DNA, 360 bp, Zea mays
  Clone ID: LIB143-031-Q1-E1-B8
acccacgcgtccgcggacgcgtgggtgcacgcgggagccggcgaggtgcctaatggactcggccgaaatggcattcagctacaatatcaagactggactcgtgtccgtcgacttgccggtgccggcgcatgacctatacctttggacactggacattatgatctaagtcgtgatgctgtgcgccgacggtaaagcatgccatcgcggctgagccattatgagtctgacgacattgtcatttgctatgtgcactatatgatcatgtatcgtggtggtatagtatacttggcatggggagtgtcttttttgttatgttcatatctgtatcacatacatgctctgaatgttacaagatacctg

SEQ ID NO: 3242 - DNA, 356 bp, Zea mays
  Clone ID: LIB143-031-Q1-E1-A10
gcggcctctgccgccgcgtctccatcctgaggctccgaatcgatctcccttccccaccaaaccggagcacttcggaggccggacccggcgagaagcgagcgaccgcagccagctcacgtcgcccgcttcatccaccatgctgagggtcgcgggcaggcgcctctcgtccgctctcgcctggcgccccgccgccgccgcctcaggctcccggggccctctcgcgggtacactacccggccgcgacgacgacgacacacgcgactgcagggcgcgtttcgccatcggaatctcccttcgtcgccgctgccagagggttttcaggagagactcctgcgcgaggaaaccaggatgtgggc

SEQ ID NO: 3243 - DNA, 401 bp, Zea mays
  Clone ID: LIB143-030-Q1-E1-G6
atcagtgccgccgcacgagctggcgtggcgcagccgcgcggcgtcgctgtccgtgcacgagggggtcgggcggacgctcaaggggcgcgacctcagccgggtaagggacgccgtctggaagaggaccggcttcgaggactgagccgatgctgatcccccgccgcgcaggccgccggtatgtgtaggttagaatatgagcagcgctgctgattgcttatctcttgagttccttttctctctctctctctttttaaaaaaaagtcgggccagggtagtagtaagctctttttttttgtttcgttcatgttgatgtgagccaacagtgcgggggtgtgacggtgtgtcattcatatggtgtgacgattttaaggacaccttaagaaaaaagacgaattttgtac

SEQ ID NO: 3244 - DNA, 434 bp, Zea mays
  Clone ID: LIB143-030-Q1-E1-G7
cgcgggccgacccacgcgtcagcccacgcgtccggggcgaagttccgtgctcgcgctgcttctcctgctttccgccggaggagcccgagcgtcctacgacggcgagggcgaggcaggggcaggggcagaggagaaggagaaggctgcggcgtggacgggcgggctgagccggcggagctttcccaaggggttcgtgttcgggacggcggcgtcggcctaccaggtggagggcatggcgcacaaggacggccgcgggccgagcatttgggacgccttcatcaagatccccgtagtacacttgtatggattgcatatgaaaatgcatcgatcgtggattgaattggcttgacatggttggatcatggcatggcaatggcggcgtcctgcttttcaagcgagattccaaacaacgccaccgcggacgtgactgttga

SEQ ID NO: 3245 - DNA, 420 bp, Zea mays
  Clone ID: LIB143-030-Q1-E1-G8
atcagcaagtacttcgagtcccgcgtggagcgctacggctccaccgtggtgcgcatgaacgtgccgccgggccccttcatggcgcgcgacccgcgggtggtggcggtcctggacgccaagagcttccccgtgctcttcgacatggacaaggtggagaagaaggacctgttcacgggcacctacatgccgtccacctccctcaccggcggctaccgcgtctgctcgtacctggacccctccgagcccacccacaccaaggtgaagcagctgctcttctccctcctgctctcccgcaaggacgacgtgatccccaccttccgctccaacttctcctcgctcctcgccaccgtggaggcggagctggccaagggcggcaaggccgagttcaacaagctcaacgacgtcacctccttcgacttc

SEQ ID NO: 3246 - DNA, 436 bp, Zea mays
  Clone ID: LIB143-030-Q1-E1-H1
tcgcgggcggccacacgcgtcaaaacatttttccactgggatgtacctcaagcactagaagagaagtacggcggcttcctagataagagtcataagagcattgtagaagattacacatactttgctaaggtgtgctttgataacttcggcgacaaggtgaagaattggttgacctttaatgagccccagacatttacttccttttcctacggaactggggtctttgccccaggtcggtgctcacctggactagactgtgcctacccaactgggaattcactcgtcgagccttacactgctggccataacattctcctagcccacgctgaggctgttgatctttacaacaagcattacaagcgcgacgacacccgcataaggcttgccgttttgacgtaatgggtcgtgtgccatacggaacatcgtttctggataa

SEQ ID NO: 3247 - DNA, 421 bp, Zea mays
  Clone ID: LIB143-030-Q1-E1-H10
ctcgcgggccgatacacgcctcaacacttcgtcccgctgaccgccgcgtccgcctcgcccagcgcagcagccgccgcagcacatcgctatctcgatctcagccatggcggaggtggagcagcaacaggacacgccgaagctgttcaaccgctggaccttcgatgatgtccaggtgaacgacatctcgctgaacgactacctcgctgtgaacgcgacgaagcacgcgatgtacctgccgcacaccgcggggcgttactccaagaagcggttccgcaaggcgcagtgcccgatcgtcgagcgcctcacaaactccctcatgatgcacgggcgcaacaacggcaagaaggtcatggctgtccgcatcatcaagcataccctggaagatcattcacctggctcaccgggatgccaaccccatcca

SEQ ID NO: 3248 - DNA, 349 bp, Zea mays
  Clone ID: LIB143-030-Q1-E1-H11
tcgcggtccgttacaatcctctataatggatcatattaaaaaaacaaaaaaaaaaaaaaaaaaaatcacccatgaaattcatcacacaaaaacaaaccaaaatcacagttatctcagaccaccgcccgctttggaaaatgctcaacaaaagcggggcgacacgctccagcctcacgacgaggaaacatgtgcatcaaggccagaggacagatgttcctgtgggactggttctaccgggtgctggcctctctcagcctgtggcaggaggaagccatgattttcttcctctaactcgacttcaccagcaacaccattctgctccacatgctcaatgacaagcggttggtgc

SEQ ID NO: 3249 - DNA, 205 bp, Zea mays
  Clone ID: LIB143-030-Q1-E1-H3
atcttggcattcgtgttcctgcttttaaagtaggtaatggacgtacccatgctgggatcaatctggccatgcatgagttcaggacttgacctgttggtgcaactgcatttgttgaagctcttcgtatgggcagggaactttacgatgtcttgaagagcatcaataagtcaaaatatggtcatggtgcatccagctgtcggacatg

SEQ ID NO: 3250 - DNA, 435 bp, Zea mays
  Clone ID: LIB143-030-Q1-E1-H5
tcgtgggccgatacaagcctcaagaatgagtcggcttaagaaggccgacgcgctcgccgctgctaccgaaatcggccagacattccccaaaccctacgctcgctcgctcgccggagccctcgttgaaccgagcaggcgggcgaaggaggctcgacgatgttccgcaaccagtacgacaccgacgtgaccacgtggagcccccaggggcggctcttccaggtggagtacgccatggaggccgtcaagcagggctccgcctgcgtggggctccggtcccgcacccacgccgtcctcgccgccgtcaacaagcccgcctccgagctctcctcctaccagcggaaggtgttccgcgtcgcccgacacgcgggggttgcgctcgccggcctcacggccgacggccgcgtcctctcgcgcttcctccgcaacgagtgcatc

SEQ ID NO: 3251 - DNA, 373 bp, Zea mays
  Clone ID: LIB143-030-Q1-E1-H6
gacccacgaatcagggctgatgaaagctactgagcccgtagctgcaagaggctgagccttttcgtcaacgttgcatgccaccgagcgccaggctcatcttctgcgtggcatacatataagattggctgcccccgctggttaaataataatagcggcgaaggaacaggatagcttgttctcaacgctgatcttcgccgctaaagtggagtgtttggcaggatgctattttctttcccattagggtacgttcgggttttacggaacggtaggtttttatacggaacggtgggtacaacaattcctagagccggattgtttctctaattatttatataaggtttgatcaattgaaataattttggatccattcttg

SEQ ID NO: 3252 - DNA, 417 bp, Zea mays
  Clone ID: LIB143-030-Q1-E1-H7
atcagaggagcttgtcatgcctgttcctgcttttaatgtaataaatggaggtagccatgctggcaacaatctggccatgcaggagttcatgattttacctgttggagcaactacatttgctgaagctcttcgtatgggcagcgaagtttaccatgtcctgaagagcatcattaagtcaaaatatggtcaagatgcatgcaatgtcggagatgaaggaggttttgctcctaatgttcaagacaacagagagggtcttattttgcttatggatgccattgagaaggcaggctacactggaaaaatcaaaattggtatggatgttgcggcatctgagttccttacaaaggatgggaactatgatctaaactttaagaatcagcctaatgatggagcccatattctctcagcccagcatct

SEQ ID NO: 3253 - DNA, 413 bp, Zea mays
  Clone ID: LIB143-030-Q1-E1-H8
atcaagcaatcgactacctaaaatcccttcagctccagcttcagatgctggtcatggggaagggaatgtcaccagtggttcctcttgagctgcagcaatacatgcattacatcacggctgaccctgcccagttgcctccgttgcgcccctccggccagcagcaccggcaatttcagataactcaagccaatccccagagacaatctaacgtcgagtcggatttcttgagccagatgcagaacttgcactcttctgagccgcctcagaactttctcaggccaccgaaattgcaactttatacaccggaacaagagggttggcctaccagcacgagccacaacactggatggatttctgggagttcctcgtataacttcatggagtgatgtgctccttgcctccttatgacaaaa

SEQ ID NO: 3254 - DNA, 383 bp, Zea mays
  Clone ID: LIB143-030-Q1-E1-H9
actcgcgggccgacacaagcctcaacacacgcgttctggaacactgcctcgccaagatagccgaggccggccgctcgtcggagggagccaagtcgccgatctcgctcgtctcccgccactcccgccgctcctcctcgtcctccgaagatggcagcgtgaagtccgcggggagcaagaaggtggatccaaggtgcccgaacgctggcaatctgttccatgaatgcggtgagcattgcgccgccaagatgcagcggtcggagcagcagcagaagggggtcaatctcaagtcaccgcgcaggaaaggggggaagaacgctacagcgatcccaaagtggaacgttgatccgaggtgccctaacgcgtccaatccggtccacatgtgc

SEQ ID NO: 3255 - DNA, 352 bp, Zea mays
  unsure at all n locations
  Clone ID: LIB143-031-Q1-E1-A1
ctcgtgggtcgatacaagcctctagagttagtcatattacgctccaacttctcctcgctcctcgccaccgtggaggcggagctggccacaggcggcaaggccgagttcaacaagctcaacgacgtcacctccttcgacttcaacggcgaggcctacttcggcgtgcgcccctcggcgaccgagctcggcaagggcgggccgagcaaggcggccaagtggctcatctggcagctccacccgctggtcacgctcggcctccccatggtcctggaggagccgctgctccacacgttccacctcncgcctttcctcgtcaagggcgactacagggcgctgtacaagtacttctcca

SEQ ID NO: 3256 - DNA, 384 bp, Zea mays
  Clone ID: LIB143-012-Q1-E1-H9
attcagattgtatccagcctgcgtgcttcctccccaaattcttcggtcagaagagcaagatgaagactcgaaaggcaaggtctgagctgggacataacgccggcaccctgcccgagcttgttgccgagccaacatcagctcggtcgatgtcatttgtcgggacccatgaatacttggcccctgaaatcatcaaaggcgaagggcacggaagcgctgtcgactggtggaccttcggcatcttcctgcatgagctgctgtacggcaagaccccgttcaaggggtcagggaaccgtgccaccctgttcaacgtggtaggccagcaactgaaatttccagagtcgccgtccacaagctactcgagcagagacctcatccgtgggctct

SEQ ID NO: 3257 - DNA, 286 bp, Zea mays
  Clone ID: LIB143-013-Q1-E1-A1
aacacctctaagtttcaaactggccctaaaccgctgctctttgggcttgactctgcccgcttttctccatctccacttggtccctctctcgcatggcggcggcggcatcggcgtcgacgccgcagggggtggcggagcggcggggcatcccggcggcggccttcgtcgaggacgtcgaggcctacctccggcaggccgggctcgacgttaactccgccctcgccttcctccaggaaaggttgcaacagtacaaaatagtggagatgaagcttctagcacaacaacg

SEQ ID NO: 3258 - DNA, 411 bp, Zea mays
  unsure at all n locations
  Clone ID: LIB143-013-Q1-E1-A10
gtgaagctctgtcacgtgagaaggaagttgggatcctggaacaggaaaagaaccatcttgaggagaagtatttgtcacagtgcaaaaagtttgatgagacagatattagatgcaaggaagctgaaagggaagcaaaacgagcaacagaattagctgatgtagctcgtgtagaagcttctgctgctcaaaaggataagggggaagctcaacggctcgcaatggagaggtttgcactgatanaaaagaatggagcgacaggttgaagctctagaaagggacaaggctcagttggtagaagagattgagagacttcatcagtcagagaaggatgctgtgtccaaggtcgcattgcttgaaagaaatgtcggtgagcgagaaaaagaaattgatgagatgttgaaacagaacaac

SEQ ID NO: 3259 - DNA, 94 bp, Zea mays
  Clone ID: LIB143-013-Q1-E1-A11
ggtccaggcgacgcgtccgaataccaatcagtttcaaactggctctaaagcgatgatccttgggcgtgactctggccgctttacacgagcttca

SEQ ID NO: 3260 - DNA, 457 bp, Zea mays
  unsure at all n locations
  Clone ID: LIB143-013-Q1-E1-A2
gggcccgcccaggcttcggcagcatccctcaaaaccgacccggattatcaaaccccaatttccccaagaagaagcaaacccaaccaaattgaccgcttgaacctccacccggcgaaccaaaaccgaaccggagccgaacgcaacgccgcgatgggaatctccctccggtccccccccgtcgcctcgctcgtcctcagttcgctcgtcttgcacgtcccagcggcaaaaactatagatccttacaacggtcaangagttgacacaaatgctagccaacgggatattcagaaagcctttcacacactttctctaaaataccaccctgacaagaataaaggaaagggcgcacaggaaaaatttgaagaaatatacaatgcatatgagatccgatctgatgaagagaagagaataactatgacctctacggcgatgagaagggtaccctggaattgtggtg

SEQ ID NO: 3261 - DNA, 371 bp, Zea mays
  Clone ID: LIB143-013-Q1-E1-A3
cgtctaaaaggttgtaaaaaccaggaagttcacagtgataaccggaactagggttaaccgaggacatcctggaaaaggattttccacaggctggattcaccgattacagaatcacgccgacagcgctgggtttccaatcggtcatctacgtcttcccctgacgaagaagcatatttatatatatatacatagatatgatcacactgtgtacgatgtgtcaagtgtgccctgtgcgtaaggaaatctacataccattattactaagttattaataagacagacatgatgatgagcgtatgggcaaatatacatgagatgcatatcaatgctaaagatttaacgttgtactactgccgtctggattttcacga

SEQ ID NO: 3262 - DNA, 453 bp, Zea mays
  unsure at all n locations
  Clone ID: LIB143-013-Q1-E1-A4
gggccacccacgcgtcgggaaaaaccctccccttcgcttccttcccaagcgcggacgccaaccagacgaaatggccccgaagaaggacaaggccccgccgccgtcgtcgaagccggccaagtccggtggtggcaagcaaaagaagaagaagtggagcaagggaaagctaaaggagaaggtaaacaacgcggtgctgttcgaccaggctacctacgacaagctgctctcggaggtgcccaagtacaagcaaatcaccccttccatcctctccgagcgtctgaggatcaacggctcccttgctcggagggccatcaaggacttgatggcgcgtggcctcattcggatggtctcggtccactcaagccagcagatctacaccagggcaaccaatacataaggatggggaagaggtctaaaatgcattgtctgcactctctgcaagangagctcgtc

SEQ ID NO: 3263 - DNA, 378 bp, Zea mays
  Clone ID: LIB143-013-Q1-E1-A5
ccacccacgcgtacgtattttgtcccagtcatctgatctgagtgtctgacgatatgtactactaataatgtgactaagggggtgtttgtttgaaaaaaaaaaaaaaaaaaaaaaaaaaaaaaaaaaaaaaaaaaaaaaaaaaaaaaaaaaaaaaaaaaaaaaaaaaaaaacaaaacacaaaaaactccccaaacaatacaacacaataaaaaccaccaacaaaacccacaacaaaccaaaaaacacccaaaacacaaaatccaacgtcaacaaccataaaaaaccaaaaccacgcaaaaacacaaacataaaacaacaacaccattaccaaaacacccaccaatacgaaacagcacaaaatcaaaaaaccaccccaac

SEQ ID NO: 3264 - DNA, 420 bp, Zea mays
  Clone ID: LIB143-013-Q1-E1-A6
aaagacccctgagctgatgcccctcagccatgtccttgccaccaagcttggtgctcgtctcacggaggttcgcaagaatggaacctgcccctggctcaggcccgatgggaagacccaggtgacagtggagtaccgcaacgagggtggcgccatggttcccatccgtgtgcacacagtcctcatctctacccagcacgacgagacagtcaccaacgacgagattgctgctgacctgaaggagcacgtcatcaagccagtcatccccgagcagtacctcgacgagaagacaatcttccacctcaacccgtctggccgcttcgtcatcggcggacctcacggcgacgctggcctcactggccggaagatcatcatcgacacctacggtggctggggagcccacggcgggggcgccttctccgg

SEQ ID NO: 3265 - DNA, 374 bp, Zea mays
  Clone ID: LIB143-013-Q1-E1-A7
aagtcaccgaaccgccttgtcgtcgacgaggccaccaacgacgataactccgtcgtcgcactgcaccctgacaccatggagaggctgcagctcttccgcggcgatactgtgctcctcaaggtctgatatggctaatctgagcttgttgcagcagcttggggatgttgagctaatctagcagattgtattatcacgtgaccgatctgtgtgtgttcgacctgaattccgtgtattcagagtgcagacctgttagaaataaccttagcttttgtcacaagtacttgctgaagtgtttaatgttgtaatttgttgtattgtttgagaacttgagtatgctgaggcattgagggtatttgggctcctcctgctttgct

SEQ ID NO: 3266 - DNA, 444 bp, Zea mays
  Clone ID: LIB143-013-Q1-E1-A8
aggacaacgccgcgcgccgctccggcgcggagatcgagaccatgaagaagtacaacgctggtatgaacaatgcggcgtccagcgggacatccctcaacaccaggcgcctcgacgatgacacagagaacctcgcccatgaccgagttccaagtgacctgaagaagaatctcatgcaagcaaggctcgataagaagttgacccaggcacagcttgctcagatgatcaatgagaagccacaggtgatccaggagtatgagtcaggcaaggcaattctcaaccagcagatcattggcaagctcgagagggccctgtgaacgaagctgcgtggcaagagataaccaggagcagcatagggaagacaaggcacactgtctgcttattatttgctatgtttggtaactcaagtcaatgcggactgtttgtgttggtacaagagtgaattac

SEQ ID NO: 3267 - DNA, 440 bp, Zea mays
  Clone ID: LIB143-013-Q1-E1-B1
gacgaaacacagctagctcgctgtggcagcatgttccgatctgccgtgcagcgtctcgtcagggccagcgggaagagtacggccgacccagccgccgccgcgtccgctttcttcctcagtcgcttctccgcggcggccgggccgccaccgccaccgccacagaggctggctggaaaggtggcgctgatcaccggcggcgcgagcggcatcggcagggcaacggcggcggagttcgtccggcacggcgccaaggtcatcctcgcggacgtccaggatgacctgggacgccacgtcgccgcggagctgagcctgccgggggggcccggcccggcggccgtccactacacccgctgcgacgtgaccgacgaggcgcaggtcgcggcggcggtggacctggccgtggagctgcacggccgcctcgacgtgatgctcagcaacgc

SEQ ID NO: 3268 - DNA, 456 bp, Zea mays
  Clone ID: LIB143-013-Q1-E1-B10
cgccggtccgaaactcacggggccatgcacgcgtccgaaccttctcggttacttgttcactaacaaggtcgggacggcatggcccttggagctgcgtaccatcactacctgcagctcgccggcgaccatggcaccgccacacacgcactgctcctcggcgtacttatcttcctcgtcatccgcctagtatccgcaaggcgaaccggcacaacctcagccaacaaacgtaagcagcaacagcggcttccgctcccgccttcgcccccgggcaagctgcccatcatcggccacctccacctcatcggcgccgagacccacatctcgatccgggacctggacgccaagcacgggcgcaacggcctgctgctcctccgcatcggcgccgtgcccaccctgttcgtgtcctcgcccagcgccgccgacgccgtcctgcgcacccaggaccacatcttcgcg

SEQ ID NO: 3269 - DNA, 401 bp, Zea mays
  Clone ID: LIB143-013-Q1-E1-B11
gagaaacacacactagtgcgtttgcgagagaaaccgagaaagagaagctacagagtcactgaccgaccgctatggcatcgaggcagaacacgcgtgaggcgcgcgccgaggccgacgcgcggcgcgccgtggaggagctggctcgggcgcgggacgagcacctcgagaaggcggaggtgaacgcccgctcggccgcggacgagatcgcgcgctcccgcgccgaccgcggtgccgccggtggcggcggcatcctggagagcgtgcaggagggcgccaggtccttggccagcgccgtgggccgcaccttcggtggcgccaaggacgcgaccgtggacaagacctcgcagacggcgcacaccgcgggcgacaagctcggcgagtacagggactacaccgccgac

SEQ ID NO: 3270 - DNA, 422 bp, Zea mays
  unsure at all n locations
  Clone ID: LIB143-013-Q1-E1-B2
gcccgcccgctacccaaccgccgccgcggttctcgctgccagcgacggacgggccacaccgcgcaggggctcagccccgccacccaccttaaccccgccgtcgggaggcgtcgtccccggcccggcccggcccggccctcgccctctactgcaactggactggcgcgtagacctgtccccgccacgagatcgttccgccctatgtcggtgaagatgctctttgcatagctcaagctgcaatctgatggactctgatgacaagaagtttggaaatggaccaagggagctcactggtgctgttgatttgatcagccactacaaactgctgccacaccatgatttcttttgcaagaaacctttgccgctggcaatatcagatacacattatcttcacaatgttgtgggagacactganattcgca

SEQ ID NO: 3271 - DNA, 356 bp, Zea mays
  Clone ID: LIB143-012-Q1-E1-H8
gcgtcgacccgatcgcagacaggcaaccggttgccaaagaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgac

SEQ ID NO: 3272 - DNA, 342 bp, Zea mays
  Clone ID: LIB143-012-Q1-E1-G12
cgtcgatcacaatgccgtctccttcccaaacgcggttgccgtctcctttggttcaacggcttgccacgcagcagcagcaaaattccgagccaagccttcaactcgcatattaatcctactagcccgccgcttcttttcttcgatgtccgcagtctagaggtttgcttcgcccggctcgagcgggtagggtttcaggagtgctcggtgagacggcatgataacgcggggagcgaagcgcgcggccatgtcagagcccgccgcacgcgatttaccaagtacgagagtaatggacggacactcttttgatgtgcacagggcggagtcttccaatcagcatgtgat

SEQ ID NO: 3273 - DNA, 346 bp, Zea mays
  Clone ID: LIB143-012-Q1-E1-G2
tcggaccacgcgaccgcacaaacagaaactgaactaaaagagaagaagttgagagttgaggatgccctaaatgcaactaaggctgccgttgaggaaggtattgttgttggtggagggtgcactcttttgcggcttgcagctaaagtcgacgccatcaaggatacactggagaacgacgagcagaaggttggagctgaaatagtaaggagggccctgagctacccacttaaattgattgctaaaaacgccggtgtcaatggcagtgttgtcactgagaaggtcctttccaatgataacttcaagtatggttacaatgctgctactggacagtacgaggacctgatgg

SEQ ID NO: 3274 - DNA, 324 bp, Zea mays
  Clone ID: LIB143-012-Q1-E1-G3
agcaaaagttattattgatgcaaacacaggccgttccaggggctatggatttgtcaggtttggagacgacaacgacaaatctcatgccatgtctgaaatgaatggtgtatattgctctacgaggccaattcgtataggacctgcgactcccagaagatcttcaggtgattctggctcctcgactcctggtcattcagatggtgattcttctaacagaacggtatatgttggtgggcttgaccccaatgtcagtgaagatgaactgagaaaagcctttgccaaatatgatcttgcctctgtgaaaattcctctaggaaagcaatg

SEQ ID NO: 3275 - DNA, 307 bp, Zea mays
  Clone ID: LIB143-012-Q1-E1-G4
cgcgaccgggaacgcgttgtttgggctgcgtactgagggctttccagggggtttgtctttgcccggtttggcgtctgtgtctgcgtgtcgcgtgtgatgtcgtacatgcatggtggggattgctcggcgaggggggttctggcggggtgtggggctcccagtggcttctgaggcgcttctgggtcggcggtggttgtggttgtcgacggtgattcatctctggtaactgtcgatcttgctgggcttgtgtcggggctagctccgccggccaccattggctcggtcgagcacctcatgcccacgatgg

SEQ ID NO: 3276 - DNA, 322 bp, Zea mays
  Clone ID: LIB143-012-Q1-E1-G5
ggctaggctaggaagacgcagccaatggcggggcttcacttcgtgctcgtgccgctactggcgcagggccacataatcccgatggtggacctggcgcgcctcctcgccggccgcggcgcgcgcgtcagcgtggtcaccacgcccgtcaacgccgcgcgcaacggggccgtcgtcgagagcgcgcggcgagcggggctcgacgtcgagctggcggaggtcgcgttccccggcccggggctcgggctgccagaggggatggagaacgtcgacatggtggcggaaaaggagcacttcatgcccttcttccaggccacgtggaaga

SEQ ID NO: 3277 - DNA, 326 bp, Zea mays
  Clone ID: LIB143-012-Q1-E1-G6
cgcttccccagttcccccagctccccccaccttccgttgccttctcgaactcaacccccgcccccgtcgcggatcgtcatggccgccggcctcgccttccccgtcgcctcctttccactcgcctgcgtctcctcacctccccaccccgggcaccgcatctgctgcgcgatcccgtcgtcgtcctcgcgccgcaccgtcaaatcctcgccgctccgcgcgactaccgtcctctccagggaacgacggggcacgggccgtggcgcgtccgtagtgtgcgctgtccaaggccaggacacgaccatccaagtcccagatgtgacaaagtc

SEQ ID NO: 3278 - DNA, 324 bp, Zea mays
  Clone ID: LIB143-012-Q1-E1-G7
cccacgcgtccgaatccacgttcctcgccccctgcccctccggagagtcatggccaccgccgtttccacccccgcggacctgtcgcccacgcctgccccgagacggcggggccggccgccgaagaaccccgccccagccgaggccccaggcagcccggctgaccaagcggaggtgattggggactacgagcgcgagagggacgcgaggatccgggagaacatggagcggatgcagaagctcggcatcctcgacctcgcgcacaccctcagccactgcgccgccgcctcgggtcggggtaccggcagtgggcggtggcgccggaa

SEQ ID NO: 3279 - DNA, 330 bp, Zea mays
  Clone ID: LIB143-012-Q1-E1-G8
aaccggctgtccccacgcggttgctccaaggaaggaaactctgatcccgctatccccgcccccgctctctctcgccatctccgtgcggctgctccaaggaaggaaggtccgaccccgccatcgccatccccgcgtggctgccttcccctctcgccatccccgcgcggctgctccaaggaaggaaggtccgaccccgccatcgccatccccgcgcgcccggtcgagcgccaccagccgcataagtctgggctagcgccgccggccaccattggctcggtcgagcacctcatgcccacgacggtcagtcgccgccttcatggctcagagtcg

SEQ ID NO: 3280 - DNA, 381 bp, Zea mays
  Clone ID: LIB143-012-Q1-E1-G9
aaagtaagcttcttgaagtaatagattcgagtgagttgccagaattccttggtggatcatgcacatgtagtgacaagggtggttgccttggatcgaacacagggccatggaatgatccttatatattgaagctgatccacaatttggaagctggatgcatgacggaaaccaccaaacccgtttctgaaggcggtgaaagaagcagctcttcctttcggttggaacagatgaaatggcagggcatgttaagcgatacatcaaatgctgaatcaggatccgatgttgatgattttggtccatcatttgttcataaagtttcaggctatggttgcttgactccggttcgtgaggaagtaaagggcacagattgtgcaacatact

SEQ ID NO: 3281 - DNA, 361 bp, Zea mays
  Clone ID: LIB143-012-Q1-E1-H11
aaacgactcccacccggtggctcgtcctcggacgccaagccactccgcgccccaatccggaagcgccgacgccgccgatggaccggccgtcgacccatgctccgcgcggcgctcttccgctcagcccccgggctccgccggtctccggcgacggcccacttatcgaccgccgccgccgccgcagcgtggctctccaacggtgcggtctccatgccgcctaaggtgcgcctcctcatcggcggggagttcgtcgagtcgcgcgccgacgagcacgtcgacgtcaccaaccgcgcgacacaggatgtggtgtctcggattccgctcactacgggcgatgagttcagagctgccgtcgatgccg

SEQ ID NO: 3282 - DNA, 389 bp, Zea mays
  Clone ID: LIB143-012-Q1-E1-H12
tgagtcgtattagagccactgtgatctctgttgacccagatttaaaactgatcagggttaggttattaaaccctaaccctaaaacatcgatctgtttttactatctcgaatcttctgggtttggccgagaccaaatctctgttagtggccaaaaccctacatttagggttaggtaaaccctaacccgagagataaaaaatattctttctattttaatctatctgttctcgggtgataaacgaagtaaatagttcaatcatgttgatccgagacttttctgtgatctcataaaactgatgcggattaggagatctagggttcttaggacggctttgataccattgttagaatctatactgcctaggatcgattcctaagtccctagaata

SEQ ID NO: 3283 - DNA, 348 bp, Zea mays
  Clone ID: LIB143-012-Q1-E1-H2
gggtcggcccacgcgaccgggaatggaaagaagagggtacaaggaggttggtttccttagagaggtcgacgaagtagtgagaacaggagtgacgcctgcggagaggctgctgaacctgtacgagaccaagtggcaacgcaacgtcgaccatgttttcgagcatttgttatactgattactgaggatgacgccgccgaacgacgttggactgagcttgtagatgtaccccgtaccctaatacagagtctcgtcttgattcattcaatgcctgagccggaagggctcagtttcaggcacacaggagcagagcttttggttggttgttgacgggggcaaccgctgcacagc

SEQ ID NO: 3284 - DNA, 354 bp, Zea mays
  Clone ID: LIB143-012-Q1-E1-H3
gaatacggcgtcggccacgcgaccgcttacgtgtacccttcccatccccgccgttctctctctcttttcccactctcccacacttcctccattgttccctttttctctcgcggagtagcggtgatccagacaccgagtgtcctacgcgtcacggaccgtgcacatggcggcggggtcgatccgggtcaccatggaggtgggcgccgacggcgtcgcgctcataaccatcgccaacccgcccgtcaacgcgctccaccccatcatcatcgccgggctcaaggacaagtacgcggaggccatgcgccgtgacgacgtcaaggccatcgtgctcaccggtgctggaggcaagttctg

SEQ ID NO: 3285 - DNA, 348 bp, Zea mays
  Clone ID: LIB143-012-Q1-E1-H4
gcgtcgacccacgcgacaggccaaagcgcaatgactcctccatgcttacctacgtacctctgcagctacccgccatagcaagctaggccggagcaaaggatcaaacacatcggggaacggaagagacgattaatggccaaagtccatcccaacgccgcggggtccgtcgttgccacagcagcagcactaggccgggccacgacggaggccgatgaagagccgtcgactgtgctgacggtgtggcgcaagtcgctgctcttcacctgcaacagcttcactgtcaacgacgcgagcagcgacctgtccttcagcgtgcactgctacgccggatccactcggagctggcgc

SEQ ID NO: 3286 - DNA, 324 bp, Zea mays
  Clone ID: LIB143-012-Q1-E1-H5
catcgatccgccattgctcaccgcacacgtgcacgctcacctcacacacgcagctgactctctaacgccgtacgcgagaacaaggataggctcgacatggaccgacgagaacaagcacggcctgcagctgctggacttctgggtgagcccattcgggcagcgctgccgcatcgcgctggacgagacaggcctgacctacgagtacctgtaccaggacctgcggaaatcgagcgatctgcgcctccgcgccaacccggtgcacaagaatatccccgtgctgctgtacgacagcagcgtcgtctgcgagtccctcgtcatcgtgca

SEQ ID NO: 3287 - DNA, 342 bp, Zea mays
  Clone ID: LIB143-012-Q1-E1-H6
tcgacacacgcaaccgctcgcagcgcacctcttcgagatctcggcatcgtacgagaatcaacaggacattcagctcatgaggtttgctgattactttggccgggcatttgcagctgtgagcgcatctcaatttccatgggcaaagatgttcaaagaatcaacagtgtccaagatggttgatatcccattgtgccatatatctgaggctgtgatcaagactgtgagtgattggatcagtcaaagatcttctgatgccctgggagactttgttttgtggtgtatagatagcatcatgtctgaattgtcaggtccatcagctggccctaagggttcaaagaaggt

SEQ ID NO: 3288 - DNA, 324 bp, Zea mays
  Clone ID: LIB143-012-Q1-E1-H7
cggacgcgtgggttgcaagttaagtcatcaccaccacagccgccaccaccacaagcagcttccctgcacaatgatcctgccataatacagtcacattattctcaacctgcatcaacgtcatcaagtttgccttcagctgggggtgcagttttaccagacttcagctcccaggcagttcaatatgggcttcagaggccaacctttcagagtaaccttcctctctaccaaccagggaatactccgtggggctcttcagtggcacctccagcaggaaatgctccatggggctcttcagtggcgcctccagcaggaaatgcttcaaca

SEQ ID NO: 3289 - DNA, 410 bp, Zea mays
  Clone ID: LIB143-012-Q1-E1-G11
aaggtttagagaaactccccggctcgaggagatcgtgacattgagaggacgatgggagggcgcgcgctcctcctcctcctcctggtctcggcgttggtctttcagatccacgcctccgacacgctgctgtacgagccgttcgatgaggactttgaggggagatgggtcgtctccaagaaggatgaataccaaggtgtgtggaggcatgccaagagtgatggtcatgaggactatggcctccttgttagtgagaaggcaaggaaatacgccataatcaaggagcttgatgagccagttaccttgaacgatgggacagtggtcctgcagtttgaagtgagacttcagaatggccttgaatgctgaggtgcctacattaagtacatccgccctcaggatgctggatgggatgc

SEQ ID NO: 3290 - DNA, 320 bp, Zea mays
  Clone ID: LIB143-012-Q1-E1-E5
cagcacgcatcactatagtctatagctcagaagatccggtccattttccagctctaaaactaaggcatagcggtaaacaccaccgaagtctcagcttctccgaggaaggggcacaattgctgaagcagccacttcaccttggggccatacagaaatggcggcttcttgcgcctccacactcccttcactttccttcgtttcctcgtctagttcatcgcgccgattcaggcgctctggtgtggtggccatggccagcgttgggcataaggtgtatgcgcccggtgtggcagtgtcggagggcaatggcgggctgccgaaaa

SEQ ID NO: 3291 - DNA, 324 bp, Zea mays
  Clone ID: LIB143-012-Q1-E1-E6
cgggcaacctgtcccccgccgccgtggccgctataaaggcctcgcaccctaacgtcgccgtcatggcggggctcggcggcgccagcgtgctggacatcgtcaatgccgtcttcaccccgacctccgtcgacacgtgggtggccaacgccgtgacgtcgctcacgggcatcattaacaggtacgggctggacggcgtggacgtggactacgagcacttcgccgacggcgccgacgtgaatacgttcgtcgagtgcatcggccgcctcctgacacagctcaagcagacgatgcccaacatcgccacctccatcgcgccgttcgagg

SEQ ID NO: 3292 - DNA, 321 bp, Zea mays
  Clone ID: LIB143-012-Q1-E1-E7
cgggcaacctgtcccccgccgccgtggccgctataaaggcctcgcaccctaacgtcgccgtcatggcggggctcggcggcgccagcgtgctggacatcgtcaatgccgtcttcaccccgacctccgtcgacacgtgggtggccaacgccgtgacgtcgctcacgggcatcattaacaggtacgggctggacggcgtggacgtggacgacgagcacttcgccgacggcgccgacgtgaatacgttcgtcgagtgcatcggccgcctcctgacacagctcaagcagacgatgcccaacatcgccacctccatcgcgccgttcg

SEQ ID NO: 3293 - DNA, 270 bp, Zea mays
  Clone ID: LIB143-012-Q1-E1-E9
ctgccacatcgcatctgacgccattctcagtcggtgttaacgcgtgtgagaatgatagagacttggcttactttaactccggagggcatccttttcaggccgagtgtccgatgtatctattctatctaatctcagcgctcagttgttagatgcatatcgacagtgcctgttcatcgtgtcttcctatcatctatcacggaatgtgtgggtggtcctatgattaaggggaccatgaagaatgaactctaaggcatacaggctcatgacatt

SEQ ID NO: 3294 - DNA, 325 bp, Zea mays
  Clone ID: LIB143-012-Q1-E1-F1
cccacgcgtccgcccacgcgtccgcgacggagacatggacacattgccaggccgccctaaaaccctcccacgatcatgtcgctcgccagactcagccacccggccgtcgccgccgccgggagcggaaaatcgcttttcccggcgggcccgactgtgcaatccgtagatttccccaatgcacggctccctgtcaccgccgtcgtctccgccgctactgcggctgttcacgctgaggatagggtttcgtcgctgacgcatgtctccggcgtgctacgcgtcgcatttggcgacgagggaaagggcatgctcgtcgacgtgctcgccc

SEQ ID NO: 3295 - DNA, 413 bp, Zea mays
  Clone ID: LIB143-012-Q1-E1-F10
aatggcaaccgcagagagtttgttccgtccaggcaaccaaaaagcgttgccccgccgcgcagaggaagaagagagcagaggaggatggctcgtacgaagcagaccgcccgcaagtccacgggaggcaaggccccccgcaagcagctcgccaccaaggcggcgaggaagtcggcgccgacgaccggcggcgtgaagaagccccacaggtacaggcccggaaccgtggcgctgcgcgagatccgcaagtaccagaagagcacggagctgctgatccgcaagctgcccttccagcgcctggtgcgcgagatcgcgcaggacttcaagacagacctccggttccagagccacgccgtgctggcgctccaagaaggccccgaggcctacctcgtcggcctcttcgaagacaccaacct

SEQ ID NO: 3296 - DNA, 378 bp, Zea mays
  Clone ID: LIB143-012-Q1-E1-F11
attcacggtcgaccacgcgtccgattttgtgttccatctcaggttgaggttgcgctcaagctctccaagatgcaagagtacactggccgctctgcccccaccgttatcacataaatttttgaaaagtgatttacaatgagttgacgcgcttacacaaattttcattcaagcctcttgttctaaagttctacttcctgttgcatctcaccaatgaataaaatgtatgtatcaagaccgaaaccgtagcactgcgcaagatccgcaagtaccagaagaacaaagaagctgctgatccgcaagctgcccttccaacacactgatgcgcaagatcgcacaagaattcaagacaaaacacaaggggcgggccccccaaagtgt

SEQ ID NO: 3297 - DNA, 388 bp, Zea mays
  Clone ID: LIB143-012-Q1-E1-F12
gaacgcatgaaccgcaagtcatccatgacctcttctattccgaagctgcttctcctcctcttctttctcagccatcgctctcccattgctcgcgcaggcgatgatggcagctacaaggttctgtccatgggctctccgagaactgactccgtctgttcccagtccaaagcggttccttcgtcgtccgccggtgccgccacggtgcccttgcatcaccgtcacggcccatgctcgccgttgccgaccaagaagatgctgacgttggaggagacgctccaccgcgatcagctccgagctgcctacatccagcggaagttctcaagcggcggtggcgctggtggtgacgtccagcgatcggacgccaccgtgccgacggccctgggcacct

SEQ ID NO: 3298 - DNA, 328 bp, Zea mays
  Clone ID: LIB143-012-Q1-E1-F2
cgcagcaagtgcccagaaggccagaaccagaaccaagcagctcgttgcaacctcatatcatcccctgccacgcacctccgtccgccgcgccatggaatcgaggaggagggccgtgcccaccgtgacggcggttgcggtggcgacgctgctgctgacgatgatgacgtcgtcgggcgtgggcggcgacttcgcggcggaccgggcggagtgctcggagcagttggcggggctggcgacgtgcctgacgtacgtgcaggagcaggcgacggcgacggcgccgacgcccgactgctgcgcgggcctcaaggcggtgctgcagagcagccgc

SEQ ID NO: 3299 - DNA, 324 bp, Zea mays
  Clone ID: LIB143-012-Q1-E1-F3
ccacgcgtccgctcgccggctcggggacgccgccgctggagaccacgggcttcgcgctggcgccggggcagtcgcgcgcgctgtacgcgccgcaggggtggtcgggccgcttctggggccgctccggctgcgacttcgacgccgcctccgccaagggctcctgcgccacgggcgactgcggctccggcgaggtcgagtgccgcggcgcgggggcgtccccgcccgccacgctcgccgagttcacgctcgacggcgccggcggcaaggacttctacgacgtcagcctcgtcgacggctacaacctgcccatgctcgtgcgggcca

SEQ ID NO: 3300 - DNA, 330 bp, Zea mays
  Clone ID: LIB143-012-Q1-E1-F4
caggattgtcttctgcccatgggaattacttctgaaaatgttgcccatcgatatggtgtaaccaggcaagagcaagatcaggccgccgctgagtctcataggagagctgctgcagccacggcctctggaaaattcaaggatgagatcgtcccggtcccaacaaagatcgttgatcctaaaactggagaggagaaggaagttgtgatatcagttgatgatgggattaggccagggaccacagcatctggattggcgaaactgaaaccagtttttaaaaaggatggaactacaactgcaggcaattccagtcaagtgagtgatggtgctgga

SEQ ID NO: 3301 - DNA, 325 bp, Zea mays
  Clone ID: LIB143-012-Q1-E1-F5
acagcccacgcgtccgcgcacgcgtccgctgctacccccaatttttgcatcagatgagagcacttcttgttcacaatggaacacagccatggaaaaacgtacacgatggacaagacaggaagttgtcggtaactttcgtattggagatgtgtttggaaattgttgtcgactcaacggcctacatgcattgacatagttcacagttgtcactcacaatgctatagaccgacatgattctgagaagttccctttctcaattttcgacaagaatggcaagtagtgtgcatgccttatcgactgccaccacactgagcaacacggatgg

SEQ ID NO: 3302 - DNA, 321 bp, Zea mays
  Clone ID: LIB143-012-Q1-E1-F7
ccacagccagcacgccaggctcctcctccagctcctgttcgagatggtggtggctccatgtttggaggaattgggtccaccattgctcaaggtatggcgtttggcacgggtagtgccatggcacacagggctgttgactctgtattaggtccccggaccatccagcatgagactcttgccacagaagctcctgctgctgcccctgctgctccagcgatgaatgctgatgcttgcagcttccattctaaggctttccaagattgtctcaacaactatggcagcgagatcagcaagtgccagttctacctagacatgctgaac

SEQ ID NO: 3303 - DNA, 326 bp, Zea mays
  Clone ID: LIB143-012-Q1-E1-F8
cgagagaggcacacgcagacgaacagaaatcaccgcactggatgggtcaagaagaggcgagattttttcctgcttctcatcgacgtatatatatactatgcaccagagagaaaaaaacagagagtaatatgtgaacaggaaacgcgagaagtggggctgcacgaaccagagtggagcgcgggcctctggaagtggcgaggagcattgaaggcccccggcccgggatgcgcggcgcagaatggcagcgcgacgagaagcagcagcgccaggcggatggggggagccggcaatgccatggctgggggtcggctcaccggcgcggcggc

SEQ ID NO: 3304 - DNA, 397 bp, Zea mays
  unsure at all n locations
  Clone ID: LIB143-012-Q1-E1-F9
agcagcagcacaagcaggagccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgacgcggccaccganggcggcggctgcgactgcaacacctgcaagtgcggcaccagctgcggctgctcctgctgcagctgcaactgagctggcccggcccggcgatggcgcacgagagtcgagaggaggaggacgacgacgaggcgtataaatataatagcggcgtccagtaaataagatcctgt

SEQ ID NO: 3305 - DNA, 327 bp, Zea mays
  Clone ID: LIB143-012-Q1-E1-G1
ctaactttagctactacgtgtgcaagtgcaagcagcccactcgttcgaccatggctgcgagagcggcgctcctccagctggctgtcagcctggttatccttgccgccgtggcgagcgcgagcgcgaccaactgcccaccgccaccgctgccgccggccccaaagccgccgacgcccggcggccaccacggccacgggtcgtgccccaggaacgcgctgaagctgggcgtgtgcgccaacgtgctgggcctggtgaaggccaaggtcggctcgccgccgtacgagccgtgctgctcgctgctggacgggctcgtcgacctggaggccg

SEQ ID NO: 3306 - DNA, 394 bp, Zea mays
  unsure at all n locations
  Clone ID: LIB143-012-Q1-E1-G10
agctccaatctggtataggacggagctgagcttctaccaacgtacagtgtatccgccatgagtcctttcggggcggtgatcacgccagaaaccctcaagtacatgtccaagtaccagggacgtgagatcacgcangtggactgcgcacgggaggcgatgaggctgatccacgcggaagacaagaacctcaaggccgaggactcagcgtgggagctgaagaagaagttcggcaacggcgtgagcaccatggtcctcgtctacaacgccaccggggccagcctgagcctggtggacgacgggaaagactggatgggctccgtctacagctcgccgatcccggacaccttccacaacgggcagtggatcgccttcctccacgtcaagcccggctcgc

SEQ ID NO: 3307 - DNA, 325 bp, Zea mays
  Clone ID: LIB143-012-Q1-E1-E3
ctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctggccccgccgaaggccgaggccgaggccgaggctgctgctcctgctgatcccgaggagcttcccgcggccgagcagcaggcagccgccgaggcggaggccgc

SEQ ID NO: 3308 - DNA, 416 bp, Zea mays
  unsure at all n locations
  Clone ID: LIB143-030-Q1-E1-D6
agccttcgatagcgtgttccgctccatcgtgccgtcgtcgtcgtcggcggcggcggcctccgagaccgccgccttcgccagcgcccgcatcgactggaaggagacgcccgaggcgcacgtgttcaaggccgacctccccggcgtgaagaaggaggaggtgaaggtggaggtggaggacggcaacgtgctgctcatcagcgggcagcgcagcagggagaatgaggacaagggcgacaagtggcaccgcgtggagcgcagcagcggccagttcgtgcggcgcttccgcctccccgagaacgccaagaccgatgaggtgagggccgcgctggagaacggcgtgctcacggtcaccgtgcccaaggccgacgtcangaagcctgaggttaagagcatccagatctccggctgaagaagac

SEQ ID NO: 3309 - DNA, 185 bp, Zea mays
  Clone ID: LIB143-030-Q1-E1-D7
atcaaattctgatagtactattctgaacttcccatttgtggttaaaaaaaaaaaaaaaaaaaaaaaaaaaaaaaaaaaaaaaaaaaaaaaaaaaaaaaaaaaaaaaaaaaaaaaaaggctgcccccccaaagggttcaagcttacattacccttcatgctaagtccaatcccctccaaaatgttc

SEQ ID NO: 3310 - DNA, 418 bp, Zea mays
  Clone ID: LIB143-030-Q1-E1-D8
agcaattagctagcttcttctagctctagctaggctcgtctgctgcaagaaggtaacagtaacagcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcggcatccagggcatcgcctggtccttcggcggcatgatcttcgccctcgtctactgcaccgccggcatctccggcgggcacatcaac

SEQ ID NO: 3311 - DNA, 260 bp, Zea mays
  Clone ID: LIB143-030-Q1-E1-E10
cgcgtcagaaccattcctcccaacaccacctcgccgcgatctccgtagcctccgtcgcgtcgagcatcgatcatgtcggcctactgcggaaagtacaaggatcagctcatcaagaatgctgccgacattggcagccctggcaagggtatcgttgctgctgatgactctactggcttcattggcaggcgcctttccaccgtcgacgtcgataatctacaggacacggtccgctgcccacggtcagtaccaatcaggtagtc

SEQ ID NO: 3312 - DNA, 311 bp, Zea mays
  Clone ID: LIB143-030-Q1-E1-E11
cgcgtcagggcaaggatcaaaagtcgcagactaccgcaattactgccctgtaaaaccacagtattccatcatcatacataagtcatccatacctagatcagtaatgctcaaggtctaatgaccaatttacatgcaatcaatgcaaccctgaaaactgttgatgggccctcaactaacgactgcaggggtcaaagggctactaatttcaacatcattcccaacatcactggagctgctaaggctagttgaaaagtgcttcctgtcctcaattggaaagttgacgtggaatgtctttccgtgtcccaacctgt

SEQ ID NO: 3313 - DNA, 377 bp, Zea mays
  Clone ID: LIB143-030-Q1-E1-E2
gacgcacgaatcagcaattagctagcttcttctagctctagctaggctcgtctgctgcaagaaggtaacagtaacagcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcgtcctctacatctccatcctcaacgtcatgggcgtctccaagtccacctccaagtgcgccaccggtcggcatccatggcaatcacctggtccttcggcgg

SEQ ID NO: 3314 - DNA, 246 bp, Zea mays
  Clone ID: LIB143-030-Q1-E1-E3
cacgcgtcaggagacttcatccattcgcggtgtgcctctctgcttgactgtctcaaatttccactaagactgccatggcggaccagcgcagcaagcaggatcttccccagttgaagggtgtattcagtctctacgtttttgatagacaacgcagcatcgtcatgagtgcagttgtcatcgtcaggcactgattcgagtgaagatttcgaggagctcagcctcaggacctcatcccgcacgttgatg

SEQ ID NO: 3315 - DNA, 416 bp, Zea mays
  Clone ID: LIB143-030-Q1-E1-E7
ctcgccggccgacccacgcgatcaacctcgattcatacaacaggcagcagccatgtccaaggtcttcaccctcgacgcggtcgccaagcacaactccaaggaggattgctggctcatcatcggcggcaaggtgtatgatgtgacgaagtttttggtagaccacccaggaggtgatgatgttctgttgtcctcaactggcaaggatgcgactgatgatttcgaggatgtcggtcacagcaacactgcccgcgcgatgatggatgagtacttggtgggtgaaatcgacgcgtcgacgatcccttccaggacgaagtatgtccccccgaaacaaccgcactacaaccaggacaagactcccgagtttgtcatcaagatcctccagtttttggttcccctggcaatcctgggcttggctg

SEQ ID NO: 3316 - DNA, 387 bp, Zea mays
  Clone ID: LIB143-030-Q1-E1-E9
tcccgggccgacaaacgcgtcagcccacacgtccgcaaagctccaactccgacgataatcgccactcctcgaaatctcgaacgactttctgcggcgaacatcttcgtcacgttacgtaatggtacaggtctcaccatcaatgtccatggaagtaatgcatattcataaggatgttgatgggcgttcatctaaacgactgtgacgggatggaatgggctcggacgtttcaacatcattcccaacaccactgaacctgctaacgctgttggcgatatgcttcctgtcctcaatggaaagttcactgaaaagtctttccgtgtcacaactgtcgatgtttctgttgttgatctgactgttacgcttgagaaatctgccacctaatatgag

SEQ ID NO: 3317 - DNA, 344 bp, Zea mays
  Clone ID: LIB143-030-Q1-E1-F1
ctcgattcatactgcacgcagcagccatgtccaaggtcttcaccctcgacgcggtcgccaagcacaactccaatgaggattgctggctcatcatcggcggcaaggtgtatgatgtgacgaagtttttggtagaccacccagcacgtgatgatgttctgttgtcctcaactggcaaagatccgactgatgagttctaagatgtcggtcacagcaacactgcgcgcgcgatgaaggatcaatacctggtgcgtgaaatcgagccctcgacgatcccttcccagacgaagtacgtccccccgaaacagccgcactacagccaggacgagactccccgagtttgtcat

SEQ ID NO: 3318 - DNA, 319 bp, Zea mays
  Clone ID: LIB143-030-Q1-E1-F11
tatcacagaaaagctaaacccgacctccgctcgccggcgcccggcaggatggcttcgtcggcggcgtaccctgatgcggacgacaacctggaggccatcatcacccgcatagatcagaagtcccgaaagatcgagacccttctcaagcagtcgaagccggtggaggccctaaagacggcgctcgaggggtcaccgctcaagacccgcgacgagcgatgcaggtcggcgaactggatcgtggtgcaccgcgcgttgatggcgattatggacgtagacggcatgttcaactccctggatcccgagtactacgacatcctca

SEQ ID NO: 3319 - DNA, 198 bp, Zea mays
  Clone ID: LIB143-030-Q1-E1-F6
atcagcagcgatccgaagctcagtcaattcactcaaacctcttccccaaatcttcgattagattctcgttgacaagaagattagaaccgaacctgaccatgtcgctgatgtgccgcagctgcgtgtccgatcccttctgcctcgacctgtgggatccctttgagggcttctgcgtcggctccggcgcgcggtcctctc

SEQ ID NO: 3320 - DNA, 425 bp, Zea mays
  Clone ID: LIB143-030-Q1-E1-F8
gacccacgcatcagcccacgcgtccggttattttctgcaatactaagagaaaggtggattggctcactgaaaaaatgcgtacaaataacttcaccgtatcagctatgcatggtgacatgccccaacaagaaagggatgccattatgggtgagttcaggtctggcgcaactcgtgtgctaataactacagatgtttgggctcgaggactggacgttcagcaggtttcacttgtcataaattatgatctcccaaataatcgtgagctttacatccatcgcattggtcgttctggtcgttttgggcgcaagggtgtggcgatcaatttcgtgcgcaaggatgacatccgtatactgagagatatagagcagtactacagcacacaaattgacgagatgccaatgaatgttgctgatcttatttgagca

SEQ ID NO: 3321 - DNA, 267 bp, Zea mays
  Clone ID: LIB143-030-Q1-E1-F9
ctctatagtgaaacatattaatcgtccgtgtagtgcttgcgctacacaagatacaaggctgaccaacaccaatggcagccgcctactcatctccagttttccagatgctcctgctcgcagccttagctggtattatcacgaacacagcgaccttcatcatcacgaacatctgctggttcaccgtgtggcacctggacacactcggtggtcagcggcacccagctcatgccggtcgggaccttgacggtcaacgtgccggctggcaac

SEQ ID NO: 3322 - DNA, 427 bp, Zea mays
  unsure at all n locations
  Clone ID: LIB143-030-Q1-E1-G2
gtggtccgctacaagcctcaagagtgagtcggactacgccctccgcccaaaacccaatccagggccaggccaggccaggccaaccaaaccctaggcactgcgccacgcctagcgcgcgtggtatccatgggctgaccgcgtcccggtggggagcccggatccggagctagggttccgtcctaggcggcaccaccatggagtgggacagcgagtccgacggcgccggcagcgtcnacgccggctatgaggagcaggaggaggaggaggaggagcggggaggcgagggtggaggtggcgacgccgggggcggcggtgggatgttcacgttcgcgattgaaggcatgctgcgctcctccgggccctgcgggctagtcgtcaccgacgcgctcgagcccgattgccccatcatctacgtcaaccgcggctt

SEQ ID NO: 3323 - DNA, 422 bp, Zea mays
  Clone ID: LIB143-030-Q1-E1-G4
cacgcgtcaggaagtgtccggagcattttccgaggccttggccgagcttgcgcaaggcaacccttccatgagaactgacgttcctttctacaacgttgtgcccgtagccggagctggccgctctgcgtgtacgaacgacataatgacgtgcgagttactggcatccaacgtctccagtgcaaagtccaaaccagccgaaccgttcgctgtgacgcctgcttgaatgcagctttccttcggaaattggaggtgggcgcacgttggaatttttgccacaggagccggcggccagtcaacgccagttggacgacgactgttgaccagcttctctagggctggccgcggtagcttcgtttctgtgctggcggtcgattaacaaaaagacgtacggtgatcatcacagatgcacccatactgtatta

SEQ ID NO: 3324 - DNA, 374 bp, Zea mays
  Clone ID: LIB143-030-Q1-E1-D5
acgcgtcaacagccgtcgaggccgcgtctcagtgcgaggagaccacgactcatatggccagccgctgggtccggcccgaagtgtacccgctgttcgcggcaactgccggtggcgtcggcatctgctgatttcagctcttccggaacatcaccggtaacccggaactcagggtatacatggcagggagggcagctggtgtccttgagaaccatgatgatgggacgcgttaccccatgcatggcctaataagctttgtgcacgatcagactcctgagatcatgcctgcagttaacaggttcttcactgatcctaagtcgagcatgttgattggcatactactactactacttgctactggtggattttacactttg

SEQ ID NO: 3325 - DNA, 363 bp, Zea mays
  Clone ID: LIB143-030-Q1-E1-B7
atcagcggacgcgtgggaaacctttcaatcggcggcaatggcggcgccggcggccgacgatgcctcggcatccccaggctacgtcctccgctccacacttgaggggcaccgccgcgccgtatcaaccgttaagttctccccggatggccgccttctcgcctccgcctccgccgacaagcttcttcgcgtgtggtcttcctccgatctcacccccgttgcggagctcgagggccatggagagggtgtctcagacctctctttctcccccgacggccgcctccttgcctccgcctccgatgatcgcaccgtccgcatctgggacctcgccgtcggccgaggggcccgccccgtcaagacgctcac

SEQ ID NO: 3326 - DNA, 416 bp, Zea mays
  unsure at all n locations
  Clone ID: LIB143-030-Q1-E1-B8
aaacattttcaaactttgtggacctaagtgacatcccttgacaagttcaagggccacttatgcatttaactcagaaaacattgccatacaataaaatactgtaacacaatcttcagagtagaacatgtatacatgtgcatcgatgctattcagcgctgctggtattatctcatattaagctctggaaggaaattctgttacagcacaagtctaggacattcctcgaatgcttaaaacaaaatttctcatatatacttgctatgcctatacagtacgttttttagtcacagatctttgctattattgacttcaggcgcgccagcaatgacctcgaggggtctactggagaaggatttcgagcagattggggagttcctcnnacangcagtgaccatctgcctgaacatccagaagga

SEQ ID NO: 3327 - DNA, 346 bp, Zea mays
  Clone ID: LIB143-030-Q1-E1-B9
gacacacgcgtcaacatctgcgcacacggtctccctcttcctgtcagtagtagagtgagagtgaggcagcgagtgggagacaaggggaaatggggaagggagcgcaagggagcgatgcggcggcggcgggcggcgaggtggaggagaacatggcggcgtggctggttgccaagaacaccctcaagatcatgcccttcaagctcccgcccgtcggcccttatgatgtccgcgtgcgcatgaaggcagtggggatttgcggcagcgatgtgcactacctcagggagatgcgcatcgcgcacttcgtcgtgaaggagccgatggtgatcgggcacgagtgcgcgggcgt

SEQ ID NO: 3328 - DNA, 378 bp, Zea mays
  Clone ID: LIB143-030-Q1-E1-C1
agcattgttggacgcgttcccctcctgcacgcaacctcatctcgtcctccagatccaggatggccgtcctccttgagaccttgcctccccgagtgctctcggtgagctactttgtttcgatttatcaggaaatccgtttgcttcatgttgtgcaggctcatatctgattgctggattcggcaaacccgcgttggatcctgtatcgatctggagaaatcgcgaagtcgtcgtcgttcggttcggagcggatctgaggcgacgatagatggaggcggcgggatctctcggtctgcagtcctgctccacctcgatggatgatgtctctgcgctgataattattggatcaatttcgataattattagtagatctatgagata

SEQ ID NO: 3329 - DNA, 419 bp, Zea mays
  unsure at all n locations
  Clone ID: LIB143-030-Q1-E1-C2
aacagccacctcataagactgttgatggaccctcagccaaggactggagaggtggcagggctgccagctttaacatcattcccagcagcaccggtgctgccaaggctgtcggtaaggttcttcctgaattgaatggcaagctcactggcatgtccttccgggttcccaccgtggatgtgtcagttgttgacctcactgtcagaatcgagaagggggcctcttacgaggaaatcaagaaagctattaaggctgcttctganggcccactcaagggtattatgggctacgtggaggaggatctggtttccaccgacttcaccggtgacagcaggtcgagcatcttcgacgccaaggccgggattgccctgaacgaccacttcatcaagctcgtctcttggtacgacaacgagtggggctac

SEQ ID NO: 3330 - DNA, 354 bp, Zea mays
  Clone ID: LIB143-030-Q1-E1-C3
agcccttgcacaccattgggactcgttacccatctcgtggactcttctgtttcttctccttttctccccccgtttattggaccagcggcggcttgctcctcttcgtgtaacgggatttggttttctgcggatgagtgtttattgttcgatgcggagcttcgatctggattcgtgcttgtcctcttggtctctgctcgctttgtaatgcttgggtacggtgcgctgaaggtgtttggggggtatgattgttgttgcacctgaataactgaggtgggtgtggcgcgaacttgggggtgtcttctctttggcgatcagtgcaatcgaatggtcagttgagttagatagtttttacat

SEQ ID NO: 3331 - DNA, 433 bp, Zea mays
  unsure at all n locations
  Clone ID: LIB143-030-Q1-E1-C5
ctcgtgggtcgatacaagcctcaaaaattcgtcagtacaaacaaacagggtagagggagaggagaggagaggagaggagaggttgggtctgggacaccatggctccgatgaagctgtacggggcggtgatgtcgtggaacgtgacgaggtgcgcaacggcgctggaggaggctggctccgactacgagatcgtgcccatcaacttcgccaccgccgagcacaagagccccgagcacctcgtccgcaacccgtttggtcaggttccagctctgcaggatggtgacttgtacctcttcgaatcacgagcaatctgcaagtacgctgctcgcaaaaacaagccagagctgttgagggaaggaaacctcganngaggagcaattgttgaatgtttggattcaggtggaggctaaccagtacaccgctgcactgaatc

SEQ ID NO: 3332 - DNA, 439 bp, Zea mays
  Clone ID: LIB143-030-Q1-E1-C6
tcgtgggccgatacacgcgtcaacggtcacttggggcaattgctctcagaaggcactagcacgcaaaaaccccacgagagagacgaatcttccgaatctctcggtggcgatggcgctctccgaccgctcccgcgagtcgctcctcccgagcttcctctacgcctcctcggcgcgctctttcgctgccacaggagccgccgcgcgcctccctgtctcctccccagcgcctgccacggctggagcaggaggcggcgtgccgttctcgatccaggcgcccaaggagaagatcgagatgtactcgccggccttctatgccgcctgcactgccggaggaatcgccagctgcgggctcacccacatggccgtcacgcctctcgacctcgtcaagtgcaatatgcagattgacccagcgaaatacaagagtatctcatctggattt

SEQ ID NO: 3333 - DNA, 416 bp, Zea mays
  Clone ID: LIB143-030-Q1-E1-C8
aaggctgccacagctggaggtgtttctcagataagagcattatcaggatgcacagctggtggggaggatatactccagaacataatgcgccatgttcttcccaattttgatggtatatatgctggccagacaatggatagaatcaagtcgatgagcttactgcgaattgctactcaagatgcaattcacaggctcgttagtcaagaatccgtggagatcaatatagatttggggaatggccacatggtgtccaaagttctagaccattcagagtttgaacaagtcaaccgggcaattttcgacaagtgcgaaaagatcatcaaccagtgcttggctgatgcgaagtttggtacagaggacatcaatgatgtcatactggtcggaggttgttcgaagatccccagaatcagaagcct

SEQ ID NO: 3334 - DNA, 181 bp, Zea mays
  Clone ID: LIB143-030-Q1-E1-C9
agcccacgcgtccgcgggaccccttggccccattgttaataaattgcattaccaacaccaattgtgcacataaaatttggcgcattatatgcaatttgccaaggacattacaaccaaaattgaaaaaaaccttggtgtgacggtaacagataatgggaacccagaggtaaaaccaccacct

SEQ ID NO: 3335 - DNA, 380 bp, Zea mays
  unsure at all n locations
  Clone ID: LIB143-030-Q1-E1-D1
aaccgccgtcgaggccgcgtcccagtgcgaagagaccacgactcagatggccagccgctgggtccggcccgaggtgtacccgctgttcgcggcaacgggcgtggccgtcggcatctgcggatttcagctcttccggaacatcaccggcaacccggaagtcagggtaaacaaggcaaggagggcagctggtgtgcttgagaaccatgangaggggaagcgttacgccatgcatggcctaagaagctttgtgcacgacaagactcctgagatcatgcctgcagttaacaagttcttcactgaccctaagtgaagcatgttgattggcatactactactactacttgctactggggattttacactttgctggcaactcaata

SEQ ID NO: 3336 - DNA, 416 bp, Zea mays
  Clone ID: LIB143-030-Q1-E1-D12
actcgcgggccgacacacgcgtcaacggtcactcgggtcagccgccgctccgcctcagcgcgtcgcccgccgccacatcctacagcgacctcatcgatcaccttcaactttcaatcatggcggacgtcgatgtcgaaccggaggttgccgccggcgctcccaagaagaggacgttccgcaagtacagctaccgcggcgtcgacctagatgcgcttctcgacatgtccacggacgacctcgtccagctcttccccgcgcgcgccaggagaaggttccagaggggtctgaagaggaagcccatggcactcatcaagaagctgcgcaaggcgaaaaaggatgctcctgctggtgagaagccagagccagtcaagacacatcccccgtaacatgaatcattgcccccctgagatgattgg

SEQ ID NO: 3337 - DNA, 419 bp, Zea mays
  unsure at all n locations
  Clone ID: LIB143-030-Q1-E1-D2
agcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgangatgatgatgaccttgatctttttggtgatgaaactgangaggacaagaaggcagctgatgagcgtgctgccgcttgcaaggcctcttctaaaaag

SEQ ID NO: 3338 - DNA, 79 bp, Zea mays
  Clone ID: LIB143-030-Q1-E1-D3
aaaatggatcctgcacatttttttcgttagggtgtatcagtagttctgtacaatatgtttttaatgagaccattcggcc

SEQ ID NO: 3339 - DNA, 429 bp, Zea mays
  unsure at all n locations
  Clone ID: LIB143-030-Q1-E1-D4
tcgcgggcgcctacacgcgtcaagaatccttgcaatgagtgcaaggggactggagagagcatcaatgagaaggaccgctgtccagggtgcaagggtgagaaggtcattcaagagaagaaggttcttgaggttcatgttgagaaggggatgcaacacaaccagaagatcaccttccctggtgaagctgatgaagcgcctgatactgtcactggagacattgtattcgtcctccagcagaaggatcactccaaattcaaaagaaagggtgaagatctcttctatgagcacaccttgtctctgaccgaagcactatgtgggttccaatttgttcttacacatctggacaacaggcagcttctcatcaaatcagaccctggtgaagttgttaaacctgaccaattcaaggcgattaatgatgangggatgcca

SEQ ID NO: 3340 - DNA, 438 bp, Zea mays
  unsure at all n locations
  Clone ID: LIB143-030-Q1-E1-B4
tcgcgggccgatacacgcgtctacaagcatcatactcttcttcttcttcctcctcctcctagcacagctagcgcctgctccccttcgcctgtgatcatgtcttgcagcagcggcaagtgcgactgtggctccagctgctcctgcggcagctcatgcaactgcatgtcncctaacgtggagaccgccgccgccagcagcatcaagaccacggtcctcgccgcgccgaccaccaatgccagcgccggcggcttcgaggcggccaccgacggcggcggctgcgactgcaacacctgcaactgcggcaacagctgcggctgctcctgctgcaactgcaactgagccggtcaagggatggcgcacgagagtccagaggacgacgacgagtcctataaatataatagcggcgtctaaataggatcctgtcaactgcacccgcca

SEQ ID NO: 3341 - DNA, 256 bp, Zea mays
  Clone ID: LIB143-029-Q1-E1-H8
cccacaccgggcacaccccccgagctcagcttagctccactccagctccaatcacagtcgtgaccagagcgcgagagctagctagagggccgtgaaaatgccgatcactaggatcgccctggggagccaccaggaggtgtagcacccgggcgccctcaaggcggcgttcgctgagttcatctccaccctcatcttcgtcttcgccggccagggctccggcatggccttcagcaagctgaccggcggcggcccgacg

SEQ ID NO: 3342 - DNA, 102 bp, Zea mays
  Clone ID: LIB143-030-Q1-E1-A10
actcgtgggccaatacaagacccaagactgagtcgtactatctgcttttcattattctcagctaattcttagaaatgaagtattggtttgttattgtgagtc

SEQ ID NO: 3343 - DNA, 334 bp, Zea mays
  Clone ID: LIB143-030-Q1-E1-A11
agccgaagggaagaggcttcctctcgaggaggtggatgaaaacgcctgcatcgaccactgaacagaacaagcaggcgaaattttgtgtggatggcgtctgccacaaaaggattgaaacgcggagtgtgctctggttgtgaagtgataactaggctaccgcatgttcattttcaaaagttttcgtgtgtgatcgtgatcaggggtgaaaccatggtttcagccaacaaacttgcagttcctgttgcttctcccccttttttcctttatatatatattttgtatcggttacagaacatggtttatccagtgaagatgctaagtttcgcttaataat

SEQ ID NO: 3344 - DNA, 433 bp, Zea mays
  Clone ID: LIB143-030-Q1-E1-A2
tcgtgggccgatacaagcctctatagtaagtcgcatgaaaggctgttgctacttaaaagaagtgtacggatattcaagcttggaggactcgcgggactagaatgaggcatggaggtgctagaagaattgccttgttttgcaactttggtgccacaatcaggaagctcccctgcaagtagattgtctgatagatcaagaactcgcagctgcttccactgacaaatctgattaggaataagcccagtaattcggttggagtagagaaccaccagctgtagtagtggggcttcaaaattcagtgacagtggtccattcaaagagttccttgagatgtcaaacgtcacaatgcttcttggcagccgtggtaccgagccagtgagctggtttgaactgagctgaaagattcccactgacatgaactcaaaatcacggg

SEQ ID NO: 3345 - DNA, 326 bp, Zea mays
  Clone ID: LIB143-030-Q1-E1-A3
agtggacaactctgtctgactcctgtgatcacacagatgagtcgcgcatattatgcagagactgcggggcaatatcagctgtgcaggtccagttgattgcgcacaagtgccacaaatgcaagtcacacatgacccgccagatttgaagtaagagtcgcatgtcacacaacaccgtcagatctggactagcaaatcctgtgggggtttctgcaggttcttcacgagacatgatggaatgatcgcaccgtcccgtgacctgctgagcaccgggatgtctggcaagacacgcagcactgtatccactccactgggtcctgcagaggcaa

SEQ ID NO: 3346 - DNA, 362 bp, Zea mays
  Clone ID: LIB143-030-Q1-E1-A5
acgcgtggtccgacgcacgcgtcaagacaactctgtctgactcctgtgatcaagcgatagaccccggagccgacagaccatgcagccatggcgctgcgtgccctgtacaacgagatccggagcatgaaggtccgctgacgtgccggcttacctgaagccgcgcttgacctgggacaacgtcaagaagagcgccgaccatgccgtcgaccgctacatcgagaagtacatcgacacgagctcgccggatcctctctagcacgtctgcatcggatggatgatcatctcctacttcgtcaatctgccctgcgagcgcgctcacctcgcccatctctaggacatggacaggacccgtgggaagcact

SEQ ID NO: 3347 - DNA, 437 bp, Zea mays
  unsure at all n locations
  Clone ID: LIB143-030-Q1-E1-A6
actcgcgggccgacacacgcgtcaacgcatttcggccgtaccccaatctcctcccagcgatttgccttgccgaggtcgccttgccgctgttcccgagcccgacgccttgccgcccctgccctgctaggctgctacagaggaggagaacccccagattttcccacccccatggcaacgcgcgcgccgccgcagtcttcttcgaccggatccgtgacggtgacgatcgacccgtccccctcgtcgtcgtcctcctccgccccgcccgcgtcggcgccggccccggccccggctcctgagtcggtggtgctgcgcctgaagcgccgggctaagaagaaggtgtcgtggaaggangggacggtggacaacgaagggctcggccgcaggagctcaaagaatgctgcatattccacaaggaggtccccttcgacgaggactgc

SEQ ID NO: 3348 - DNA, 424 bp, Zea mays
  Clone ID: LIB143-030-Q1-E1-A7
accggtctagtaggcactcgcgggccgacccacgcgtcaggagacattcagggttcattatccctctgtcaagggtgcaaaagttgtgactgataaattgacaatgcgcacaaagggttatggatttgtgaaatttggtgatcctacagagcaagctcgtgcaatgactgaaatgaatggaatgccttgttcttccaggcctatgcgtattggtcctgcagcaagtatgaaaaatacaggaggtgttgttcaagagagagtaccaaattctcaaggagctcagtctgagaatgatcctaacaataccactatatttgttggtgggcttgaccccaatgtcactgaagataccctaaaacaagttttttctccttacggtgaagtcgtccatgttaagatccctgttgggaagacatgtggtttt

SEQ ID NO: 3349 - DNA, 412 bp, Zea mays
  Clone ID: LIB143-030-Q1-E1-A8
catcacccgacttgtttacccccgaaaatttgccgtcttctcatctcgctcccctctttgcgccgcccccagatccggcaccgcccgctgctcgaacccgcaccccacgcccgcaggccgggaccggtgggcgcgcgccgggcagtaggagggagaggaagggcggcatggcggcgccgccggcgagggcccgggccgactacgactaccttatcaagcttcttctcattggggatagcggtgttggcaagagttgcctcctgttgcggttctctgatggttccttcactacaagctttattaccacaattggtattgactttaagatacggacaatagaattggatggcaagcgtataaagctacagatttgggatacagcgggccaagaacgcttccgtactattaccac

SEQ ID NO: 3350 - DNA, 315 bp, Zea mays
  Clone ID: LIB143-030-Q1-E1-A9
catcacgccgccactgatctgctctgttgctggtgactaggagcagtagcgagagggattctggatggccaagtcgaagaaccacacggcgcataaccaatcgttcaaggcgcacaagaacggcatcaagaagcccaagcgccaccgccagacctccaccaaggggatggacccgaagtttctgaggaacttgaggtactcaaggaagggcaacaagaagagtggcgaggctgagtccgaggagtaagatgatggtgattgagtttgtggcgacaaatgcatctcttgtatcgctaagagtcttagctgtgaact

SEQ ID NO: 3351 - DNA, 427 bp, Zea mays
  unsure at all n locations
  Clone ID: LIB143-030-Q1-E1-B1
acaagcctcaacactgagtcgcaatacgaagcttcaagctagtctcggcggctctagaagacgatgggcaaggacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgacgcggcgtgcggcggcgtgggcgtgctgggcatcgcctgngccttcngcggcatgatcttccgcctcgtctactgcaccgccgggcatctccggggggccacattcaaccccgccgtcaccttcggcctcttcc

SEQ ID NO: 3352 - DNA, 352 bp, Zea mays
  Clone ID: LIB143-030-Q1-E1-B10
cgggccgacccacgcgtcaactacctctcccatctcaggctcccaccccccactgccttctagaaccttccgccgtccgcgatgccgacaccgcctctgcggaagaagcgcctggtccgcgcaggcctcctcgccgccgcggccggttacttcgccttcgtcctcctcttcgagctacccctgctaccctttctggcgtcgtcccccgccgccaccacctcctcctcgctccccttccagcacccgcgccggcgggagctggaggccgcggcggcggcgttcacgtccccgttctcgcccgcccgcccctccaagcgggccttctccgccgccgccgccgcagcgggcccgg

SEQ ID NO: 3353 - DNA, 267 bp, Zea mays
  Clone ID: LIB143-029-Q1-E1-H7
acacgcatcaggctacggcggagattagccgcgtccagaactggcagtggctgcgccacggagcggcgctggatgccggaggtgtggaagtgcacgcgacgccagagctactcgcacgcgtcatctaagaggacatggcgagggtcgaggtagatgtcggtcccgacaggttcagaaaggggcggtacgcttgaggcaggcaagatcttcagccggcattgcaacgctccggaattggacgacttcctcacactggacgagtacaac

SEQ ID NO: 3354 - DNA, 354 bp, Zea mays
  Clone ID: LIB143-012-Q1-E1-C3
ggaatacggcgtcggcccacgcgaccgtgaatttgctgatgactctgagaggccaccacggagaaactatgagcgccacagcgggactggccatggctatgagatgaagcgtgatggcgcagggcgtgggaactggggcactgccactgatgaacttattgcccaggatgcagaggactccccgaagatggaggaggctgctcctgttgctgagaaacaaggtgagcagaatgatgccccagcagcagatgagaacaaagataacaaggatgctactgcaaatgaggaggaagaaaaggaagaggacaaggagatgactctggaggaatttgagaaaataagagaggagaagag

SEQ ID NO: 3355 - DNA, 327 bp, Zea mays
  Clone ID: LIB143-012-Q1-E1-C4
gacagaattgcagaatgctgtcgaggatttggagctgatgttataatgacatcagcatcttgcaaaaacggatctgaacgctgctgtgaggcactaaagaagcttgataagcactatgatattgttgtcaatattcaaggagatgagcctctcattgaaccagagataatagatggtgtagttatgtcactgcagcgagctcctgatgcagtcttcagcacagctgttacttcactgaaaccagaagatgcattcgatacaaacagggtgaagtgtgttgtggataatctgggctacgcaatatacttttcaagagggctgattcca

SEQ ID NO: 3356 - DNA, 321 bp, Zea mays
  Clone ID: LIB143-012-Q1-E1-C5
ggatttcgcacactacaaatctggagtgtacaagcacatcaccggtggcattatgggtggccatgccgtcaagttgattggatggggaaccagtgatgctggagaggattactggcttctggcaaatcagtggaatagaggctggggcgatgatggatacttcaagatcataaggggcaaaaatgaatgtggcatcgaggagggcgttgttgctggaatgccatcgacaaagaatatggttccaaacttcggcggtgccgttggaagagctatagtttaattggttacgtttgcatggcctcaaatgctgttggaattaag

SEQ ID NO: 3357 - DNA, 324 bp, Zea mays
  Clone ID: LIB143-012-Q1-E1-C6
ctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgc

SEQ ID NO: 3358 - DNA, 324 bp, Zea mays
  Clone ID: LIB143-012-Q1-E1-C8
cgaatgctcctgacatggaaatattttccatgtacggagtaggcattcctactgaaagggcatatgtctataagttggccccacaggcagaatgttatatacctttccgaattgacacctcggctgaaggcggggaggaaaatagctgcttgaaagggggtgtttacttagccgatggtgatgaaactgttccagttcttagtgcgggctacatgtgtgcaaaaggatggcgtggcaaaactcgtttcaaccctgccggcagcaagacttacgtgagagaatacagccattcaccaccctctactctcctggaaggcaggggca

SEQ ID NO: 3359 - DNA, 386 bp, Zea mays
  Clone ID: LIB143-012-Q1-E1-D10
gcgtccaaactggatcaactggctcaagtccgacctcggcttcgacggctggcgcctcgacttcgccaagggctactccgccgccgtcgccaaggtgtacgtcgacagcaccgcccccaccttcgtcgtcgccgagatatggagctccctccactacgacggcaacggcgagccgtccagcaaccaggacgccgacaggcaggagctggtcaactgggcgcaggcggtgggcggccccgccgcggcgttcgacttcaccaccaagggcgtgctgcaggcggccgtccagggcgagctgtggcgcatgaaggacggcaacggcaaggcgcccgggatgatcggctggctgccggagaaggccgtcacgttcgtcgacaaccacgaca

SEQ ID NO: 3360 - DNA, 343 bp, Zea mays
  Clone ID: LIB143-012-Q1-E1-D11
cagcacaggtgcatcggcgccaccaccctggaaggattaccgcaagtacttggaaaaggacgcaccgttcgagcggcggttccagcaggtgttcgtcgcggagccgagcgtgcccgataccgtcagcattctgaggggactcaaggagaagtacgaggggcaccatggcgtgaggatccaggaccgcgccctcgtggtcgcggcacagctctccgcgaggtacatcatgggtcggcacctgcctgacaaagccatagacctggtggacgaggcctgcgccaatgtgagggtgcagctcgacagccagccggaggagattgataacctggagaagaagagaatc

SEQ ID NO: 3361 - DNA, 326 bp, Zea mays
  Clone ID: LIB143-012-Q1-E1-D3
ccgagtacggagaggcaagccagtaccagatccaagaagtcattggtaaaggcagctacggggtagttgctgcagctgtagatacccgcaccggtgagcgggttgctatcaagaagatcaacgatgtgtttgagcatgtctcggacgccacacgcatactgcgggagatcaagctccttcggttgcttcgtcacccagacatagttgagattaagcacatcatgctccctccatctcggagggagttccaagatatttatgttgtttttgagctcatggagtctgatctccatcaagtgatcaaggccaatgatgacctcaccccg

SEQ ID NO: 3362 - DNA, 321 bp, Zea mays
  Clone ID: LIB143-012-Q1-E1-D5
cccttctccaacctccgtttctaatccgcgctgctaatcccactcccagtcccagctcgtccgctgagatggacagtagcagcctcaaatccgcgcagctcctggagctgatgcgccagcacctggccaccgatgccggcaaggaggtcaccaagaaggtcggcctcgtctaccagctcaacatcgcccccaagaagatcggcgttgatgaggagatcttcgtggtcgacctcaagaagggcgaggtcaccaaagggccgtaccagggaaagccggatgccactttctccttcacggacaacgatttccttggaatcgcca

SEQ ID NO: 3363 - DNA, 323 bp, Zea mays
  Clone ID: LIB143-012-Q1-E1-D6
cgagaagtacgagtaccaggctgaggttacccgcttgatggacttaattgtacacagtttatacagccacaaggaagtatttttacgtgagcttgtaagtaacgcgagtgatgcactggataagctgagattcctcagcgtaactgatccttctgtgttggctgatggcggtgagttggagataaggattaaacccgacctagaggcggggacaatcactatcacagatactggcattggaatgactaaagatgagctcaaagactgtcttggaaccattgcacaaagtggcacctcaaagtttttgaaggctctaaaggaga

SEQ ID NO: 3364 - DNA, 342 bp, Zea mays
  Clone ID: LIB143-012-Q1-E1-D8
tcgacacacgcgaccgcgtcattctcttcctcttccggtgctcgtgctcgtgctcgtgctctccgccctccccctccgccacctcgcgcggaacggaacccaggccgccgccgacccagccaccgctaggcgaccgcgcggcatggtggcgcttttacactacctatgctagtttgcctgatgctacatttccacgatggttaagctgactatgatagcgcgtgtcactgatggccttccattgtcggagggattagatgatagtccgggatctaaagatgctgacttctacaagcagcaagcaaaactgttgttcaagaacttgtccagagggcagcatga

SEQ ID NO: 3365 - DNA, 351 bp, Zea mays
  Clone ID: LIB143-012-Q1-E1-E1
gaatacggcgtcgacccacgcgaccgagcacttacaaggtgtttgatttgaaaaactacacattactgtatttggtgtctgataagaatgttcaagaaataaagatcagccctgggataatgctattgatttatgcaagaacaagcagctcggttcctctgaagattctttccattgatgatggtacagtcttgaagtccttcagccacctcctccatcgtaacaagaaggtagattttattgagcagttcaatgaaaagcttctggtcaagcaggaaggagagaacctccaaattcttgatgtaaggaacttccaattgacagaagtgagcagaactgagtttatgactc

SEQ ID NO: 3366 - DNA, 364 bp, Zea mays
  unsure at all n locations
  Clone ID: LIB143-012-Q1-E1-E10
agcagaatganaatgaatacggtaacattcaaggccattatggtcaaccagggaagagatacatgctatgggcagctcagatggcacttgcacttgatactggtgttccttgggtaatgtgtaggcaaacagatgctccagaacaaattctcaatacttgcaatgccttttactgtgatgggttcaaaccaaattcctacaacaagccaacaatatggactgaggattgggatggatggtatgccgactggggcgaatcattgccacatangcctgctcaagacagtgcttttgctgttgctcgtttttatcaacgtggtggaagcttacaaaattantacatgtantttggtggaaacaattt

SEQ ID NO: 3367 - DNA, 382 bp, Zea mays
  Clone ID: LIB143-012-Q1-E1-E11
atgaatacggtaacattcaaggccattatggtcaagcagggaagagatacatgctatgggcagctcagatggcacttgcacttgatactggtgttccgtgggtaatgtgtaggcaaacagatgctccagaacagattctcaatacttgcaatgccttttactgtgatgggttcaaaccaaattcctacaacaagccaacaatatggactgaggattgggatggatggtatgccgactggggcgaatcattgccacataggcctgctcaagacagtgcttttgctgttgctcgtttttatcaacgtggtggaagcttacaaaattattacatgtattttggtggaaccaattttgagcggacagctggtggtccacttcagat

SEQ ID NO: 3368 - DNA, 97 bp, Zea mays
  Clone ID: LIB143-012-Q1-E1-E12
cgtccaaaataaaaaaaaataaataaaaaaaaaaaaaaaaaaaaaaaaaaaaaaaaaaaaaaggacggaaaaacaaaaggttaaaaaaattaaataa

SEQ ID NO: 3369 - DNA, 343 bp, Zea mays
  Clone ID: LIB143-012-Q1-E1-E2
ggtcgaccacgcgaccgctcactctctctcggcgtcgattgggcgaccgccgccgccgcccccaggtcttcgctgggcccgtcgccggcgacgagcacccaccaggttcggaaacattgctgacgttcacctgtaccacagtagttcagtcgagtagctgtcggactcggaacacacatgccggcgatggcaactgctcctgtgaaattctctgtggctacgaactccccatgtgtccagcctagcttgcccctgaggcgtacacctgccgccatctccttcccttgtcgtccatggtcagccgcaatgaactcatgtactggattgttgaggcgctctgacg

SEQ ID NO: 3370 - DNA, 345 bp, Zea mays
  Clone ID: LIB143-012-Q1-E1-C2
tcggcccacgcgaccgctcatttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctgtgtttggctgcaggaaccctgaggagatcccgtggggttcggt

SEQ ID NO: 3371 - DNA, 322 bp, Zea mays
  Clone ID: LIB143-012-Q1-E1-A8
cgacgacacccgcatagggcttgcgtttgacgtaatgggtcgtgtgccatacggaacatcgtttctggataaacaggccgaagaaaggtcctgggacatcaacctaggatggttcttagagccagtggttcgtggtgactaccccttctccatgagatcattggctagggaacgactacccttcttcaaggacgagcagaaggagaagctcgccggttcctataacatgttggggttaaactactacacctcacggttctccaaaaacatcgatatctcaccaaactactcacctgtgctcaacactgacgacgcctacgcc

SEQ ID NO: 3372 - DNA, 409 bp, Zea mays
  Clone ID: LIB143-012-Q1-E1-A9
ccaaccaagccttcgaatatcaaccacctaatgaaggtgcacggaattcgcagggtttctgttctttacctgatcagattgccgctggacgtcctaatttctggcacactgtaaacgctcattaccaagaccagcaaggcaatcacaatctgttccctggttcatggtccatgatgccttcaagtactggctttgggatgaacagacagagctatccaatgatccaggaagtcggtgggatgtctcagagttgtacaaacaccaagtttgggaatggagtttatgctgcactacctggccgaggcattgatcgatacccatctggatggtttgggcacacgacacccggtggtcgcgtggacgatgcccagccacgcgtgattaagcctcaacctttggtccttgctca

SEQ ID NO: 3373 - DNA, 319 bp, Zea mays
  Clone ID: LIB143-012-Q1-E1-B1
ccgtattgtcgtccctctgtagggcattagcaccggccgacgatattactaagtgcttaatttaagtactggcccttggcgtgaaacttcaccagctccgcgactgcgcatggctaacggccttcctgatcctcgctgcgtcgtcctcatggctgacactgcacgctctctcgacaaatccgtcgaagccgtcctcttcgactgctatgatttcatgtgtgacggagatatgctcagtggatgggtcccatcaacgaatgaacgacgtaggaatctgggatcaaacttaatttttgtgtcaaatgactctagaccagtc

SEQ ID NO: 3374 - DNA, 404 bp, Zea mays
  Clone ID: LIB143-012-Q1-E1-B10
ggtcgacgacgcgtccgatgtcaacgagctccagcgtccctcacgcgtccaggcggtgtccgcctacttgtggaaggtcctcgccgccgtcgtggccgcgtgccgcgtgcccgaggagcggtgctgcatgggctggatggtggacgctcggcggcgggtgaagtcgcccgagctgatccccgcgatgcgcaactacttcggcaacgtcacggcctacgcgctgggcggcgcggccgtggaggagatccggcggaagccgctggccgaggtggcggccatggtgcgggataccatcacgtccatagactacgacgagtacctgcaggagctggtggactgggtggaggtgcacaagacggagcacgtgatggagaagggcgtcctcgggctgggctcgccgacgt

SEQ ID NO: 3375 - DNA, 390 bp, Zea mays
  Clone ID: LIB143-012-Q1-E1-B11
gaactcccggataattataaaagggaggggaaaaggaaaacaacttgcaccggaatcaacaacgggggctccaatcaccggtcaacccctcggtgtcaaccccctcctcaaaagttctaattgcagttcagcccctggccggtccgccgggccaccggaaggagccgctcgccggaggaagccccccatctccttgccctgcggcgggtttatggggttctcgctgtaccccatgaagacgtccacgcggttgctctggagcactagcttcttccgccataagctcagctcctcctcctgcttcctctgagcccgccccacccgcgtcgatcacctcggccgccgcccgctgttgctgcgcggtcctagcacccgttcgagtgtgtgtgt

SEQ ID NO: 3376 - DNA, 247 bp, Zea mays
  Clone ID: LIB143-012-Q1-E1-B12
gcgtccgaaactaataatgagtcgtagtaaaaagaaaaaaggggggaaaaatcaagggcattgggccgatactctacaggctttaagtcttcattaatcctacatgagaggctcttaaatcttctgtcctggcctcaattttcagttcattggacgtcgtattcccccgtcggtgaacagcgaaaagcctgccattgccaaacctttgcaccttgcaccacattgtcacattcggaggttggcctaa

SEQ ID NO: 3377 - DNA, 307 bp, Zea mays
  Clone ID: LIB143-012-Q1-E1-B2
agtcgtaccatctgtagggaattagcaccggccgaggatattactaagtgcttagtttaagtactggcccgtggcgtgaaacttcaccaggtccgcgactgcgcatggccaacggccttcctgatcctcgctgcgtcgtcctcatcgctgacacagcccgctctgtcgtcgaatctgtcgacactgtcgtcttccactgagatgatgtcacgtgggcagggtatccgcgcaggtcacggtcatcgacctcgcccggctgtgccagccgggcggcggcgccgacgaggcctcgaagcaaatgactcta

SEQ ID NO: 3378 - DNA, 327 bp, Zea mays
  Clone ID: LIB143-012-Q1-E1-B3
catcatcaaagaccacaagggcatggctaaggagtactttaactttctcaataagtaccttgccacattcaaagggtcagatgatgaatcagctacaattggtgatgcgaaggaagaggctgttgcggcaatcatcgagtttgttaaatcgcctaatctctttcagtgtgatttgctcaacatgccagctgtttcacagcttgagaaggacgaaaagtatcagttggtgtatgaactactaaagatattccttactaagaagcttgattcctacttggagtttcaaagtgcaaactctgacttgctgaaagattatggtctcgtcca

SEQ ID NO: 3379 - DNA, 366 bp, Zea mays
  Clone ID: LIB143-012-Q1-E1-B4
aggccggtaggaatacggcgtcgacccacgcgaccgggcacctatctggtataggacggagctgagcttctagcaacgtacagtgtatccgccatgagtcctttcggggcggtgatcacgccagaaaccctcaagtacatgtccaagtaccagggacgtgagatcacgcaggtggactgcgcacgggaggcgatgaggctgatccacgcggaagacaagaacctcaaggccgaggactcagcgtgggagctgaagaagaagttcggcaacggcgtgagcaccatggtcctcgtctacaacgccaccggggccagcctgagcctggtggacgacgggaaagactggatgggctccgtctacagctcg

SEQ ID NO: 3380 - DNA, 323 bp, Zea mays
  Clone ID: LIB143-012-Q1-E1-B5
caacaaggcagcagcacaagcaagaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgatgcggccaccgagggcggcggctgcgactgcaacacctgcaagtgcggcaccagctgcggctgctcctgctgcagctgcaactgagctggcccggcccggcga

SEQ ID NO: 3381 - DNA, 326 bp, Zea mays
  Clone ID: LIB143-012-Q1-E1-B6
gttcgtcgggcgtagcggcagcgatgatattttagtcgtactcgtacagaagccacagccctctgctagctagctagctcctgctagaatggaaagtgcaggaggggaagctcggccggtgctgccgccgccgccgccgccggtgcaagagctcgccggcgcagcgaacgacgtgccagctcggtacgtcgcgcgcgcaggcaacgagcccaaggtcacggtaaccgcgccggtcccggtcatcgacctcgcccggctgtgccagccgggcggcggcgccgacgaggcctcgaagctccggctggcgctcgagtcctggggtctcg

SEQ ID NO: 3382 - DNA, 321 bp, Zea mays
  Clone ID: LIB143-012-Q1-E1-B7
ggaggactttggcggctggaatatgcagtatgcagcagagctatgcctgccaagccgccgggacgacgacgacgacggcctcctcggtgatttcctaggcggcggcggtttggacatccgttctgaccatggcggcctcaacctgccctcgtcgcaccctgctgtccagaaccttgtgccctgccacggcggcgtgagtctttccgtttccgacgccttcatgggcctggacacggcggatatgctcgctagcgtcaccggcgcactggactgcagcctcctcgacacgtttgcttgcggttcggacgccgtcgtcgtcgc

SEQ ID NO: 3383 - DNA, 324 bp, Zea mays
  Clone ID: LIB143-012-Q1-E1-B8
cggacgcgtgggcaaatttcaatctccatcgatcgattcctcccgaacccgacccgatggcctccgacgccgccgccgagccctcctccggcgtcacccaccccccgcgctacgtcatcggttacgcgctcgcgccgaagaagcagcaaagcttcatccagccgtcgctggtggcccaggcggcgtcgcggggcatggacctcgtccccgtggatgcgtcgcagcccctggcagagcaagggcccttccacctcctcatccacaagctctacggagacgactggcgcgcccagctcgtggccttcgccgcgcgccacccggccg

SEQ ID NO: 3384 - DNA, 402 bp, Zea mays
  unsure at all n locations
  Clone ID: LIB143-012-Q1-E1-B9
ttgcaacaccctgacgtgagtcgtagaagcttggcaacgaaagcaacgaattattcaaaccgaaaacaatggagccggtgcggaagagcgtgtgcgtgaccggcgctggcggcttcgtcgcgtcggagctggtgaagctcctcctctcncggggccaatacgcggtccgcggcaccgtgcgcgaccctggtgctagcaagaatgcccatctcaaggtgctggaaggagctgaggaaaggttgcagcttctcaaggctgatctgatggactacaacagcattgcatcagcagttgccggctgtgagggtgtcttccatgtagccagtcctgtcctttcccatcgaccctccaaccctgaggtggaggtcatagctcccgctgtaataggtacaaccaatgtgt

SEQ ID NO: 3385 - DNA, 353 bp, Zea mays
  unsure at all n locations
  Clone ID: LIB143-012-Q1-E1-C1
gaattacggcgtcgggccacgcgaccgctaactttagctactacgtgtgcaagtgcaagcagcccactcgttcgaccatggctgcgagagcggcgctcctccagctggctgtcagcctggttatccttgccgccgtggcgagcgcgagcgcgaccaactgcccaccgccaccgctgccgccggccccaaagccgccgacgcccggcggccaccacggccacgggtcgtgccccaggaacgcgctgaagctgggcgtgtgcgccaacgtgctgggcctggtgaaggccaaggtcngctcgccgccgtacgagccgtgctgctcgctgctggacgggctcgtcgacctggaggcc

SEQ ID NO: 3386 - DNA, 425 bp, Zea mays
  Clone ID: LIB143-012-Q1-E1-C10
ggtcgacgacgcgtccgagctgtatccgttggcggggaccggcatccttggcccaggacccatgccgccgccgccgtcgccgggtctctggttcccgcagtcgccgtctgggctcctttctccatcaggcttcttgccgagccttagcccaaggtggagagatatatagcaagtctgtgttttccacagcagctgcccctcttgagcaaggcggccgtgtaacatttgacggtagggacgtagccacggtgaggtcggttgggtcgtccgccggatttggctggagaaacacacaggtgggttgtaactttggactcccatatttattgctgctacttactgcttctgtgctgtggttgattagtcggtatgtaaaaggagatttgttatatatttgtaattgtataactgtgaaatatttcaat

SEQ ID NO: 3387 - DNA, 387 bp, Zea mays
  Clone ID: LIB143-012-Q1-E1-C11
ggcagctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggccgtggcggctacggcggtcggcgcgagggtggtggcggcggcta

SEQ ID NO: 3388 - DNA, 157 bp, Zea mays
  Clone ID: LIB143-012-Q1-E1-C12
ggtcgacgacgcgtccgatgcctagcggctgacgtgctgtatccacacgggacgcctgtcacggccagtacgaataatctcatcaccgagaacaacataatgccggcaatggacatcgaccaggaactcgcaacgctgtcgacacgacttacgctcg

SEQ ID NO: 3389 - DNA, 325 bp, Zea mays
  Clone ID: LIB143-012-Q1-E1-A7
caggcaacaaggcaccacacctcttcttcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactga

SEQ ID NO: 3390 - DNA, 309 bp, Zea mays
  Clone ID: LIB143-011-Q1-E1-G9
aaaatggaaagcgtgataagagaagagacattaaacgccttagttgtttcgaactatctcaaaatccgactgtcactcgcggtgtccatcacatatgctggtcttgcatatccagttgacttcaataccaatcatattatcaagagtgtccagtatgtgaaaccgtggtacaataacaatcaccatggactcgttacggctgaggaaagaagacatacagaacatagatcaagacgttatcaaggtttacggagtcgaaaacgagcatcaggtcaaagtcgtcaccctgaagtcgctggacaacaaccc

SEQ ID NO: 3391 - DNA, 317 bp, Zea mays
  Clone ID: LIB143-011-Q1-E1-H12
aggcggacgaggacctgtgccaagcaacaatgggtatctcacgcgactcgatgcacaagcgccgtgccaccggtggaacgcagaaggcctggaggaagaagcgaaggtatgagcttggtcgccagccggccaacaccaagttgtcaagcaataagacagtgaggagggtccgtgttcgtggaggtaacgtgaagtggatggctcttcgccttgatactggtaactactcatggggaagtgaagctgttacccgcaagacccgtatcctccacctggtctacaatgcatcaaacaatgagcttgtgaggacacaaacc

SEQ ID NO: 3392 - DNA, 409 bp, Zea mays
  Clone ID: LIB143-011-Q1-E1-H2
ccctataatgagtcatattacctcgcgcccccgctcgcttcacttctctaggtgcgcaccgatcagaagagatggcggtgccgctgctgacgaagaagatcgtgaagaagcgggtcaagcagttcaagaggccccacctcgaccgctacaagtgccttaagccaagctggcgcaggccaaagggtattgattcccgtgtcaggaggaagttcaagggatgcaccttgatgcccaacattggttatggttctgacaagtcgaccaggcactacctccccagcaagttcaagaagtttgtggtccacaacgtttctgagctggagttgctcatgatgcacaacaggacctactgcgctgaaattgctcacaacgtgtccaccaagaagcgcaaggagatcgtggagcgtgc

SEQ ID NO: 3393 - DNA, 402 bp, Zea mays
  Clone ID: LIB143-011-Q1-E1-H3
cctataatgagtcatattagacgccagcctacatgtctcaagaaggacctcctatgggtggtcgatatggacgagctgaacctatgcaaccagctgccatgggccctccagcaggaaactttggtgcctcggcgactgccaagatcagtgtggacgcctctctggccggtggcataatcggcaagggtggggtcaacactaagcagataagtagaattacaggcgtcaaggctctccatccgcgaccacgagtctaaccccaacctaaagaacatcgagctggaaggcaattttgaccagatcaagcaagccagcgacttggtgcgtgatctcatcgcaaccatcagcgcaagcatgccagcgaaaaatccatctgctgccgcggcaccagcaggatgaggc

SEQ ID NO: 3394 - DNA, 398 bp, Zea mays
  Clone ID: LIB143-011-Q1-E1-H4
tataaatgagtcatattaggacatcggatacggtgctgtaaagcgtgtgcgtgacaggcgctggcagtatcgacgcgtctagagctggtgcagctcctcctctcccggggcctattgccggtcagcagcatcgtgcacgagtctgatgtgcacaagagggtgcaactgactgtgccggcaagatttgaggaatcgttgcagattctcatggctgatttgatggcatatgacagcagtgcatcagcagttgctagctgtgacggtgtcgtccatgtacctattgctgtcctttcggatcaactctccatccctgaggtgtatgtcatacactcccgctgttatacgtactgccgattgtattaaatgcttgctattctgcaggagttatgcaatttatg

SEQ ID NO: 3395 - DNA, 210 bp, Zea mays
  Clone ID: LIB143-011-Q1-E1-H9
agttctctcaaacgtgccgctacctctcttcattcagcaatgattacagccgctccttcacgtgatgtccatcaccaattagacatgcacgtgggaaattcaatgcggtcagacacatcacctgctttgtccatctgatcgaacaatggtgaccgcgataacatcacgggaactgatactgcatctggccagctttgcaggattttcaca

SEQ ID NO: 3396 - DNA, 330 bp, Zea mays
  Clone ID: LIB143-012-Q1-E1-A1
gaagggcattgctgagggtaacctgaatgctgcagttgttgattgttgcattggtattccagtctactttacggatctgcagcgcagggctgttcttgatgctgctactattgcgggtctccagccattgcgattgttccatgagacaacagccactgcactggcatatggtatttataagactgatctcccggagaatgaccagttgaacgttgcatttgttgatgtcggtcatgcaagcatgcaggtcagtgttgtcggttacaagaagggacagctcaagatgttgtcgcatacgtatgaccagtctcttggcgggagggactttga

SEQ ID NO: 3397 - DNA, 367 bp, Zea mays
  Clone ID: LIB143-012-Q1-E1-A10
atcgccacctcgttcgccgcctctcctgctcctaccgcagctctccctcatgtttagtgttcgcaatggcggccttcaacaagcttggtggccttctaaggcacagtgctctggtgagcggtatcactggtggctcttctcctgcagtgttcaatgctgcacggctcatgtctaccaagctatttagtggtggtcttgactggggtgttgatgacgtgaaactaagacaagcatttagcagctttggagacgttactgaagcgagggtgatcacagacagggagactgggatgttcaaaggctttggctttgtgaactactccgacagtgattctgccaatgaagctatttctgcaatggatggcaa

SEQ ID NO: 3398 - DNA, 371 bp, Zea mays
  Clone ID: LIB143-012-Q1-E1-A11
tcaggaatcttgagattttggtcggaaagcaaactgagaacatttcaactctacagcaagctaatgaagagttacaaaagaacatctacactttgactgagcaatcacaacaggtcaaggtggagatgcaaagtgatttgaaggcaatacaagaagagaagaatgcggtgctatcacaactgaagcagtcagaaacttcagtacaaaatcttgagaatgaggtgatacgactgaaagaggagctttctgtccagctagaaaacaattccaccttggacaagcagtttgaagaagccaggagcaatctgcatgctgaaatttcagagctacgtgcagataagaacacatctctattgaaattacagacgtct

SEQ ID NO: 3399 - DNA, 401 bp, Zea mays
  Clone ID: LIB143-012-Q1-E1-A12
aagtaaacagagtaatctctctgtgcctgcgacgacgactaggtgggttaccgccgtcgcgccgccgccgccgccgccgtcatactacaggtgcgaggccttcatcggtatcttaacaggcgacgaacaccaaccaggtaacttcgtcggtatcttcacttcaccgacggcgacgagcacgaactcgaaccttttttccccccaaaaattagccccctccctgccccagtctgcactctacgatggcggcgcctccggccacggctcccgcggcctcccggtgtctctccggtgccaagtcgtgctgggctgctgagcggagctccagctcgtttgccgtctcggcgccttctactggcctccggcaaagtatgagccgcgtcctcagcgttcgtgccaag

SEQ ID NO: 3400 - DNA, 328 bp, Zea mays
  Clone ID: LIB143-012-Q1-E1-A2
cacccaccggcctagtagctctcgccatccacatcgcctgtagctgcatgcggtgatcgcggcggcggtgcaggccacagacgtacgcgcgcgggctggctgtcgggcgcgcggatgcgccggccgcggcgggcggtgacagaagagagtgagcacacggccgggcggaacggcaccggcggatggtgccgtcgcggacgcgtgctcactgctctatctgtcatccactctctcccccgctccgctccggtcgctttgccgccgatctgtcgaagcaccgcagctgactagccgccgtgatcaccgcgcgcaccggccggcgccgcgc

SEQ ID NO: 3401 - DNA, 337 bp, Zea mays
  Clone ID: LIB143-012-Q1-E1-A3
acgcgaccgcggacgcgtgggcggacgcgtgggctgtggcctcccggccaccaccaccacagcgtcgccgccgccgcttcctcggcgtgctcgtctcctcccaccatatgcgccaccaccagcaccacctccatggccgcctccgccgcttcttcttacccttgttgcctcacccaccaaagccattacaatggcggcggatctgcagggagcagcagccacagtagctgcttcctgttccaccacgagcaccagcagcaggaggagcccgccgatgtgagcatatcgctgtccatagccccgccgcgcagcaacaacgacgcggcttcctgtggtg

SEQ ID NO: 3402 - DNA, 351 bp, Zea mays
  Clone ID: LIB143-012-Q1-E1-A5
attcgggcgtcgacacacgcgaccgcccacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatct

SEQ ID NO: 3403 - DNA, 90 bp, Zea mays
  Clone ID: LIB143-012-Q1-E1-A6
gcattcgcgcgtcgacacacgcgaccgaaaaaaaaaaaaaaaaaaaaaaaaaaaaaaaaaaaaaaaagggaggacgcacaaaaggataaa

SEQ ID NO: 3404 - DNA, 315 bp, Zea mays
  Clone ID: LIB143-029-Q1-E1-F11
ctttcacgtggcataacaaggctgaacaaacgcgcatgccaggatgctgctgttttgggcctggggtttctcaaacttgatgctcgtgcacggaaggatactcaaaagattgaccacacagtgaaggagagagcagcgcttcttaaccattttgccagagcatttaaggagcgagctcagtcagacttgaagaaagctgcagacaaacattggagtgatggtgccttggaggcagacctgcgacgagctgacttggttgttaaacgacgtgccatggaagacgctttcatggcattgaagtttgttcaggatatc

SEQ ID NO: 3405 - DNA, 313 bp, Zea mays
  Clone ID: LIB143-029-Q1-E1-F12
cccacgcgtccgcacgcatcaattcggcgtgggcatcaagtttacacgcaagtttgtgcctcttgtcactccatgtccttgatttcataccgtgatttggttggcgtggcctatactgaagaggaaacaaaggcaatggctgctgagattgaggtagttgatggtcctaatgatgagggtgaaatgttcacccgccctggtaaactgagcgatcgcttcccacagccttatgcaaacgagcaagcagcccggtttgctaatggtggtgcataccctccggaccttagtctcatcacaaaggcaaggcacaatg

SEQ ID NO: 3406 - DNA, 257 bp, Zea mays
  Clone ID: LIB143-029-Q1-E1-F2
caaaccatgagtttatatcattatcccctctatctcaccttatattgaacatggtttttgatactattcttctttgtgcttgaaggttgccggtctgcgagttgaatcatggcggagcacttggcttcgatcttcggcactgagaaggacagggtcaactgccctttttacttcaagattggggcctgtcgtcatggggatcgctgctctcgtctgcacaacaggccaactatatcaccaactcttgtgcttgctaa

SEQ ID NO: 3407 - DNA, 257 bp, Zea mays
  Clone ID: LIB143-029-Q1-E1-F3
caagcctgccctgtcctgccttgttaagcaacacagcgagacatcacgagagctacagagagatggcggccacggtttcctccttcgcggtggtgaacatggacaagttggagacagaggagagggccacggtcatggaggtcatccgcgacggctgcaataactggggcttcttcgagctgctgaaccacgggatctcgcacgatctgatggacgaggtggaacggctgaccaaagcgcactacgccaccttctgg

SEQ ID NO: 3408 - DNA, 101 bp, Zea mays
  Clone ID: LIB143-029-Q1-E1-F4
caaaatgtctcatggaggaaaattttcggtcgcctgtgtagcgctctgttaaatgagcaaccttcacaataattcaagctcggtagaattctgaacttgtt

SEQ ID NO: 3409 - DNA, 266 bp, Zea mays
  Clone ID: LIB143-029-Q1-E1-F6
tcgaaacacgcagtccgatcagcttacggcaatatcccctctatctcagcttatgttggacatgggtttatggactatgcttctttgtgcttgaaggatgccggtctgcgagttgaatcatggcggagcacttggcttcgatcttcggcactgagaaggacaggggtcaacgtgccccttttagttcaagattgaggcctgtcgtcatggggatcgctgctctcgtctgcacaccaggccatcaaaatcaccaactcttgtgcttg

SEQ ID NO: 3410 - DNA, 253 bp, Zea mays
  Clone ID: LIB143-029-Q1-E1-F7
gcggcggcggctatggctgcggcggaggaggagatcgcggtgaaggagccgctggatctgatacgcctcagcctcgacgagcgcatctacgtcaagctccgatccgaccgcgagctgcgcggcaagctccatgcgtatgatcaacatttaaacatgatacttggagatgttgaagaggtcgtgacaactgttgagatagatgatgaaacatatgaagaaattgtgcgcaccacgaaacgcactatcccctttc

SEQ ID NO: 3411 - DNA, 252 bp, Zea mays
  Clone ID: LIB143-029-Q1-E1-F8
cccacgcgtccgcggacgcgtggagacgacttgtttcattgattcttgaagagatcgagcttcttttgcaccacaaggtcgaggatgtcttgcaactgcggatcaagctgcagcagcagctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtcc

SEQ ID NO: 3412 - DNA, 314 bp, Zea mays
  Clone ID: LIB143-029-Q1-E1-G10
cccacgcgtccgcggacgcgtggcggacgcgtgggttaataatgaggcaccactagggtgcctcaagccaaatatttctcagtataactctccagagcagataggtggtgttgaagggtttcctgagaataatgaaaaaaggaatgatattgttgctgcagaaaaaatctgggaggcgactccaaaccaaggccttagcaggcccatctaccgacaagaattttatgcctggccatatatttattcagattatcaaatcgtgcgtcagccactaccttatggttttgacaaccaattttatcagataaataggg

SEQ ID NO: 3413 - DNA, 316 bp, Zea mays
  Clone ID: LIB143-029-Q1-E1-G11
ccaactcgaagcttgcgttcttgtagtagaggtcggcagcaagcggtagagcgagaggtcgagaagatgaagagcagcactctgttggcgatcctagttctccaggcccttctggtctctacggccgtggccaaaggacctgcagggccgaagaagcagtgctggtgcggcgagtgcaccagctggtcgggcgtgtggacctgcgacgacctcctcaccaagtgcgccgccacctgcaagaactgcgtccccgtctccacggacaagggcgccaccaagtacagatgccgcgacttcctccccgaaaactgcggct

SEQ ID NO: 3414 - DNA, 311 bp, Zea mays
  Clone ID: LIB143-029-Q1-E1-G12
tataaatacgcgccaccgcgtaaaccgcgaagaaaaagtaaaagggaggaaaagggtccggtgcggcgacgatggagaggggcggcggcggcggcggggacgagatgatgatgacctcgggcgcgacgggccggatcgtgccggtgttccgctccgtgctgtcgcggcgcgcgctgctccgcgtcgctgtggcgctgcactcgctcttcctctggctgctgctcctcgcccgcggcctccgccggcaccgggcggggaccggcgccgacgcctcggcgtcagaggcgggggctggggccgggacctggagc

SEQ ID NO: 3415 - DNA, 253 bp, Zea mays
  Clone ID: LIB143-029-Q1-E1-G5
cccacgcgtccggttgttgctatagctaatcagaggcttcttggtatcccttccggaaagctaaacttaagtggtggtgctgtttccctgggccatcctatcggttgcagtggtgcacggataattgtcactttgcttgggattcttaggcagaaaaatggaaaatttggtgttgctggagtttgcaatggcggcggcggcgcttcagccctcgttttggagctcatgcaaccctcttcgcatatccattcat

SEQ ID NO: 3416 - DNA, 253 bp, Zea mays
  Clone ID: LIB143-029-Q1-E1-G6
gtccgccgtggcgcctgctgggaaggctgcccagcctgtggtgaccaccaagttcccgaccaagcccgctcctccctcgcagacggttcgggatgcacgcggcggtggctcatcagctcgtggaggcgttggccgtggtgaaattggtcgtggcagatgtggacggggatatggccatgaccgtggcttcagtggtgacaatggcaatgagttccagtgaggttatagtggcggctgctatggggatggtgct

SEQ ID NO: 3417 - DNA, 261 bp, Zea mays
  Clone ID: LIB143-029-Q1-E1-G7
aatccgctcctatccttgcacgcacacgcaaacgcatcccatcctgtcctcgcgttactactagttagttagagagagacagagaggatcgatctgctggcggcgtctaagctggagaaaggcggcgccaccgccgagggcgacgagataggcatcgacccagcggcggagactccggagcagcgcaacaagttcctggtcctccgcctgtacgaggcgctcaacgcccgggaccacgccgccgtgcagtcgctgctggcg

SEQ ID NO: 3418 - DNA, 244 bp, Zea mays
  Clone ID: LIB143-029-Q1-E1-G8
cagctctcatctcgcaaccgcagctagttacaattcagagagaagaaagagaccgatatctcgccgatagctatcatcatggcgtccaatgcgctcctcgtgctaacgctcctgctcgccgccaccttcctcgccgcctccgctaacttccaatccaaggcggacacataggagaataacgtagcggtcctttactggcatcgcggtttcagcctaccggtttaaggaagcttacgaggcggat

SEQ ID NO: 3419 - DNA, 310 bp, Zea mays
  Clone ID: LIB143-029-Q1-E1-G9
acttaattaccctcacgcgaagcaccttacctctgctagtcctcctacgtctcttctcttcgcttaatcttggtcggtgatttgattcttcacttcttgcgcgcattgcagagggtgctcggtctgcagctatcttaggttaaccagtcgtgtgtggtctatcggtttcgatatagtattactactgctctgttataatcagcggggaggaggaagatgacggtgacgccacggatcacggtgagcgacgggcggctgacggtgcgcggccgtacggtgctcaccggcgtgccggacaacgtgtcggcgg

SEQ ID NO: 3420 - DNA, 315 bp, Zea mays
  Clone ID: LIB143-029-Q1-E1-H10
gcagcaacagccaacacctaaactaaagaacagtagtagtccccgtgtacgtctagcaacgatccgcaccgagctcgccagttttgctcgttagtttggggacggcgatggcgtccggtcaggaaagcagggaggagctggcgcgcatggccgaggaggggcagaccgtcgtccccggcggcaccggcggcaagaccctcgaggcgcaggagcacctcgccgaagggcgcagtcacggcgggcagacccggagtgagcagctgggccatgaggggtacagcgagatgggcagcaagggcgggcagacccgcaaag

SEQ ID NO: 3421 - DNA, 313 bp, Zea mays
  Clone ID: LIB143-029-Q1-E1-H11
ccctctcgcgcttggcttgctttcactctccagggccccactcccacctcgccgccgcagccatggcgatcacagcgccaactcccgacatcctcggcgagcgccagtccggccaggacgtccgcacgcagaacgtgatggcttgcggggcggtggccaacatcgtcaaatcctcgctcggccccgttggtctcgacaagatgctagtggacgatattggtgatgttacaatcactaatgatggagcaaccatacttaagatgttggaagttgagcatccagccgccaaggttcttgttgagttggctgagct

SEQ ID NO: 3422 - DNA, 315 bp, Zea mays
  Clone ID: LIB143-029-Q1-E1-H12
cccacgcgtccgcccgccgccaccccacgcctgcagccatgccgcccaagctcgacccgtcgcaggtggtggaggtgttcgtccgtgtgaccggcggcgaggtaggcgcggcgtcttcgttggcccccaagatcggtccgctcggtctttctcccaagaagatcggagaggacattgccaaggagacggccaaggactggaagggcctccgcgtcaccgttaagctcactgtccagaaccgacaggccaaggtctccgtcgttccctctgccgcggcgctcgtcatcaaggcgctcaaggagcccgagagggacc

SEQ ID NO: 3423 - DNA, 261 bp, Zea mays
  Clone ID: LIB143-029-Q1-E1-H4
cggacgcgtgggcgcgggtggtggccgccctagggtacgacgacggcaggttcgcgccggggaggtgcacggggtgcgaggccgggggggactcgggcaccgagccctacgtcgtggcgcaccacctcatcctctcccacgccgccgccgtccagaggtaccgccgcaggcaccagccgacgcagaggggcagggtcgggatcctgctggatttcgtgtggtacgagcccctcacggcggactcagccgccgaccgggccc

SEQ ID NO: 3424 - DNA, 257 bp, Zea mays
  Clone ID: LIB143-029-Q1-E1-H5
cgcgatcagagcaggagcaggcaacgcgcaccgaaatcttccaatccacaagactcgctacttcgcagttggcagactcgcccgcagcgagccgctagcaaccaagcagaaatgtcgctggtgaggcgcggcagcgtgttcgacccattctccgtggacctcttcgaccccttcgacagcgtgttccgctccatcgtgccgtcgtcgtcgtcggcggcggcggcctccgagaccgccgccttcgccagcgcccgcat

SEQ ID NO: 3425 - DNA, 255 bp, Zea mays
  Clone ID: LIB143-029-Q1-E1-H6
gatgaggacaagaagctgaatgctacgtacatcattagtgttgcaaggaagattggatgctctgtgttcctgttgccagaggacatcgtcgaggtgaatcagaagatgattctaacacttaccgctagcattatgtattggagcctacagaatcagcatcagtcacagtctgaaatgccagagcaatcagaaccatctagcatggcttcagacgcagcctctgacattgcctcggaggacggtgcttcaacgaca

SEQ ID NO: 3426 - DNA, 311 bp, Zea mays
  Clone ID: LIB143-029-Q1-E1-F10
ggagttggggttaaattagcgtctgaaatacttgtttggtttaggtattcctatgtagacgacctgattatgattcagggtgatttatcgtagcagtaatctgaagtttggtgtggtgtttgatctgtgtgagtcttgtgttaggtgagtcatgaacaaatttatgtggtctttattagtaggtcaaggtgaagttcttctctttatgtatcgtcatgaacaaagttatgtggtctttattagtaggtcaaggtgaagttcttctctttatgtatctatatcagcttagctgtgatatgcgtgtgagtcgc

SEQ ID NO: 3427 - DNA, 258 bp, Zea mays
  Clone ID: LIB143-029-Q1-E1-C2
gtgaactctcaacatccattgatgggaggattactgaatgctgtagagactgttttgaagctctcattaccaaatgtctacctgtggctttgcatgttttattgccttttccatctgtggttaaacatacttgctgagattcttcgatttggtgaccgagaattctacaaagactggtggaatgcaaagacaattgatgagtactggagaaaatggaacatgcctgtgcataaatggattgttcgtcatatatatttt

SEQ ID NO: 3428 - DNA, 276 bp, Zea mays
  Clone ID: LIB143-029-Q1-E1-C4
ccaaaataacaagcctaagtccaaggtccccaatggaagtgaagctgatgacactgatggcgcctctaggcctaaatctgctggacttgtggactatgacgatgatgacgatgaggacttcaatccaccaccaaaggagccttctaggcctgcagaggatgatgtgcccttaaacatatccccgttgaagcggaagccagtgaatgcagtggatgggaaacattcagacggagagggtcgcaggaggcaaaaaatagaaactagaattagttgtgc

SEQ ID NO: 3429 - DNA, 96 bp, Zea mays
  Clone ID: LIB143-029-Q1-E1-C5
gaggaaatgagcataccgcaagcaggttgtcccatcgcgctctcacacctccacagtgcctctcgatcaactccgtcatgtgtgtgctcagttcgg

SEQ ID NO: 3430 - DNA, 270 bp, Zea mays
  Clone ID: LIB143-029-Q1-E1-C7
cggacgcgtgggcgcgcgggaagcagaagattgacgcgcagcggcgtaacgcggagcgaaaccagaaatccaaggggtctcagctcgaggcccgcgccgtgggcctcaagatcgtctgctccatctgcaaggtacaattggcaaatgaaaaacagctgaccgatcactatggatcaaagcatccaaaggagaaacctccgagcacatcgagcaccgaataaccatggctggtcgtgacgcagaaatatagatcctgcttggctggtttgc

SEQ ID NO: 3431 - DNA, 199 bp, Zea mays
  Clone ID: LIB143-029-Q1-E1-C8
ggggaaacaagaggttactccacattcgtgtgccacgcagcgcaccgactaaaccagcgggtcttgtctcgtaggacgcaccatgaccatcaggacttcaagccaccaccaaaggggccttctaggcctgcagaagaagatgtgcgcttaaacaaatccccgtttaaacgggagccagtgaatgcaatggatgggaaac

SEQ ID NO: 3432 - DNA, 309 bp, Zea mays
  Clone ID: LIB143-029-Q1-E1-C9
cccacgcgtccgagagaccgaggcgcccgcggttctgctttccttccttgccccgttcacgagagaagtttctggagtcttcgactcgagcagggttccgatggcgctgcaatggatgatcctggcgtgcgtggtggcggtggaagctgcggtggctgcgctggtcacgctcccggtgccccgcgctgtgcggggccagatcgtcgcgctcacgtccttgttcctgcagcccctgtccagtgtgatacccttcgccgccttccagatcctcgatctctactggaagaaggagcacagactgatgtgcac

SEQ ID NO: 3433 - DNA, 314 bp, Zea mays
  Clone ID: LIB143-029-Q1-E1-D10
cagcgatccgaagctcaatcaattcactcaaacctcttccccaaatcttcgattagattctcgttgacaagaagactagaaccgaacctgaccatgtcgctgatccgccgcagcaacgtgttcgatcccttctccctcgacctctgggacccctttgagggcttccccttcggctccggcaacagcagcagtctcttcccctcgttcccgcggaccagctcggagaccgcggccttcgctggcgcgcggatcgactggaaggagactccagaggcgcacgtgttcaaggccgacgtaccggggctgaagaagga

SEQ ID NO: 3434 - DNA, 313 bp, Zea mays
  Clone ID: LIB143-029-Q1-E1-D11
cgcgttcgtggtggacatgccggggctgggcacgggcgacatcaaggtgcaggtggaggacgagcgggtgctggtgatcagcggcgagcggcgccgggaggagcgcgaggacgccaagtacctgcgcatggagcggcggatgggcaagttcatgcgcaagttcgtgctgccggacaacgccgacatggacaagatctcggcggtgtgcagggacggcgtgctcaccgtgaccgtcgagaagctgcccccgcccgagcccaagaaacccaagaccatcgaggtcaaggtcgcctgaggtgggactaggtcgacc

SEQ ID NO: 3435 - DNA, 315 bp, Zea mays
  Clone ID: LIB143-029-Q1-E1-D12
cttgggggagagagagaagtgggagacccgcgagaggctgccgtgtagggactagggaccgtagagtaagcgacagcgaaggagggagagggggatggccgggatcgggccgatcaggcaggactgggagccggtggttgtgcggaagaaggcacccaccgccgctgccaagaaggatgagaaggccgtcaacgccgcgcgccgctccggcgcggagatcgagaccatgaagaagttcaacgctggtatgaacaaggcggcgtccagcggcacatccctcaacaccaagcgcctcgacgacgacacagagaacct

SEQ ID NO: 3436 - DNA, 270 bp, Zea mays
  Clone ID: LIB143-029-Q1-E1-D6
gtcgaaccacgcatccggcaagcgcgagatcgccgccttcttcgcgcacgtcacgcacgagaccggacatttctgctacatcagcgagatcaacaagagcaacgcctactgcgacgcgagcaacaggcagtggccgtgcgcggcggggcagaagtactacgggcgcggcccgctgcagatctcgtggaactacaactacgggcccgccgggagggacatcggcttcaacgggctcgccgaccccaacagggtggcgcaggacgccgtgat

SEQ ID NO: 3437 - DNA, 254 bp, Zea mays
  Clone ID: LIB143-029-Q1-E1-D7
gcgccgtccacagaaaaaatggaagaggtaaaagaagcaactaagggctccaaaacatcaggagttttgagtcccgcagcaaacgttgagatagtaaaaaatcaaaaagtgccagcaatgactccgaaaagaaagaggatggccaatgtgctagatgtactggaaacaatcaaatcttcaagcacacctccgaagaaggctgctgtcactcctgaaacagcaactgaaatttctggttctacagctccagagca

SEQ ID NO: 3438 - DNA, 252 bp, Zea mays
  Clone ID: LIB143-029-Q1-E1-D8
ggtgatcttcagcccggtgctggtgccggccgccatcgcgctggcgctcatggcggccgggttcgtcacctccggcggcctcggcgtcgctgcgctgtccgtgttctcctggatgtacaagtacctgacgggcaagcacccgccgggcgccgaccagctggaccacgccaaggcgaggctggcgtccaaggcccgcgacatcaaggatgcagcacagcaccgcatcgaccaggcgcaggggtcttgagagaa

SEQ ID NO: 3439 - DNA, 185 bp, Zea mays
  Clone ID: LIB143-029-Q1-E1-D9
cccaatcgtctgcccactcgtccacgctggtcatgtgttcagcgccatgggcatccaatgtagatatgagaccgtcatcgtgtggaaaagaagattatatggtcatgtccgctttgatgctctagtggcctctggaggcatgtgtgggctgtcaacgttcacccatgtggaacacgtctgcagaa

SEQ ID NO: 3440 - DNA, 315 bp, Zea mays
  Clone ID: LIB143-029-Q1-E1-E10
cccacgcgtccggtcctttcggggcggtgatcacgccagaaaccctcaagtacatgtccaagtaccagggacgtgagatcacgcaggtggactgcgcacgggaggcgatgaggctgatccacgcggaagacaagaacctcaaggccgaggactcagcgtgggagctgaagaagaagttcggcaacggcgtgagcaccatggtcctcgtctacaacgccaccggggccagcctgagcctggtggacgacgggaaagactggatgggctccgtctacagctcgccgatcccggacaccttccacaacgggcagtgga

SEQ ID NO: 3441 - DNA, 314 bp, Zea mays
  Clone ID: LIB143-029-Q1-E1-E11
cccacgcgtccgcgagctcgagccctcgcccgctcagtcacaaagcctcagatctcagtcgcctgcgccgccgcttcgttcgtgtggaggggagaagacaggaaatggcggcgactgagggcgtgctcttggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagg

SEQ ID NO: 3442 - DNA, 304 bp, Zea mays
  Clone ID: LIB143-029-Q1-E1-E12
gatcgatctcactctcagctggtcgctcactcttgcagctccacccttcactcagtcttaggctcttagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgaggctgctgctcctgctgatcccgaggagcttcccgcggacga

SEQ ID NO: 3443 - DNA, 257 bp, Zea mays
  Clone ID: LIB143-029-Q1-E1-E3
gacagcagcttctgcttgctctggggggaaggagagagagagagcgagagagagagagagatctagtagagaggctagtaggtggtcctcgaacgaagatgttggcggtgttcagcgggcaggtggtggaggtgccggcggagctggtggcggcgggcagccggacgccgtcgcccaagacgaaggcgtcgcagctcgtggggcgcttcctggccgcgtccgagccggccgtgtccgtgcagctcggcgaccacggc

SEQ ID NO: 3444 - DNA, 153 bp, Zea mays
  Clone ID: LIB143-029-Q1-E1-E4
ggtcgatcaggagtccgcaggaaaggagatgagcagttcactcaggaaggcagcctcccttgccactccttttccttgagatgacgattacgagcgatgaagatgcatcagcagctcctggtcatcgtttctctcatgtttctcgttgcggtg

SEQ ID NO: 3445 - DNA, 251 bp, Zea mays
  Clone ID: LIB143-029-Q1-E1-E5
gtcctacctgcgtgcgaataagatgttcgttgatcacagccaggttgacgctgaaagggtatactcttcctatctagaacttaacttggaagaggtagaaccatgtctatcaggaccaaaacggcctcatgatcgagtgacattgaagaatatgaagtctgattggctttcttgcttggacagcgatgtaggattcaagggttttgctgtccccaaagaatcacagggcaaagttgcagaattttcgttcc

SEQ ID NO: 3446 - DNA, 253 bp, Zea mays
  Clone ID: LIB143-029-Q1-E1-E7
gtccaaagcactggtgattactgggattgatgacagaagatactggcaacacatgccaacttcagaatcgagattccagtctgtagcctaccttcagcaaatctggtggtttgaggtggttggtgaagtcgatttctgcttccctgttggaacatatagcttgtacttcagggtccatcttgggaagttctacagacgatttggccgccgccagtgcacctcagagcatgttcatggttgggacaagaagcct

SEQ ID NO: 3447 - DNA, 252 bp, Zea mays
  Clone ID: LIB143-029-Q1-E1-E8
caggaaaggagatcaccacttcactcaagaaggcaccctcccttgccactccttttccttgagatgacgatgacgacgatgaagaagcagcagcagctcctcctcctcctttctctcatgtttctcgttgctgtgacagcagccgctgttgctgccgatccacatccacagcaggtgcaggtgcagcagcagcagcaagcacagatgaggattaacagggccaccagatcccttcttcctcagccgccgccg

SEQ ID NO: 3448 - DNA, 315 bp, Zea mays
  Clone ID: LIB143-029-Q1-E1-C12
caccaccaccactcgcccgcgcaattcccaaatctcccaggggcctcttcgcttacctcccgcccgactcctcgcgaccccatcgcctcgcctcgacccgtcccgagccttgctcgtcgcggagcgccacaaccacgcctcgccgccgccggcgagcggtcaagcctaggggctatctccgtgtgatggctaccgcgccggcctccgaaagctcgaccgcctcctagggcggcagttacccgaggctgagctcgtgcgcgcgcgtggggacatccgtgctcagctcgcgaaaccctaggagcagcaggaggcgag

SEQ ID NO: 3449 - DNA, 311 bp, Zea mays
  Clone ID: LIB143-029-Q1-E1-E9
ctctctcgctggtgcgagagcgcgcgcgcaagcaagcaagcaagcaaggagcgtcgtgtctagctagctgagcacctggttttggagcatggaggacaacggtgccgccgccgccgccgccgctcccgcgacgagcatgcctgccgagaagcgtgtggtggtcatccagcgggacgcgccgccggagccggcggcggggctactgccctgcgggccgaggaagacggggctccacctcttcgtcatgaacatcaggagcgtcttcaagctggacgggcttgggtcggaggtgctgcgcatcgcggtgcccg

SEQ ID NO: 3450 - DNA, 267 bp, Zea mays
  Clone ID: LIB143-029-Q1-E1-F1
ccacgcatccgaacccctctccacctcccgaccttccgccgcctcacccccacctcctccctccgcgccgccgccgccatgtcctcctcctcgtccgcggtcgccgccccgatcgagcacttcgtgctcttcaaggcccgcccggaggcggtggcctcgggcgccgcggctgcgatggtctcctcactgcaggcgctggccactctcgtcccgggcctggcctacatcgatgcaggacaggtgctccgcctcggagttccgggcgcg

SEQ ID NO: 3451 - DNA, 310 bp, Zea mays
  Clone ID: LIB143-029-Q1-E1-A11
gcagctgccacagagacatcagagagcggtcctccttgtgagtctgagctgaagaggaggaggaggaggaggagaagcagcagcgcagccggaggagggagagcgaagatgcgccgcgtcgcgctgttgctcgtcgccgccgtgtgcgcgctggcggcgccggctgccgcggtcgtcactgacggtcttctcccgaacggcaacttcgaggatggcccgcccaagtcggcgctggtgaacggcacggtggtgtcgggcgcccacgccatcccgcggtgggagacgtccggcttcgtggagtacatcgagt

SEQ ID NO: 3452 - DNA, 314 bp, Zea mays
  Clone ID: LIB143-029-Q1-E1-A12
gaagaaggtgctagaggtgtacgaggcacgcctgaccaagtgcaagtaccttgctggagacttcctcagcctcgccgacctgaaccatgtgtctgtcactctctgcctgttcgctacgccctacgcatctgtgctcgacgcctacccgcatgtgaaggcctggtggtctggtctgatggagaggccgtctgtccagaaggtcgctgccctgatgaagccatctgcttgaaacggttgccctgtcaatcggtgaatggaataagccaagtctgttctgggttgtttgcttgttcagtgatgtgtcttctatgacg

SEQ ID NO: 3453 - DNA, 260 bp, Zea mays
  Clone ID: LIB143-029-Q1-E1-A2
gtacaggtcaaggaatttcatcctgatgtttgcaaggacccagaaattgcagatttaagaatgagcgagtgatggaggtctatcagggagtgttcttcgttgttgtccattgtgaaacatgtcctaccgtatcccttgccaaccagctcctgtatctgttgcccactcgattcgttgaagcacagagtatggagaaaacacaacatatatcgcatggattatgatttgttagtgcatgtgttacatattgacttatcgca

SEQ ID NO: 3454 - DNA, 258 bp, Zea mays
  Clone ID: LIB143-029-Q1-E1-A3
gcttccagagccccccgccgccgctgcgccctcctctcggtcctgccgtccgtcgaggtaaaaggacagcatggtgagggtcagcgtgctcaatgatgctctcaagtccatgtacaatgctgaaaagatagggaaacgtcaggtcatgatcaggccgtcatccaaggtgatcatcaagttcctgacggtcatgcagcgccatggttacattggcgagttcgagtacgtggatgaccacagagctgggaagatcgtggt

SEQ ID NO: 3455 - DNA, 259 bp, Zea mays
  Clone ID: LIB143-029-Q1-E1-A4
acctactcgccgtcgcggtgccgtgcgccggtgctggccagtctaggttttcggccctcgcccgccgatccgtcccccccgccggccatgtcgaagcaaggagggaaggccaagccgctgaaggcgcccaaggtcgacaagaaggagtacgacgagagtgatcttgcttatttgcagaagaaaaaagatgaggaaaaggcgctgaaggagctgaaggccaaggcacagaagggcgcaattggaggctcgggtctcaaga

SEQ ID NO: 3456 - DNA, 258 bp, Zea mays
  Clone ID: LIB143-029-Q1-E1-A5
cggaatccagagccccccgccgccgctgctccctcctctcggtcctgccgtcagtcgaggtagaaggacagcatggtgagggtcagcgtgctcaatgatgctctcaagtccatgtagaatgctgagaagatagggaaacgtcaggtcatgatcaggccgtcatccaaggtgatcatcaagttcctgacggtcatgcagcgccatggttacgttggcgagttccagtacatggatgaccacagagctgggaagattgtg

SEQ ID NO: 3457 - DNA, 256 bp, Zea mays
  Clone ID: LIB143-029-Q1-E1-A6
cacaatttacttcaagctggaaggaattatggtctggctgctggatcatggttgggtccatatgctatgtgccgggcatggcagacccttattcgcacaaatagagagcaagctgatgctgtagatgggaaggaaaatttccctatggcgctgtatgtggtttcgggtgatgaagatggcgaaagaggtggagctccagttgtttgcattgatgttgctgctcagctttgctctgatttcaacaaaggaccatcta

SEQ ID NO: 3458 - DNA, 149 bp, Zea mays
  Clone ID: LIB143-029-Q1-E1-A7
cacgcatccgaaacactgcaacagcgctgtgcaggcgtttcagctcgtgccttctctccaggctcaatgcaaacatcatgtggatgatagtgcacgtcgctactcccattcccatttaggacgcggaggccatatcgacagatgaggtc

SEQ ID NO: 3459 - DNA, 255 bp, Zea mays
  Clone ID: LIB143-029-Q1-E1-A8
atgcgggccaaggcgagagggaggcactcgcactagcttcgtggattggcaggagctacagggcgcacactggatcggagatccgctggtcggacactgaagacgcggcgggctctcccctgacgctgttctggaagcacagcgacgccataatctgctgctctctaaagccggctttcacgctcaagttcgccaaccgcgccggcttcgacatactggagacgacggtggcgaatgtccaggacctgccgctgg

SEQ ID NO: 3460 - DNA, 313 bp, Zea mays
  Clone ID: LIB143-029-Q1-E1-A9
cgagaagctcgccggcgaggccgccaagctcgcgcggtacaacaagaagcccaccatcacctcccgcgagatccagacctccgtgcgcctcgtcctcccaggagagctcgccaaacatgccgtctccgagggaaccaaggccgtcaccaagttcaccagcaattgagcagcctgcagcgtccacggatttgttaggtctccccttcttacaagggttcttcgtcgtgtcctctacccctccccgcctatgtatgtgctgtgaaatcgttgatgttctcgtcgggtgaacaaaggccagtagctagcttgcctg

SEQ ID NO: 3461 - DNA, 257 bp, Zea mays
  Clone ID: LIB143-029-Q1-E1-B1
gagacgatggcgcgaggtggcgcgtgggccgcggtggcggcggcggccgtgtggtggatggcggcgggggccggggcggtatggctggagattgcgccgtcagggactaagtgtgtgtcggaggagatccaatccaacgttgtcgtcatcggcgactactccgtcctctatgatcaccaccacgcccagcctaccatctccgtcaaggttacgtccccttttggagacattgttcataagaaagaaaaggtttcgat

SEQ ID NO: 3462 - DNA, 295 bp, Zea mays
  Clone ID: LIB143-029-Q1-E1-B10
actggacagcggcggaggcgccgttgcggaggatgcatccctggagtgtgacgcttgatgccatatgtgagacagtgtttgcgaagcagtggacaagtgatgcagctctcaggacttagatttaatctcaccgcacgaaatttcacggtcgcaattcacagtccatatcccacatgatacattggtgactactacacatcgtagagcatctctacatactcatgagcctcaccccataactgagttgtcaactcacacagtgttgtcatccagcaaatcttccttccaaaagatc

SEQ ID NO: 3463 - DNA, 311 bp, Zea mays
  Clone ID: LIB143-029-Q1-E1-B11
tgacattatctggttcttattcatttcaagttgttctttcaaaaaaattggaatataagtcattttggaatcgtgtggttctattgctgctagcttagtaaggtaaaatagcctgacctcgtcaacaattagtttttttaggagaaaaagatgcaacaaatgaggattgatgcttcccgcaagagtacatgatgtacaatatatatctttagatggtttcattgttgactgttgtagctgatactaagaatgtagcttttttctttattcaaggtggtcgcagcgatctgtgattgtttatgcccaaagcg

SEQ ID NO: 3464 - DNA, 205 bp, Zea mays
  Clone ID: LIB143-029-Q1-E1-B12
cattaccgggttcttattcattgcaagttgtacattcaaaacaattggcatagaagtcagtttggaatcgtgtgggtctaatgcggcaagcgtagcaatgtcaaatagccggaccacgtcagcaattagtttttcaaggatacaaatcagcaacacatgacgactgatgcttcccgcaagagtacatgatctccaggacatatct

SEQ ID NO: 3465 - DNA, 260 bp, Zea mays
  Clone ID: LIB143-029-Q1-E1-B2
gtctctctctccgtgagggaggaagttgggcttcgttctcgagtactcttcgttctcaggcggcccccggctgcttctgctggtcgccgcccagctccagttattagagaaataagggccagcctggttgcccgaggctgacccagcacctgcgatggaggagaaggctgtcacaaatggagcggcagctgctgatgttgctgctcctgataataaggataacaccaaggaagaggttagcaagagcaaggagccagtaa

SEQ ID NO: 3466 - DNA, 255 bp, Zea mays
  Clone ID: LIB143-029-Q1-E1-B3
caccgggcacaccccccgagctcagcttagctccactccagctccaatcatagtcgtgaccagagcgcgagagctatctacagggccgtgaaaatgccgatcaataagatcgccctggggagccaccattaggtgtaccacccgggcgccctcaaagcggcgttcgctgagttcatctccaccctcatcttcgtcatctccggccacggctccggcatggccttcagcaagctgacctgcggcggaccgacgacc

SEQ ID NO: 3467 - DNA, 258 bp, Zea mays
  Clone ID: LIB143-029-Q1-E1-B4
ctcccctcctctgcccccatctcgcttctcgcacacggcagccggattccgaagcgcaccccctcggccccagccaaaagcatcgcagtttctaatcgtttggagagcacacaagaatgtcgttcgtgcagctctctggtgctggagtcgctgcagtggccttcacgaacaagagcctagtctctcggcacgcagcgctacgggtctgctcgtcgaggcgctcgatccgtagcctggtcgttaaggctgcaactgtcg

SEQ ID NO: 3468 - DNA, 252 bp, Zea mays
  Clone ID: LIB143-029-Q1-E1-B5
atggatctcaagcaagcctcctctggtacaatcttctgccttctgcttctattctgcgtgggctgcagatgtcggccttcggaaatagaggccacccagacagcagccctcaaggttgatgcctcgccacagcttgcccggaagatccctgaaacactgtttgggatattttttgaggagatcaaccatgcaggagctggtggcatatgggcagagcttgtcagtaacagaggtttcgaagctggaggctcc

SEQ ID NO: 3469 - DNA, 240 bp, Zea mays
  Clone ID: LIB143-029-Q1-E1-B6
gcgtctgagggccagtcgacctctctgctcgccatcaatggtcgccgtagcggcaggtttggctgcctacatggcggtgctgcgggcagcgccgcggacattcgagggcgaccagctgatgctgaacgactctgcggtggagatctggctccgctttgatgaccaacgatggtctaacgccatgctccaaccatgcaccgcctgcactcgccgacgcccgctaagtagcacacttcatca

SEQ ID NO: 3470 - DNA, 250 bp, Zea mays
  Clone ID: LIB143-029-Q1-E1-B7
caacctctctcccctcgactgttgggtgtggtggatttcctccgctcccgccgaacggtcgatcttttgcatggcagcagcggcggctagctccaaggggcgggcgatcgctgggagcttcgtcagccgcgtcctggccggcaaggccgcctccccgaggagggccgtgcacgcctcgtcgtacgacaagaacccggaggagcaggtgcgcccggcgttcgtgccggacgatgtgatcggccgcggcgcg

SEQ ID NO: 3471 - DNA, 316 bp, Zea mays
  Clone ID: LIB143-029-Q1-E1-A10
aggcaccacacctcttcctcctcttcctcctcctagcacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcgaggcggccaccgagggcggcggctgcgactgcaacacctgcaactgcggcaccagctgcggctgctcctgctgcagctgcaactgagcc

SEQ ID NO: 3472 - DNA, 257 bp, Zea mays
  Clone ID: LIB143-029-Q1-E1-C1
acacgatggagacggtgagaccgctgcccatgcactggagctgggtgaagtcacgcaggttcctatgcacgtgtccagcgtgttgtaggtggagcccatgcacgtgtccagcgtgttgccctgcaggacaaacatggcctcgttgccaattggcaacccatgaagttggccatgcagacagtgacctaggtcgggtcaaagcagcagggcctggatgtgctcgtgcatgggtacgcacgctgcgctgagccaccaat

SEQ ID NO: 3473 - DNA, 194 bp, Zea mays
  Clone ID: LIB143-029-Q1-E1-C10
gggactccggcgtcgacgcacgcgaacgggctgactggtgctaggccgacgatctgtagatgacggatacggtgcagatcgggaacatgttctagtttctggcgtttacctcacttagacctcttacctggcgccaatggcaagtcttcaggagactctgtgcactatggagctcctggtgcggaaggaggtcc

SEQ ID NO: 3474 - DNA, 312 bp, Zea mays
  Clone ID: LIB143-029-Q1-E1-C11
ggggctacgaggtcctgtacatggttgatgccattgatgagtatgctgttggtcagctcaaggagtttgagggcaagaagcttgtctcggccaccaaggagggtctgaagcttgatgagaccgaggatgagaagaagaggaaggaggagctgaaggagaagtttgagggtctgtgcaagatcatcaaggaggttctgggcgacaaggttgagaaggttgtggtgtctgaccgtgttgtggactcaccgtgctgccttgtcactggtgagtatggctggacagccaacatggagaggatcatgaaggcgcagg

SEQ ID NO: 3475 - DNA, 314 bp, Zea mays
  Clone ID: LIB143-011-Q1-E1-F10
acctacttctagatcgcgagcgccgccctttttgtttttttttctattgaccaccacgtatagatggttacaaagtttgatcacgggacgttatacagctgactgttattaagacgaccagatctgatgtctccatgacttatggccacagacctttcggacctacatgcggcatgcccagctggacaccatatcttggtatcatccctaatgtcttgagtaatcttagagatgtcaggggtagtcccatcagtgacacaagagtttctgtgtttgcagaacagcaagccactacgatcacaactgacatgagt

SEQ ID NO: 3476 - DNA, 385 bp, Zea mays
  Clone ID: LIB143-011-Q1-E1-F11
tacaagactctagactgggtcctagtagcggcgaggccaccatgagcactctcaagttctgccgggaatgcaacaacatgctgtacccgcgggaggacaaggagacgcgcaccctcctgtacgcgtgccaaacgtgcgagcatgaagagattgccactgatacttgtgtgtacaaaacggttatccgcaagcctggtggtgagcccaaggatgtcctgaaggatgcagcaactgatcctagcctgcctcgcaccagaagcgtcagatgttacaactgcaaccatccagaagctgccttttttcaagcccctactaaaggagaataagccatgacgctgtacctcaactgctgcaacccaagctgcgggcacaggttgagggactg

SEQ ID NO: 3477 - DNA, 356 bp, Zea mays
  Clone ID: LIB143-011-Q1-E1-F12
tacaaaaccctatactgagtcatattagccgtaagatcctctgatgtgtccattcgcgtgttgagtcggcggcttgtgaaggcatccgacccctccctccagccgcacgtcgtcaccttcacaaacctagatctctacccggacaacgtgcaggcctccataatgtggctctaccccaagctgtcaacaaagtccgggccgggcggcggcttcgacgccgtcgtctccaccttcgaggccgtcctgccgaccttgcttaaccacttctaacctctcgccggacgcattgtcctcaaaccaaactccagcgtccccgagctccacgtccacaaccagggggtggagctcgtcgtggg

SEQ ID NO: 3478 - DNA, 411 bp, Zea mays
  Clone ID: LIB143-011-Q1-E1-F3
gcaggcctccgcaatgcttcaacatgagacagcaactgcgagaacttgcaatgctaaattcgccactccgagaggagagtccacatccaggtggtgctcctcctagtcccttcagtaacggcggcatgaaaagagtgaaacaatgacaccgccgaggctcgttcctccatcttgactccccagcaaccccaatgcagtccataccttcacaccctatttttcaatgagcaagctttcatgacggtgttggtagtgtgtgacattcttcactgtactagcaggtgaattttgatctcccatcccatgttacattaaccttgagtgacagatgactatgcgtagtgtatcctctatggcagtataactagaacatttgatttatttgttactggtaatgctgagatatagtac

SEQ ID NO: 3479 - DNA, 408 bp, Zea mays
  Clone ID: LIB143-011-Q1-E1-F5
acaaaactctacactgagtcgtagtatcagccaagtgcaagtgatcgagctcccccctcctcatcagtcgctaggcacagcgcacttgcaggatggcgcaggtctctaagacgcttctccttgtggccctggtgttcgtgtcgtcggcggcggtggagctgtgccgcgcgatcgacttcgacgagcgggacctggcgtcggacgaggcgctgtgggacctgtacgagcggtggcagacgcaccaccgggtgcaccggcaccacggcgagaagggccggcggttcgggacgttcaaggagaacgtgcgcttcatccacgcgcacaacaagcgcggcgaccggccctaccgcctccgcctgaaccggttcggcgacatggggcgggaggagttccggtccacgttcgccg

SEQ ID NO: 3480 - DNA, 330 bp, Zea mays
  Clone ID: LIB143-011-Q1-E1-F9
atattcttggggtcaaatcagtagcatctcatggctgtgaagtcgatgatgttcaacgagtagcagtgcaggatgaatttacccgcatctcagttccacaaaaacatattggcaacaagggatcacgtgattcttccccggataatgtttgcaatgctgcgattccgtctgctatggagcaaggatatacattgatgactggcacacataatccttctgttaatgtcgttaccgtcacagtccatggtgttggtgttctagtctttgcttcagggttggtatcgcgaacatatacagtgggaactgtgatgagtggatgcattccacaag

SEQ ID NO: 3481 - DNA, 389 bp, Zea mays
  Clone ID: LIB143-011-Q1-E1-G1
atcatcatcaggttctccgttccactccatggtcttccctgctgtgcccctcctcgccgctctgctcctggtcgccgccacgcggctgtgggactacgtcttcgtgcgcctcgtatggcggccgtacgccatcaccaaggggttcatagagcaagggatccatggaccctcctacaggttcttcaagggctgcaacgaggagatcaggagcatgaatgagaagaccgacggtctcgtgctggacgtcggcgaccacaagtacctcccgcggatcgcgccgcactacctcgaatggagggctcagtacggagaaccatttctatattggtacggggcacaagcccgaatttgcatatttgactacgaactagcaaggcaaatcctttcga

SEQ ID NO: 3482 - DNA, 356 bp, Zea mays
  Clone ID: LIB143-011-Q1-E1-G11
ttacaacaccctgatgtgagtcgtattaaatccactgtctccgggtggtgtccgcattggcgcgccagcaatgacctcgaggggtctactggagaaggatttcgagcagattggggagttcctccaccaggcagtgagcatctgcctgaacaggcagaaggagtacggcaagctcctcaaggacttcaacaagggcctggtgaacaacaaggacatcgagaacctcgatgtccaggtggagaactttgccgacaccgtcgacatgcctgggttcacgcttgagagcatgaacgacaacgagtatacatgccccccatgcaccgcaaggtcctcctgtaccgacatccttccttgtg

SEQ ID NO: 3483 - DNA, 387 bp, Zea mays
  Clone ID: LIB143-011-Q1-E1-G12
ccctgaagtgagtcgtattaactagctagatactccgtggtcgtcgtcgtcgttggacgtacgccagaagagggagctagagaagaataccgtacagctgcttccaacatggcagctgcctcgtctgcccacctgttcggactcggcgacgggcatatgcagatgcagccgcagcagcagcaagcgccgcctcctcctcttgtgaacaacccggccgcgccgccgcccaagaagaagcggaaccaacccgcagaccctgacgccgaagttattgcgccttcccccaagacgctgatggcgacgaaccggttcctgtgccaagtgtgcaacaaggggttccagcgggagcagaacctgcagctgcatcggcgcgggcacaacctgccg

SEQ ID NO: 3484 - DNA, 402 bp, Zea mays
  Clone ID: LIB143-011-Q1-E1-G3
ccgctcaactcaccccaccccaccgcccgcaaccgcaagctcagattccctcccaccccaccccaccgtcccgctcactccagcccagcccgcgtccccacagcccagcgacagcgagcaccggcggcatccagccatgtgcggcggcgccatcctgtcggacatcatcccgccgccgccgccgcggcgtgtcacggcgggccacctctggcccgagagcaagaagccgaggagggctgcagccggcaggaggagagcccccgtggagcaggagcacgaggatgatttcgaggccgacttcgaggagttcgaagtggagtccggcgagtcggagctcgagtccgaggacgagcccaagcccaagcccttcgccgcccccagcagcgccctcgccagaggtgg

SEQ ID NO: 3485 - DNA, 416 bp, Zea mays
  Clone ID: LIB143-011-Q1-E1-G4
tacaagcccctatactgagtcatatcaacgacaggtacaacgattttgtgacacctgaggagaaggaagggttgattggaaagcttcaggaggttgaagattggctatatgaagatggtgaggatgagacaaagggagtctatatttctaaactggaagatcttaagaagattggtgacccaattgaggcacggtacaaggagtcgacagaaaggggttcctctgtagatcaactggtctactgcatcaacagtttcagagaggctgctttgtccagtgaccaaaagtttggccatatcgacatatctgagaaacagaaggtcatcaatgagtgctctgaagtagagaactggttgagagagaggaagcagcagcaggacgccctacctaagcacaccgatcctgtgctgctcgta

SEQ ID NO: 3486 - DNA, 424 bp, Zea mays
  Clone ID: LIB143-011-Q1-E1-E9
atacacgcctctaaaccgagtcagtttatccgtcagatctgtgacagctggcgatatagatatcacacacattcgttattcgttgaactacagccactggcgaggccgtccgtccaaagcgtccacgtcctccttctcccactcgccacgcatggccacatcaacccgctgctccagttccgcaagctgctcgccggacgctctggcgtccggtgcacgctcgcggcgacccgcttcgtcgtcagctcgacgaagccgaccccgagctcggtccacgtcaccgtgatctccgacggctgcgacgagggcagtccctccgaggtgggagggatgggcgcgcgctacttcgagcgcctcgaggcggtcgggtccgagacgctggacgacgtcctccggtcggagtcggcgctggggccgcccgtgc

SEQ ID NO: 3487 - DNA, 397 bp, Zea mays
  Clone ID: LIB143-011-Q1-E1-D2
tataatgagtcatattatgataccgcgattccacatgtctattgctgctgcggcgatggggagcgacactgaaacggttaataaggcctcggtggcgctgatatcaatcgcgaaacccctcgctgggaagacgctctgcatgcgggccctcaagctcgtgcgactagccgccgaggcgaaatgcctcaagcgcgtcgtcaaataggtagtcaagaccattcgtcgcgggaacataggattgtgtgtgatctctggaaatatttctcctattgatgtcattacacatgttccgataatatttgaggaagctaatgttccttacgtatatgttccatcaaatgacgatcttgcgacagcacgaaacactatgaggccgaattgttgcgtcgtggttctg

SEQ ID NO: 3488 - DNA, 395 bp, Zea mays
  Clone ID: LIB143-011-Q1-E1-D8
gtgtccctctgtcgtcgtcgtcatcagtgaaccaggcgaggcgacgatcggacccgggtcgtaagcggtaagcccaccggctcaacagcaggctgcagatccccccaccccccacgcaactccatctcctctccgcctccacctgcacccatcgagcaccgaacggcggcggcatggaggctggcggcgaggagttcgcgatcggcgtggtgatctccgcgaagaccaccctgggggaggagttcgagggccagatcgtcgccttcgaccgcccctccaacctcctcgttatccaggagggcgtgggtagggcggagaggggggagcggaggaacgtgagggtcctcaaagcgaactacatccgggagttctcggtggtcagtaagggtgacgag

SEQ ID NO: 3489 - DNA, 189 bp, Zea mays
  Clone ID: LIB143-011-Q1-E1-E1
ttttacctttgcctgtcctgggcggggatggcggtgttgtgactgttgttgctgttcttcacataactcatgctgcaattgctacggttggaaacagcggggcagctggatccgaggcaacatctgccatgatgcagaggttctgggattcagcaatgtccattggacctattggtgatgacgatgagt

SEQ ID NO: 3490 - DNA, 331 bp, Zea mays
  Clone ID: LIB143-011-Q1-E1-E10
agagatatggtgatatgagctgatgatttttattaaaaaaaacaaaaaaaaaaaaaaaaaaaaaaaaaaaaaaaaaaaacaaaatatagataaaatataagattaaagttacatggggtgggcttcaagtggttccaaggttacgttcgctttcttcacagttcatacttcttcaatgtggtcacgtgaattcccttcagcgtccgtagttttacctcttcttgctggggaacaccttggtttctacgaattttatcgccttgcactagatcctatttttgctaattgggttgctattgatgagggctatatggattggccttccgaaaag

SEQ ID NO: 3491 - DNA, 404 bp, Zea mays
  Clone ID: LIB143-011-Q1-E1-E11
tgagtcatcttaagaggcgcatagcgcaaccgagcgatagagagaggacggcgacggtggagatgatggggtggggagaggaggtggtggctctgtccctgcgaggctacggctatggcaacgatgaggatcaccggccggagataccgcggcggtacggtgtgaccgagatgcggagccccttctactccttccgccccgcaaaccaggcgctccacgcaatattggattctcttagtccattcgttgatggtttgaagttctctggccgatgccatactttgatgggaaaagaattggttagtcagatcactgatctagcacacaggcatgacatttatgtgaccacatgtgattgggcatagcatttgctgtcccaaggaccctcttctttcaagcaatat

SEQ ID NO: 3492 - DNA, 412 bp, Zea mays
  Clone ID: LIB143-011-Q1-E1-E3
tacaggcctctagattgagtcatattagccagaaggtggagttctgctcctatagaatgttagattctacaaggaggaagagaagaacgaacctgagtttgctaagaagctagcatctgttgctgacctttatgtcaatgatgcttttggcacggcacacagagctcatgcttcaaccgaaggagttaccaagtatttgaagcctgctgttgctggcttcctcatgcagaaggaacttgactaccttgttggagctgttgccaacccaaagaagccatttgccgctattgttggtggatccaaggtctcaagtaagattggtgtcattgagtcgttgctggcgaaggtcgatatcctcatccttggtggtggtatgatctacacattttacaaggcacaaggatattctgtt

SEQ ID NO: 3493 - DNA, 404 bp, Zea mays
  Clone ID: LIB143-011-Q1-E1-E5
cacacgtccggatatattgatgcgtgttatcgcccaaaatcttcctcctgagtccaccacggtcgagaaggtcatgactcagagtcctgaatgtgccacagtggacaccccaattcttgatgctcttcacacaatgcatgatgggaaatttttacatttgcctgtcctggacagggatggaaatgttgtgactgttgttgatgttcttcacataactcatgctgcaattgctacggttggaaacagcggggcagctggatccgaggcaacatctgccatgatgcagaggttctgggattcagcaatgtccattggacctattgatgatgacgatgactcgagaagtgaagggtcgactagagtggtatctgaggcaacagatataggaagaccagccttctttc

SEQ ID NO: 3494 - DNA, 408 bp, Zea mays
  Clone ID: LIB143-011-Q1-E1-E6
acaaaactctagagtgagtcctactaaaggaagcagtacaaattcaaaaagtggttcaagggtgaaggataattctgagcaaggacagggtaatgatgctaggagtaaatgtactcaaagctctgtcgttgagcccacacaaccatcttcagggtctgttgtgcttaaccctatgatgccattttggcctgtgccccctcccatggctggcccagcaactactctgaatatgggagtggattactggggtactcctgcttctgtacccatgcatggtaaagttattgcagcaccgacatcagctccttcgtcaaattcacgtgatattgttctcagtgatccgactatacaggatgggagagaactgaagagacataaacggaagcaatcaaatagggaatcagctcg

SEQ ID NO: 3495 - DNA, 384 bp, Zea mays
  Clone ID: LIB143-011-Q1-E1-B4
tacaagtctctataatgagtcatattagccggttggcccagcggtccgggcaagtccatctgctcgctcgcgccgcaactcaagcaggcagatcagtgtgagctatccattcgcagacagggagtcatcatcatgaatggaatcggttgtaatatgagcggaatggcggtttcatgctcacgtaacccaggtgcgctgctcgtcaggcagggagcgctgctggatgtggaggagttcttacagcactggtgagatggcattactacgagggactgtttcggagagcaatgcttccgcgaacatggccacctggatgagatggacgatcagatcgaagcaggcgggctgcaccgcgacgagcaggatctcttctatcaagaccat

SEQ ID NO: 3496 - DNA, 322 bp, Zea mays
  Clone ID: LIB143-011-Q1-E1-C12
ctacaccctgatgtgagtcgtagttaaagccaagtgcaagtgatcgagctcccccctcctcatcagtcgctaggcacagcgcacttgcaggatggcgcaggtctctaagacgcttctccttgtggccctggtgttcgtgtcgtcggcgggggtggagctgtgccgcgcgatcgacttcgacgagcgggacctggcgtcggacgaggcgctgtgggacctgtacgagcggtggcagacgcaccaccgggtgcaccggcaccacggcgagaagggccggccgttcgggacgttcaatgagaacgtgcgcttcatccaggcgcag

SEQ ID NO: 3497 - DNA, 414 bp, Zea mays
  Clone ID: LIB143-011-Q1-E1-D1
acaggcccctacaatgagtcatatattctttctcggggaggagccggagtccgagcaggagtggcggcgggagggaagagatcctgatctgttgtcgcagcggggaggggaggaccggaggaggaagatggctgcgcaggagcaggagcatgagcaggagaagcagcaggcgaagacgagcaccacgagctcgctcccctccagcagcgagcgctcctccagctccgctcgcaacaacctcacggaaggaggggcggagagcgacgaggagatacggcgggtgccggagatgggcggcgcgtcggcgtcggcctcgtcgggcgccggcgcggacgagcgtcccaagggggaggacggcaagcaggggcaggtggcggcgggggcgcagcctccggcgggcgggaagaaacgcgg

SEQ ID NO: 3498 - DNA, 181 bp, Zea mays
  Clone ID: LIB143-028-Q1-E1-F12
aagcaacaaggcagcagcacaagcaagaaccacacctcctcccttcgcctgtgatcatgtcgtcttgctgcggcggcaagtgcgggtgcggctccagctgctcctgcggcagcggatgcaacggctggcggtatgtaccctgacgtggagaccgccgccaccagcagcgtcaagaccacgg

SEQ ID NO: 3499 - DNA, 199 bp, Zea mays
  Clone ID: LIB143-028-Q1-E1-F2
caaacatgcaatgcatcgagctcttgaacgcaatggacaggtggttttactgggttctgcaccagatcctcgcatacaaagtgactttacaaatttggccagtaagctgcatggtgaataccatggccgagtgaagctatgtctaacctatgacgagccactgtcacatttgatatatgctggcgcagacttcattctc

SEQ ID NO: 3500 - DNA, 198 bp, Zea mays
  Clone ID: LIB143-028-Q1-E1-F5
caatgggactgctaagggccatcaggttcaggggcaagccaaaagtagaacatgctcaccacggtcccctcctactactatagtaaaggaggcagaggtgtcatcatgtaatggcttcaataagcggggttcatcagcaatggactcaggaaagcctccaaggcctgttgaatgtggtgcaggtcagagccaggctgg

SEQ ID NO: 3501 - DNA, 195 bp, Zea mays
  Clone ID: LIB143-028-Q1-E1-F6
gacccctggttggttttagtgattaatgacaacgtaatattatatgcgactaacgtgtgttttgcagagacaaatggtaagttaggtcgcatgacaggtagaagtactacaacggtgaaaacaatcccggagataagaactcgaagcgacggctaaaacgacggaacaaaaggtgaaggtctacggagtccgaga

SEQ ID NO: 3502 - DNA, 197 bp, Zea mays
  Clone ID: LIB143-028-Q1-E1-F7
caagactcacttgcatttttggcacaccagcacagaagaagaagaaaaaacaggcactgagctgagatggcgaagcacttggctgccatgtgcaggtgcagcctcctagttctggtactgctctgcttgggctcccagctggcccaatcccaggtcctcttccaggggttcaactgggagtcgtggaagaagcaagg

SEQ ID NO: 3503 - DNA, 194 bp, Zea mays
  Clone ID: LIB143-028-Q1-E1-F8
cgctcactggcaatggctaccattaccaagctcgtggcccttggcttggccgtcctcgtgagcgttgggttctccgatgcagcgagggtagttaggcttgggagctatgcgtctgccggaggaggcggcggcggtggaggcggcggctccggatcgaccggggctgctgggtacggcggtgggtctggcggtgg

SEQ ID NO: 3504 - DNA, 180 bp, Zea mays
  Clone ID: LIB143-028-Q1-E1-F9
ccccgctccgcctccactcctcgcgccgctgccgcatctcctctacaggtaagaaggagagaaagagggcgaaatggtgaagcacaacaacgtcatccccaacgggcacttcaagaagcactggcaggaactatgtcaagacatggttcaaccagcccgcccgcaagcagaggcgccgca

SEQ ID NO: 3505 - DNA, 203 bp, Zea mays
  Clone ID: LIB143-028-Q1-E1-G1
aatgaactcgcaaactacaaagatgtagtggtgatggtcacaagcaacggggggcggacgaccgtgagcaggaggagcaaggcggaagacctggaagcgcagctaaccgacctcctggtgaagatgcactcggagcacattgcacagcccaattcgtaggaccatcgagcgagcgagatggttaaattaaatcagacatgccg

SEQ ID NO: 3506 - DNA, 179 bp, Zea mays
  Clone ID: LIB143-028-Q1-E1-G10
ccaggccgaaggaaaacaatcctgaaaccaagccatgggtctgcaggtacacggctcgtcactctctaaatcgccatattctgctactcgcttgttgaagatcgaacgtttattcatctgatggtcaccaagattggttctttgtttccatttggttctgaatctccagttccgtttcg

SEQ ID NO: 3507 - DNA, 177 bp, Zea mays
  Clone ID: LIB143-028-Q1-E1-G11
gtccaccgcgccaaccccaacaagcaccaccagccactcgaggcaccgaatcacgatggagcccgcgggcacgatcgtgttcgcctccgtcggcgtcaccaacttcggcttcgacgtgttctctgcaaccgtccctgcggcaacgtccgtggaggcaggcgtctccgcggaggacct

SEQ ID NO: 3508 - DNA, 180 bp, Zea mays
  Clone ID: LIB143-028-Q1-E1-G12
ctcctcgacgtccgcctcatcgcgctcgacatgggcgcgcttgtcgcgggcgccaagtaccgcggcgagttcgaggagcggctcaaggccgtgctcaaggaggtggaagaggccgaggggaaggtcattctcttcatcgacgagatacacctcgtcctgggcgcgggcaggacggagggt

SEQ ID NO: 3509 - DNA, 198 bp, Zea mays
  Clone ID: LIB143-028-Q1-E1-G2
cgagaagagcggcggcgcgggcggacaaggagcaggcggaggaggagctgtgccaagccacaatgggtatctcacgcgactcgatgcacaagcgccgtgccaccggtggaaagcagaaggcctggaggaagaagcgaaagtatgagcttggtcgccagccggccaacaccaagttgtcaagcaataagacagtgagga

SEQ ID NO: 3510 - DNA, 202 bp, Zea mays
  Clone ID: LIB143-028-Q1-E1-G3
acaacatcaagctctatgtgcgcagggtgtttatcatggacaactgtgaggaactgatccctgagtggctgagttttgttaagggtattgttgactctgaggaccttcccctcaatatctcccgtgagactcttcagcagaacaagatcctgaaggtgatccggaagaaccttgtgaagaagtgtgttgagctcttctttga

SEQ ID NO: 3511 - DNA, 199 bp, Zea mays
  Clone ID: LIB143-028-Q1-E1-G4
aacttcctcttatctatctggcagcaactgctggtgccaggcttggtgtagcagaggaaataaagtcatgcttccatgtcggctggtctgattatgagagccctgaacgtgggtttcagtacatttacctcactacacaagattactcacgtctaagctcttcagtaatagctcacgagctgcaactaaaaaatggaga

SEQ ID NO: 3512 - DNA, 196 bp, Zea mays
  Clone ID: LIB143-028-Q1-E1-G5
gtaaaaattgtggaagtagggccacgagatggtctacagaacgagaaggacatcgtgccaacacctgtaaaggttgagcttatacgaagattggccacatctggattacctgttgtggaggcaacgagttttgtatctccaaaatgggtacctcagttagctgatgcgaaggatgttatggaagcagttcggacta

SEQ ID NO: 3513 - DNA, 195 bp, Zea mays
  Clone ID: LIB143-028-Q1-E1-G6
agatcatgctacaacagaactggatgtgaaaagtgattctttagataattctcagtctctaccttcaagcattcaggaatgtgaaccaatataccaaggtgaagagcacatacttggcaccacaaatatggtgtatgaaaatcaagagccagtgtatgagggggaggtggttcttgctgagcaggctgacaagat

SEQ ID NO: 3514 - DNA, 198 bp, Zea mays
  Clone ID: LIB143-028-Q1-E1-G7
cggacgcgtgggacaaggcagcagcacaagcaagaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcg

SEQ ID NO: 3515 - DNA, 177 bp, Zea mays
  Clone ID: LIB143-028-Q1-E1-G9
cttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactcca

SEQ ID NO: 3516 - DNA, 200 bp, Zea mays
  Clone ID: LIB143-028-Q1-E1-H1
gagtcacgcgtcagttcgttccctcctctgtgtaccggccagtaaaatccgaacccacagcgagaaatggcggcggcagcgctccgtccggcgatcctccgccgcatccgcctctccccctccccttcgctcgccctcgccgccgctgggacaggtgcatcccacccgcacgcgctggggcggtggctcgcgcggcccat

SEQ ID NO: 3517 - DNA, 179 bp, Zea mays
  Clone ID: LIB143-028-Q1-E1-H10
aagaccaccccctttttctgcttaatatataatggggcgtagttttcatgcgttttcgagaaaaaaaataaactaaagcattggcccaccacctcgacgctcatgcgagctctctctgtccctcagtattctcttctccacgtccattggtacgggttcaaagtctgcatcttcatcga

SEQ ID NO: 3518 - DNA, 177 bp, Zea mays
  Clone ID: LIB143-028-Q1-E1-H11
ccgagatggctcggactcagaaaaataaagcaacagaatatcatcttggacaactgaaggcaaaactagcaaagttgaggacacaactattagagcctccaaagggttccagcggaggtggagatggttttgaagtcacaaagtttgggcatggtcgtgttgcacttattggatttc

SEQ ID NO: 3519 - DNA, 179 bp, Zea mays
  Clone ID: LIB143-028-Q1-E1-F11
ctcggattggtccgccctccttgtgctccgccggcaatggcgtccaccgccgtcaagctcatcgacatcgcagtcaacttcacagatggcatgttcaagggcatctaccacggcaagcagtgccagcgtcgccgacatcccggccgtactcgcgcgcgcgtgggctgcaggcgtcgacc

SEQ ID NO: 3520 - DNA, 202 bp, Zea mays
  Clone ID: LIB143-028-Q1-E1-H3
accaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaa

SEQ ID NO: 3521 - DNA, 198 bp, Zea mays
  Clone ID: LIB143-028-Q1-E1-H4
cccacgcgtccggaccaattagctagcttcttctagctctagctaggctcgtctgctgcaagaaggtaacagtaacagcaggcatggaggggaaggaggaggacgtccgcctgggcgccaacaagttctcggagcgccagcccatcggcacggcggcgcagggcacggacgacaaggactacaaggagcccccgccgg

SEQ ID NO: 3522 - DNA, 52 bp, Zea mays
  Clone ID: LIB143-028-Q1-E1-H5
gggtcaacccacacgtccgctcgatctttcgaccgggcggccgtcctagggg

SEQ ID NO: 3523 - DNA, 196 bp, Zea mays
  Clone ID: LIB143-028-Q1-E1-H6
acagcaccgccctctcacatctcctctcccctcgattcatggccgccgccgccgccgcgccatcccgcaagacggagacctacaccgacaccaagcgccgcgatgacgtgcgcggcgccaatatcgccgcagcgcgcgccgtcgctgacgccgtgcgcacctcgctgggaccccgtggcatggataagatgatctg

SEQ ID NO: 3524 - DNA, 194 bp, Zea mays
  Clone ID: LIB143-028-Q1-E1-H7
cgacatggacgcggacgtgatcaccatcgagaactcgcggtccgacgagaagctgctctccgtgttccgtgagggtgtcaagtacggcgcgggcatcggccccggtgtctacgacatccactcccccaggatcccgtcggccgaggagatcgccgaccgcatcgacaagatgctggccgtgctggacaccaaca

SEQ ID NO: 3525 - DNA, 196 bp, Zea mays
  Clone ID: LIB143-028-Q1-E1-H8
tctccctctctcgctggtgcgagagcgcgcgcgcaagcaagcaagcaagcaaggagcgtcgtgtctagctagctgagcacctggttttggagcatggaggacaacggtgccgccgccgccgccgccgctcccgcgacgagcatgcctgccgagaagcgtgtggcggtcatccagggggacgcgccgccggagccgg

SEQ ID NO: 3526 - DNA, 175 bp, Zea mays
  Clone ID: LIB143-028-Q1-E1-H9
cttcacggcgctgcactttgctgctcagaattctcacctggatcttgtgaagtaccttgtgaagaaaggtgttgacgtcacagcaaagaccaaaggtggtcagacagctctacatgtcgctgaggatgatgaagtgcgtgcgttcctgaaggagtgcgagcaatccttgaagaag

SEQ ID NO: 3527 - DNA, 259 bp, Zea mays
  Clone ID: LIB143-029-Q1-E1-A1
agaggtcaaggtcgaggtcgaggacggcaacatgctggtcatcagcggccagcgcggcagggagaaggaggacaaggacgacaagtggcaccgcgtcgagcgcagcagcggccagttcgtcaggcgcttccgcctgccggagaacaccaaggtggatcaggtcaaggctggcctcgagaacggcgtgctcacggtcaccgtgcccaaggcggaggagaagaagcctgaggtgaaggctattgagatctctggttgagca

SEQ ID NO: 3528 - DNA, 178 bp, Zea mays
  Clone ID: LIB143-028-Q1-E1-B9
cacaaatgtttataagaagggattcaacgtggagtcatttgggcccgacaggaaggagttgagagctactcttccgtaggttgggagaatggcagtcctcaatatgatatgatatccaggagaaataaacattgatgaagaaggcctcagacattgctggaattcttttgttggcaaa

SEQ ID NO: 3529 - DNA, 205 bp, Zea mays
  Clone ID: LIB143-028-Q1-E1-C1
acattcgcgcaaagacgccaagcccacccagcgaaatctctccccaaactacccctcgccagcgcccggcgatgtgcccaacgaagcccgatcgccctggccaggccgccgccggctccggcgagaagagctggcgggaggaggccgtggccgcctgctcgctgcggctggtcgacctggaccgtggcaccaacggctgggcctc

SEQ ID NO: 3530 - DNA, 178 bp, Zea mays
  Clone ID: LIB143-028-Q1-E1-C10
gcagcttctgcttgctctggggggaaggagagagagagagcgagagagatctagtagagaggctagctaggtggtcctcgaacgaagatgttggcggtgttcagcgggcaggtggtggaggtgccggcggagctggtggcggcgggcagccggacgccgtcgcccaagacgaaggcgt

SEQ ID NO: 3531 - DNA, 177 bp, Zea mays
  Clone ID: LIB143-028-Q1-E1-C11
tgcggcggcggctaccggatcgtctgcgaggaggacccctcctacgcctgcgccatcatgtgattcgtttattatcaatatcatcccttgatgagtgtaccgtccgtgtgcgtaccatggccttaattaccattatacccaaccccaccctaaaaaaaaccccagtatgtcgtctca

SEQ ID NO: 3532 - DNA, 178 bp, Zea mays
  Clone ID: LIB143-028-Q1-E1-C12
ctctgttcgacatgcattagctccgtacctggagtacagaggaatcttcagcgttgccctcatctcctgagagcactccttcagatgctggaaaaacattgtgattcgatctcccagagattatcacctgagcagaatggttaaatcgtccagttagcagcctttgatgccgcatttg

SEQ ID NO: 3533 - DNA, 199 bp, Zea mays
  Clone ID: LIB143-028-Q1-E1-C2
cgagcactcgacaccagcgtctaacgggatggcgagcctgaccatgccgccggtgccggcgtggccgcggcaggacgccatcgacctccacaaagcattcagagggttcggttgcgacagcacgacggtgaccaacatcctggcgcaccgcgacgcgacgcagcgctcgctgatccagcaggagtaccgggccgtgttc

SEQ ID NO: 3534 - DNA, 202 bp, Zea mays
  Clone ID: LIB143-028-Q1-E1-C3
gtgagagtgagagccatgacggagctgttcgacacggccgtgaccagcctcctccacctgccggaggtgctggaccgcctcgccgccgcagacagcgaccggcggtcggccggccaccatgcggcgcacggccacgggcacggacgcgtccactggctcggcggcggctgcggagctccggtggacatcgtggatagccccc

SEQ ID NO: 3535 - DNA, 198 bp, Zea mays
  Clone ID: LIB143-028-Q1-E1-C5
gttgggaataaactactacacctcaatattctccaaacatatcgacatctcaccaaaatactcgcctgttctcaacactgacgacgcctacgctagtcaagaaacgtatgggcctgacgggaaacccattggtcctcctatgggaaatccgtggatctacttatacccagaaggcctaaaggatatccttatgatcat

SEQ ID NO: 3536 - DNA, 194 bp, Zea mays
  Clone ID: LIB143-028-Q1-E1-C6
cgcagttgatccagtacacaattgcagagagctagaagacacaagaccatggcgtccaagcgactcctcgtgctagctctcctgctcgccgccgttttccttgccgtctcaggagcagctaacgacgaccaagcccaaccgaggaaggacggcggcgagaacaaagccgacgtgcaggactaccgtggcggcgg

SEQ ID NO: 3537 - DNA, 194 bp, Zea mays
  Clone ID: LIB143-028-Q1-E1-C8
accagccgccgtcatgtcgaagcgaggtaggggaggttcggctgggaacaagttccgcatgtcactgggtctaccggtggcggccacggtgaactgcgcggacaacacgggcgcgaagaacctctacatcatctccgtcaagggaatcaagggccgcctcaaccgcctcccgtccgcctgcgtcggcgacatgg

SEQ ID NO: 3538 - DNA, 179 bp, Zea mays
  Clone ID: LIB143-028-Q1-E1-C9
ctcacacactgcaacagccaagtgcaagtgatcgagctcccccctcctcatcagtcgctaggcacagcgcacttgcaggatggcgcaggtctctaagacgcttctccttgtggccctggtgttcgtgtcgtcggcggcggtggagctgtgccgcgcgatcgacttcgacgagcgggact

SEQ ID NO: 3539 - DNA, 201 bp, Zea mays
  Clone ID: LIB143-028-Q1-E1-D1
cagcctggatgaccccaacaccttcggcaaccggatccaccgcatgctcaaactcggtctgagcatcgatgaggacgagcctgttgaggcagaggctgagatgcctcagcttgaggacgacgctggtgaaagcaagatggaggaggtcgactaagtgtcgcatcgcatgcttgccgtttatcttatccctagctaagctac

SEQ ID NO: 3540 - DNA, 177 bp, Zea mays
  Clone ID: LIB143-028-Q1-E1-D11
atccaggacaactggcgcatcctcgacttcttctcgcaccacccggagagcctgcacatgttctccttcctcttcgacgacgtcggcatccccgccgactaccgccacatggacggatccggggtgcacacgtacacgctcgtcagccgcgccggcaccgtcacctacgtcaagttc

SEQ ID NO: 3541 - DNA, 178 bp, Zea mays
  Clone ID: LIB143-028-Q1-E1-D12
cgcgcacccggttccgcgtgcctttccccacctactctcgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatctt

SEQ ID NO: 3542 - DNA, 196 bp, Zea mays
  Clone ID: LIB143-028-Q1-E1-D3
attcctttcgtgggcagctgagcctgaaatggacgagagaaagctgatgggagtgacatggatctttcaacgatcactaccgcttctcgaagctgccgacgatcgccgcatgaggtggtcagtcctgaagtcgcgaaagctggtcctggatgtcgtcaactgaggactatcattaaccttttttgattgaaatatg

SEQ ID NO: 3543 - DNA, 214 bp, Zea mays
  Clone ID: LIB143-028-Q1-E1-D4
gggtcgacccccacgtccggtggtcaatgagcacaggtatgtcccagacacatgatatgtgctccatgacattgaccaggaggccaaggaacaggcattgctgtaccacagtgagaggctggcaattgcttatggtctgattagcactccagcacgaactccacttcgtatcattaagaacctgaggatatgtggtgactgccacaacgccatc

SEQ ID NO: 3544 - DNA, 197 bp, Zea mays
  Clone ID: LIB143-028-Q1-E1-D5
cggacgcgtgggcggacgcgtgggcacagacagcagccacagcggagcttaattagcaatcattgactatgggtgcgctcttgccatggctggcatggttgctcgtctccctcgtcggcgtctacctcctcggccatctcgtgcaggcccgtcgtcgtcgtggtctaccgccgggaccccacccgctgcccatcatc

SEQ ID NO: 3545 - DNA, 198 bp, Zea mays
  Clone ID: LIB143-028-Q1-E1-D7
attcctttcgtgggcagctgagcctgagatggaagagagaaagctgatgggagtgaaatggatctttctactatcactagcgcttctccaagctgcctactaccgccgcatgaggtggtcagtcctgaagtcccgaaagctggtcctggatgtcgtcaactgaggactatcattaccctttttttattgaaatatgtt

SEQ ID NO: 3546 - DNA, 194 bp, Zea mays
  Clone ID: LIB143-028-Q1-E1-D8
gtggtcaatgagcagaggtatgtcccagacacaagatatgtgctccatgacattgaccaggaggccaaggaacaggcattgctgtaccacagtgagaggctggcaattgcttatggtctgattagcactccagcaagaactccacttcgtatcattaagaacctgaggatatgtggtgactgccacaacgccat

SEQ ID NO: 3547 - DNA, 179 bp, Zea mays
  Clone ID: LIB143-028-Q1-E1-D9
cggacgcgtgggtgcgcctccatttcggcctctgtcccttgcaagttcaatctcacctccaaccatgggtaaagagaagtcccacatcaacattgtggttattggccacgttgactctggcaagtcgaccaccacaggacacctgatctacaagcttggaggcattgacaagcgtgtga

SEQ ID NO: 3548 - DNA, 196 bp, Zea mays
  Clone ID: LIB143-028-Q1-E1-B8
acgagaactgcacggtctacatcgacgccgcgcccggtaaggacgaactggtctacagggtggaccggagcggcggtctggtgaacgctgagacggggatgaagtcggacatcctgatccaggtccccaccagctccaccaggagcgacgctgcgcaggccgtcaagaagatgaggatcatggaggaggacgagga

SEQ ID NO: 3549 - DNA, 203 bp, Zea mays
  Clone ID: LIB143-028-Q1-E1-E1
ctagaactagtacgtagatccaacactcgggacgaaattaaaagagacgacgcacatcaaccagcaggcatcgcgcggtcaccaccatggcggcgcaggagggcggcatgaggctggtgtcgcacccgatcgcggcgcacgacgggcggctgccgcggcagtacacggcggaggggcagggcgccaagaaggacatgtcgccg

SEQ ID NO: 3550 - DNA, 176 bp, Zea mays
  Clone ID: LIB143-028-Q1-E1-E10
cctaccgctgctctcgtcaccatctctccgactcatccctctgtcctcacaagccgccgccggccaagtcctgtccttctcccttgtctggttcggatcgtcgttgctagccaggtgctggatccgtagcggcggcggcggccatggacaagagcatgctcggcgacctggacggc

SEQ ID NO: 3551 - DNA, 176 bp, Zea mays
  Clone ID: LIB143-028-Q1-E1-E11
cgagcgagcgagcgagccaccgcccgagagagagagagagggagagggagagtggggattcaagtttcaaactcactatcgaggggggataggaaggtggtcactcatcggtccacagctagctcgtcgccccccatggctgactggggccccgtggtgatcgcgacggtgctgtt

SEQ ID NO: 3552 - DNA, 179 bp, Zea mays
  Clone ID: LIB143-028-Q1-E1-E12
aagcaacaaggcagcagcacaagcaagaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacg

SEQ ID NO: 3553 - DNA, 197 bp, Zea mays
  Clone ID: LIB143-028-Q1-E1-E2
cattccccccgccccaacttgtcaggactcaagaggctcccctcctccctcgccgcggaacacgcgcgccgtcgtcgccagcccgggttcatttctccgttccttggtgcggtggtagccgagcgctccggccatggcgttctatcggggcctcaccgcagtctcgagactgcgatcacgcatggcgcaggaggcca

SEQ ID NO: 3554 - DNA, 217 bp, Zea mays
  Clone ID: LIB143-028-Q1-E1-E3
ggcccgggtcgagtacaggtcggagagcacaggggggtcgtgttccagcccttcgaggagatcaagggggagctcgcgctcgtgccccagtccccagacaagtcgctcgcgcgccacaagttcgtcgatgactgcgaggccgccctcaacgagcagatcaacgtggagtacaacgcctcgtatgcataccactccctcttcgcctatttcgaccgcg

SEQ ID NO: 3555 - DNA, 218 bp, Zea mays
  Clone ID: LIB143-028-Q1-E1-E4
gggccgacccacacgtccagcagcaacgaacacgaaccttggcagaacgaagctgaagtagttcgctgtgaacccagtatggcaaacgcgccgaggatcctggccctcggcctgctagcgctcctgtgcgctgccgccggcccggccgccgcgcagaactgcggctgccagccaaacttctgctgcagcaagttcggctactgcggcacgaccgacgc

SEQ ID NO: 3556 - DNA, 121 bp, Zea mays
  Clone ID: LIB143-028-Q1-E1-E5
gggtcaaaccaaacttccgatactacgtgcatgcccttgactatcggtatctatgatgaaccactcacaccatcgaacaggtatctcgcggtcaacacgatcgggcgagcagggacggcgg

SEQ ID NO: 3557 - DNA, 199 bp, Zea mays
  Clone ID: LIB143-028-Q1-E1-E6
ccacattcgccccgccccaacttgtcaggactcaagaggctcccctcctccctcgccgcggaacacgcgcgccgtcgtcgccagcccgggttcatttctccgttccttggtgcggtggtaaccgagcgctccgggcatggcgttctatcggggcctcaccgcagtctcgagactgcgatcacgcatggggcaggaggcc

SEQ ID NO: 3558 - DNA, 198 bp, Zea mays
  Clone ID: LIB143-028-Q1-E1-E7
cagataaggaagaggaggagggcaggatgtcgcaccgtaagttcgagcacccgaggcacggctccctcggcttccttcccaggaagcgctcctcccgtcaccgcggcaaggtgaagtcattccctagggatgaccccaagaagccttgccatctcactgccttccttggctacaaggctggcatgactcacattgtcc

SEQ ID NO: 3559 - DNA, 194 bp, Zea mays
  Clone ID: LIB143-028-Q1-E1-E8
gtcagtccgatatctattcttttgggattgtggtcttgcgccttttgacaggaaggcctcctgatggcataaagaagattgtggaggatgccatggagaaaggcgacctgaactcagtagttgataccttggcaggagactggcctgctttgcacgtccagcagttagcactccttgctcttagttgcacagag

SEQ ID NO: 3560 - DNA, 201 bp, Zea mays
  Clone ID: LIB143-028-Q1-E1-F1
ggatttaggaccacaacgaccgcatcgagaaaggcgacgagcccatccgatcgctctccgccgaacgccgtgcatttttgctctgttcgttgtatcgtgtgcaacgtaccccgcgccatctagatcggtctcgatcacacatgcatatgatgctatgcaggcattatataatgttagcagatgatgatctataatgttagc

SEQ ID NO: 3561 - DNA, 215 bp, Zea mays
  Clone ID: LIB143-027-Q1-E1-G7
aaaaaaaaaaaaaaaaaaaaaaaaaaaaaaaaaaaaaaacaaaaaaaaaagaaagtagaccaaaatgaatagaaggctgaattatacgtacgggggcatatgtttcctcggtttcaatgtgtccggtcttcaattgagtgaccgtctttctattttgtcttgatcgtgttccctcttgcttttcgctgtcttcttgcctttctgcgacttccccg

SEQ ID NO: 3562 - DNA, 214 bp, Zea mays
  Clone ID: LIB143-027-Q1-E1-G8
gcagaacggcatcaacgagaacaacaccatcatcgaccggcagggcctgatgaacatccacatgccggcctacctggacgcgctccgcaagggcgtctccaccgtcatgatctcctactccagctggaacgggctcaagatgcacgccaaccacgacctcatcacaggcttcctcaagggcaggctcaacttccagggcttcacgatctcggat

SEQ ID NO: 3563 - DNA, 182 bp, Zea mays
  Clone ID: LIB143-027-Q1-E1-G9
ggcatctagcatcaccactggcgtgaacagcaacactgaaagcagcacaagcattgagatctcaggcgctgctgcagcctctacctcgatgaccgctactaccgcagatacccaccgtgggtaccctatcacccgtgacccaaaacactaagaaccatgatgaagggttcgtatatcagggc

SEQ ID NO: 3564 - DNA, 184 bp, Zea mays
  Clone ID: LIB143-027-Q1-E1-H10
agctctgtcttcccgatctcttctctctctctcgtctcccacatctccagcccttcgccctcttctcggcccgaccttgacggtgttccaccatctcctaccctcttcttttcccgcccgcgccatccctttctccgctgtagccactgcaagccccgcgcgacgcacacggcagtggtccacg

SEQ ID NO: 3565 - DNA, 184 bp, Zea mays
  Clone ID: LIB143-027-Q1-E1-H11
acccacgcgtccggcatcgatccgccattgctcaccgcacaagtgcacgctcacctcacacacgcagctaagtagctaacgccgtaggcgagaacaagaaaaggctcgacatggccgaggagaagaagcagggcctgcagctgctggacttctgggtgagcccattcgggcagcgctgccgcaa

SEQ ID NO: 3566 - DNA, 185 bp, Zea mays
  unsure at all n locations
  Clone ID: LIB143-027-Q1-E1-H12
aggcccttttggaggtggtggcagcagtaggggcagaaggcagcgaaggggagaggatgtggttcatcctctgaaggtttctctggaggatttgtacaatggcacatcgaagaagctctctctgtcccgcagtngttctctgctccaagtgcaatggtaagggttcaaagtctggagcttcatcg

SEQ ID NO: 3567 - DNA, 219 bp, Zea mays
  Clone ID: LIB143-027-Q1-E1-H2
acggaaaactctgttcaaccacccgccgagttcagcagcactctcctccgccctcttccaggtccagcagagattgggggcgcgtgggcatcggagattgcctcgggagcgcgtttcctggtcaactaaggccggcatgaagggctgctcagagcgcttgctgtttctgctgctgctgctggcatcgtcgtcgttactgtccgctgtgattgccgcgca

SEQ ID NO: 3568 - DNA, 263 bp, Zea mays
  Clone ID: LIB143-027-Q1-E1-H3
ggttgccctggcggtactagtctagaattcccgggccctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatcccc

SEQ ID NO: 3569 - DNA, 238 bp, Zea mays
  Clone ID: LIB143-027-Q1-E1-H4
ccgggccgacacaaacgtaagaggcgttcccctcctccacgcacccttctcccctccagatccaggattgccgggctccttgactcgttacctcgcgcgccctcgatgagctattttgattcgattcattgagagatcagtttgcttcatgttgcgctggcttaaatgtgaatgccggattcatcgtcttacggcttgaatcgagctgggaggctgtggttctgagcacgggaggtac

SEQ ID NO: 3570 - DNA, 209 bp, Zea mays
  Clone ID: LIB143-027-Q1-E1-H7
cgagtctaggacattcaaggagagtgacccgtgccaaggacgagaactgtgcgtcaactgtcagcatcggtggctacactacagccttctgcatcgcagtcctacaacaccagttccagccgctgccggaagagcgcgaataatcaatcaatcgatcgatcgagtttgcgatcgtgttacctcctaaataaaagttgtacacgcgaaga

SEQ ID NO: 3571 - DNA, 214 bp, Zea mays
  Clone ID: LIB143-027-Q1-E1-H8
cgccacgtcaacgctgagcgccgcctcgaggaatggaaggccgaggccggggaccgccatctagaaaagctcgccgagaacttcatcaagaagaaggccaaggaggcgggccgccgcggcggaccctcagctgctgaggtggacaagtacctggagaagtaccgcaaggatgctgagatctgcgtcaacgcggttgaggaatccgtacgtgcat

SEQ ID NO: 3572 - DNA, 182 bp, Zea mays
  Clone ID: LIB143-027-Q1-E1-H9
gggaccggccggacctcgcaaccgtcgtactgccggagctcaaccggttaaggaacctcggccacgcgtacgaggcacgcatgagcgccgtcgggaccaacagtggaagtggcaaaagtaatgaccaggtcagcgggagctcgccgacggcgggtggttcatggagaacggcggagagctaa

SEQ ID NO: 3573 - DNA, 204 bp, Zea mays
  Clone ID: LIB143-028-Q1-E1-A1
aaatgctttccactcgtgctgtgagtgaaatatatggaagagaattggtggacctgcggaaagaaattcgatgggagttccttaatacccttttctctgtttcagaagctgtcatgttcatgcagatggttgacaagttagatcagggattggtgccagctgaacttgggccactggattacaaaggactgtacaatgctgttt

SEQ ID NO: 3574 - DNA, 179 bp, Zea mays
  Clone ID: LIB143-028-Q1-E1-A10
ctcgacgacgacattctcaactctgaaacggcgatgtcacggctactcccgcccatgctctctcctttaccggcgctctcgctgccgccgccgcttcttcctcgcatccacatccgcacgtcggcgggtgagaggcggtgcggcggagaacgcggcggcgtccgggacgacggcgaggg

SEQ ID NO: 3575 - DNA, 176 bp, Zea mays
  Clone ID: LIB143-028-Q1-E1-A12
cccacgcgtccggcagcgatccgaagctcaatcaattcactcaaacctcttccccaaatcttcgattagattctcgttgacaagaagactagaaccgaacctgaccatgtcgctgatccgccgcagcaacgtgttcgatcccttctccctcgacctctgggacccctttgagggct

SEQ ID NO: 3576 - DNA, 119 bp, Zea mays
  Clone ID: LIB143-028-Q1-E1-A2
catgaactcaaaaataaaccaaacaaacagccaaaaggacatggccggctctccgtctcctctctctctcacacacacctctttttgtttgcaaactgtgttacgcatgcgctgcaggc

SEQ ID NO: 3577 - DNA, 203 bp, Zea mays
  Clone ID: LIB143-028-Q1-E1-A3
acttccttggcagggcttgaaagcagccacaaagaaacagaagtatgacaaaataagtgagaagaagctttcgactcctattgaggctctatgtaaatcccatcctgtggaatttgcttcctatttccactactgccattctctgacatttgatcagcgtcccgattatagtttcttgaggcatgtctttcgagaattgtttg

SEQ ID NO: 3578 - DNA, 199 bp, Zea mays
  Clone ID: LIB143-028-Q1-E1-A4
atcaaagggcatttcctcagccttgataagtcgtatggaagcaagtttgatgaattggtagagaagcagaaggcattagaagaaaagaaagctgaagcttgtaggttgattgcagagaaagaggctgatatttctataaaagagcgtgcctccctgaatcagcttcaggagctaagggatgctgctgtctcttctctag

SEQ ID NO: 3579 - DNA, 201 bp, Zea mays
  Clone ID: LIB143-028-Q1-E1-A5
ctttttgttcctcgcgccgccgccgccgccgccgtgacggaaggaagaggaggagcaaggagcacgacgcgatgggccactccaacgtgtggaactcgcaccctaagaactacggccctggctcccgcgtctgccgggtctgcgcgaaccctcacggtctgatcaggaagtacgggctcatgtgctgcaggcagtgcttca

SEQ ID NO: 3580 - DNA, 198 bp, Zea mays
  Clone ID: LIB143-028-Q1-E1-A6
cacaagcacgacgacggggcacacgagctcacgggtgatggcgaacgagggcgtcgcggccgagcgggcggtcaaggcccctccaccggagacggagagcatcgtgtggagggaggacaaggggaggttccagacgcccgacggcgaggccttccttcagtaccgcctcctcgacggccgcggggcccccgctgcggc

SEQ ID NO: 3581 - DNA, 192 bp, Zea mays
  Clone ID: LIB143-028-Q1-E1-A7
gggtcaacccacacgtccgcacaagcactacgacggggcacacgagctcacgggtgatggcgaacgagggcgtcacgggcgagcgggcggtcaaggccgctccaccggatacggatagcatcgtgtggagggaggacatcgggaggttcgagatccccgacggtgaggccttccttcagtagcgcctcctcg

SEQ ID NO: 3582 - DNA, 212 bp, Zea mays
  Clone ID: LIB143-027-Q1-E1-G6
gaaaaaagaccgtcggttcagccgctacagttgcgattcaaaaccagacgcagtgctctctttcaccaggctcaacttctaataaaatgcaagtccctttcaaccatctcatcctgtagggttataaattaagtaccaacatgcatcagtttacagcagccacttccttcagtgagttcactgtcttcaggacttcttcccccatccgcttg

SEQ ID NO: 3583 - DNA, 196 bp, Zea mays
  Clone ID: LIB143-028-Q1-E1-A8
ggattcaaacccttcgatcccaaatctgccctgcacgcctcgccgccggccacacccccggcggtcgtcgccctacccgcccttctccttacctctaaccccgccggagcccaacacctccccaccatgccgcgaaacttccgcaagcggggcatcgagcaggacactgacgaccgctccgacgacgaggacactc

SEQ ID NO: 3584 - DNA, 178 bp, Zea mays
  Clone ID: LIB143-028-Q1-E1-A9
cgggcttcgcccatggcgggacggaggtggagggcaagcgcgagatcgccgccttcttcgcgcacgtcacgcacgagaccggacatttctgctacatcagcgagatcaacaagagcaacgcctactggcgacgcaagcaacaggcagtggccgtgcgcggcggggcagaagtactacg

SEQ ID NO: 3585 - DNA, 206 bp, Zea mays
  Clone ID: LIB143-028-Q1-E1-B1
actcactcactcacagtcgccgccgctgcccagtgcccactgctcgccgctagaggaatctgagagagagaggggaaagggcgaaggaggcgcaggcaggcatgggctccccttcctccctccccgccgcggcggcgctcgtgctcctggccctgctcgccggagcccagtgccgcgaggcccagttcgacgccgcggacgccggc

SEQ ID NO: 3586 - DNA, 180 bp, Zea mays
  unsure at all n locations
  Clone ID: LIB143-028-Q1-E1-B10
cgaactcaatgatggaaaaccaagaaagattaagaatgcaaggccttattcttttactctagaagaagacaccacctcatatggcacttactttagaggtggtattgtcacacaggtgaagccaccanaaggttcttaaattcaaaaccttgaaggatgcaatcaaggagccaggagaac

SEQ ID NO: 3587 - DNA, 180 bp, Zea mays
  Clone ID: LIB143-028-Q1-E1-B11
agatcctcaaggtcatccgcaagaacctggtcaagaagtgcatcgagatgttcttcgagatcgcggagaacaaggacgactacgccaagttctacgacgccttctctaagaacatcaagctgggcatccacgaggactcgcagaaccgcgccaagctcgccgacctcctgcgctaccaca

SEQ ID NO: 3588 - DNA, 201 bp, Zea mays
  Clone ID: LIB143-028-Q1-E1-B2
gctaagcaagtgccaaccaacgagtagcaggaaacatgtctccgcccgtcaagatcctcggccactacgcgagcccgtactcgcaccgcgtcgaggccgctctgcggctcaagggcgtgccgtacgagctggtccaggaagacctgggcaacaagagcgagctgctgctcgccaagaaccctgtccacaagaaggtgcccg

SEQ ID NO: 3589 - DNA, 201 bp, Zea mays
  Clone ID: LIB143-028-Q1-E1-B3
attcattcttgttacaagcatatggaagagcagttcctgtatatgttccagtctacttagtccctgcacttgtagttcataggcagcatctcatgaaaaggccttactcaattatagggaagagttttctaggagtagcaagatctagtctgtttctctcagtatactgtgcatctgcatgggcttggacctgcctgcttt

SEQ ID NO: 3590 - DNA, 200 bp, Zea mays
  Clone ID: LIB143-028-Q1-E1-B4
cccacgcgtccgcccacgcgtccgcccacgcgtccgcccacgcgtccgcggacgcgtgggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccac

SEQ ID NO: 3591 - DNA, 201 bp, Zea mays
  Clone ID: LIB143-028-Q1-E1-B5
ccgacgcctccggggaagctccccatcatcgggcacctccacctcatcggctcccacccgcacgtctccttccgcgacctccacgccaagtacggccacaacgggctgatgctggtgcaggtcggcgccgtgcccaccatcgtggtgtccacgccgcaggccgccgaggccgtgctccgcacgcacgaccacgtgctggcg

SEQ ID NO: 3592 - DNA, 200 bp, Zea mays
  Clone ID: LIB143-028-Q1-E1-B6
taagcatgtgccaacgaacgagtagcaggaaacatgtctccgcccgtcaagatcctcggccactacgcgagcccgtactcgcaccgcgtcgaggccgctctgcggctcaagggcgtgccgtacgatctggtccaggaatacctgggcaacaagagcgagctgctgctcgccaagaaccctgtcgacaagaaggtgcccgt

SEQ ID NO: 3593 - DNA, 412 bp, Zea mays
  Clone ID: LIB143-006-Q1-E1-H6
aagacactcaaatctgatggtattgctgggctttaccgtggatttaacatatcttgtgttggaattattgtttatcgtggcctgtatttcggactttacgattctatcaagccagttgtcctcactggcagcctccaggacaacttctttgccagttttgctctgggttggctgatcaccaacggtgctggtcttgcatcttaccccattgatactgtccgcagaaggatgatgatgacttctggtgaggctgtcaagtacaagagctcattggacgcattccagcagatccttaagaaggaaggccccaagtccctgttcaagggtgctggtgctaacattcttcgtgccattgctggcgctggtgtgctttctggctacgaccagctccagatcctcttcttcggaaaga

SEQ ID NO: 3594 - DNA, 464 bp, Zea mays
  Clone ID: LIB143-006-Q1-E1-H7
ccacgcaaccgcatcgcgaccgccaaagcccgcgactttcagcctacggaggccacatctggccgcgcgggccgccgctggcaacgcacccacgtccccggtccgcgaggtcgtcactgagctcgacgcggtcgccggcttcagcgagatcgtgccggacaccgtcgtgttcgatgatttcgagaggttcgcacccacggcggccacagtgagctcgtcgctgctgcttgggatcactgggctcccagacactaagttcaagagtgcgatagatactgcactggcagatggtgagtgcaacgcactggagaaggctgatgacatgatgtcctgttacctcaccaaggctcttgcatatgttggcgctgaactggctcatcaagtccctgggagagtttcgacggaaatagatgctcggttagcttatgacacccagggcataatccacagggtacatgaactgt

SEQ ID NO: 3595 - DNA, 370 bp, Zea mays
  Clone ID: LIB143-006-Q1-E1-H8
ctccaccaccccgccgagctccgcccccatcgtgccgacggatctccaacccagccaggagcttcccctctcgctggcggatcccccaccctagcaggagctcccctctcccgtcggcggatcccccatcccgctaggagctcagtccgggccactgacggcttcaccaacgaagccgccaccacgctgccagcgccaggttcacccccacctgcgcatcccgctagtagtggaccccacggccaggatctcggcacgcccccgacactgccagccccccacccacccatgctggacggtcgaaggattcgaccccacgcaatcatgcattgctttgacttatcaatgcaacgtttaatcctaatgcatg

SEQ ID NO: 3596 - DNA, 439 bp, Zea mays
  Clone ID: LIB143-006-Q1-E1-H9
acccgtccgaaaccgtcacctgccatcaggcggtggtgaacaatctggatgacgcgcacgagcagatcgacacggccattgccacggcactgacggagagcaagcccgtgtacctcagcatcagctgcaacctccctgggctgcctcatcctaccttcagccgcgacccagtgcccttcttcctcacccccaggacgagcaacaagatggggctagaggctgcagtggaggcaactgtcgaattcctgaacaaggcggtgaagccagtccttgtcgccggccccaaactgcgtgtggcaaaggcatgaaaggcatttgtcgatatggtagatgccagtggctatgcctatgccgtgatgccatcggccaagggtcttgtgccagagactcacccccacttcatcggcacctactggggcgccgtcagcaccgccttctg

SEQ ID NO: 3597 - DNA, 384 bp, Zea mays
  Clone ID: LIB143-011-Q1-E1-A10
tgagtcgtattaaacaaaacattggtgaaagggctgcatctgaatggcttttcataattccttggggccttcataagtcacttaattatatagcgaagaagtacaataatccaacaatttatgttactgagaatggcatggatgaagaggacgatcaatccgcaacgcttgaccaggtcctaaacgacacgacgagggtcggttacttcaaacggtacctcaattcagttgcgcacgcgatcaaggacggagctgatgtccgcgggtactttgcgtggtcgttcctggacaacttcgagtgggcaatgggctacaccaagaggttcggcatagtctacgtggactacaagaacgggctgtccatgcacccgaaagcatcggcgc

SEQ ID NO: 3598 - DNA, 383 bp, Zea mays
  Clone ID: LIB143-011-Q1-E1-A11
gagtcgtatacgatcagagcaggagcaggcaacgcgcaccgaaatcttccaatccacaagactcgctacttcgcagttggcagactcgcccgcagcgagccgctagcaaccaagcagaaatgtcgctggtgaggcgcggcagcgtgttcgacccattctccgtggacctcttcgaccccttcgacagcgtgttccgctccatcgtgccgtcgtcgtcgtcggcggcgggggcctccgagaccgccgccttcgccagcgcccgcatcgactggaaggagacgcccgaggcgcacgtgttcaaggccgacctccccggcgtgaagaaggatgaggtgaaggtggaggtggaggacggcaacgtgctgctcatcagcgggcagcgc

SEQ ID NO: 3599 - DNA, 388 bp, Zea mays
  Clone ID: LIB143-011-Q1-E1-A7
ccaaatgcaagtgatcgagctcccccctcctcatcagtcgctaggcacagcgcacttgcaggatggcgcaggtctctaagacgcttctccttgtggccctggtgttcgtgtcgtcggcggcggtggagctgtgccgcgcgatcgacttcgacgagcgggacctggcgtcggacgaggcgctgtgggacctgtacgagcggtggcagacgcaccaccgggtgcaccggcaccacggcgagaagggccggcggttcgggacgttcaaggagaacgtgcgcttcatccacgcgcacaacaagcgcggcgaccggccctaccgcctccgcctgaaccggttcggcgacatggggcgggaggagttccggtccacgttcgccgactcccgcat

SEQ ID NO: 3600 - DNA, 276 bp, Zea mays
  Clone ID: LIB143-011-Q1-E1-A9
ttgagtcgtactacacgacgcagtaatatgtatcactttgggatcttcatagatactataacaatggcgaacctaacgattcttttggcttaatggccggctatgttcaggatgagggctaaagttgctttgcgataaaaaagtgttgaatttggatagccagaagattcatttctcgtacaggagacctttacccctccagagtattcccattcacatgacaatcccggttctggtctaaaacggtacactcgtatttgaatctcgatacattgt

SEQ ID NO: 3601 - DNA, 455 bp, Zea mays
  Clone ID: LIB143-006-Q1-E1-H5
ccacgcaaccgcagatccgacgctccatcgagtgtgtgcggtggcggcgggaggagacgaaagagaaatatgcaggcggtggcacgggcggcgcgtgggctcgcggctgcggcggtggcacgggcggcgcgtgggctcgcggctgcggctgcggctgcgcggccgtcggtgatggaggcagggcacagcgggcaggtgcagcaagctcggggcatcgtggtgcaggtgagggacgggaatctggagccggcgctgtcgatcatggagcgcaagatgcggtccagcggcacggagcgcctcatccgggcgcacacccttctcgacatcaaggactcggagaaccgcttgctcgcgcttaaggagcttatgcaacgtgtccgttcccaggagctcatgctccgcaagatcgtcatcaagcagatcagaaccatggaggaggataatgcagactggtg

SEQ ID NO: 3602 - DNA, 429 bp, Zea mays
  Clone ID: LIB143-006-Q1-E1-G1
gtccggacagaaatgcagaatgctgtcgatgaattggagctgatgtcataatgacatcagcatcttgcagacacggatctggacgctgctgtgaggcactaaataagcttgatacgcactatgatattgttgtcaatattcattgagatgagcctctcattgctccagagataatagatggtgtacttatgtcactgcaccgagctcctgatgcattctgcagcacagctgttacttcactgaaaccagtacatgcattcgatacacacagggtgaagtgtgttgttgataatctgggctacgctctatacttttcaagagggctgattccattcaatagatcagggaacgccaatccaaaatatccatatcttcttcatcttggaatcgctggctttgattcatcatttatgaagatatatctacaac

SEQ ID NO: 3603 - DNA, 421 bp, Zea mays
  Clone ID: LIB143-006-Q1-E1-G10
gtccgacaagttatagatcgcgagcggctgcccttttttttgtttgttttgttttagactgcacacacatgtatttatcagaggagtttctagtcacactgcgcagtatcgatgtgatgcattgacttgtaggaagactaataaacctcctctgctggtgaccctgacaagtctaaacaacagtaactaataggctactaaagttaactagatgttttagactaccacatgcattgaacattcaacctccagaagttcattgtttcagccctacagggctcacaggagtcccagccatacaggactatggctgctccgtgttgtcctcctcttcccactccacgttcttcccatcctcgccatacagccagcagcaccaagcgaagtacacgaagttcgccacgccgtatcccgtgagcag

SEQ ID NO: 3604 - DNA, 424 bp, Zea mays
  Clone ID: LIB143-006-Q1-E1-G11
gtccgcaagaccatgggcacattgaagcagaccgtggaggtagaaaaacaggagaggcaaggtaaggaggtcttagtggttcatgaattggatgagttgaatgaggattctgggtcactggatgagccgccgggttggcttcctgacggttggactatggaggtttgtcaagaagacaatggctccatctacaagtactacacttccccaatgtccggatacatgttcacatcaaagatggagacattgcattatcttttctcaggggtggaagaacgtatgttggagttgcaggcaagcgccgaggacaacgagcttcatgagtcacatacatggcttccacgtgggtgggtgattgaagtcagagccggtgggaagaaaatggacaaaatgtacaagttttatgttcaactacctactgggc

SEQ ID NO: 3605 - DNA, 424 bp, Zea mays
  Clone ID: LIB143-006-Q1-E1-G12
ggaataacaataagtttaaccaacaaaaccggaatcccaattgcccggcaaggtcccctaaggaaggctaaggaccaccggtcaaccctacaggctgatacccaaaaccctgaatttcaccacaggttcaaggaacttggcctggaaaagggttggggtgattgccctaagcgtgcaaaggaaactatccacctcctcttggacctcctggaggccccagatccgtccaccctggagaagttccttggaacgatccccatggtgttcaatgtcgttatcctctcccctcatggttacttcgctcaagctaatgtcttgggttaccctgacaccggaggccaggttgtctacatcttggatcaagtgcgcgctatggagaacgaaatgctgctgaggatcaagcagtgtggtcttgacatcacgc

SEQ ID NO: 3606 - DNA, 431 bp, Zea mays
  Clone ID: LIB143-006-Q1-E1-G2
gtccggagagccagcgcagccccgaggcggagatcggccaccgggtggaggacctctgggaggtggcggagccgcagctctcgccgtcggagaagctcaactcctgcttcgaggacatccccgtcgcgtccttcccgcgcacgcacccgtcccaagtcattgagattccttcagatgcaagtcttgctgaaactgtagaaatattatccaaaaacaaaatcttgagtgcacccataagaaatgttgaggctccagaagatgctagttggatggacaaatacatcggcattgtggaatttgctggtattgccatgtggttgctcagtcagtctgatgctgcagttaatgggacggttggttcgggaccaggatcgcctgtctccagtctagtttcgaggttgggttctttcacattcagaaggacatcatct

SEQ ID NO: 3607 - DNA, 451 bp, Zea mays
  Clone ID: LIB143-006-Q1-E1-G5
caagcaattgtcaaccgactctatctagctctcttcgcaagccagtaggtcaccactcaccactcaaaagcttgtgaagcaggtgagatgggcaaggaggtggatgtgtccactctagaggtcggcggcgtccgtgaccgtgactacgcggaccctccgccggcaccgctgatcgacatcgacgagctcggcaagtggtccctgtaccgcgccgtgatcgccgagttcgtggccacgctgctgttcctgtacatcacggtggccacggtgatcgggtacaagcaccagacggacgcgtcggcgtcggggcccgacgcggcgtgcggcggcgtgggcatcctgggcatcgcgtgggcgttcggcggcatgatcttcatcctcgtctactgcaccgccggcatctcgggcggccacatcaacccggccgtcacgttcggcctcttcctggcgc

SEQ ID NO: 3608 - DNA, 236 bp, Zea mays
  Clone ID: LIB143-006-Q1-E1-G7
ttccggggccaccacgcgtccgaatactgcgccatcacaatcccaacagctaccagccgcctcctcgccaagcacttctcctctcaatctcgccacaacatcctcctccggtccaaactccgtcatcttcatctgagcgtctgggacgacaacaacgcagcgaagaccatcatggcgatctgtgccggacgaagcagtggacacatcgatcacaccaagggtgagcgcgctgcggc

SEQ ID NO: 3609 - DNA, 447 bp, Zea mays
  Clone ID: LIB143-006-Q1-E1-G8
tgttaatatccttcaggaaggccactgggcagaagccattgagaataatattctacagggacggtgttagtgaaggccagttctatcaagttctcctttacgagttagatgccatccgtaaggcatgcgcatccctagaaccaaattaccagcctcctgtaacatttgtggtggttcaaaaacgtcatcatacgagactatttacaaacaatcacaaagacagaagtagcatggacaagagtggaaatattttgccaggaactgttgttgattctaagatatgccacccaacagagtttgatttctacctctgtagtcatgctggaatccagggaacaagtaggcccgctcactaccatgtcctctgggatgagaacaatttcacagcagacgaaatgcaaacactgacaaacaacctttgctacacttatgcccggtgcacacgct

SEQ ID NO: 3610 - DNA, 429 bp, Zea mays
  Clone ID: LIB143-006-Q1-E1-G9
cacgcgtccggacatatatcacgatccactcgagcacaatcccaaggaaaggtaaggaactatgccccccggcttggttccggcaaaggccggcccggtcccggccaaaacaaaggggccggttcccttaacaatcaactgcaccaagcaactggaggacaaaatcatgaaggtcgcctcgctcgagaaagttcctgcatgagcgcatcaatgtcgcctgcggcaatgctggcaacctcggtgactccgtcaccatctctcgcgacaagaccaaggtcaccgtcacctctgactgacccttctccaataagtacctgaagtacttgaccaataagtacttgaagaagcacaacgtgcgggattggctacgcgtggttgctgccaacaatgaccgaaatgtctatcagctccgctacttcaacattgctg

SEQ ID NO: 3611 - DNA, 455 bp, Zea mays
  Clone ID: LIB143-006-Q1-E1-H1
gtccggaatgccagtctgtgctgtctacatggacacgtcttctacctggtgagaaatctgagattaaatacagtgatgtcgatgatgcaacaggatacaggagcagtagtgggcggactctgctgaaccggggcggcggacgcggcgcagcagcagcagctggcagcaggggatgccgcggcggctcgggtgcggcccgtggaaacgctgcttcgcgcggcaccgctggggctctgcgtggccgccatgaccgtcatgctacgtaaccagcagagcaacgagtatggcgccgtcgcctactccgacctgtgaggcttcaagtacctcgtctacgccaacggcctctgcaccgcctactcgctggtatccgcgttctacactgccgtgccgaggcctgccaccgtgtcgcgctcctggctcgtcttcctcctcgaccaggtgttcacgtacctgat

SEQ ID NO: 3612 - DNA, 409 bp, Zea mays
  Clone ID: LIB143-006-Q1-E1-H10
ccgggtccacccacgaatcgcgaacggttggcttctcctccccctccggttcgggttcgggttcgtgaggttctccggggttcggtttcgtgggtgggcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaacttctccacggatgatgcaataccgaacgccatcgacggcatgaacggcaaggagctggacggccgcaacatcaccgtcaacgaggcccagtcccgcagcggccgtggaagcagcagtcggtgctacggtggtggccg

SEQ ID NO: 3613 - DNA, 433 bp, Zea mays
  unsure at all n locations
  Clone ID: LIB143-006-Q1-E1-H11
cgcgtccgcaaaatgttcatcaggtttccttaatggttaaccaaacaaaaggattggcccaacaatcaaaaattacccaagggaattttttaaaggaggcaaaaaaaaaccttgcaattatcctaacaatccatccattggaaaaggaaaaggtattgtgtgaccggcttgcatctttgtgatggcgatttccaatgccttggaaaccctaaagagctaaaggctanatatggggggacatacatattcacagtgacaacacccccagaccaagagatggaggttgaacatctagtgcgtcagttctcgcccagcgcaaacaagatctaccatctatctggaactcagaaattcgagctgccgaagcaagaggtgaaaatagcccatgtttttgacatggtcgagaaggcgaagcgccngctctcaatacatg

SEQ ID NO: 3614 - DNA, 360 bp, Zea mays
  Clone ID: LIB143-006-Q1-E1-H12
gtcgtattatcaagtgcagctgataaagtgccatcggcgcccccttggccgaacccttgggcgaacccttggcccaagggaaaatttccggggccgttccacggtgttcacggaggtcctggccaacagggtgaaaaaggttgtggcctcggaccccttgttgaaccccccttgcagcctgttgacggccgattacggctggacggccaacatggagaggatcatgaaggcacaggcgctcagggactcgagcatgtctgggtacatgtcctccaagaagaccatggcgatcaacccggagaacgccttcatggacgatctgcgcaagcgcgcttcggcctacaagaacgacaagtctgt

SEQ ID NO: 3615 - DNA, 222 bp, Zea mays
  Clone ID: LIB143-006-Q1-E1-H3
gtgtgtggtggtggggggccgttttgtgtggtttaaagctggcggtggctcgggctgggcgtgggctcgcgggtgttgcggttgctctggcggtgcgtgggctctcggctgccgttgcgggtgtgcggtcgtttgtgttcgcgggccgtcgtttttggctggttgtgcttggtcggggccttgtgttgcccgtgttggaccgctttctgcgcttcgcgcttt

SEQ ID NO: 3616 - DNA, 385 bp, Zea mays
  unsure at all n locations
  Clone ID: LIB143-006-Q1-E1-H4
cacgcaaccgcacaactccaccaccccgccgagctcggctgggctttgccgtggntttcgcntntcttgtgttggccttgttgtttctcgtggggtgtgtttcgggctttccggttctgtcgggcgggttgtcctcgctggcggcctcctgggcgggttctttgcctgttttgctctgggttggctggtcgccgtcggtgctggtcttgcctcttgccccgttggttctgtccgctggcggttggtgttgccttctggtgcggctgtcgngtgggtgggctccttggccgtgttcctgcggctcctttgccgggccggccccgggtccctgttcgcgggtgctggtgctcngtttcttcgtgccgttgctggggctggtgtgctt

SEQ ID NO: 3617 - DNA, 398 bp, Zea mays
  unsure at all n locations
  Clone ID: LIB143-006-Q1-E1-F9
cgcgtccgaaaccctgaagcacagccttccccacacaagaacttcgctgacgacgttgccttcctgaatccgctcttcngtggcctcaagtccggtggcaatgcntatgtgattggtgactctgcgaagcccgggcagaagtggcacgtctactacgccgctgagcaccctgaggagcctgttgttactctagagatgtgcatgactgggctggacaagaagaaagcttctgtcttcttcaagaccactgctgatggttactcgctgtgcgccaaggagatgaccaagctctctggtatctcggacatcatcccaaaaatggagatctgtgacttcgacttcgagccctgtggctactccatgaatgctgttcatggccctgctttgtcgaccattca

SEQ ID NO: 3618 - DNA, 418 bp, Zea mays
  unsure at all n locations
  Clone ID: LIB143-006-Q1-E1-E5
ggggccacccacgcaaccgcattcttcgatttcgatctcaccgaggccgacggagcagacgactaggagtccactattcccgagaagaatccaggagaggagaggagctaagcagcagctgctgtagctgcgtttggtggatcgaatcggtcgtcgtctggtgctgtgtttttgctactgaggagagggagggatctgagggaggggggtgatgtcgtcgtcctcttcctcgtcggtggtatacgaggggtggatgatccgttacggtcggcgcaagatcggtaggtccttcgtccacacccgctacttcgtgctggagccacggatgctgtcctactacaagcgcaagccgcagcacaaggccgacaaggtcgggggaaagctccccatcaagtcncttcacatcgatggcaactgc

SEQ ID NO: 3619 - DNA, 321 bp, Zea mays
  Clone ID: LIB143-006-Q1-E1-E6
ctcttctcctgctgcggtttgtgcctgtggtgtcttcgatctttcgtcgtgccgtgctgcctttgcgcctgtcatttctggcagcgtttggcgggacgtcggtgcttttttccgcggcgggtgctggcctccggcgcgatcggttggttattcaaacggtttcgttgatggatcggctactcaaattacaaaatctagatttgcaccttactccataccgagttcttgcaattggacatgattaccggatgcttgaatttaatagttccagttctcttgcacagattctattagaacatcacagtattacaagttacctag

SEQ ID NO: 3620 - DNA, 461 bp, Zea mays
  Clone ID: LIB143-006-Q1-E1-E7
ccacgcaaccggagacaccttccgtggtagagtgtgtgaatgccccactttcaatggcgtacaatttaaaggcgatggctacagcaattgtgaacctgctggaccaggaaaatgcttgataaaccatggaggatgttggcatgaaactcgcaacggaaaaacattctctgcttgccaggaatctggagatgggaaatgcctgtgcccagctggtttccgaggggacggcgttaaaaaatgtgaagacattgatgagtgcaaggagaaaaaagcttgtcagtgtcctgaatgcaactgcaaagatacatggggtggctatgactgcacttgcagtggtgaccttttgtacatcagagagcatgacacctgcataagcaagacagcagttcaggctaaagcagcatgggctgcagtgtggggtatcttgatagttgttgctgttgttgcaacggaaattattt

SEQ ID NO: 3621 - DNA, 438 bp, Zea mays
  Clone ID: LIB143-006-Q1-E1-E8
ccacgcgatccgcagtgagcaggatcgacgacgccgtgactcggattctgcgcgtcaagttcaccatgggcctgttcgagaaccccatgccggaccccagcctcgcggaccagctggggaagcaggagcacagggacctggcgcgggaggcggtgcgcaagtcgctggtgctcctcaagaacggcaagccgggcgacgcgccgctgctgcccctgcccaagaaggccgccaggatcctggtcgcagggagccacgccgacaacctggggtaccagtgcggcgggtggacgatcgagtggcagggcgacacggggcgcaccaccgtcggcaccacggtcctggacgccgtgaaggcggccgtggacccgtcgacggaggtggtgttcgcggagagccccgacgccgagttcgtcaggagcggcggcttctcgtacgcga

SEQ ID NO: 3622 - DNA, 356 bp, Zea mays
  Clone ID: LIB143-006-Q1-E1-E9
cgtccgaaaagcgagatcttgcatcagcgagctaactaagcaagtatgctaatcgagcccgaggcaacgagccgatcgtcaagcgcatgatagaccactacccacgggctccatcaaaagctggacagtggagatcgcatcgcctgtcgccgcgctgcgcctcttccgcgccgccgtgatggacaggcacaggctggcatccaatgtcgccgcccacgtcatcaccagcgcccatgccgtggaaggcgatggcggcgtcagcagcgtcaggcagttcaacgtcaactaatccatgacgtgcggcatccttaaggataagcgcgacttcctggacgtagacaagtgcgaatgtacat

SEQ ID NO: 3623 - DNA, 384 bp, Zea mays
  unsure at all n locations
  Clone ID: LIB143-006-Q1-E1-F1
gtccgcaatntcaacttcgctcccccggcggcgccggcggcggtaagcccccgaactccccttcatttctggtccccagagtgtcaatccgccctaaaaaggcaggatttgttggcaattatggaaccaggtatggggcaaccttgcttaggcaaatcagtaaaatggaggtatctcacaatccaaagtacttttgcgatttctgtggaaagtttgctgtcaggaggaaagcagttggaatttggcggtgcaatgactgtgggaaggtgaatgctggtggtgcttacaccatgagcactgctagtgcggtcaccgtcaggagcacgattcgccgcctgagggagcatactgaagcatgatatacctctttatattattggggtt

SEQ ID NO: 3624 - DNA, 421 bp, Zea mays
  unsure at all n locations
  Clone ID: LIB143-006-Q1-E1-F10
gtccgccaccccgctgtggcgctgtcncctccctggcacccaccctcacaaagcatcagcctctccaatcagacgcgagccacccaccgcgcgacctcagggtgcctgtgcctgctcccgctgttccttcctcatggccaccgcctgccacctcgccgcgccgctcggcctcgccccgttgccccgcggctgcgcctctgctggcgtcgtggccgtcgtccggtgcgctcggtcgtcaggctccaagattccgagaggcgttgctgtcagggcgacgtccggcggcgagggcgccacggaggaggtgccggagattgtgaaggctgcgcaggacgcgtgggacaaagttgaggacaagtacgccgtggccaccatcggtgtcgctgccatcgtcgcgctctggacggtagtaggtgccatc

SEQ ID NO: 3625 - DNA, 403 bp, Zea mays
  unsure at all n locations
  Clone ID: LIB143-006-Q1-E1-F11
cacgcgtccgcaaatccaaagcgaagatcgcgatcagagcaagagcaagcaacgcgcaccgaaatcttccaatccacaagactcgctacttcgcagttggcagactcgcccgcagcgagccgctagcaaccaagcagaaatgtcgctggtgaggcgcggcagcgtgttcgacccattctccgtggacctcttcgaccccttcgacagcgtgttccgctccatcgtgccgtcgtcgtcgtcggcggcggcagcctccgagaccgccgccttcgccagcgcccgcatcgactggaaggagacgcccgaggcgcacgtgttcaatgccgacctccccggcgtgaataaggangaagtgaaggtggatgtggaggacggcaacgtgctgctcatcagcaggcagcgc

SEQ ID NO: 3626 - DNA, 399 bp, Zea mays
  Clone ID: LIB143-006-Q1-E1-F12
aagggccccatttattaattaaaaggcagaacatgggccgaaggtagtttaaggggtcaaagttataaacaaggattacaacattgaattaccaaccaaggtgccccaaggtggttactttgagtcggaatgtcgccgctcctaacctcctccgacgccccctaagaagactgctgaatataacggcaccatggagtacactgaggtgctgaagctccgtgggcttccctactctgcgacgactgaggacatcatcaagttcttcctgaagtatgagctgacataggacaatgtgcatattgcgatccgctcagatgggaaatctaccggtgaatcctttgttgagttctcaatagctgaagttgccaagacggcgatgtgcaaggataagatgactat

SEQ ID NO: 3627 - DNA, 415 bp, Zea mays
  unsure at all n locations
  Clone ID: LIB143-006-Q1-E1-F2
aggcggcgccaaggaccggaatccaacccattgcttgcaacaatggcaagggaattgaaaaaccacttgaaaaggctcaatgcgccaaaccattggatgctcaacaaccttggcggaccttttgcccccaagccatcttctggacctcacaagtccaaggagtgccttcctctgatcctcatcatcangaacaagctcaagtatgctctgaactaccgtgaggtcatttctatcctgatgcaacgccatgtacttgttgatggcaaggtcaggactgacaagacctaccctgctgggttcatggatgtcatttccatccctaagacaatggagaactacaggctgctttatgacaccaagggccgcttccgtcttcacccaatcaaggatgangatgccaagttcaagctctgca

SEQ ID NO: 3628 - DNA, 445 bp, Zea mays
  unsure at all n locations
  Clone ID: LIB143-006-Q1-E1-F3
gtccggaatcatatccccatctcccagatccaattccgcagttctccctcctcggccgcaatggcgctctctgtggagaagacctcgtctggacgggagtacaaggtcaaggatctctcgcangcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaacctcgangagtactggtggtgcaccgagcgctgcctcgactggggcc

SEQ ID NO: 3629 - DNA, 426 bp, Zea mays
  Clone ID: LIB143-006-Q1-E1-F4
gtccggactagaacagccaagaaaagcatatacccgagtcgccgaaacaacaacaatcccaatcccccctcgtcactcaaaactcgaccaacaatgtcgctgattcgccgtggaagcgcattcgaccccttctcccttgacctctgggaccccttccaaggctttcccttcggctctggaagcatcagcagcagcagcctgttcccctcgttcggaggcaccaacagctctgagacaggcgccttctccggcgctcgcgtcgactggaacgagacgccggaggcgcacatgttcaagaccgacttgccggggctgaagaaggaggaggtgaaggtggagctggaggacggcaacatgctccagatcagcggcgagcgcatcaaggagcacgaggagaaaacggacacctggcaccgcgtggagcgc

SEQ ID NO: 3630 - DNA, 462 bp, Zea mays
  Clone ID: LIB143-006-Q1-E1-F6
ccacgcatccgtacgagtccagggggcaggggcaccattaccgagtagtttaattagtgctagttgtattaccattgttagtgacttaattaccctcacgcgaagcaccttacctctgctagtcctcctacgtctcttctcttcgcttaatcttgtactactgctctgttataatcagcgggaaggaggaagatgacggtgacgccacggatcacggtgagcgacgggcggctgacggtgcgcggccgtacggtgctcaccggcgtgccggacaacgtgtcggcggcgcacgcggtcggggcggggctcgtcgacggtgccttcgtcggcgctcacgccggcgaggccaagagccaccacgtcttcaccttcggcacgctccgggactgccggttcctgtgcctgttccggttcaagctgtggtggatgacgcaccggatgggcgtctccggccgcgacgtc

SEQ ID NO: 3631 - DNA, 457 bp, Zea mays
  Clone ID: LIB143-006-Q1-E1-F7
atccgaagaaagaaagaaagggaaggcggggggaggccggccaaggcaccaccacaccaccacccgacgaattcaagcatgaggccgcagagcgcagagcagggctgccgccgctgccgctgaggagcggctacagagtgctatacctattacacagcggcaacaggcaggcaggtgcgtgcaggcacaccgctcctcgctgttccgcgcccacccgcacaagcaagcgccgccaccaccaccaccaccaccaccgagaaggaaccgcctcgcgcccccagatctcgccgccaggggtcgcgcgagtaggtacatgagggcggcgcccttcagtgccgacgggaacggggcggggaccatagaggcgctgctttggccgcacgggaagggcggcggcggaggccacctgctgttggagccgacgtcggtgctggactgcagacggagcccgagcccg

SEQ ID NO: 3632 - DNA, 460 bp, Zea mays
  Clone ID: LIB143-006-Q1-E1-F8
ccacgcatccggaaccccgcgcgtgccgcttctcacctgtgcacctcgccgactcctcggatttgtcatattcgcctgaggtgggctcagtcgctgagagtggccacggtgaggaatgacgatgaagacggggccgcggaccgcgtgccgcacctgccgtggatgcggtaccccgtcgatatcgacaccttctctggctgccccgtcacacagctcccccgcctcgacccgaggttagagaggtttttgatgatattgctcctatggtgggcttgtcagtaggttcagcagttggtcaatcatcaatagcagatgaagtttctagtcttgtcccgaagcccaaacaagagttttacccaactattgacgaagaatatgtccaaatggaaccacagactaaaattgatatattggtggcaacccctgaaagactaatggatcacattaacatgacaaatgg

SEQ ID NO: 3633 - DNA, 448 bp, Zea mays
  Clone ID: LIB143-006-Q1-E1-E4
gtccggaatgtgatgtccgaccgccatctccgcagccggctggcctagctacctccctcacctcacgcaggcacactgcacacacacccatggtggtggcggcgatgcggcggccgtgcgctgtgccagcgctgctggtggcggcggcgacggcgacgctagtgcttctgctgctgctgtcaccgtcgagcgcgcagccggtgccgtccccggcggcggcgccgggccccgcgggcgggaccgggatcgactcggcgtgcctgaactcgctgctcaacatgtcggactgcctcccgtacgtgagccaggggagcacggcgcggcgccccgacgcgccctgctgcccggagctggcgggcctcgtcggctccaaccccgtctgcctctgcgagctcctctccggcgccgccgactcctacggcatcgccgtcgactactgccgcgcgct

SEQ ID NO: 3634 - DNA, 138 bp, Zea mays
  Clone ID: LIB143-027-Q1-E1-E1
ctcacacgtcaggtccacgcatatgtcgcgacgccacggtagtgcacattgacggagtcagttagagtgggaaccctgcgagtcgcgctcgactggggtgtggtcagtctcggtcactctgctctatgctctggacct

SEQ ID NO: 3635 - DNA, 184 bp, Zea mays
  Clone ID: LIB143-027-Q1-E1-E10
agcggacgcgtgggatgtcacccacccacacaaggagcagagactggggcgatgatactgacgggaactgctacaaccagacagcccccatcgaggacctgtcctactgggggccagacaccagcaagggcctgcatgcgcgtgatcggagaagtgttcagcgcgtctaagtccaggatccccg

SEQ ID NO: 3636 - DNA, 182 bp, Zea mays
  Clone ID: LIB143-027-Q1-E1-E12
acggagcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgtt

SEQ ID NO: 3637 - DNA, 229 bp, Zea mays
  Clone ID: LIB143-027-Q1-E1-E2
ccggtacagcatgacccaacaaacgcacccccaagctaccaacgcacgcaaagcacggacgggcgcatacagctttccctttcgcgagtgcgtgccccttctcttctctagttctcttctccgtcgcgtcagagatcagggagagaccagagcaaacaacagccaccgcttgtttcatcaagaatcgtggaggagaaccgaaaggtgtagtatccttttccggtagggt

SEQ ID NO: 3638 - DNA, 213 bp, Zea mays
  Clone ID: LIB143-027-Q1-E1-E3
agcccacgcgtccgcttcctcaagggcaacttttatcgattctttgaagggtcatgtatgctcacattgcaggagtagtaaactactgtgttcctgccggcgacgcttatcaaaaggctcttgaacttgcgcgggagataaaccagaaagtaagaaaccgctgaacagcctacatgctttattttgacagaagaatcagcaaagttattcgcc

SEQ ID NO: 3639 - DNA, 263 bp, Zea mays
  Clone ID: LIB143-027-Q1-E1-E4
tttttttttttttttttttttttttttttttgtttgttttttttttttgttttttttttttttttttttttttttttttttttttttttttttttttttttttttgttgtttttttttttttgttgtttgttttttttttttgttttttatttttttttttttttttttttttttttttttttttttattttttttttttttgtttttttgtttttttgtttttttgttttgttttttttttttttttttttttttttttttt

SEQ ID NO: 3640 - DNA, 208 bp, Zea mays
  Clone ID: LIB143-027-Q1-E1-E5
ggtaaaggtcccgacgacgcggtatcgccgtatacccgcctcaagtacaaagggaaagctgcgactcgctcggaagtggggtactgtacttcccgctcgctcgctctctgctctggtccttcacgctctaaccttcagttgaggttctctaatcgggcccgctaaagtcgagagacagccaaaggtcgcgttcttttggacctgctct

SEQ ID NO: 3641 - DNA, 152 bp, Zea mays
  Clone ID: LIB143-027-Q1-E1-E6
gaaacaaccacaatcttcttcatcgcgtggtcgctcgacatcgagcgcgtcacgagtacgacgctctacgccatctccaaggcaaggttcaccctggagctggtccgcattcaggtcaatctccacgggattaactccgttgaggttggcct

SEQ ID NO: 3642 - DNA, 209 bp, Zea mays
  Clone ID: LIB143-027-Q1-E1-E7
cacacagcgaaccgagaaaccaacacaacaagcaaagcagcgatccgacatccgagagatggacgcggtgatgttcgggctggagactcccctgatggccgcgctgcagcacctgctggacgtgcccgacggcgacgccggcgcgggcggcgacaacaagacgggcagcggcggcagcgccacgcgcacctacgtccgcgacgcgcgcg

SEQ ID NO: 3643 - DNA, 223 bp, Zea mays
  Clone ID: LIB143-027-Q1-E1-E8
aaaaaaaaaaaaaaaaaaaaaaaaaaaaaaaaaaaaaaaaaaaaaaaaaaaaaaaaaaaaataaaagggaagaaaaaaaaaaatgataaataaaaaagagggaggggttgaaggggtgttaatggattgagattggtggtgggtgtttggtgagtgtttggggggtttttgttgggttttttttggttgtttttttttttttgtgtgtgtttttttttttttt

SEQ ID NO: 3644 - DNA, 182 bp, Zea mays
  Clone ID: LIB143-027-Q1-E1-E9
cggacgcgtgggggaagatatacctgacatggatacttatgaagacacaggggataatttggctgctgctgaaccatcatactttatcgcagaagaaccagaagatgacaacattcttcataccagaacatatgatgttagcataacgtatgacaagtactaccaaactccacgtgtctggc

SEQ ID NO: 3645 - DNA, 195 bp, Zea mays
  Clone ID: LIB143-027-Q1-E1-F1
gagaaaccaacacaacaagcaaagcagcgatccgacatccgagagatggacgcggtgatgttcgggctggagactcccctgatggccgcgctgcagcacctgctggacgtgcccgacggcgacgccggcgcgggcggcgacaacaagacgggcagcggcggcagcgccacgcgcacctacgtccgcgacgcgcgc

SEQ ID NO: 3646 - DNA, 184 bp, Zea mays
  Clone ID: LIB143-027-Q1-E1-F10
cccacgcgtccgcgcgggcggacaaggagcaggcggaggaggagctgtgccaagccacaatgggtatctcgcgtgactcgatgcacaagcgccgggccaccggtggaaagcagaaggcctggaggaagaagcgaaagtatgagcttggtcgccagccagccaacaccaagttgtcaagcaataa

SEQ ID NO: 3647 - DNA, 182 bp, Zea mays
  Clone ID: LIB143-027-Q1-E1-F11
tgtttccgctagattctgccaagatcagcgattccctccgccagcagaatcgctcgctctctttccatcgagcgtgcattcttttctgctgctgagtcgggcaggatcggcgtaaccgctccaaaccccaagacctttgtccagcagcctcgcgccctcgccgcgtcggtatggtttttcct

SEQ ID NO: 3648 - DNA, 182 bp, Zea mays
  Clone ID: LIB143-027-Q1-E1-F12
gttgctgttaagcttccctgtagtcgtgtggcgggttggtcaagagatgttgcaaggctgcatctgcagttgtcagcagcaaaattagcagcagccacagcaagaggcaatagaggaatccgatgtgctgtttgtgactgattgcttcccaattccaaacctcttctcttgcaaggacctag

SEQ ID NO: 3649 - DNA, 222 bp, Zea mays
  Clone ID: LIB143-027-Q1-E1-F2
ccggctcgacccaaacgtacggtcagacgtcagccagcagttcgaaaccagggatcgatccaggagcttccggaaggctaggcgcgcgcgcagcgtcgaggtgctggtgccggtgccgcccatggatcgggctcgcggatccgcgttcctgctcggcgtcctgcacgcaggatccgtgctcgcgttttcagtcgcgaaagaggagaccacgaagctcgggac

SEQ ID NO: 3650 - DNA, 215 bp, Zea mays
  Clone ID: LIB143-027-Q1-E1-F3
agcaaggcaccacacctcttcctcctcttcctcctcctagcacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggca

SEQ ID NO: 3651 - DNA, 218 bp, Zea mays
  Clone ID: LIB143-027-Q1-E1-F4
ctcactcacagtcgccgccgctgcccagtgcccactgctcgccgctagaggaatctgagagagagaggggaaagggcgaaggaggcgcaggcaggcatgggctccccttcctccctccccgccgcggcggcgctcgtgctcctggccctgctcgccggagcccagtgccgcgaggcccagttcgacgccgcggacgccggcgcggagaacttcaacac

SEQ ID NO: 3652 - DNA, 207 bp, Zea mays
  Clone ID: LIB143-027-Q1-E1-F5
cgacttgcaaggctaggcgccttttgcaactgccttctaccagaaggcttgcggcttgagtcaactgaaacaaagcatcttggagactgtcgtttctcagatggttccaataccaccagcaacgataactctgacgaagatgaattggaagataaacacctgcttccgactacttctgttggtgaagacacaattgtaaaagaaatt

SEQ ID NO: 3653 - DNA, 213 bp, Zea mays
  Clone ID: LIB143-027-Q1-E1-F6
cgacgactaccagaagtggcgctggcagcccgacggctgcgacctccccagatttgaggctaagttgcttctggagaagctaaggaacaaaaggctgatgtttgtgggtgattctctgaatcggaaccagtgggagtccatggtgtgcctggtccagtcagaggcaccatgggacaaaaaatctctcgtcaagaatggttctcttaatgtctt

SEQ ID NO: 3654 - DNA, 218 bp, Zea mays
  Clone ID: LIB143-027-Q1-E1-D8
aacgtcagtgcttgttccgagcagaataaatttctggcgagtaccatcgaagagtgactttgaacgaagtgattcgacacagtaaaaaaaaaaaaaaaaaaaaaaaaaaaaaaaaaaaaaaaaaaaaaaaaaaaaaaaaaaaaaaagaaaaaaaaagggggggggcgctaaaggggataaacttaaatgtacgtgaaaatgagatgaaagagctccta

SEQ ID NO: 3655 - DNA, 208 bp, Zea mays
  Clone ID: LIB143-027-Q1-E1-F7
ccaagctcttgtcctgcgagatcaggaagaggaagtggggttgaggatgaggcgcaataatatgcgtgcaaaccaacaacccaggctggctttttaaggaggagatagttttggatatagagctcataaccatggtataagctttggcctgcagcttctgcttgtgctttgtaatgggagttgtagagggggtttatgtggttgcgat

SEQ ID NO: 3656 - DNA, 212 bp, Zea mays
  Clone ID: LIB143-027-Q1-E1-F8
ctttcattcgccgccgccgcctcctctctgctgccgtcgccatggggagaaggcctgcgagatgctatcgccaaatcaagaacaagccataccccaagtccaggtactgccgtggtgtccctgaccccaagattaggatctacgatgttggcatgaagagaaagggtgttgatgagttcccctactgtgtgcaccttgtctcttgggagaag

SEQ ID NO: 3657 - DNA, 176 bp, Zea mays
  Clone ID: LIB143-027-Q1-E1-F9
ccccgctccgcctccactcctcgcgccgctgccgcatctcctctacaggtaataaggagagaaatttggcgatctggtgcaacacaggaatcgtcagtcgcgaacgggcacttcaggaagcactggcagggactatgtcaagacatggttcaaccagcccgccctcaagcaggggc

SEQ ID NO: 3658 - DNA, 214 bp, Zea mays
  Clone ID: LIB143-027-Q1-E1-G1
agccttcccttacccggcggcttaaaccctagttctcactcccatcgccgcttcagctccgccgcagcagatggagttctggggtctcgaggtcaagcctggttccactgttaagtgtgagcctggatatggctttgtgctgcacctttcccaggctgctcttggggaatcgaagaagagtgataatgccttgatgtatgtcaaaattgatgac

SEQ ID NO: 3659 - DNA, 179 bp, Zea mays
  Clone ID: LIB143-027-Q1-E1-G11
gtatgtactaatcaactatatatatatatatatatatatatatagtagtcatgatatacagcaggtctgcctctcaaattaaatatgtacataataacgataacaacatctagcagtaatgttatggcgaaaattatggtccaggattagaatttgctacctaaagtccatatggggct

SEQ ID NO: 3660 - DNA, 182 bp, Zea mays
  Clone ID: LIB143-027-Q1-E1-G12
cgactccagcatccctcgtccccgcatcaccgcgccgccgacactccgctcgctttcgctcccgagacccgggcctgccgagccgccgccatggacgaggagtacgacgtgatcgttctgggcacggggctcaaggagtgcatcctcagcggtctcctctctgtcgacggcctcaaggttct

SEQ ID NO: 3661 - DNA, 219 bp, Zea mays
  Clone ID: LIB143-027-Q1-E1-G2
acgcagctgaagcagttcttcccagcaaggacgatctgaggaagaccattactgaaatcctcaagaaagttgacttcaacacggcaactttcagtgacattctgaagaagctcgacaatcactacaaaatggatctgaccccaaagaaagaagccatcaaagttatgatccaagacgagttgaccaagctatcagaggaggatgaagaaggagagggag

SEQ ID NO: 3662 - DNA, 213 bp, Zea mays
  Clone ID: LIB143-027-Q1-E1-G3
agcggacgcgtgggttcttgcgcacgccgcttggtggttctcctcctcacggttccatctccgggtccttgggtctggatggaactggagacacggtagaggagcccgcggtttcccttttcccctcccaacaagggttgatagggaggattttttggattgatctataagccttttggtggctaacggttgggagctttggaggagaactcg

SEQ ID NO: 3663 - DNA, 219 bp, Zea mays
  Clone ID: LIB143-027-Q1-E1-G4
acgccaagatcggccgctgccaactggggggcctcaccgccacccgttcttggaaaacagcacgctacttacttgaaagtaaagggagatacttgccgcgttgggattctccaactccaaccaagacgaacgatttcatcccactaatcctttttcttttcttttcgtttttatttttaatttcttggttcggttcttgatcacctgttcttccttatg

SEQ ID NO: 3664 - DNA, 185 bp, Zea mays
  Clone ID: LIB143-027-Q1-E1-G5
cgcctctgaccagttcggtaccgccggatcgtcagcgtcactccccgcctcctctccccaatgacagtaggtttcacctcggaatggcggatcatgctaaccaatgtcactgtccttcagtaagcacggatcgccagattccattctggcgctcgagtcacactcgtgcaaggatgtggcggtgc

SEQ ID NO: 3665 - DNA, 207 bp, Zea mays
  Clone ID: LIB143-027-Q1-E1-A5
cggacgcgtgggcggacgcgtgggtgcgagtagtatggaaaccatgttccttacccatactatcctcctgccagatgggaaatcccatccggtcatccacaggcaatggactcatcttattattatcggccaccaaactgtggaacttggccatatcatgatatctcacatccttctgagttccattgttgctgcaaccgggcatat

SEQ ID NO: 3666 - DNA, 206 bp, Zea mays
  Clone ID: LIB143-027-Q1-E1-A6
cccacgcgtccggagaagcgaagcaagcaggcttcgagaacaagggggagggggaggaccaagcgaaagggggaactagagcaagatgggcggcgaactgctgcttgcgctcctcctcgtctctgctgctgccgcccctcaggtacttggagttggcaatggagacaatcacatgagaatcatccaggaggacatcattgagacag

SEQ ID NO: 3667 - DNA, 209 bp, Zea mays
  Clone ID: LIB143-027-Q1-E1-A8
agatctttcccccgtcctccctcgccttcgccttcgccggcaggagatttccaccaccaccgccgaaccgccccgaccctcctcccctctcgcgctatggcccagactgttgtgctcaaggttggcatgtcctgtgagggctgtgttggagctgtcaagcgggtcctcggcaagatggaaggcgtcgagtcctacgacgtagacatcat

SEQ ID NO: 3668 - DNA, 177 bp, Zea mays
  Clone ID: LIB143-027-Q1-E1-A9
gcgggcttcgcgcatggcaggacggaggtggggggcgaacgcgagatcgccgccttgcgtcgcgcacgtcacgcacgaggacggacatttctgctaggtcagcgagatcaacaagagcaacgcctactgcgacgcaggcaacaggcagtggccgtgcgcggtggagcagaagtacga

SEQ ID NO: 3669 - DNA, 212 bp, Zea mays
  Clone ID: LIB143-027-Q1-E1-B1
gtctgtccagaaatacattagaaaaaagagccaaagaggagaacaccggccggcgaggtggacgaagcggcccgccgaggaaatggcgtcgatgcagagctggcgcaaggcctacggcgccatcaaggacaccaccaccgttagcatcgccaatctcaactccgacttcaaggatctggatgtggcgatcgtgaaggcgactaaccacgtgg

SEQ ID NO: 3670 - DNA, 182 bp, Zea mays
  unsure at all n locations
  Clone ID: LIB143-027-Q1-E1-B10
gccgatacgaatccgacgagctcgatcgctccacttccccgatcgcacgccaatcagcaccagccaccgtggcgatgacggaggaggcggaggcgaaggcgaagggcaacgcggcgttcgcggccggccngtttcgaggaggctgtccagcacttcagcgacgccatcgcgctcgcgcccga

SEQ ID NO: 3671 - DNA, 185 bp, Zea mays
  Clone ID: LIB143-027-Q1-E1-B11
aggcctgtccccgtggtacgacaacctatgccgccctgtcacagacttgctgcccattatcgccagcggcgtccgtggagtcaccagcaacccaacgattttccaaaaggccatttcatcgtccagcgcatatgatgatcagttcaagcagctcatttcggcaggaaaggatgcggagagcgcta

SEQ ID NO: 3672 - DNA, 182 bp, Zea mays
  Clone ID: LIB143-027-Q1-E1-B12
cggacgcgtgggctcttggagatagtgtgatatgcaaggttgattacaaccggcgcacactgattgctccaaatcatacgtgtacccacatgttgaactttgctctaagggaagtacttggtgatcatgttgaccagaagggttcaattgttctaccagagaagctaagatttgatttctca

SEQ ID NO: 3673 - DNA, 75 bp, Zea mays
  Clone ID: LIB143-027-Q1-E1-B3
cccacgcgtccgcccacgcatccgaggtcgcatggccggaagcgtgtgatatatctacatctcagtgatggtcaa

SEQ ID NO: 3674 - DNA, 221 bp, Zea mays
  Clone ID: LIB143-027-Q1-E1-B4
aacgtcaggcttctgcttgctctggggggaaggagagagagagagcgagagagatctagtagagaggctagctaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcctccgagccg

SEQ ID NO: 3675 - DNA, 208 bp, Zea mays
  Clone ID: LIB143-027-Q1-E1-B5
ccacagttgaccgactccattgtgctaccagagaagtttgagttatttggacagaacatcgacctgagtccactgaaaggcatattttcttccatcgaaaatgcagcatcctcggttgcaaagaccatatctgagcagcctccgctcaaaataccgatcaggacaaacaatgctgaatcgtggttgcttacgacataccttgacgaac

SEQ ID NO: 3676 - DNA, 208 bp, Zea mays
  Clone ID: LIB143-027-Q1-E1-B7
cggacgcgtgggcggacgcgtggggcaagaataagaaggacataagcggcaacccccgtgcactgcgccggctgcgcacggcgtgcgagcgcgccaagcgcacgctgtcatcgactgcccagacgaccattgagatcgactccctgttcgagggcatcgatttctactccacgatcaccagggctcgcttcgaggagctcaatatgga

SEQ ID NO: 3677 - DNA, 112 bp, Zea mays
  Clone ID: LIB143-027-Q1-E1-B8
cgtcgattcctttggaagggcagagcttactgttctgaactcagttgcagagtttcattaactttttcaaatgtgactaaagataataaagcaactgaactggtagttacct

SEQ ID NO: 3678 - DNA, 196 bp, Zea mays
  Clone ID: LIB143-027-Q1-E1-B9
aggcaaacgtcaacgtacgcatagatgtatgcatccgcggattcaatctgcgagatcactttgggcccaacaggaaggagtttagagtcactcctccgtccggtgggagaatgggagtcctcaggtacgatatgatatccatttcgaaggtatacattgatcaagaaggcctcatccattgctgggtttcgtttgt

SEQ ID NO: 3679 - DNA, 182 bp, Zea mays
  Clone ID: LIB143-027-Q1-E1-C11
tacgaaacgaattaatccccaatcaacacagcaagtcagcaacaagcaaagcagcgacccgagagatggacgcgaggatgttcgggctggagaccccccgggtggcggcgctgcatcacctgctggacgtgcccgacggcgacaaggcgggcggcggcgccacgcgcacctacgtccgcgac

SEQ ID NO: 3680 - DNA, 183 bp, Zea mays
  Clone ID: LIB143-027-Q1-E1-C12
gaaacatagctactcctactactcaaatccatccttattgagcttagtgtttgatccatggactcggaaggagtagcagcaaaggtggcagatgagactactaaaccggcaagccaagaagacggcgagaagcaaggccgggatgactgatctgctgatgctgaccgacaagtcgcagctgca

SEQ ID NO: 3681 - DNA, 221 bp, Zea mays
  Clone ID: LIB143-027-Q1-E1-C2
ctcaagtccgccctgcgtctgggctcatggtaggtgtccggctcagtcagtactgtctgtaataaagatccaacgtggggccaatgtaactaaggctgctgccagtaagaaatgatctatctggcttgtgcagtccttgcttgttggttacctcgaggtaggcttaggatatctcgtcttgttgccatccttgcacttgtctcgttaacaagtaatctatg

SEQ ID NO: 3682 - DNA, 216 bp, Zea mays
  Clone ID: LIB143-027-Q1-E1-C5
aacgtccgaaaaaatagcatgtaaatctataaaatcaatttccatctctcaccctatgaatttgagataggtttaaatgataactttggaaagtggtgaatgtcacattctaaaaaagtagcctattccattagtaagattccaattcctcaaaatgaaaggaaacaaacgggaccttaatctatttcttgtaaaagcatggattgggttggaata

SEQ ID NO: 3683 - DNA, 209 bp, Zea mays
  Clone ID: LIB143-027-Q1-E1-C6
ccacgcgtccgggcaaacggtggctgtcggagtcatcaagagtgtggagaagaaggacccaactggagccaaggtgacgaaggctgctgccaagaagaaatgatctatctggctggtgctgtgcttgcttgttggttacctcgtggaagcttaaaatatctcgtcttgttgacatccttgcagttgtcgcgtgaacaagtaatctatga

SEQ ID NO: 3684 - DNA, 209 bp, Zea mays
  Clone ID: LIB143-027-Q1-E1-C7
cggacgcgtgggtaccaatccccatcgccccagaccacagcgcgacagtgagtacagcagcagcagctgagagcgtgagagcgtgcgaagcaggagggaggacaagaagaagccgatggcggttgtgagcggcagcggcgggaggctgaacccctgggcggagcccttcgtgccttccggggcgcggtaccgcggcctgcggaccgtgg

SEQ ID NO: 3685 - DNA, 206 bp, Zea mays
  Clone ID: LIB143-027-Q1-E1-C8
gtgtggcgcaagtcgctgctcttcaactgcgacggcttcaccgtctacgacgcccgcggcgacctggccttccgcgtggactgctacgccggctcgttccgccgccggcgccgcgccgacgtcgtgctcatggacgccacggggaagccgctgctcaccgtgcgccgcaagacgcggttcggcttagcggagcgctgggtcatcta

SEQ ID NO: 3686 - DNA, 262 bp, Zea mays
  Clone ID: LIB143-027-Q1-E1-A4
ggttgccctggcggtactagtctagaagtcccgggccgacccaaacgtcaggcccggggcaacaagcgaaccgacggcggcgatggggatcggtgagcacttcgagggcgtcaagcagcactgggcgagcaacttcgccttcctcgactacttcaagaaggtctacggccgcgccgagcccctccccaagtggtccgacgccgacgtcgacgagttcatcgcatccgacccggtctacgggccccagctcaaggccctgcgg

SEQ ID NO: 3687 - DNA, 213 bp, Zea mays
  Clone ID: LIB143-027-Q1-E1-D1
agaataaatgctgaatatacaacatgagatttatatttgccatggagaaaaaaatcttgtaatgatgaatgggtgcgactaccgtcaggagaatgtagtttcgtgttgcaatggcagccttgcggatgtattatttcacgtgagatcaatcagaccaatatttcataagtgtaataatgtgatgaataacgatgggcgcaataacaacactga

SEQ ID NO: 3688 - DNA, 184 bp, Zea mays
  unsure at all n locations
  Clone ID: LIB143-027-Q1-E1-D10
atcacaacgaacaaaagctctcgatctcaccgacaccgaggaagaagagatcaatggcgtccgagcagggagtcgtgatcgcgtgccacagcaaggctgagttcgacgcccacatgaccaaggcccaggnaagccggcaagctggtggtcatcgacttcactgccgcctggtgcggtccatgcc

SEQ ID NO: 3689 - DNA, 183 bp, Zea mays
  unsure at all n locations
  Clone ID: LIB143-027-Q1-E1-D11
gcagcttctgcttgctctggggggaaggagagagagagagcgagagagatctagtagagaggctagctaggtggtcctcgaacgaagatgttggcggtgttcagcgggcaggtggtggaggtgccggcgngagctggtggcggcgggcagccggacgccgtcgcccaagacgaaggcgtcgca

SEQ ID NO: 3690 - DNA, 177 bp, Zea mays
  Clone ID: LIB143-027-Q1-E1-D12
ggcagagtggccttgctgccacgatccactgagatccagccccgcgtcgcacggattcgtctgcaaaggattcagcacgccgcccgttgggaagggagcttcgaggcggcccgccgcggcgcgtcggccgggcgggctgagccaatggcacgggcccttggggcgcgaacgccctaa

SEQ ID NO: 3691 - DNA, 214 bp, Zea mays
  Clone ID: LIB143-027-Q1-E1-D2
agtgttaacctgtaccctgatcgcatcaagaagcttgccgacaactgcactggtctccatcgcttccacgtcttcaacgactgttggtggacgatcgggctctggccttggttccctcctcctacagcgcctgtctgttgactacagcatgaagtccacgcttgtgttcactgtgtacccttccgcacaagtttctacttcggaagttgagcca

SEQ ID NO: 3692 - DNA, 216 bp, Zea mays
  Clone ID: LIB143-027-Q1-E1-D4
agcccacgcgtccgggaactgactagaactagtacgtagatccaacactcgggacgaaattaaaagagacgacgcacatcaaccagcaggcatcgcgcggtcaccaccatggcggcgcaggagggcggcatgaggctggtgtcgcacccgatcgcggcgcacgacgggcggctgccgcggcagtacacggcggaggggcagggcgccaagaaggac

SEQ ID NO: 3693 - DNA, 206 bp, Zea mays
  Clone ID: LIB143-027-Q1-E1-D5
gtcagtgtcaccacgggatcctagcacatcctccactggctaagggaccattagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacg

SEQ ID NO: 3694 - DNA, 87 bp, Zea mays
  Clone ID: LIB143-027-Q1-E1-D6
agactctaagactgtgtgtcagtgtgttcgagtttgttccgtgcagagagtgcacgtcaactccgctttaattaatctgcttttgtt

SEQ ID NO: 3695 - DNA, 207 bp, Zea mays
  Clone ID: LIB143-027-Q1-E1-D7
caattaactagcttcttctagctctagctaggctcgtctgctgcaagaaggtaacagcgcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaa

SEQ ID NO: 3696 - DNA, 332 bp, Zea mays
  Clone ID: LIB143-026-Q1-E1-G6
agcacgcccctccagaccagcttccaccggagcaagagctaagtcgcctcgaattcttcccagctagtagcgtgtgccgtaccccgtcgctcaaccgggatggcgtcgagtggggatccgcccggatctgctgatgaaaagaaaactccaatagccgaagggtcttccgacgaacgtcaagggcttcctccagcagggttttcaaatccttttgatcttggttctatgcaaagtttgctcaacgatccagctattaaggagatggcagatcaaagtgcaagggatcctgcagtcagccggacggctgagcagctacagaacagtgctcaaag

SEQ ID NO: 3697 - DNA, 307 bp, Zea mays
  Clone ID: LIB143-026-Q1-E1-G8
acttgcgtttccaagtccgatacaaaccagcgccgcgccgcgcgagcacgtcgggcgacgttgcggcaggcgagatccgagaacactcctccctcgcgcccccgcacccgcatggccgccgctggccgcagatagggaggcgcaggcgggggcgtgcagatccagatccggtgggcggcgaggacgagatcgccccctaccaccatggcgggcgccgtgtcggcgctcttcctgctggacattaaaggccgcgtcctcgtctggcgcgactatcgtggtgatgtctccgcgctccaggccgaacgct

SEQ ID NO: 3698 - DNA, 407 bp, Zea mays
  Clone ID: LIB143-026-Q1-E1-G9
cagcgatccgaagctcaatcaattcactcaaacctcttccccaaatcttcgattagattctcgttgacaagaagactagaaccgaacctgaccatgtcgctgatccgccgcagcaacgtgttcgatcccttctccctcgacctctgggacccctttgagggcttccccttcggctccggcagcagcagcagtctcttcccctcgttcccgcggaccagctcggagaccgcggccttcgctggcgcgcggatcgactggaaggagactccagaggcgcacgtgttcaaggccgacgtaccggggctgaagaaggaggaggtcaaggtggaggtcgaggacggcaacgtccttcagatcagcggcgaacgcaacaaagagcaggaggagaagacggacacctggcaccg

SEQ ID NO: 3699 - DNA, 393 bp, Zea mays
  Clone ID: LIB143-026-Q1-E1-H1
ggaagatgtccggttttgggcaccgtgtgtataaaaactatgaccctcgtgctaaagtcataaggaaattggcagatgaggtgttctcaattgttggacgggatccacttattgaggtggccattgccctagaaaaggcagccctgtcagacgaatattttatcaagaggaagctgtatccaaatgtggatttctactctgggctaatttatagggcaatgggattccctacagaattttttcctgtgctgtttgctattcctcgcatgggtggctggctagcgcattggaaagagtcactcgatgatcctgacactaagattataaggccccaacaggtatacaccggcttctggcttaggcactatacccccgtcaaaaaacgagtgctat

SEQ ID NO: 3700 - DNA, 418 bp, Zea mays
  unsure at all n locations
  Clone ID: LIB143-026-Q1-E1-H10
cccaggtacacgtccgcacgctgagtcgttgcctgctgcggattgcccccaggcgggccccactcattccgctgctgaaatttcgtttggttctcctttccgttcttgtccgtcgccaaggccttccgctcgctccccagctccagcaagcagatcagatccatccaaccacgaacaagaaggaaggtatgangaagggctgaagttgaaccatgagtgccgtcgcggtttcgtcgtcgctgaacccgaacgcgccgctcttcatcccggcggcgctgctgcaagtggaggacttctcgccgcagtggtgggacctcatcaccaccaccgcctggttccgcgaccactggtcccgcgagcacgcccacctggacgagatagccgagcagctcgagttggtcgccctccttgcctacga

SEQ ID NO: 3701 - DNA, 308 bp, Zea mays
  Clone ID: LIB143-026-Q1-E1-H11
gagactacaccacagccacttttgaaggatgactttgaattcaacggaaggaaactaacaaaggctggtgtgagacaaatgatataacgggatattttggagtatcatcgccagatgcttcaggactacatcgaatgtgcagatcacattcacttcctatacccaagtggggttgatcgcgtccaacgacagattgctcatctcgacgagaactacaggagacgagtatctagcagcccgtcgcgaacgcagcccacatcgctgccaagggagcgagtctgctcatcagatcatggtcacagtcacga

SEQ ID NO: 3702 - DNA, 367 bp, Zea mays
  Clone ID: LIB143-026-Q1-E1-H12
tacgcatctgtacaacttcgggaaaagccaacggctcgtcagctataattcaccggacatgtccggtgtgcaccggactgtccggtgtgactccagcgcaacgggtatcccgcgccaaccggtaacttgcaaaggcattaaatgcgccgcagcgcgcgcagatgtcaggtttgcccatactggcgcaccggacaatgaacaggagctgtccggtgcgccaccggacatcaagggtggcccacaagtcagaactccaacggtcagattccaacggcactgatgacgtggcaggggcaccggacatgtccggtgtgcaccggactgtccggtgcgccatcgagcagactggctccccaacggccacatt

SEQ ID NO: 3703 - DNA, 146 bp, Zea mays
  Clone ID: LIB143-026-Q1-E1-H2
aggaaccgcatcggcccgcggccgtacgctcccgagctccatccgtcgcgcctcgaccgagatcgtccccggcgattgcttccgctgtggccgcttcatccactacgcggtgcctgccgcggcctccgaaccgctgctgtatccgt

SEQ ID NO: 3704 - DNA, 414 bp, Zea mays
  unsure at all n locations
  Clone ID: LIB143-026-Q1-E1-H3
tgtcctcgacctttgatccgacanattggctgcattctctgctgcatacgcagaacttgaatctgtactttctggattgaatgtgcttgttgagacttactttgctgatgttcctgctgagtcctacaagaccctaacatctctgagcagtgtgactgcttatggttttgatcttgtccgtggaacccaaactcttgggcttgtcacgagtgctggtttccctgctggaaagtacctctttgctggtgttgtggatggacgcaacatctgggctgatgatcttgctacatctctcagcactctccagtctcttgaggctgttgttgggaaggacaagcttgtcgtatcaacttcctgctcgctcatgcacaccgctgtggatcttgtgaacgagactaagcttgacagcgagat

SEQ ID NO: 3705 - DNA, 306 bp, Zea mays
  Clone ID: LIB143-026-Q1-E1-H4
gacataatttctctcgcttaaaataattattagctaaaatgctcaaacagttcaagtttgtgacagaatgcatggctgaagtaacgcaaagaacttaacactgcaatggaagtggctaagtcgacctattgttcacaaagggcggcgatcctacaggatcaaatcttgcttccacgtgctatgcaatcttaaagatctcttctatgagtgtcagtcaacataagttcatgggcagtcgttttaaaacgtcgtaaggggaaaaaccctggtctatcccaacgtaaacgctttacattaaagccccct

SEQ ID NO: 3706 - DNA, 225 bp, Zea mays
  Clone ID: LIB143-026-Q1-E1-H5
acggaccgcccagttctaccgcgacggcgctcagaacacggtcttgatcaaggtcgtcggcaacatctctgcggacgactatatgctcctcacgaccatctcggcggtctctgtcaccgttggctacctctctgggatcaagccgtggatcaggggcccgtcgatgtgtcacgggcggcctcatcgatgtcatgggagggttcatgtacgcctagcataactccg

SEQ ID NO: 3707 - DNA, 410 bp, Zea mays
  Clone ID: LIB143-026-Q1-E1-H6
ggaaaaagagagcagagaaccctagctagagtttggcgagtggtgcggaggcgcggctgctcctgctcgtcgcgacgtcgaatttcagcgccgcccgcgcgatccttggtctcttcgcccgtgaggagaggcgcgacaatggctgggaaaggcgggccgaccaacctggagaaggagcagatgtttgggatggcggagaaggagatggagtacagggttgatcttttcaacaggcttacaaagacctgttttgagaagtgcgttgaaaaaaggtataaagaagctgagctcaatatgggtgagaacagttgcattgatcgatgtgtttcaaagtattggcaggtgactaatttagtaggtcagatgcttgggaaccagcctcagatgtgaaccgagatgcactagttcca

SEQ ID NO: 3708 - DNA, 429 bp, Zea mays
  unsure at all n locations
  Clone ID: LIB143-026-Q1-E1-H7
ggcagagagcagggatgagcgacgagcgggtgaaggcggatgcgctgcagatcctgggcctattccaggtgctcccccgcctcgtcgtcttcgacctcgactataccctctggcccttctactgcgagtgccggtccaagagggattcgccgagccttttcaagcacgccaagggcatcatgtactccctcaacgagaaagggatcgacatggcgattgcttctcgctcccccaccccggacatagccaaggtgttcctcgacaagttggagttccagtccatgttcgtcccccaagaaattattcccaagctgaactcacaagactgagcattttcagaagatcaatangaaaactgggattccctacaaatccatgctgttctttgatgatgagaacaggaatattgaagcggtatcaaaaatggga

SEQ ID NO: 3709 - DNA, 152 bp, Zea mays
  Clone ID: LIB143-026-Q1-E1-H8
cataaccggattatggcggatgctccgcacatgctgcggctattgcacgtgctcacctgcctcgtcgtcttcgacctcgacaatactctccggttcttccattgcgagtgccgcttcaatagggattcgccgagccttttcaggcatgccaa

SEQ ID NO: 3710 - DNA, 437 bp, Zea mays
  unsure at all n locations
  Clone ID: LIB143-026-Q1-E1-H9
gtcgagattagcgggtccacgcacgcgtccggaagaggccgggtaccccgctctacaacatcaaggctttcctccctgtcatcgagtcctttggtttctccagccaactgagggccgcaacctctggtcaggcgttcccccagtgtgtctttgaccattgggacatgatgggctcagatcctttggaggccggctcccaggctgctcagctggtgctggatatccgcaagaggaagggtctcaaggaacagatgacccctctttctgagtttgaggacaagctctaaaatttttggctgttggtgatactgtttcatctgccggtttaatcatcaattcgtctactgtaatagcagcgacttcaatattttattttgttttagttgtcanatgcacctgtttttgaacantatttgtgatgtantgccctgccgcgc

SEQ ID NO: 3711 - DNA, 210 bp, Zea mays
  Clone ID: LIB143-027-Q1-E1-A1
cccacgcgtccgccaaattatggtaaatgagaaaaaggtatcaagtcaaccagcacgtggtctgtcggcgaagggatcaaagggtttgttactgggaagggttagttaaaaggtgccaattactattttataatttaattgcagttatttaaggtaagaaaatatgttgttttcttgtattgctgtgaggcaaatagacacgcttagtgg

SEQ ID NO: 3712 - DNA, 182 bp, Zea mays
  Clone ID: LIB143-027-Q1-E1-A10
cccacgcgtccgcccacgcgtccgcccacgcgtccggtcgcctccctttccccttccctccctccctctccccgcgggccgccagaggcaatttcgccctcgattcgaccccgattcgtccgcccgcgaccgggattccctccgccaagcgcggatctgaacgctgcgctccgtgtcgccgc

SEQ ID NO: 3713 - DNA, 180 bp, Zea mays
  Clone ID: LIB143-027-Q1-E1-A12
acccacgcgtccgcccacgcgtccgattcgttggtagttgccggaataaagaggatctggacagactacaaaagcttaaggacaggtccactgaactacacatagatgagcttgtggagttccacaaggatgatttcttacagggacctgtgtacaatttcttgggggtgccattgctgg

SEQ ID NO: 3714 - DNA, 214 bp, Zea mays
  Clone ID: LIB143-027-Q1-E1-A3
aggcggaggccacctccggggcaatcggctcgctcgtcagcaccaccgtgctctacccgctcgacacctgcaagaccaagttccaggccgagctccagacgcaccagggcgctcagaagtataggaacctttcagatgtcttttgggaagcgattcgtaaaaagcaatttttgtccctatatcagggcctgaacacgaagaacattcagtcttg

SEQ ID NO: 3715 - DNA, 342 bp, Zea mays
  Clone ID: LIB143-026-Q1-E1-G3
agtcaaagatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaagccatcatcaagcagattccccgtct

SEQ ID NO: 3716 - DNA, 334 bp, Zea mays
  Clone ID: LIB143-006-Q1-E1-C6
ccacgcaaccgcagaagaaaattgaaaaattgaggcagctattatcaggagttttcagtgagcttacaaactttgatgagccaattcgttcaccattagcaccaactcttctcctaacaggagttgtgcctcaagaatcgtctatatttaagagtgccttgaaccctttgcgcctgacatttaaaacagcaaatggcggaacatccaagattatttacaaaaagggtgatgacctccggcaagatcagttggttattcaaacggtttctttgatggaccgactactcaaattagaaaatctagatttgcaccttactccataccgagttcctgc

SEQ ID NO: 3717 - DNA, 462 bp, Zea mays
  Clone ID: LIB143-006-Q1-E1-C7
cccacgcatccgcaaaagatcattgaaaaattgaggcagctattatcaggagttttcagtgagcttacaaactttgatgagccaattcgttcaccattagcaccaactcttctcctaacaggagttgtgcctcaagaatcgtctatatttaagagtgccttgaaccctttgcgcctgacatttaaaacagcaaatggcggaacatccaagattatttacaaaaagggtgatgacctccggcaagatcagttggttattcaaacggtttctttgatggaccgactactcaaattagaaaatctagatttgcaccttactccataccgagttcttgcaactggacaagatgaagggatgcttgaatttattagttccagttctcttgcacagattctatcagaacatcgcagtattacaagttacctacagaagtttcatcctgatgaggatgggccttttggt

SEQ ID NO: 3718 - DNA, 420 bp, Zea mays
  Clone ID: LIB143-006-Q1-E1-C8
cactgagcaggatcgacgacgccgtggctcggattctgcgcgtcaagttcaccatgggcgtgttcgagaaccccatgccggaccccagcctcgcggaccagctggggaatcacgagcacacggacttggcgcgggaggcggtgcgcaagtcgctggtgctcctcaagaacggcaagccgggcgacgcgccgctgctgcacctgcccaagaaggccgccatgatcctggtcgcatggagccacgccgacaacctgaggtatcagtgcggcgggtggacgatcgagtggcagggcgacacagggcgcaccaccgtcggcaccacggtcctggacgccgtgaacgctgccgtggacccgtcgatcgatgtggtgttcgcggagagccccgacgccgacttcgtcaggagcggcggcttctcgt

SEQ ID NO: 3719 - DNA, 370 bp, Zea mays
  Clone ID: LIB143-006-Q1-E1-C9
aaagtggatgcagttctccgttgccgattctcggaatcggtttctcgattgatgcctgaaatttcatcatgattagcgtttatgggtgatttcaacgatgagggggttcccaagggctatgctttccctctcacgatgcctactgttactctgattgagtgaagatttgcaaccttcactcacaggtcagctgctgcacatccgtggcatttcgtgtagattgttccataagcgcctactgttttcaactgtgtagttgtcattatcaagagtagtacggttaagtatgagctacacacagacagtagacttaattgggctgatcacgttctctattcaaccattatttacccccaaagctacggtttca

SEQ ID NO: 3720 - DNA, 391 bp, Zea mays
  Clone ID: LIB143-006-Q1-E1-D11
catccccactcccctctctccaaccggggaacgggcaatcccctggcctcctgaaccgattccgtccccggccggccggcccggcggcgcgccccccgggccgggagccccggccccgggtaatccggttaagccacaaccggggcctcgccaaaaactgcggctcccgcggcttctccggctcccgcggcgcattcaagggcgcctgaaacgcacccgcccaacgcacgaagggcaaccgaaaacccctcgatcgggctctcctcgcgctgtagcttttataacgccgtagacgacaacgaaagagaacggaaagaaataaaacccaccacacctaccgtcgtccgtagaggaaggaaggactcgagatggacaccgtcagcgtccccgt

SEQ ID NO: 3721 - DNA, 401 bp, Zea mays
  Clone ID: LIB143-006-Q1-E1-D12
ttcacggggccccccacgcgtccgccaactgcaagctgcgctgcactctggatgggcacggtggctatgttaacgccgtcgctgtgagccccgacgggtcgctgtgcgcctccggcgggaaggacggtgttactctgctgtgggatttggctgaggggaagaggctgtactcgctggacgcgggctccatcatccactctctctgcttctcacccaaccgctactggctctgcgctgcgacgcaggactctgtcaagatctgggacctcgagtcgaagcacgttgtgcaggacctcaagcccgacatccaggtctccaagaaccagatcctgtactgtacaagcttgagctggagtgcggacggaagcaccctctacactggctacaccgatgggtctatc

SEQ ID NO: 3722 - DNA, 452 bp, Zea mays
  unsure at all n locations
  Clone ID: LIB143-006-Q1-E1-D2
caacaacatgtcaggactcaagaggctcncctcctccctcgccgccggaaaagccccccgtcctccccaacccgggttcaattccccgttccctggtgccgtggtaaccgaacgccccgggcaaggggttccaaccggggctcaacggaatccccaaaacggcattaacccatgggcaaggaggcaacaaccctggggggtttaaggtggctgcagatgcagagcgcgtccgatctcgatcttaagccccagttgcangaattgattcgggaacaacaggatcgcttanagaagctcaagtcagagcatggaaagaaccagcttggaaacataactgtggatatggtccttggtggaatgagaaggatgactggaatgctttgggaaacatccctacttgattcagangaaggtattcgttttaagggcctctcaattccagaatggcaaaa

SEQ ID NO: 3723 - DNA, 396 bp, Zea mays
  unsure at all n locations
  Clone ID: LIB143-006-Q1-E1-D3
gtccgcaaacacaacattattctaatccaacccccccttccggttgccccccggcggccgaacccggtccccccttggccttttcccccccgccgacctcaaagggtcattgggttggtggcccgttttgttggaaaaagccggcgctggcacccgcggttgctgccggcgacgagcgatgacgactgcccgcggtcggagcgcgcgcgatgatggccgcgcgggttcaccccaaaacaacanacaattcgcgatgctctgctttcctttcatttgttcttttcgaaaaattagaagtattttttaataaaaaagatatctgttgtttgttgaatggctctgtcttctgtntgtgcataatcgttttcttagtgnggtctaattctatatcacatc

SEQ ID NO: 3724 - DNA, 439 bp, Zea mays
  unsure at all n locations
  Clone ID: LIB143-006-Q1-E1-D4
gtccggaaaagtacaagtgatcgagctcccccctcctcatcagtcgctaggcacagcgcacttgcaggatggcgcaggtctctaagacgcttctccttgtggccctggtgttcgtgtcgtcngcggcngtggagctgtgccgcgcgatcgacttcgacgagcgggacctggcgtcngacgaagcgctgtgggacctgtacgagcggtggcagacgcaccaccgggtgcaccggcaccacggcgagaagggccggcggttcgggacgttcaaggagaacgtgcgcttcatccacgcgcacaacaagcgcggcgaccggccctaccgcctccgcctgaaccggttcggcgacatggggcgggaggagttccggtccacgttcgccgactcccgcatcaacgacctccggcggcaggattcccccgcggcgccgggcggggc

SEQ ID NO: 3725 - DNA, 387 bp, Zea mays
  Clone ID: LIB143-006-Q1-E1-D5
catcgtctccgccgcagcgatgccgtcgcacaagaccttccggatcaagaagaagctggcgaagaagatgcgccagaaccgccccatcccctactggatccgcatgcgcacggacaacaccatcaggtacaacgccaagcgcaggcactggcgccgcaccaagctcggcttctgagcgcgcggatcggccggctcctgcgtcggaattctagggtctctacctttcctttggttttatcgatgtctcttgtgtttctgtaagctagcaaacagttccagaaagcttttgttaagattttgatgacgctaagaggattgatgctactatgctgtactcaggattccatgctgcattgcgatgctaaattaaagaacctctgttacctt

SEQ ID NO: 3726 - DNA, 288 bp, Zea mays
  Clone ID: LIB143-006-Q1-E1-D9
acgcgtccgcgaacgcgtgggttggcatgcaatcggaggcctatgcacagtacacccagtatgttggcttctagtagagtatatacatataataagtccgagaaatatattacgaagttgcaatatagagatagatcataggtgagcacataagtttcagtagtacatgtaaactgtaaatgtaaagcagtggatccgtaaagcactggctccgtgtgaataaattgtcagattatttttttgtcaaaaaaaaaaagaaattaaaaagcaaaatccgaaaaaaccaca

SEQ ID NO: 3727 - DNA, 439 bp, Zea mays
  unsure at all n locations
  Clone ID: LIB143-006-Q1-E1-E10
gtccggaaaaagatgtgaattcgtctctgaaagttgacaaactgcactttgcagagccaatcacaaaagctgaagtgattcaactcatctctgcaagttgatgaaccgctcattccaaagccaggcatgagctcatctctagagaacacacctgctgtgaatggccactcagcccccatatccccaaccattactcctactctaataagcgtgccaacagcaaccatgcctgtcagcaatgacagatgcggttgctacatgtcaaccaacagaatccaagtctaccctcgccacactgatatggttatcccggaaggcgcggccgtgcttcccatcagcgataatcagtgggtagctgtcagcctaccttattccatggaacaaagggatttctgttgccgtaatccggactgccacttangaagatanaagcagacaa

SEQ ID NO: 3728 - DNA, 452 bp, Zea mays
  Clone ID: LIB143-006-Q1-E1-E2
gtccgcaaaagaaaattgaaaaattgaggcacctattatcaggagtttccagtgaccttacaaactttgatgagccaattcgttcacaattagcacaaattcttctcctaacagaagttgtgcctcaagaatcgtctatatttaagagtgccttgaaccctttgcgcctgacatttaaaacagcaaatggcggaacatccaagattatttacaaaaagggtgatgacctccggcaagatcagttggttattcaaacggtttctttgatggaccgactactcaaattagaaaatctagatttgcaccttactccataccgagttcttgcaactggacaagatgaagggatgcttgaatttattagttccagttctcttgcacagattctatcagaacatcgcagtattacaagttacctacagaagttccatcctgatgaggatggtcctttt

SEQ ID NO: 3729 - DNA, 412 bp, Zea mays
  Clone ID: LIB143-006-Q1-E1-E3
gtccgcaagcaaatgtcaaccgactcaaccaacctcccttcgaaagcaattaggtcacaattcacaatccaaaaccttttgaaccaggtaaaatgggcaaggaggtggatttgtcaatcctaaaggtcggcggcttccgttaccttgactacgcggaccctccgccggcaccgctgatcgacatcgacgagctcggcaagtggtccctgtaccgcgccgtgatcgccgagttcgtggccacgctgctgttcctgtacatcacggtggccacggtgatcgggtacaagcaccagacggacgcgtcggcgtcggggcccgacgcggcgtgcggcggcgtgggcatcctgggcatcgcgtgggcgttcggcggcatgatcttcatcctcgtctactgcaccgccggcatctcggg

SEQ ID NO: 3730 - DNA, 418 bp, Zea mays
  Clone ID: LIB143-006-Q1-E1-C5
ccacgcatccgcagacgcgtgtgtgtcttcccatcgctgaagcccgacatactcggcaccgagagtttcattcaagtacgggtgcacgaggggagtctttggcgcgccgttcttctttgtgaatggcttcctccagccatggggcggatcgcctatcgactacagcacgtggatcggcatcctgtgacccccttgtttcccagaacggtgaacggatcgagatgtttacttcgaggtaagtgattgaagtggccttgctacggaggatacggtcgtacagatgtttcgctagtgccgacggctgacaagcagacagctattaggcaattgcaaactgtgtgtaagctctgcagtggtaaatagcatcccactttgctcgttgtactgttatgctaacagttgtgtgctagctgtatat

SEQ ID NO: 3731 - DNA, 439 bp, Zea mays
  Clone ID: LIB143-006-Q1-E1-A8
ccacgcaaccgaaccaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcattcttggacactctgaaaggagagctctgctgggagaatcaaatgaatttgttgga

SEQ ID NO: 3732 - DNA, 362 bp, Zea mays
  Clone ID: LIB143-006-Q1-E1-A9
gtttcagatctcatcaaccttaacctctcagactccactgacagaatcattgctgaatacatatgcgttggtggttctggaatggacatgagaagcaaagccaggactctacctggaccagtgactgacccttcgcagctaccaaagtggaactatgatggttcatgcacaggccaagctcctgatgaagacagtgaagtcatcttatactctcaagccatattcaaggatcctttccgtataggaaacaacattcttgtcatgtgcgatgcgtacactcccgcgggtgaaccaatcccgactaacaaaagacacgctgctggtaatgtctttagcaaccctgatgttgcagctgaagttcc

SEQ ID NO: 3733 - DNA, 438 bp, Zea mays
  Clone ID: LIB143-006-Q1-E1-B10
cacagcacaagcagctcgagagagagagagagagaaagatgtcgtggttccgggcacaccaccacaaccaggcggctcccccggggtcgggccccaaccaggtgttcatgatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcgggcagtcccacccggtcaagctcgcgcctttcagcccggaccaggaggacgcgtcggtgctgtggacggagagcaaggacgtgggcaagggcttccgctgcatccgcatggtcaacaaaacccgcctca

SEQ ID NO: 3734 - DNA, 449 bp, Zea mays
  unsure at all n locations
  Clone ID: LIB143-006-Q1-E1-B11
gtccgcaaagataatganagttgcagatttcatcaacgaaattcgtcaggctggcagaaatggagaactttcaagtgagactttcatattcttcaacaagcagatcaaaggaaacaagagggagatcatacagcttggtgtaccgttatttcaacctaccacagaggatgctaattgtcacacagaaccaatcccccttgtcctgcatgctgtcattgaccaccttgttctttggcgtttaataccagaaagcaggaaaccaaatagtgtcgtcatcaacttcttcgatgaggatgaacattcgcagccctacttcaagcctccccatcttgacaaccccatttgcactcttctgctgtctgaaaccacgatggcatttggcaagtcacttgtcactgacagcaacggtaactacaaaggacctctcacactttcactaaagcaagggt

SEQ ID NO: 3735 - DNA, 435 bp, Zea mays
  Clone ID: LIB143-006-Q1-E1-B12
acccgtccgacagcaacagccaagtgcaagtgatcgagctcccccctcctcatcagtcgctaggcacagcgcacttgcaggatggcgcaggtctctaagacgcttctccttgtggccctggtgttcgtgtcgtcggcggcggtggagctgtgccgcgcgatcgacttcgacgagcgggacctggcgtcggacgaggcgctgtgggacctgtacgagcggtggcagacgcaccaccgggtgcaccggcaccacggcgagaagggccggcggttcgggacgttcaaggagaacgtgcgcttcatccacgcgcacaacaagcgcggcgaccggccctaccgcctccgcctgaaccggttcggcgacatggggcgggaggagttccggtccacgttcgccgactctcgcatcaacgaactccggcggcaagattccccg

SEQ ID NO: 3736 - DNA, 404 bp, Zea mays
  unsure at all n locations
  Clone ID: LIB143-006-Q1-E1-B2
tgggcgacaaaggtttgaaaaggttgtggtgcctaaccttttggtggacccaccttgctgccttgtcactggtgagtatggctggacagccaacatggagatgatcatgaatgcgcatgccctganggactctagcatgtcngggtacatgtcgagcaaaaagactatggaaatcaacccggagaacccaatcatggatgagctccgtaagcgcgccgaggctgacaagaatgacaagtcagtcaatgatcttgtgatgttgctgttcgagacagctctcctgacctccggcttcagcctggatgaccccaacacctttggcacccggatccatcgcatgctaaagctcggtctgagcatcgatgaggacgagtctgctgangccgaagctgagatgcctccgc

SEQ ID NO: 3737 - DNA, 369 bp, Zea mays
  Clone ID: LIB143-006-Q1-E1-B3
gtccgacatatcatcgccgctgcgccgtctcctccgctcccgtcttcgggaaacatggcgtcccacattgttggataccctcgcatgggccccaagatggagctcaagtttgcacttgagtctttctgggatgggaagagcaccgctgaagatctggataacgttgctaccgacctcaaggccagtatctggaagcagatggctgatgctgggatcaagtacatccccagcaagaccttctcgtactatgaccaggtccttgacaccagtgccatgcacggcgctgtccccgaaagctactcatggactggacgacagattgggtttgacacctacttctccaaggccaatggacaacccactgtccct

SEQ ID NO: 3738 - DNA, 452 bp, Zea mays
  Clone ID: LIB143-006-Q1-E1-B4
gtccgcgactccaccgccgctcccgctccgccccagcgcatcgcccgccgccacagcgtatcgcgacctcatctatcaccttcagctttcaatcatgggggacgtcgatgtcgaaccggatgttgccgccagagctcccaggaagaggacgttccgcaagtacagctaccgcggcgtcaacctagatgcgcttctcgacatgtccactgacgacctcgtctagctcttccccgcgcgcgccaggagaaggttccagatgggtctgaagaggaagcccatggcgctcatcaagaaactgcgcacagcgaaaaaagatgctcctgctggtgagaagcctgagccagtcaagacacatctccgtaacatgatcattgtccctgagatgattgtgagcattgttggtgtctacaacggcagagacttcaaccaggttgagatcaagcctgagatga

SEQ ID NO: 3739 - DNA, 394 bp, Zea mays
  Clone ID: LIB143-006-Q1-E1-B5
aacaggtgggaatggaccatgtggtagaggcgaggctgtagttttatttccagtagtttagatgttttgttcacaagtctgctactacagactgctacgtttatgatgaagaacttagccatgttggtcatattgatcatgagttacctatgttgagcttagacgatcttgtgtccaaccatcgctgggtagtatgattacggtcacgtaaggtggttaaggtcccaatctactacctatattgcatgtgtcgaagatccattccaattgtacgtctagcgcactatttgtgaaatgttgctgggcctgtaccgcattgacattaggtatcgcaccatatgattaagctgttccagtgaacgatgtcaaagatgcagatgcccgaaattttttc

SEQ ID NO: 3740 - DNA, 464 bp, Zea mays
  Clone ID: LIB143-006-Q1-E1-B6
ttccggggccacccacgcgtccggaagtttatttccaaggagggtaatggtgagctacctctggagggaacaatacctgatatgacttcccttactgagtattatgtaagcttacaaaagatttaccaagctaaggcagaatttgactgtcttgccctggagcatcatgtaaaggaaatcttgaaacagattggtagagatccggattctatttcaagagcatatatcaaaacattttgtaaaaattctaggaaactaaggatttgtagatatcgtagtttcaaggaggaatttagctccccgattgtctctgagattcagaggtatttcagcgatgaagactgcagttacgcaatgaacttctacattctactacgggctgtcgatcgattggctgccaattatagccgattacctggaatcttcgacagtgagattgacgaagatatccctaggctgaagac

SEQ ID NO: 3741 - DNA, 380 bp, Zea mays
  unsure at all n locations
  Clone ID: LIB143-006-Q1-E1-B9
tgcatccggaaaaaatggcaaagtcaaaaaaccacacggcgcaaaaccagtcgttcaaggcgcacaagaacggcattaagaaaccaaagcgccaccgccagacctccaccaaggggatggaccccaagttcctgatgaacctgaggtattctangaagggcaacaaaaagagtggtgaggctgaagctgaggagtangaaggaaagcatggctttgtttcctctgtttttagctcagttccacctttaggacctgnggttttgctaaagatggaacttaagtggtgttactgtatgatggcaaggaccttttgctgccgaaggttatgttttgaagttcatgctaccttttaaagtacggattaccttgtgcctatgttc

SEQ ID NO: 3742 - DNA, 425 bp, Zea mays
  unsure at all n locations
  Clone ID: LIB143-006-Q1-E1-C11
cccgtccgcacacgcaaccgtccgtatttccgtcacaactcacaacccgagcccccaaaacccgaagcagcaggacctcccctgaccttgctccgcctccgatcaaagaaaaggaagatgagctactacggccagcagccccccgtcggcgtcccgccgcagcaaggctacccggggaaggacngctacccgccagcggggtacccgccggccggctaccccccgccggcgcaaggctacccgccgcaaggctacccgcagcaaggttacccacagcagggctacccgccgcagtacgcgcagccgcctccacagcagcagcagagcagcgggccttccttcatggaaggatgcttggctgccctctgctgctgctgcctcctggacgcctgcttctgacggaaccatccgtgccgggtccaaca

SEQ ID NO: 3743 - DNA, 448 bp, Zea mays
  Clone ID: LIB143-006-Q1-E1-C12
cacgcgtccggaatgagggtgtaagccttcaccttgtgggcatgaaaaaaacccttgcaaccttaaacccggaaggaattgaaattgatggttacggaaattacaattgggaatttcccggggttaaaggaacatccatggataaaaaaccattgctcaacctgtatttcctgcacagcggtgactattccactgtgccgtcaatcaatggttatggttggatcaacgcttcacagcaagtctggttccaacaaacatcttcaagtctacaggcaacgtatatgaataagaacccgaaacagaacgaaccagcacctggccttgtatttttccacattccactaccagagttcagcagttttacggcatccaatttcacacgagtaaagcaggatggtatcagctcagcatcaattaactctgggttctttgcctccatggtggaggc

SEQ ID NO: 3744 - DNA, 406 bp, Zea mays
  unsure at all n locations
  Clone ID: LIB143-006-Q1-E1-C2
aggcggagaatattcaaggcaacaaccacaatagaacttagcatttgatccaatcttctccttaaggcaaaattcaagggtgctattggcgttgaatattccgagcaggctgagaagcagattgagatgtacacaaagcaagggttctccagcctccccatttgcatggcgaagacgcagtactcgttctcacacgtcncgtccatgaagggcgccccgaccggctttgttctgccgataagagacgtgagggccagcatcggcgctgggttcatctacccgctcgtgggcaccatgagcacgatgcctggccttcccaccagaccctgcttctaccagatcgacgtcgacactgccaccgggaaggtcatggggctgtcatgaattgaagttcctgatggtatca

SEQ ID NO: 3745 - DNA, 267 bp, Zea mays
  Clone ID: LIB143-006-Q1-E1-C3
gtccgcaagaccatgggttcttgcacagtcgacatggtggttcccatcatcacggttcaatctcagggtccttgcatccggctggaactggcgacactctataggaccccgcggtttcgcttttccgctcacagctaaggttcatatggaggagtttttggactgatgtacacgacttttggtagctaactgttgagaactttggacgagaactcaaatctctggtctctaagtgtggctggacaggccggatgaagttgccaatgg

SEQ ID NO: 3746 - DNA, 438 bp, Zea mays
  Clone ID: LIB143-005-Q1-E1-H10
cacgaatccgcatctactgacctgtgacctccgcatttccaaacagcccgagcgagctagagctagcagagcggcaggcacctccctcctcaaggaacatggcccgcacgcagcagttggcagtagtggcgaccgccgtggtggccttggtgctgctggcggcggcggcgacctcggaggcggccatcagctgcgggcaggtggcgtcggccatcgcgccctgcatctcctacgcgcgcggccagggctcggggccctccgccggctgctgcagcggcgtcaggagcctcaacaacgccgcccgcaccaccgccgaccgccgcgccgcctgcaactgcctcaagaacgccgccgccggcgtcagcggcctcaacgccggcaacgccgccagcatcccctccaagtgcggcgtcagcatcccctacacgatcagcacct

SEQ ID NO: 3747 - DNA, 417 bp, Zea mays
  unsure at all n locations
  Clone ID: LIB143-005-Q1-E1-H11
gaaggacagggtgatgataactattattagttgtttaaactttaaactgtaacatctgataattaggttcaaccgttggtgaacttagatagaaaatagatgtacatgtttgcaatggccctgaaattttgtgaatgcatcattagaatatcaaaagtctatactacttaacatttgcttgtgttttctacagttagagtatcttgaggagcgccggctgaaggatctgatcaagaagcactcagagttcatcagctacccaatctctctctggatcgagaagaccactgagaaaaatatctgatgatgatgacgaggaagataagaaggacgaagangggcaagttgaggatgttgatgagaaggaagaaaaggaaaagaagaagaagaagatcaaggaggtttctcatgattggc

SEQ ID NO: 3748 - DNA, 356 bp, Zea mays
  Clone ID: LIB143-005-Q1-E1-H2
ccctgtttgaaggaattggtcttcttcctggagaaaaattagcatacttaattacaatgttttcaaagatgcagggggaaacggcggaggcgttgggcggattcggaggacccggggcggcggacgcggcgcagcaccagcacctggcagcaggggaggccgcggcggctctggtgcagcccgtggaaacgctgcttcgcgcggcaccgctggggctctgcgtggccgccatgaccgtcatgctacgtaaccagcagagcaacgagtatggcgccgtcgcctactccgatctgtgaggcttcaggtacctcgtctacgccaacggcctctgcaccgcctactcgctggtatccgcg

SEQ ID NO: 3749 - DNA, 440 bp, Zea mays
  Clone ID: LIB143-005-Q1-E1-H3
gtccggaatgcatgtctgccctgtctgcatgcacacgtcttcttcctggagagaattccattatccatacaaagagttcgacgatgggggaagataaagggggagcagtatgcggactctgaggatcctgggcggccgacgcggtacagcagcagcagctgggatcatgggaagccgcggcggctcgagtgcagcccgtggaaacgctgcttcacgcggcaccgctggggctctgcctagccgccatgagcgtcatgctacgtaaccaacagagcagcgagtatggcgccgtcgcctactccgacctgtgatgcttcaagtgcctcgtctacgccaacggcctctgcgcctcctactcgctggtatccgcgttctacactgccgtgcccacgggttgccaaccgtgtcgcgctcctggctcgtcttcctcgtcgaacagg

SEQ ID NO: 3750 - DNA, 315 bp, Zea mays
  Clone ID: LIB143-005-Q1-E1-H4
ccattccacccgcaggtcgcagactcatcacacagtcagcctcaaacctctttctcgtccgaatccagaacttccatccatggcagtgtcatcagggatggtcgtctccgtccgcccgccggctccggccgggccctgcgcttgctctgccacggggagggcgcgccccgtcggcgacggcgccaagtggtgggcgccgctgctggggtggtccgggcatccggactacatcgacgcgcggccggcgtccgaagacgagcctctgccgcgggggccgggctctggctcggcctcggccacgctgttcggcctgct

SEQ ID NO: 3751 - DNA, 444 bp, Zea mays
  Clone ID: LIB143-005-Q1-E1-H6
ccacgcgaccgcagtcccaatcccaatccacccgcaggtcgcaaactcaacacacagtcagcctcaaacctctttctcgtccgaatccagaacttccatccatggcagtgtcatcagggatggtcttctccgtccgcccgccggctccggcccggccctgcgcttgctctgccacggcgagggcgcgccccgtcggcgacggcgccaagtggtgggcgccgctgctggggtggtccgggcagccggactacatcgacgcgcggccggcgtccgaggacgagcctctgccgcgggggccggcctcggcctcggcctcggccatgcggttcggcgtgctgacggacgacaaggcgcggcggctgcgcgtgcagatgatggagacggagagcttccacgacgccatgtaccactccgccatcgcgtcgcgcctcgcctccgccgcgc

SEQ ID NO: 3752 - DNA, 438 bp, Zea mays
  Clone ID: LIB143-005-Q1-E1-H7
ccacgcgaccgcatatgcacctgagaatgttgagaagccctttcctgtgtggataaagtcacatactccggaaaaagggtttgaagagacaaaacaagttattggggctctaaaggagaagggagtgtctgctgttggagctgcagggtattgctggggtgcaaaggttgttgtggagttggcaaaagctcatgagatccaggctgctgtgctgttgcacccttcttttgttaccgttgacgatatcaaagaggtcaagtgcgcaatttctatcctcggagctgagattgacaaaatgtccccaccggagctaatcaagcagttcgagcaggtcctttctttgaactcaggggttggccacttcgtcaagatcttccctggtgtggcgcatggatggagcgtgagatacaaccacgacgacgcagctgccgtgaagag

SEQ ID NO: 3753 - DNA, 358 bp, Zea mays
  Clone ID: LIB143-005-Q1-E1-H8
acgcgtacgcacacgcgtccgcgcgcccacttcttatactgccagcgtctgctccctctcgcggaggcctcgctctggttggaaggtttggagaaactccccggctcgaggagatcgtgacattgagaggacgatgggagggcgcgcgctcctcctcctcctcctggtctcggcgttggtctttcagatccacgcctccgacccgctgctgtacgagccgttcgatgaggactttgaggggagatgggtcgtctccaagaacgatgaataccaacgtgtgtggaagcatgccaagagtgatggtcatgaggactatggcctccttgttagtgagaacgcaaggaaatacgccataatc

SEQ ID NO: 3754 - DNA, 439 bp, Zea mays
  Clone ID: LIB143-005-Q1-E1-H9
aaccggaacgaataatgcaaattgagactacgcaccaactagtcctttggtttgtatcttaatataaaggtttcttttattgacggttcttcatttctcgacatctctcacgatctcaacaccaatcctttctccgcaaaacttctgaagaaggaggtctcagttttggattctactcacttatagatgaaatggttggagcaagacgagagcgcatgtgagttacgagaggaactagacagagttaattcagagaacaagaagctaacagatatgtcagctacagtctgtgagagctacagcgatttacataatcatttggacaagtttcagagtcgccacagccatgatatcgatcagaccgatataccgagtgagacaatatcacatgacccggatgaattcctaaggctttcctattggactcagtagtggaaaa

SEQ ID NO: 3755 - DNA, 402 bp, Zea mays
  unsure at all n locations
  Clone ID: LIB143-006-Q1-E1-A10
gtccctcgttcgcgcacgccaagcccgcctcaacctcccatgccggagcagcaccgcatcgccggagatccgccgtactggtgatccccggagcaggagcagacgcaatggaccgcatcatgatgtcccgcccaccccttcccgccccgacccatgccgctgcgggcgccgacggtgacttcctcgagctcgacgtgctctggcccgcctccccttccgcggtaggtctcggcctcctcgccgcgcttccggaggatgagggcaagaagaagaagcgcgccgcggccggggtcggggtcggggtcggagcccccgcccgatccgccgcgcgccccgtcacggagaccgtcgcagcgtccgcgatggcgaggtcggcgccngtgcgtataccgtcggatcccg

SEQ ID NO: 3756 - DNA, 424 bp, Zea mays
  Clone ID: LIB143-006-Q1-E1-A11
acgcatccgcatccctcggtcccttccatcgacggaaggagaacagggtacggccgtctcctcgcccccatggcccacgagaagaagctgtccaacccgatgcgggagatcaaggtgcagaagctcgtcctcaatatctccgtcggggagagcggcgaccgtctcacccgcgccgcaaaggtgctcgagcagctcagcggccagacccccgtcttctccaaggcgaggtacacggtgcggtcgttcggcatccggcgtaacgagaagatcgcctgctacgtcacggtgaggggcgagaaggccatgcagctgcttgagagcggcctcaaggtcaaggagtacgagctgctcaagaggaacttcagcgacaccgggtgctttggtttcggcatccaggagcacatcgaccttggtatcaagtacg

SEQ ID NO: 3757 - DNA, 447 bp, Zea mays
  unsure at all n locations
  Clone ID: LIB143-006-Q1-E1-A12
gtccgcagcctccaaagccactcccaaacccccgcttccagaaccttctcgaagctccccgccgcctcctcaactcgcaccgatggcgaaagaacaatgcgcgtgctcgtcactggcgccgcaggacanattggatatgccctggttcccatgattgctangggtgttatgcttggtgcagaccagcctgttattctgcacatgcttgacattccgccagcagctgaagcccttaatggtgttaagatggagttggttgatgctgcgtttcctcttctgaagggagttgttgctacaactgatgttgtggaagcctgcactggggtcaatgtggccgtcatggttggtggattccccaggaagganggaatggaaaggaaagatgttatgtcgaaaaatgtttcaatctacanatcccaagcatctngccttgaagcccatgcagct

SEQ ID NO: 3758 - DNA, 424 bp, Zea mays
  unsure at all n locations
  Clone ID: LIB143-006-Q1-E1-A2
ccgtccggaagngcatgaacaaaattatctgtcaataactctcccacacttaaaaagagaagaactcttctgagtttagactgaccagacattctctangggtaccatggcaagatcactctccaccgccctcatgaggggacttatgagatcgtcccgtgcatcgacatcagctgctgtgtcacgaccagctatccagcagtttatgaactattcatcaggtcttagtggcactcctaatgcaaatggggactcagtgacaacacgagtagctgctgatcacgacacccatcaagattttcagccaacaagtaaaagttcagatatgtctttcagtgacattgttgctcaggatgtgaaggagcaccctgttgtcatctatatgaagggttatcctgatgctcctaagtgtggtttcagtgca

SEQ ID NO: 3759 - DNA, 441 bp, Zea mays
  Clone ID: LIB143-006-Q1-E1-A5
acgcatccgcaaaaccctactacataacccgccattcccactcccctcgcccaccgccgcctgcgtccacctccgccccccgccctcgccgcgtcccgcctctcctacgcagatcgtccacgtaagatgtcgtctgacgcggtgaatgtggcggtgccggagtcggtactccgcaagcggaagcgcgaggagcagtgggccgccgagaagaatgagaagtcactggccgagaggaagaagtcgatcgagagccggaagctcatcttcacccgcgccaagcagtacgccgaggagtacgatgcccaggagaaggaactggtacagcttaagcgtgaggcccgtttgaagggtggtttctatgtcagccctgacgcaaagctgctaattgtggtccgcatccgtggtatcaatgccatgcaccctaagacccagaagatattg

SEQ ID NO: 3760 - DNA, 431 bp, Zea mays
  unsure at all n locations
  Clone ID: LIB143-005-Q1-E1-H1
cgtccggaatgaatgtctgtcctgtctgcatgcactcgtcttcttcctggtgagtaatccgtagtaagtactgtgagttcgatgatggaggaggatacagcagcagcagtgggcggactctgatgaacccgggcggctgacgcggcgcagcagcagcagctggcagcaggggatgccgcggcggctcgggtgcggcccgtggaaacgctgcttcgcgcggcaccgctggggctctgcgtggccgccatgaccgtcatgctacgtaaccagcagagcaacgagtatggcgccgtcgcctactccgacctgcgaggcttcaagtacctcgtctacgccaacggcctctgcgccgcctactcgctggtatccgcgttctacactgccgtgccgangcctgccaccgtgtcgcgctcctggctcgtcttcctcct

SEQ ID NO: 3761 - DNA, 383 bp, Zea mays
  Clone ID: LIB143-026-Q1-E1-E7
cccatccgcacctctctccatctccctgctcctccgccttcttcttgatccagccaagccagggatcgccatgtcggactcggaggagcaccacttcgaatcgaaggccgacgccggagcgtccaagacctacccgcagcaagctgggaccgtccgtaagaacggcttcatcgtcatcaagaaccgcccctgcaaagttgtggaggtttctacctcaaagactggtaagcatggtcatgccagatgccactttgttgccatagatatattcaacgggaaaaagctcgaagatattgttccttcgtcacacaactgtgatattccgcatgtgaaccgtactgagtatcagctgattgatatatcagaggatggatttgtgagcc

SEQ ID NO: 3762 - DNA, 287 bp, Zea mays
  Clone ID: LIB143-026-Q1-E1-E8
acccacgcgtccggcctcactgctagccacacacctgagctcgccgcccgtcagacgcgacaccactcagcgcggtgcggcagcaccgcaacaaccattggagcccgcggcgatggaccgcatctccacccgcttctccgccgtcgatgacctctacttcccgtcgtccttcctcggcccgtctaccgccggtaccggggctgcgcccgttcctatcgcagccgctgcgcatggcggtgctccgctctctcatctctcgcgacacgccgctcttcatggaacggtac

SEQ ID NO: 3763 - DNA, 395 bp, Zea mays
  unsure at all n locations
  Clone ID: LIB143-026-Q1-E1-E9
gaacggacatggcatgcagtgggtgcagctgcgaggcggcggtgggggcgatggcgtcggaggcgtacctggagggggcgccggtgcgggaggcgcgggagctggtggcggagctctgtcggcacttctacgcgcagggatgggtcacgggcaccggcggcagcatcaccgtcaaggtcaacgaccccgccgtgccgctcgccgaccgcctcatcgttatgtcaccctccggtgtgcagaaggagaggatggtagcagaggacatgtatgtgatggctgcagatgggaaagtgctttctgcgcctgtagcanagccatgggcaaacaagcctcctaagtgcacggactgtgctcctctgttcatgaaggcgtatctgatgaaaggacctggggct

SEQ ID NO: 3764 - DNA, 359 bp, Zea mays
  Clone ID: LIB143-026-Q1-E1-F1
ccaatcacatcctccacccaatcgaaggacctagcgagcggcagcggcggcggcgatcggagaagatggtgcgcaaggcgaaggttgagttcgacgagcagccgccggataacttcgacccgaagaacccgtatgccgacccggtggcgatgctcgagtaccgggaacacctggtgcgagagaagtggatccagatcgagaccgccaagatcatccgggagcgcctccgctggtgctaccgcatcgagggcatcaaccaccaccagaagtgccgccacctcgtcgaccaatacctagaggctacccgcggcgtgggttggggcaaggatgcccgcccgcctgaactccacgagcccaag

SEQ ID NO: 3765 - DNA, 84 bp, Zea mays
  Clone ID: LIB143-026-Q1-E1-F10
aagttacggaggggcagcggctgaccacggggtttccctcgcggactgatcggtctggggtttttaacataccggggttgtacc

SEQ ID NO: 3766 - DNA, 402 bp, Zea mays
  Clone ID: LIB143-026-Q1-E1-F11
ggtaaacgcatggagattatcgaactgccaactcataggtttttcgtcggtgcacaatttcatcctgaattcaagtcaaggcccggcaagccatctccgcttttcttaggattggtagcagcgtcatcaggtcagcttgatcacctgctccaacctggtcttatcagttcgactggcagacacacctgcagcaaaggaggagcgcaaaaattaaaggctgggcacgtcatgaagccactgaatggcctggtgaacgcacactattcagcaaccggcaatggcgccattcccatctagcagcgcagagctgcgacgcgtcgcgtgcttgtttgggatttctcttctaccgttactgcttgttccttttttttccctttccctcgaagggtgttcttccgtacg

SEQ ID NO: 3767 - DNA, 414 bp, Zea mays
  Clone ID: LIB143-026-Q1-E1-F12
cactggacccatggcgccgccggagcagctggcgatcaagcccgacatggccatttccgtggaggcgtaggttggttaaagtgtgatagcagagtgagtcgatatcgatcagtagtaggtttgtcgagtcgcctgctgctgctgctacgcgacagcagcggccagatgtactgcctgcatgcatgcagtccctcccgttgactcgacccgtagagatgggatgggatggaagtagccgggcccttgggcgagtagcggcgccttgggttggcacccacgggccagccgtactggcctgtgtgatgaaccggcgagagaaagagatgagataatgtgcgagcgagagagaaggttgggttgtggtagactggtagttgaagaagacggctagctagctagatgctgctgggctct

SEQ ID NO: 3768 - DNA, 421 bp, Zea mays
  Clone ID: LIB143-026-Q1-E1-F3
ggtcgacgcccgcgtccgcacaaactttcgcgctgctaccgccgccgcggcttccttctctacccttcttccctcgcgccgccgccaccgcaagagtatctcaactctgccccgagacctcccccctcgctggtctcagccatggtgaaatattcgacggagccgaccaaccccaccaagtccgccaaggccatgggccgtgacctacgtgttcacttcaagaacacacgtgagacagcttttgcccttaggaagttgtcactcaccaaggccaaaaattaccttgaggatgtgatcgcccacaagcagggcatcccgttccgcacgtattgtggtggtgttgggcgtactgctcaggctaagtctcgccactcgaatggtcaaggacgctggcctgtcaagtctgctaaattcattctag

SEQ ID NO: 3769 - DNA, 422 bp, Zea mays
  Clone ID: LIB143-026-Q1-E1-F4
cagatagttcgattctaaaagcaaggtatgctggccgtccaaaacccaattgtcggttcactgacccattcatggatggcaaaagtctgatgaaaatatggaacttgaacaatttcactggtgtcattggagtgttcaattgtcagggagctggacagtgggtttggccagttaaacaaactgcttatgttcctaccaacataaacataactggtcagctctcaccgtccgacgtagaatctctcaaggagatagctggtgatgactggaatggggagactgcagtatatgctttcggttcatgttctctttcaaggcttcagaaacaccaaagtttggaggtgtcactgtctactatgacatgtgagatctacagcatttcaccaataaagattttcagcgaagtcgtccagtttgcgcct

SEQ ID NO: 3770 - DNA, 278 bp, Zea mays
  Clone ID: LIB143-026-Q1-E1-F5
atgaagcctctccactcgccagtgctcggccgccgcctgccgcaacccgccgtccactggtcacgcctccctgcgtccgctccactactcctggcgtccgctccattgctaccatcgtccggcgttctgctcctgcgccctccctttgatgcgttgccagttgtagtgtccggtcagatttgagctatggcagcaagcaaggattgacgaagcgtgcgttcccatcgcaccatcatgggctacacagagatcgacatccgcccctctgggagcgggca

SEQ ID NO: 3771 - DNA, 315 bp, Zea mays
  Clone ID: LIB143-026-Q1-E1-F6
agtaaggcctctccagtctcgactgctcggccgcctcctgccgcaacccggcgtccactattcacgcctgcctgcgttcgctcaactactcgtggcgtcagctccattgggaccatcgtccggtgttctgctcatgtgcccggcctttgatgcgttgctagttgtagtgtccggtcacgtttcagctacggcagcaagcaacgattgacgatgcgtgcgttcccagtctcatcaccatgcgctacacagctgattgacatccactcctctgggagcggtaagctacgtgagggagtgacatactgccgactacgg

SEQ ID NO: 3772 - DNA, 374 bp, Zea mays
  Clone ID: LIB143-026-Q1-E1-F9
cagcgagcgaccgcaccggcacggcgcccatccatccatcgccatcctctagcccagtccaaaggaaccctagccatgagcgccgcctccaagaagctcttccaggccgccaggtccctcgtcctctccgcttctaaccgctccgtcctcgccgccgagggctgcaccgccgcgctcgccacgctcaccaactttggcaggaagaccctccccaccgcctacttatcctactacaagcagggatcgcaccatgccgcgtcggggtggggagccatcgccgccgcagtcccagctgcagtttaaatgctccaggaccaggaggctcatgctgcagagatggagcgcatcttcattgccatcaagcctgatggtgt

SEQ ID NO: 3773 - DNA, 421 bp, Zea mays
  Clone ID: LIB143-026-Q1-E1-G1
ccgcagaggcgcagagacaggcgtcttcgtactcgcctatctccgcgactcaaagcttcttccatttcctaccgccgccgctgcagctccaccccattccgtcgacaccatgagggagtgcatctcgatccacatcggccaagccggtatccaggtcggaaacgcgtgctgggagctctactgcctcgagcatggcattcaggctgatggtcagatgcccggtgacaagaccattgggggtggtgatgatgctttcaacaccttcttcagtgagactggtgctgggaagcacgtccctcgtgctgtttttgttgaccttgaaccaactgtcatcgatgaggtgaggactggcacctaccgccagctcttccaccctgagcagcttatcagtggcaaggaggatgcagccaacaacttcgcc

SEQ ID NO: 3774 - DNA, 432 bp, Zea mays
  Clone ID: LIB143-026-Q1-E1-G10
atcgatacctcaacctccaattaatcaattcagcaaacatcattctaatccccaaaaaggaaggcgcggaggtagctggggacttcagacctataagcctcatccattctttcattaagattatcaccaaaaccctggctcttcgtctggcgccgagaatgaatgagttagtttcaccttgccaaagtgccttcattcaaaaaaggagcattcatgaaaacttccttgcagttagaagcgctgttaggcgcttccagcgtattaattcgcccacgctattcctcaagctagacattgaaaaagcttttgactccgtccgctgggattacttgattgccttactccgcaatttgggattccctgtgaggtggactgactggatcgcttctatcctctccacctcaacatcaagagtgctcgttaacgggggtc

SEQ ID NO: 3775 - DNA, 414 bp, Zea mays
  unsure at all n locations
  Clone ID: LIB143-026-Q1-E1-G12
ggcctcactctttttcctcgcactccgcaagacgcaagaccacctcaccagcctcctcgtccccgatctcctcccacccgcatccaagggtttccttctcgaccgtgcggaacgagccagagaacaggtatggcggcggcgcggcacctcagatccggcctcnccctcctccgcgcccacctcgcatcctccgaatccgcggccgtcgctcaagtttcgaggggcttcgcgtcgcaagccgccaagcccaccgggaaggagatcaaggttccaaaggctctgtttggcngcacaagcaactatgccagtgcactgttcctcacagcagctaaatctaatgcattggacaaagttgaatctgagattaaagctattgtagaggcttccaagaagagcccgttgttttctcaattc

SEQ ID NO: 3776 - DNA, 273 bp, Zea mays
  Clone ID: LIB143-026-Q1-E1-G2
cgtccgacgccaacgcgcacagcgccgcctcctccatgtcgtctacctcctcgactcacaccttcttcgatttaccacctcctgccgctgcagcgccaccccagttcgcgtcgacaccatgacgggactgcatctcagatccacatcgtgcaagccgggtatccaggtcggaaacgcctgctgcgaactctagtgcctctagcatggcattcaggctgagtgtcagccgcccggtgataggaccattgcgggtggtgatgatgcgttcatcac

SEQ ID NO: 3777 - DNA, 406 bp, Zea mays
  Clone ID: LIB143-026-Q1-E1-E6
acgccggtacgacgccggcgagctgccgcggttcgacccggccacgacgctcgtgtgcgagggggactggacgtgcgcgcccgtgccgccggccgtggccgaccgcaccgtggagatcacgggccccgctgagccgcggaagatggtcatcaccgcgctcaactccggcgccaaggtcttcatggctgacttcgaggacgcgctgtcaccgacgtcggagaacctgatgcacgggcaggtgaacctgcgggacgccgtggatggcaccatcaacttccgcgacgcggctcgcgggcggacgtactagctcaacgaccgaaccgccaagctcgtcgtcgggccccgcggcaggcacctcgctgaggcgcagatcctcatcgaaggcgatccggccactggcggcctc

SEQ ID NO: 3778 - DNA, 338 bp, Zea mays
  unsure at all n locations
  Clone ID: LIB143-026-Q1-E1-D1
agagcaaccgcatcgaactctacctgcctttctctcgtccctggcggcggcggcaggatggcggcttctactgcgaagacnngtgaagatgtaaacccccacaattttgtcaaggctaatccggccaacctaaaagctccgggaagaatgaacctcccgaattggtttaccattgtgagaactgcaaggttcaaggacctccctccttaagaccctgagtggtaatacatcagggctgcatctgtaccagggaatatctatttgacaaagcacttgggtttggggcgtccacaaaatttatagtgggcgccacaggaaaaggtcacacccaaatcaca

SEQ ID NO: 3779 - DNA, 103 bp, Zea mays
  Clone ID: LIB143-026-Q1-E1-D10
gtccgagattcacgggctactaatgttttccggatcggctagtgctgacatgcaaaaaaaatgttccatatttatacattggttccagtatagtagtctttgc

SEQ ID NO: 3780 - DNA, 279 bp, Zea mays
  Clone ID: LIB143-026-Q1-E1-D11
taaaaaagccgatcaatatgatcgccctgtggagccaccagaaggtgtaccacccgtgcgccatcaatgcggcgttcgctgagttcatctccaccctcatcttcgtcttcgccggccagagctccggcatggacatcagcatgctgactcgtagctgcacgacgaccccagcgggtctgatttcagtggctgtcgctcaaacgttcgcactgtgcgaagcgctatctgttagcgcaattatctgcattggacaaattcaccctttcatcagcttccgta

SEQ ID NO: 3781 - DNA, 363 bp, Zea mays
  unsure at all n locations
  Clone ID: LIB143-026-Q1-E1-D12
cctgcccggctggcggctgcccccgtcttcgtcttccttaatctcaaattcncaatcctcctccgacgccttgtttctggattatccagcggggggacgccggtgtattgctcggtcctcctccctggttgcccgaggcagccgtgacggaggcngaggtagcgggggggaccatgtacagatcggcgggggtcgcgatggcgtggaacgtgttccggttctgcacggctctccgtgggctgggttccatcatgatcctactcgtcctcgccatcgtcggcgttacctactacgctgtcgtcctctgcaactacggccccgccctcctcaccggcggcggcaacactctcgccgcgctcgctg

SEQ ID NO: 3782 - DNA, 388 bp, Zea mays
  Clone ID: LIB143-026-Q1-E1-D2
aggcggcgcagcatcgctaccaccgtccaaagatggtgaagttcctcaagcccggcaaggccgttatcctcctccagggccggttcgccggccggaaggccgtgatcgtgcgcgttttcgaggagggcacccgtgatcgtccctacgggcactgcctcgtcgcgggcctcgccaagtaccccaagaaggtgatccgcaaggactccgccaagaagacggccaagaagtcccgcgtcaagtgcttcatcaagctcgtcaacttcacgcacctcatgcccacccgctacaccctcgacgtcgactttaaggacgtcgcatcgggcgggcccgacgcgctctccacccgggacaagaatgtcgaagcctgcaaggccgccaaggcgcgcct

SEQ ID NO: 3783 - DNA, 407 bp, Zea mays
  Clone ID: LIB143-026-Q1-E1-D4
ccccacggttaaaaaaaaatggcgggccgccggcgaacaaaaaaattcttaaaaaaccggttcaagcatttcagaaggcccaacctcaacggctacaagtgcctaaagccaagctggcgcaggccaaagggtattgattcccgtgtcaggaggaagttcaagggatgcaccttgatgcccaacattggttatggttctgacaagtcgaccaggcactacctccccagcaagttcaagaagtttgtggtccacaacgtttctgagctggagttgctcatgatgcacaacaggacctactgcgctgaaattgctcacaacgtgtccaccaagaagcgcaaggagatcgtggagcgtgctgcacagctcgacattgtggtcaccaacaagcttgctaggctccgcagcca

SEQ ID NO: 3784 - DNA, 415 bp, Zea mays
  Clone ID: LIB143-026-Q1-E1-D5
actgactcgtgagccgctatctccgtatcctccgtcgcttcgagcatcaatcatctctgcctactgcgcaaagtacactgatgagctcatcctgaatgctgcctacattggcacccctgtcaatggtatccttgctgctgaggagtccactggcaccatgtggcaagcgcctttccagcatcactgtcgataacgttgaggagaaccgccgtgccctccattagctcctagtctgctgccctggtgctctccattacatcagcagtgtgatcctcttcgaggagaccctgtaccagatgacctatgatggcaagccttttgtctatgtcctcaacgatggaagactcctccctggcatcaaggttgacatcggcaccattcaggttgttggcactgataatgagaacactgccca

SEQ ID NO: 3785 - DNA, 196 bp, Zea mays
  Clone ID: LIB143-026-Q1-E1-D6
agttccagaatatcagccctggtgcagcagactcgctattacaagttgctgtgaatcatactcatcagccagtgtggtatttcaatgaaaaaattccactgcatgttttcgttggtgaagatggataattggacccatctaattttcatgatgcctggatatcctttgctgatcaacattgattttcgatctaatt

SEQ ID NO: 3786 - DNA, 410 bp, Zea mays
  Clone ID: LIB143-026-Q1-E1-D7
gtttagtagaaggctcagttagcaggatcgttgcaagaaaaacaccagagagcaggtgtcctgcaatttcattagcagaagttcctagcaaacaagcaagaaatgatcatgaggcagcagagaagcttaagtttgtcatttatcaaaggcccaaagcattccaaaatggaagcactgatttgggaaacaagaatggtgcaccaaaaactgttgaagagagaatagaggaatataataaagcacgagcacgcatcttcaatggttctgtttctgcagattctgatgctgcaagtgttttgggaactctttgcactggcagagatgagtcagtaaatgttgaaccttctgttgatgaaatcaaagtcagcacgatgaacaaccgttccagagttgctgttttcaaagatact

SEQ ID NO: 3787 - DNA, 356 bp, Zea mays
  Clone ID: LIB143-026-Q1-E1-D8
attgacgaggacgatgaggctccggaggctgacaccgacatgccccctctggaggatgacgctggcgatcagcaagatggaggacgtcgactaagctgggtttattcttatggaggacagagagagaacatctggtcagttctgtgggtcttaccacttacgctattatgcactctgttgttggtatgctagtgcgagcattgtctctgctgtcttacagttaaatgtgtagttgttttgcctagtcagtatcttcaacgattcagtttcagaaaacatctcatctgtgagatgatttgggagttcgactgagagttggaacacattgcctagttcttctgtcttctgttgatgaa

SEQ ID NO: 3788 - DNA, 404 bp, Zea mays
  Clone ID: LIB143-026-Q1-E1-D9
ggtccacgcacgcgtccgggatgaataacatggtggactttgccttcccgtacctgttgcagttcatccgtgaatacactagcaaggtggatgatttagtgaaggacacaatcgagtcacagaatgaagaaagagccagagagaaggaggagaaagatcttgtggctcagcataccatgtatgcgcaactgcttcctcttgccctgcctgctccgccaatgcccggcatgggtggccctccacctccgatgggcggaatgggcatgcctccgattggcgggatgggcatgccgccgatgggccctggtccgatgccagcattcgggatgccaccaatgggaagctactgagatgtattttttggcagagagcttagatgatgaattgatatgttcctgtgtaag

SEQ ID NO: 3789 - DNA, 421 bp, Zea mays
  Clone ID: LIB143-026-Q1-E1-E1
attcagaactggatcgaagatttattctggaaacaacttgatctcgactacccaggcatgcctgaagcaaatgttcacagtggattttattctgcttaccacaacacaacaatgcgtgacagagttatgagaggtgttaaaaatactaggaaactgtatggtgatattcccatcatggtcacaggacattccatgggaggagctatggcttcattttgtgcccttgatcttattgttaatgttgggttcaaggatgtgtcactcatgacatttgggcaacctcggattggcaatgctatatttgcatctaatttcaaaagatatttgccgaatgcaattcgattgatcaatgcacatgatattgtgcctcatttacccccatactatcactactttccacagaagacataccaccattttc

SEQ ID NO: 3790 - DNA, 112 bp, Zea mays
  Clone ID: LIB143-026-Q1-E1-E10
ggtcagttttatatatgccagctgctcatcgcagcattcgccatgtgcacaacgccaaaatgcgggaagagatcaattattaaccgagtgaaagtgtttggagaatatcgtg

SEQ ID NO: 3791 - DNA, 398 bp, Zea mays
  Clone ID: LIB143-026-Q1-E1-E11
acgaaacatagctacctactactcaagtatccatccttattgagtacagtgttgatccatggactcggaaggagttgtagcagcaaaggtggcagatgagactactaaaccggcaatccaagaagacggcgccgagagcaaggccgggatgactgatctgctgatgctgaccgacaagtcgcagctgcaggcgctggcgatgctgctgcggaacaacgaggagctcatgatgagccaggcgatcaagtcggagacggagcgcattgagtacctcaagacggtgagcgactgctacacgcggacgatgaagctcctcgacgattccatggcggccaggaccacgtacgagcgttcgggcggaacgaggagcctcgtcgcccgggacatggacgactacg

SEQ ID NO: 3792 - DNA, 420 bp, Zea mays
  Clone ID: LIB143-026-Q1-E1-E2
accacacgtccgcccacgcgtccgcccacgcgtccgcccacgcgtccggtcgcgctcgcgcggcggctctcatccctagcttcaccccatccgtcgtctgatgccagccgccaggaaccgctcggttctctcgcaagggagccggagttacaagagcgcgaaggtggcagcgaagaggctggaagaggcatcgctctcctgcaaaggggacgaacgggtgcagctgctgcgccggtggctcgtcgcgctcaaggagacccagcgcgcgaccactgtggtccgggagccgcagcttggggacaatctggaccagactacgcccctgctggatttgtacatccattacgatagcggtgcggaaccgatgaactttttccatgtcttcctctacagtcaagccctcaagtgcgttgttcgctc

SEQ ID NO: 3793 - DNA, 191 bp, Zea mays
  Clone ID: LIB143-026-Q1-E1-E3
gcgtccaaatggaccaaccatagcatccgagctgcgagtccgtggaagccggtcatactgatgagaagcgcacaggcatcgctcgccggcgataccgacgacggatgggcctcctgtaagacgccctggaggctttcaccatctgcccgcagtacgttgaaatcgtccgtggctacgccgtcattgtcctc

SEQ ID NO: 3794 - DNA, 418 bp, Zea mays
  Clone ID: LIB143-026-Q1-E1-E4
attttattgaaaagtgcagcgttcctccgtttcgcttctcccgctcccttccgcaacggcgtactccctccgccgcccgccgaccgccgactcccgccgcaaaatcctgcgtcagaagcgccgattctcggacgtcctccggatctgagacaccgagcgcactacgagctgtagctgtagtgacctaaaaatgagtgagggggatgctactcagcttgcccttgagaaaggattaccgcaagtgtctaatgatgatggttcgagtagtcctgcaactatgcacaagttgaaagttgacacagaagatgctggaagcaaaattgaatcacccactccagagaagcttgaatctagaagcaaaggggttgttgtgagttcgttggcaaggaatttacttgcagagaggtacaaagataga

SEQ ID NO: 3795 - DNA, 364 bp, Zea mays
  Clone ID: LIB143-026-Q1-E1-E5
aagagattggcagagttaatgaagcaattcaggattatgttcaggcagcaacaatctctttgaatgtgttccctctattaactagtgcatcagctgctgtaggatctatacggagtacttcagtgtaacatgtgatagcatcagcatactttcgctgttgcttgtatatcacagcgaagttggtaattgcggaagatcaccaagatgtcacagagatagctgctttgtaaaatgaattagcagagatgatcaagttccaatcaatgtgcaagtatcgtagtcagtacttctgggtgtgcatactttccatgagggtgcttatcctgatgctacaatgcgtgcttcggaagtacgccgtatagat

SEQ ID NO: 3796 - DNA, 404 bp, Zea mays
  Clone ID: LIB143-026-Q1-E1-C9
gcgtccgaacaccagtggcgtcgcggtacgagggctttagtgacgtgtcttgttgattcgatggcgctggcactgatcaccagggctgctcgtactcgagccttcaacgccccgagtagtcctaccagcccgccccttcttttcttcgatctccgcagtcgagagatttgcttcgccagggtcgagcggctagggtttcaggagtgcgcggtgagacggcatgataccgcggggagctaagcgcgcggacaactcagaccccgccgcagccgatttaccaagtaacagagtaatggacggacactcttttgatgttcacagggcggagtcttcccatcagcatgtgatggcaggacccgctagtttagatcctcggcgggcggaagctgctaacaaacatgtta

SEQ ID NO: 3797 - DNA, 377 bp, Zea mays
  Clone ID: LIB143-026-Q1-E1-B2
cccacacgtccggttcgtgctagtgatgacacacctgccacaggagaatccctaatgtcgcaaggacagaccctcgtatatcggatgagaatgattgctctcaagcgagagtttggtattttccgtacacacgtgtctgcaacgacgattgcagttcagtttactaaaccattccatgtaagcacacgcgtcgtgaacaagtgcaatgatggagctctacttctacaggtgatattcacttcctggagtgcacgcaacactggatgtaaaatgagtaccgatagatcttcaatctggatgtgatcacatgggcaaaggacatgggatggcaactttgactttagtccctctggataatgcaccttcgacgaaagctg

SEQ ID NO: 3798 - DNA, 439 bp, Zea mays
  unsure at all n locations
  Clone ID: LIB143-026-Q1-E1-B4
gggtcgagcacgcgtcgagacaactgtaaaaaggtccggctaatggtccaatcctccaaccggcaataataaaacctcaaaaatcaatcctcaagaaactttaagccatgaaggcaattcaacaatccccaatttaataactggaaacaacagtttcaaagaaatccaaagggaataacctggccctaacccttaacacaattggcacactgggtaaaccaaaaggattatttaaaacccaggagggcatcctttcccaggttaaaatccaatctgaaccgtggggatatcgaagtgaagaccaatttctgcactgtctcccgctggcacatgtgcatgggcttttcaatgctctatttgcgcccctttattcaggatcagtggttgagtttaatacannaatcagtgtaagcgggatatggcagagatggcgagaatc

SEQ ID NO: 3799 - DNA, 374 bp, Zea mays
  Clone ID: LIB143-026-Q1-E1-B5
acccacgcgtcggggccatcgtatgtggacctgaagccattgacgtcgcactcagtgaccctgcggcctaaccgccataagtaacccaagtcgacaactaggatcctcagccaaaggcatctccggccgccgtatcagtaaggcggcaacgctgcccgctatgcagatagtcttgtctggctaccgtgtcaccgtagacacgtttgactgcctccccgacgacctcttactcgccgtgttagccggcatcgctgctctcgcccggtgccccgccgacctcgctgcagccgcactaccgtgcaagatgttccgagacctcgcggagcactccgccgtgctgtcgcgtacgtcggcagcggccgtctccgtgccct

SEQ ID NO: 3800 - DNA, 405 bp, Zea mays
  Clone ID: LIB143-026-Q1-E1-B7
aatgacgcgtgccggacgcgttgggcgcctaccccgaccggaactagccattaccgacggaggcccgtcagcagcgtcggggcaaagagttcaccgcgcgcgatcaagcgattgatgcccccgtcactgcgggaatgggttcgggtcaattcgcggcggactacgtctcgctcggcgtcagggagcccgtctacgaggtgatagaagtgagatcaaatgggaggatgtcgaccaagagactacgcaggcggcagctactgaaatctagtgggctccgcctacgagatactataagtgttgacccatcactatggttaatgaattcaatgccttccctgctggtacgtgagcaggctattttactcaatcttggttcgttgcgagcaattgctatgtatgcgcgtg

SEQ ID NO: 3801 - DNA, 347 bp, Zea mays
  Clone ID: LIB143-026-Q1-E1-B8
gagagaacccaaacggagagagacaatcgagagagatggcaaactgttttggtgacgtcgtggacaattacaagctagacacaatgccaagatatatcggcaaaaagaagactcgagaagaccgggcacgagaggcctcctatctcagtaatgagaatgagaagtacaagaaagctaaagactatgtgaacatgctgaaggactggtacggcaatggagcgtcgaagctgtgcgtgatctacaaccagacgggcggaaccctgcggtacgtcgacgacaaggactggctgggctacccgggggccgacgccctagccgacggagatcggcaacgggcagtgggcgtc

SEQ ID NO: 3802 - DNA, 388 bp, Zea mays
  Clone ID: LIB143-026-Q1-E1-B9
gaagcgtagtaaacttcgagcgggaccggcgatatccgccatggacatgaccactgccgccgctcgctggagcttccccgcccgtctccagctcctcacgagacgtcgcctttgcctcaccgcctcatctgcagcaccacttacttctgtatcagggttcagttgggcggacgtactccgcatcgctgtggaacgactgcgcagccacgagtcctacctcacagggaagatggcattcgttctcaggtgcaaatgcgatctggatcgtggagagcactacgtgaagatcactgtcgacgatgacgccctctggtacatctacatgggatttacaatgcacatcattgcacctccattattcaggataaatggttaagtttagaccatg

SEQ ID NO: 3803 - DNA, 376 bp, Zea mays
  Clone ID: LIB143-026-Q1-E1-C10
gtgagcaccatggtcctcgtctacaacgccaccggggccagcctgagcctggtggacgacgggaaagactggatgggctccgtctacagctcgccgatcccggacaccttccacaacgggcagtggatcgccttcctccacgtcaagcccggctcgctggcgcagggcagccaggccgccagggtgttccgcggcagggacgtcgatggccggactcgggacttcgtcgtcgcctggtacatcccgtgggacaacataccgacacgagcttacactgaaattggcagtgaaaactacttcaagactcggtggagtagtgtcaaaacgagtctaggacattcaaggagagtgacccgtgccaaggacgagaactgtg

SEQ ID NO: 3804 - DNA, 413 bp, Zea mays
  Clone ID: LIB143-026-Q1-E1-C11
gagagcaccaaggtcctcctccataacgcgaacgggggcatgcctgagcctgttggacgacgggaaatactggctgggctccgtctacaggtcgccgatcccggacaccttccacaacgggcagtggatcgccttcctccacgtcaagcccggctcgctggcacagggcagccacgccgccagggtgttccgcggcacggacgtcgatggccggactcgggacttcgtcgtcgcctggtacatcccgtgggacagcataccgacacgagcttacactgaaattggcagtgaaaactacttcaagactcggtggagtagtgtcaaaacgagtctaggacattcaaggagagtgacccgtgccaaggacgagaactggtcgtcaactgtcagcatcggtggctacactacagcct

SEQ ID NO: 3805 - DNA, 413 bp, Zea mays
  unsure at all n locations
  Clone ID: LIB143-026-Q1-E1-C12
gcaggcagttgactttcctggagggaaagtatcctttgtggcagaaatgaacttccttccagaatcgacgagggaaaggatcaactgctaccgcgtgcttgacgacgacggcagaacgatatcaggaagtagattccaagaggtcagtcgggagctggctctgaagatgtacagcgagatggtgacgctccagatcatggataccatcttctacgaggctcagaggcagggcaggatctcgttctacctcacttccaacggcgaggaagcgatcaacatagcctctgctgctgcgctcagcatggatgacattgtgctgcctcagtacanggaacctggtgttcttctatggcgtggcttcactctgcangaatttgcannacagtgctttgggaacaagctggactatggta

SEQ ID NO: 3806 - DNA, 291 bp, Zea mays
  Clone ID: LIB143-026-Q1-E1-C2
accacgacgtccggccaagcctccgaaacgaatccagaacaacgcaacaaaaccccgggttcaatgggacaatggaacggaactccccgccgggggctccccgccgggcttgaaccgaaggggagctacggctacgacatctagagcatggacggctccggggccgggggcccggtgccgtggagcgcacatcacaacggctcctccgaggcctgcctctcctaccaagactggtgtgcagactgctggatcacacatcaggcgctgcagctataaacccagcttgaacag

SEQ ID NO: 3807 - DNA, 342 bp, Zea mays
  Clone ID: LIB143-026-Q1-E1-C3
gtgtacgcgtccaatgacgtctcttgcacagcgcaccataactcagcatttactgaacatggactgcagctcccctcggaggcgtcctcgctggcatgagcgggagaggagctactggtactacatctaatagcatggactggtctggtgaatgtggaccgtctgctttaatcatcaattatttaagctcataactatggattcattcctcacacgctttgtgaacacagtgatcctttggatgtactggttataatgcaggagcctgttatcccaggctgtttcctatgtgcgattgcaatcggccttatcccgaatattgatcagggagaagcagatgac

SEQ ID NO: 3808 - DNA, 353 bp, Zea mays
  Clone ID: LIB143-026-Q1-E1-C4
ctcaccactgccgtctccttcccaaacccggctgccgtctcctttgattccacggcttgccacgcagcagcagcaaaactcctagtcaacccttcaactcgcctactactcctactagcccgccccttcttttcttcgatctccgcaatctacagctttgcttctcccggctcgagcggctagggtttcaggagtgcgcggtgagacggcatgacaacgcggggagctaagcgcgcggccacctccgaccccgccgcacccgatttaccaagtaagagagtaatggacggaccctcttttgatgttcacagggcggagtcttcccatcagcatgtgatggcagggaccgctag

SEQ ID NO: 3809 - DNA, 325 bp, Zea mays
  Clone ID: LIB143-026-Q1-E1-C5
agcgcacgacaccaatcgcaacagccggtctgccctgcctgaactacacaatggaacgggcaccaccagcggcacacgacgtcaccaaatcctggcgtgggccgggactacgacacccactacggcggtgcgcaaggctacagtcagcagcctctgacgcagtggagtgcaaggaaagtgcagcagcagagctacaagcctgagccgtcaaggcagtggagttcttcccaggcgccacagtgcagctacgcacacgtcgagccgtcgaggcagtggatttcttcccaggcgcatcagagctacgctcccgagctaccgaggcagt

SEQ ID NO: 3810 - DNA, 229 bp, Zea mays
  Clone ID: LIB143-026-Q1-E1-C7
acccacgcgtccgcccacgcgtccgcccacgcgtccggcatgtttgagtatgtgttgcttctctgtggtgccggcgacgatggctgctactactgttaatgtgatcgggtctccttgaacaatggcataaatatgttgcttgtttactttttcctctaatggcacgtaaagttcatgatttgcgaaaaaatgaaaggtcaaactgaacttaaagataaaatgaccttat

SEQ ID NO: 3811 - DNA, 411 bp, Zea mays
  Clone ID: LIB143-026-Q1-E1-C8
ccccgtccgtcaccagaggaagaggaagaggaggatgtcggggtcgaaggtgtacacccttgaggaggtggccaagcacaacaccaaggatgactgctggctcgtcatcggcggcaaggtgtacaatgtgaccaagtttctggaggaccaccctggaggtgatgatgtcctgctgtcttccactgccaaggatgctaccgatgatttcgaagatgtggggcacagcaccaccgcccgtgcaatgatggacgagtacctcgtcggtgagattgatgcggccacgatacccagtaaggtgaagtacacgccccccaagcagccgcactacaaccaggattagaaccccggatttcgtcatcaagatcctccagtttttggtccccctggcaatactgggcctggctgttgctg

SEQ ID NO: 3812 - DNA, 367 bp, Zea mays
  Clone ID: LIB143-026-Q1-E1-B12
gaggtgatcatcatctcagcctggaactaccctttcatactctcgatcgacccagtcattggagcaatcgcagctggaaatgctgttgttctgaagccgtcagaaatagcgccagctacctcgtcattgctagcgaagctgctgcccgagtacgttgataactcctgtattaaagtcgtggacggaggcgttgcagaaacaacctcactcctggaacagagatgggataagatcttctacacaggtaatggaaccgtacgacgcatcgtgatggcagcagccgcaaagcatctaactccggtggctctggagcttggtgggaaatcccctgttgttgtggactcaaatgttgaccttcatgttgccg

SEQ ID NO: 3813 - DNA, 287 bp, Zea mays
  Clone ID: LIB143-005-Q1-E1-F3
cgtccgaaaattaacgtcttcttccccgttcttgtcatcatcctatgtccgccagttctccgaaagcggcggctatcggttcgagccagtcctataatccactgcgtcgtagagcggtgtcgtgcgaggagctcgccgccgtcgctacgcaacaggccgcagtgcacatgggcgctggggccttctcgcgcgcgtgctccaacgtctccgtcgtcttccgctggctcggcagcgctttcaagttcgcggagatgggctacttcgctaaggttggtgatttggttgag

SEQ ID NO: 3814 - DNA, 231 bp, Zea mays
  Clone ID: LIB143-005-Q1-E1-F4
gtgctcatttggagccacctgactaaattttagtcccgttagatcaaatgtttgaatactagttagaatttttaaatatagtataattacaaaattaattacgcagataaagactaaagataaggactaaacggtaagatgagtcaattaggcctgattagtctattattcgtccatgtgatgctacaataaacatttgccaaccatggagtcattaggcttaatgaattt

SEQ ID NO: 3815 - DNA, 425 bp, Zea mays
  Clone ID: LIB143-005-Q1-E1-F5
cacgagtcccgactcccgatcgcgattacttgccgcggcaccagtactccagcggccaccatgagcagcgggaagcgatccttcttcgcgcccaagaagaaggccaccaacccgttcgattccgactccgacgacgacaaaccgcagcagcggccagcgcgggcgtcctccgtgcctcccccggacgagcagcggggctcctcctctctcttcggcgccggcgacagaggcgggctcttctcttccgcggccaaccatcactaccggaacgacttccgcgacgctggcggccttgagggccagtccgtgcaggagctggagggctacgcggcgtacaaggccgaggagaccacgcgccggacgcgggggtgcgtcaggatcgccgaggagatgagggacaccgcatccaagacgctcgtcaccgt

SEQ ID NO: 3816 - DNA, 349 bp, Zea mays
  Clone ID: LIB143-005-Q1-E1-F6
ttcgccgggccacccacgcgaccggagaaaagcatatatggacgcactttcaaagatgagaacttcaaattggttcacactggacctggagtggtcagcatggctaatgctggaccgaacaccaacggcagccagtttttcatttgcactgtcaagacgccttggttggatggaaggcatgtcgtgtttggccaggtcgtggaagggatggatattgtaaggctgatcgagtcacaggagactgacagaggtgaccgtccgaagaagaaagtagtcatcagcgagtgcggggagcttccagtggtctaagcgttactcatctgttgtccgtttcacttctgacggatga

SEQ ID NO: 3817 - DNA, 432 bp, Zea mays
  Clone ID: LIB143-005-Q1-E1-F7
cacacgcgtccgcccacgcgtccgcccacgcgtccgcccacgcgtccgcccacgcgtccgcccacgcgtccgcccacgcgtccgcgctctcacccatccggcctatcctgggagtagtgttaacagcgccgcaccacctcgtgccgtgggaggtcgagctcatcgatgcgacgctcctcggagagcagcgcctcctcctgcgcggtcttctttggcgcgagggcgggcgggacggagggcgccgaggaggaggcggcggcggaggagctagggttagggttcgccgccgccgtctgagctgcggcgtcgaggttgctggggtcggaaccggtagcagctgcggcggaattcgcggagaccgccgacgtgccggccttggcgaggacctggcggtgctcttcgcggcgcttctggagctgcttctgctccagc

SEQ ID NO: 3818 - DNA, 442 bp, Zea mays
  Clone ID: LIB143-005-Q1-E1-F8
gggccacccacgcgaccggagatccgaagctcaatcaattcactcaaacctcttccccaaatcttcgattagattctcgttgacaagaagactagaaccgaacctgaccatgtcgctgatccgccgcagcaacgtgttcgatcccttctccctcgacctctgggacccctttgagggcttccccttcggctccggcaacagcagcagtctcttcccctcgttcccgcggaccagctcggagaccgcggccttcgctggcgcgcggatcgactggaaggagactccagaggcgcacgtgttcaaggccgacgtaccggggctgaagaaggaggaggtcaaggtggaggtcgaggacggcaacgtccttcagattagcggcgagcgcaacaaggagcaggaggagaagacggacacctggcaccgcgtggagcggagcagcggg

SEQ ID NO: 3819 - DNA, 235 bp, Zea mays
  Clone ID: LIB143-005-Q1-E1-F9
atccggatctgcgtaataatcccccgtcttcctcgtgagtgagacccggtcgtggctcactaggtttagggtgccatctcgtccgttgtctgtgggattcttgacctgactggccctgcccctggctttgcagccttggtcgccgcttcacagtcgttcgtcgtttgatctgtattcgcggttctgggcgcgttcaacgggttccgcaggactccgaaaagttctgcatcgtcgg

SEQ ID NO: 3820 - DNA, 443 bp, Zea mays
  Clone ID: LIB143-005-Q1-E1-G1
cgcgtccggaaagaattgcagaatgctgtcgatgaattggagctgatgttataatgacatcagcatcatgcagacacggatctggacgctgctgtgaggcactaaataagcttgatgcgcactaggatattgttgccagtattcattgagatgagcctctcattgctgcagatctagtagatggtctacttatgtcactgcaccgagctcatgatgcattctgcagcacagctgttacttcactgaaaccagtacatgcattctagacacacagggtgaagtgtgttgttgataatctgggctacgctctatacttttcatgagggctgattcaattcagtagatcagggaacgccaatccaaaatatccatatcttcttcatcttggaatcgctggcattgattcataatttgtgaagatatagctacaacttccatcaaca

SEQ ID NO: 3821 - DNA, 287 bp, Zea mays
  Clone ID: LIB143-005-Q1-E1-G10
tcacgcatccgcatcattgcgatctctcgaatcttggagcttttaacctcagccgtcaaagctatctccggtcatgacgaccagggtcaccgcgtattggtgcactctatcaatctgtctatcataccatcgcagttaaggcggcgctcgctgattttagcgcgacttatgtcttcggcgtcgactgctcaggctcctgagatactttcaatgatatcattgacaaccaggtagccactccttccggcctcgtcgacgacacggtagcacatgttttcggtctcttt

SEQ ID NO: 3822 - DNA, 442 bp, Zea mays
  Clone ID: LIB143-005-Q1-E1-G11
gacatgaccgtcatgctccgtaaccagcagagcaacgagtacggcgccgtcgcctactccgacctgggaggcttcaagtacctcgtctacgccaacggcctctgcgctgcctactcgctggtatccgcgttctacactgccgtgccgaggcctgccaccgtgtcgcgctcctggctcgtcttcctcctcgaccaggtgttcacgtacctgatcctggcggcgggcgcagcggcggcggagctgctgtacctcgcctacaacggtgacaaggaggtgacgtggagtgaagcttgcggcgttttcggcagcttctgccgtcaggcgcgcacctccgtcgccatcaccttcggcaccgtcctctgtttcatcctcctgtccctcatctcctcgtaccgccttttcagcgcctacgaggcgcccccgtcgtcggcgctcggcagca

SEQ ID NO: 3823 - DNA, 469 bp, Zea mays
  unsure at all n locations
  Clone ID: LIB143-005-Q1-E1-G12
cccggggccacccacgcatccggacagaagctcaaatactgatctcactgatccagtatggctatggcaaatgcaggcgcgccgagggtctcggcggcccagctggtgactctcgggctatcactcctctgcgctgtcgccggcccggccgccgcgcagaactgcggctgccagccaaacgtatgctgcagcaagtttggctactgcggcacgaccgacgagtactgcggcgacgggtgccagtcgggcccgtgccgctcgggcggcggcggcagcagtggcggcggtggtgcgaacgtggctagcgtcgtcaccggctccttcttcaacggcatcaagagccaggcccggagcgggtgcgatggcaagaacttctacacccggagcgcgttcctgagcgccgtcaatgcgtanccaggcttcgcccatggcgggtcgcaggtgcanggcangcgcgagatcgccgcct

SEQ ID NO: 3824 - DNA, 445 bp, Zea mays
  Clone ID: LIB143-005-Q1-E1-G2
acgcgtccgtaaagttatcactgacggagctcattgaattagttccgcagctggggagcagatcatcgacatcggcagatgcacatcccggacaaagaagaaggcttttctcagtgcaagacttcttcagatatgcggaaattgaatgaaagcgattctttgaagagttagacagagatggtgatggccaagtcactctagaagatctcgaaattgcaacgaggaagaggcggttgccaacgaggtatgctcgagaattgttcaggcgtacaagaagcaacttcttttcgaaatcaattgggtggaagcaatttttatccttgatggaacagaaggaagcaaccattctccgagcatataccacgttgtgtttgagcaagtctggaacacttcacaagaatcaaattttgacttccctgaaaggtgctggacttccaaccaaatg

SEQ ID NO: 3825 - DNA, 450 bp, Zea mays
  Clone ID: LIB143-005-Q1-E1-G6
ttcgccgggccacccacgcgaccgcacttgctaggttcctcgtccgcctctctgtcctagtctcgtcagcaacagcacagtgttgttactgacgcgccttcactctgttgacctgcatctagccaagtttatttggagactccaacctttggtctcccaaacttggagctcccaaggggagaggttctgccaaaattttggcttctgagcatccattttcagggggaggttctgccaaaatctgctcctgtgaacatagatttctcaaggggaggttctgccaaaatttcctcctgtaaccaccagctttccagggggagattctgccaaaatttccctgcactgatcatcattcttctaaggggaagttctgccgaagttttcttgtgtgacgacgacgatcagtttccagggggagattctggcaaaattttctggcactgacatcag

SEQ ID NO: 3826 - DNA, 444 bp, Zea mays
  Clone ID: LIB143-005-Q1-E1-G8
ccacgcatccgcagacgcgtgggcgggcccatcagcttccagctgcagtggttccagcaggtcacctccgccgtgtgcgggcaggactgcaagagctacctggccaactcgctgttcgtgttcggcgagttcgggggcaacgactacaacgccatgctgttcggcaactacaacgcggaccaggccagcacgtacacgccgcagatcgtgagcgccatcgcggccggcgtggagaagctgctggccatgggcgccacggacgtggtggtgccgggggtgctccccatcggctgcttccccatctacctcaccgtctacggcacctccaacagcgccgactacgacgcgctcggctgcctcaagaagttcaacgacctctccaccaaccacaacgcccagctgcaggcccagatctccgccctccaggccaagtacaagtcggcg

SEQ ID NO: 3827 - DNA, 419 bp, Zea mays
  Clone ID: LIB143-005-Q1-E1-G9
aaccgaatcacttcactctctctaatcaaaaagcttttaacctcagccgttaaatctttctccgatcatgccgaccagaaacatcgccattggtggagtccaagaagaggtctatcaccccaacgcacttatggcggcgctcgctgagtttatctcgactttgatcttcgtcttcgccggctcaggctccggaattgctttcaataagatcactgacaatggagcaaccactccttccggcctcgtcgacgctgccttagctcatgccttcggtctctttgtcgctgtctctgtaggcgctaacatttccggtggacacgttaaccctgccgttaccttctgtgtcttactcggtggtaacatcactctcctccgtggtattctctactggattgctcagcttcttggctccgtcgccg

SEQ ID NO: 3828 - DNA, 437 bp, Zea mays
  Clone ID: LIB143-005-Q1-E1-F2
gtccgaaaattcacgtcttcttccccgtgcttgcaagcacccgaggtcggcaagctcctcgaaagcggcggaatgggttcaaccaaggccgataagccactgcgtcttatagcggtgtcgttcgacgagctcgccgccgtcgctaagcagcagcccgcggtgcccatggacgctggggccttctcgcgcgcctgctccaacgtctccgtcctcttcggctgcctcggcatcactttcaagttcgcggagatggactacgtcgccaatgttgatgatttggtggaggcgtccaagtcaatttcaacattgccttctatggttgagcgagacattcagaccgacactgtcaggaaaccagggagccatacaaggaatctgcttagagtgaagcgcgggattgatatggttaaagtcctgtttgagcaaattcttgtcac

SEQ ID NO: 3829 - DNA, 417 bp, Zea mays
  Clone ID: LIB143-005-Q1-E1-D5
aaccttcattggaaattctgcttgctggatctgcagtggcgaaggagttttggaagtagatggaggcgttaactggactgatgttcatagatggatccgctttttcgggagattactttctatactctccatttcgattttgagtcgggtcggtatcttcccttgttgattagttccgctgctttgcgcctccgtgctcgcagataccttgggctgtttcgcctctgcgcgacgacgtgaggcgggagcgtgacgagtttggtttggctgggctgttcggtttgcggtttagtcttcctgcgattctagttttcgtgtggatcctgtttcgtcctcgacttctcagtgtgtggattgcaggtttgggtacgatccggtattgggaattcgtcgtggcgtcgggtggcgaggagttgg

SEQ ID NO: 3830 - DNA, 80 bp, Zea mays
  Clone ID: LIB143-005-Q1-E1-D7
tgtccgccgtttgtttcgttttctctcccttttcggcgtcgtcttcggggtctccgtctggcttcccgggggccttctca

SEQ ID NO: 3831 - DNA, 446 bp, Zea mays
  Clone ID: LIB143-005-Q1-E1-D8
gggccacccacgcgaccggatgaatcaattaccatctgtattgtgcttggttttatgcttcttgcgctgatatggaagtttgacttcccaacatttaccgtccagatcattgccatcctcaatgacgtacaagcagcatattaggtaaactaacaacatcaacctggcgacatgaataagtaccattgtggctatctcgaaggacatagtaaaaccacctgcacaacctgacagttggaagttatttggtcgtgatgactgtcattttttcttctgggctacgtacaagactgacttcttctcggtatgggccagtggctggtttagcattatttaaagttttgagaaatcatcgtagtgtgcccatccttttcatggttgctaatatacagaaattgttccatgtcgaaagccttgagaaaatttcccagggtgattttcatacg

SEQ ID NO: 3832 - DNA, 439 bp, Zea mays
  Clone ID: LIB143-005-Q1-E1-D9
ggtccacccacgaatccggatcgccgtagctactctattagttgtggcgacttgcaaacctgaagaagagattacttgcgaagagaacgttcgattcacatgtagccaaacagatcgtttcagcagacaagatttcgatagcgacttcatcttcggtgttgcatcttctgcttaccagatcgaaggcggcagaggtcgtggacttaacgtttgggatggcttcagtcaccgatacccagagaaaggtggagccgatttgggcaatggagagactacttgtgactcataccggacttggcagaaagatctagacgtgatggaagagcttggagttaaaggctacagattctcctttgcgtggtcaagaatccttccaagatgaaagaggagtaggggaatcaacgaagatggtattaagtactacagcgggctcatagat

SEQ ID NO: 3833 - DNA, 140 bp, Zea mays
  Clone ID: LIB143-005-Q1-E1-E1
gtccgcaacgctatatcggcgctcacatgggtcctagtcagtgtaggcggtctacacgaatcagcagggtctcacgctgatgtgcggaagcactccggagatgtccttgggtgtaagtctgttcgcgcgctttgactgtc

SEQ ID NO: 3834 - DNA, 72 bp, Zea mays
  Clone ID: LIB143-005-Q1-E1-E10
tgagaggcacgctgtctgtacccatgcatcacgcgcggtgtgtgtggtactcacacccagagtgctagacat

SEQ ID NO: 3835 - DNA, 440 bp, Zea mays
  Clone ID: LIB143-005-Q1-E1-E11
cacacgcgtccgccacgcgtccgcctgcctccaggctccaacaacccgggagggcgccgtccgcccccgcctccgggagcgatgatgatcgcgcgacgcctgctccgacccaatgcccccgcccaggcaaccagcttattgaagcatgtaactggcaccgcaagtttgcaaggcaatgcggatagcttgttggatggtacagtcagacattttggctcagcaccgtctgcccagcctgaagaaaatgggttcaagggccacggcatgctggcgccttttacagctggctggcagagcaatgatttgcaccctctgatcattgagagatctgagggttcctatgtctatgacattaatgggaacaagtatctggactctcttgcaggattatggtgcacagctttaggtggtagcgagcctcgattactcaaagcagctac

SEQ ID NO: 3836 - DNA, 427 bp, Zea mays
  Clone ID: LIB143-005-Q1-E1-E12
ccacgcatccgcaatatttgagctactgaacaagatgttgctttctatgtcacaagagcagaatagtccgtttctttctgcattaactcaagacacccatgtgcttccggattttcatggaaatcggtctcctgttcctgatccaaaatccaaaggagtgatttatggcttgacacttgatacaagtgagaagcatttagctcttctatacctagcaacaattcagggtattgcttatggtactcgtcatattgtggagcattgtaatgctcatggccacaagatagacacacttcttgcttgtgggggacttgcaaagaattctctgtatatccaagagcatgcagatattacaggatgtcctataatacttcctagagagagcgagtcagtgcatttgggtgccgctgttcttggcgctgttgct

SEQ ID NO: 3837 - DNA, 406 bp, Zea mays
  Clone ID: LIB143-005-Q1-E1-E2
gcgtccgcaatctcaggtgggcacacgatcggggtgacgcactgcgacaagttcgtgcggcggctgtacccgttcaaaggcgccgccgccggcacgccgatgaacctctacttcctgcggcagatgccgcggacgtgcccgctgaactacggcgcgtctgcgttcgcgatgctggacgccgtgacgccccgcgcgttcgacaacggctactaccggacgctgcagcagatgaagggcctgctggcctccgaccaggtgctcttcgctgaccgccgctcccgcgccaccgtcaaccgcttcgccgccaaccataccgccttcttcgacgccttcgccaacgccatggccaagctcggccgcatgtgcgtcaataccgccgccgacggcgaggtccgccgggtatgca

SEQ ID NO: 3838 - DNA, 438 bp, Zea mays
  unsure at all n locations
  Clone ID: LIB143-005-Q1-E1-E3
gtccgctagaaaatcggcgtctctctcncgtccggcacttcctccgatcgactagcctgcggcggcgccggcgccggcgaccagcggccatgcgggtggcacccagggtgctcttcctcgtccgcgacgccgcgggctacggcgctgccctcgccgacgcgctccgcccgccgcccgggctaacgagggagtcctcgcccttcgagctcccccttggaaagtacggcctcgacggagagaaggcgtgcgccgagctcctgagcttttccgattccagtggctctccacaggtgaccatttttgttctgccagactataagccacctcttgcagcgtgtgttgtaaatgaggtcttggaactgatttcttctgaagctacctccactgagcgaactctaattgtcncatacatcacaagatcgtcaagctatcatcatg

SEQ ID NO: 3839 - DNA, 415 bp, Zea mays
  unsure at all n locations
  Clone ID: LIB143-005-Q1-E1-E4
cgcgtccgcaacgcatcggccaacccttcggctttcaggaaggcctgataaaaggaacaaattccttgaaacaagggcccaaggaacttcaattgcggtcaaaaccaaaatgcggtcggcccggaaaatggccccccctggggtgcaatcccccccggacccacggcaaaaaatgcgcaacttcttgaggatgccttcaatgcaaagtgaatcagaagcagcctgcaatcatatcatagataaattttgggtgcagttccagcctcgcgtagtttatggatgtcagtgataagtatacaggctgcccttatatagttccatangagatagaaccctagcttatagtagatcattatatgttttatgaattgtgtaattaggtatctgctttgcagtgagtggctatatggtttat

SEQ ID NO: 3840 - DNA, 429 bp, Zea mays
  Clone ID: LIB143-005-Q1-E1-E5
caaactcgtcatcccaagcgtccgctctttctattatcgcttatgcgtcgccctttttttttttttttttttttttttttttttttttttttttttttttttttttttttttttttttttttttttttggtttttttttttttttggtaagggcaaaaagggtttcccggttgaccctcccggggttttgcaattgtccctcccgagagttcaacaaacccgcattttattacgtaggccaccctgtcccagcataggcacgattaaatgtcccttaccaggctgttcacgttgcgcttttcaggggggtacacgtccataatttttgtggggcattcgtccttaattcgatggctgcaatggccaactccatgttcattttggaatcctggtcctctgccctatgaggcgtgcatgtcttcaaaggtt

SEQ ID NO: 3841 - DNA, 287 bp, Zea mays
  unsure at all n locations
  Clone ID: LIB143-005-Q1-E1-E7
acgcgtccgcaggctcgtccgcccgctcgtccggtcggttgctttcttgggttctggcttggtggcgttctgtcgttctccggctctctgtcgcttcgcgccgctggcttttctgccctgcgcggtggccggttgtgtgcgtcttcggttcctctgcgtgctcgttgggtttctctcgcggcgcggtcctcggttgggtgtccctggcctgtctctcgtgggtctngtcccgtctctcgttccctgttggtgggtgcttgctcctgcgcttgctgggttctgcttcg

SEQ ID NO: 3842 - DNA, 410 bp, Zea mays
  Clone ID: LIB143-005-Q1-E1-F1
gtccgcaatttcaccttcgatcgcgcagccgctgccgccgccgctactcgccgcacctcgcttcatttcgtgtcgccaagatttgactcgcactaacaccgcaggtattgttggcaaatatggaaccaggtatggtgctctcttgcgtcagcagatcaggacgatggaggtatctcatcattccaagtacctttgcgagttctgtgggaagtttgctgtgaagatgaaagcagttggaatttgggggtgcaaggactgtgggaatgtcaaagctggtggtgcttacaccatgaacactgctactgcagtcaccttcatgagcacgatatgccgcctgagggatcacacctaagcatgacgatagctctttatagtactggggtttcatgtagttgctcttgtcaggcatg

SEQ ID NO: 3843 - DNA, 421 bp, Zea mays
  Clone ID: LIB143-005-Q1-E1-F10
gccgtgaagcgcatcaaggacgtgactctgtctgaacctgagttccgtgaacgcatttctgagattggcgagcttcagcacgagttcattgtgccactccgtgcttactactacagcaaagatgaaaagctacttgtttacgacttcatgcccaaggggagcctgtctgcagtcctgcacggcaacataacttctggcaagacaccccttaactgggatttaaggtcaagcattgctctagctgcagcccgtggtgttgagtacatccactcaacgagctcaacggcttcccacggtaacatcaagtcatccaatgtcctcctgggcgaatcgtatcaagcacacgtatcagacaatggccttaccgctcttgttggtccatcgtcttcaccgtctcgcgccactggataccgtgcacccg

SEQ ID NO: 3844 - DNA, 435 bp, Zea mays
  Clone ID: LIB143-005-Q1-E1-F11
caggctcgcgtcgacggagacgaagtcctcttcggtaaactcccccgcctctgtttttactgataataattcttcgacgcggttgattattgttatgaaattaaataacgtacgagatctagatccagatctaggagcagtaatctctggatttttttttcaatttttttttttaaaaaaatgaaccttatccctgttgtgttgaacactcggatttctgtgctgaactgtcctaagaactcaatagctgtcgtgtcgtgtaagaaccgcaatctcgcgttgcagagtctcgtgcgatcaaccggtacatcgccagcaagtacgcgtcagagggcacggacctgctccccgcgacggcgtctgcggcaaagctggaagtgtggctagaggtggagtcgcatcacttctacgcgaacgcgtccccggcgggtgttc

SEQ ID NO: 3845 - DNA, 423 bp, Zea mays
  Clone ID: LIB143-005-Q1-E1-F12
cacgcgtccgcaccaattcgctgtcccaggagggcttattggtgtgggaacaaccatggacccaactctaacgcgtgctgataggctggttggccaggttcttggtgaagttggttcactacctgatgtttatgtagagcttgagatcaatttcttcctactccggaggctgttgggtgtgaggacgaaaggtacagagaaggcagggaaggtgtcgaagctcaccaagggcgagatcctcatgcttaacatatgatccatgtccacaggcgcccgtgtactcgccgttaagaacgatcttgccaagctacagctcaccgcgcctgtctgcacgagccgaggagagaaggttgctctgagccgtcgtgttgagaagcattggcgtctcatcggatggggccagatccaggccggtacaacact

SEQ ID NO: 3846 - DNA, 418 bp, Zea mays
  unsure at all n locations
  Clone ID: LIB143-005-Q1-E1-D4
taagccatccagttttccaaaccgcacgttcccgcaccccctctcccggccgtgcccgacgggtaatccaattggccggccggttggtgcgcgggcgtccttgaaggggcatcaanggagaaagggactcaacaacttcatccgcgacgtccgcgacgaaggatacttcanatgccttctggacgggaaccttttgcaaacgaaaatccacaatattggcgcaacacttgtaggagttgacaagtttggtaacaaatattatgagaaactacatgacactcagtatggaaggcatangtgggtagaatatgcagagaaaggtcgttacaatgcatcccaagtgcctgctgaatggcatggatggctgcaccacatcacagatagcaccggggataagctgctgaaccagaagactgct

SEQ ID NO: 3847 - DNA, 428 bp, Zea mays
  unsure at all n locations
  Clone ID: LIB143-005-Q1-E1-B7
gacgaggaggaggacggcgtcgatgacctggacaacgagttcaactgggacggccatgactcgcagtctgtggccgagtccatgctctacggccacatgagctacggccgtggaggtgaccctaatggcgcgccacaagctttccagctcaaccccaatgttccactcctcaccaacgggcagatggtggatgacatcccaccggagcagcacgcgctggtgccttctttcatgggtggtgggggaaagaggatacatccccttccttatgcggatcccagcttacctgtgcaacccaggtctatggacccatccaaggatcttgctgcatatgggtatggtagtgttgcttgganggaacggatggagaattggaagcagagacaagagaggatgcaccagacggggaatgattgtggtggtgatga

SEQ ID NO: 3848 - DNA, 404 bp, Zea mays
  Clone ID: LIB143-005-Q1-E1-B8
ccacgcgtccggatacttcgctgcctgaggagtccccggcaccggaggtcttgctaccggctggcggcttcttcttccgttcctccccaagtcctcttcccggaggaatcatgatcgtctgcgtcgccgttgtcggccaccagaacaatccgctgtacctgcagagcttcacggaggcggacgacgccctcaagctccaccacatcgtcaactgctctctcgacgtcatcgacgagcgagtgagcaatcctaagaggagtgcacctacattgaatgagacatttttgggtcttctatacccaactgagaactacaaagtgtatggctatttgacaaacacaggggtcaaatttatcatggtcacgactgatcttgatgtcaaagatgcagatgcccgaaatttt

SEQ ID NO: 3849 - DNA, 441 bp, Zea mays
  Clone ID: LIB143-005-Q1-E1-B9
acgcatccgcaatcttcaagaaagaagaagcaaatagagcacacagtcgagtgtaaaccatccaaccaatcatggcttcgagttccaggagcaccgtgttttcacttcttctcctggtggcgctgctgctcagctgcagcggcatgagcagcgcggcgcggttgctggaagaggcgccgcccaaggaggagcacccacatcctgccgtgccggagctgccagaacctgagctgccgccgcaccctaccgacgtcgtgccgcctgagctgcccaaacccgagttaccaccgcacccggccgttgtccccgagctgccgaagcctgaggtgcctcatcaggtgccggagcagccgaagcccgagctgccaccgcacccgacagccgtccctgagctcccgaaacctgaggtgccgcacccagtgccggagctgcccaagcccg

SEQ ID NO: 3850 - DNA, 248 bp, Zea mays
  Clone ID: LIB143-005-Q1-E1-C10
ccactcacgcaaccggaaatctctatggtttcttccatttgatcatactcttgatagcgatgatgcaactgacctggctactatagttttctatggatggttcattcggcctcttacataaggtatcgattcagacatcatgctggaagatgttggtgatcggcttctacagttcactgaaacataggccgcacttgtcactggtcacatattatttttcttggtggcatgtattacgtcagtcaggt

SEQ ID NO: 3851 - DNA, 122 bp, Zea mays
  Clone ID: LIB143-005-Q1-E1-C11
acgcatccgtaattttttttttttttttttttgtattgtttatttttctttttttttttttttttttttttttttttttttttttttttttttttttttttttttttaaagttcaaaatcgc

SEQ ID NO: 3852 - DNA, 431 bp, Zea mays
  Clone ID: LIB143-005-Q1-E1-C12
acacgcatccggagtgtttgtccatacgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctacttcctggtgttcgccatcctggccggcgtggtgggc

SEQ ID NO: 3853 - DNA, 252 bp, Zea mays
  Clone ID: LIB143-005-Q1-E1-C3
gctcctgctggtgccgatgctgaggctgctgctcctgctggtcccgatgtgactcacatggccgctcatgacgcacccgccgatgatgatgctgctgctgctcgtcctgctggtgcagatgagcccgccgcggtcgagccggtcgccgaggttcaggctgctgctcacgaagaactcgccgctgacgagccgtgacgctcctgctcatgctggtcaccaagagccctccggttcaggcaagtgacgttgctg

SEQ ID NO: 3854 - DNA, 155 bp, Zea mays
  unsure at all n locations
  Clone ID: LIB143-005-Q1-E1-C4
cacgcgtccgccacgcatccgcccacgcgtccgcncacgcgtccgcattgttgtaaattgtagtatataggagtggaatcgtcatggataaactgtgtccttttgttcagagtgcacacctctactgtatactgcacacgaacccaccgctgccc

SEQ ID NO: 3855 - DNA, 96 bp, Zea mays
  Clone ID: LIB143-005-Q1-E1-C6
ttacagtggtcggtcagtactcttcgataatgccacggagcttctgttcacagggtttcgttttacgctatcgttacggggagcacgttctctttc

SEQ ID NO: 3856 - DNA, 432 bp, Zea mays
  Clone ID: LIB143-005-Q1-E1-C7
gaatgagaagaatgctgaagtgcgcaagatttctagcagattaaatgatcttgatctgcagctaaggaaggagaaagaggaatgccacaggatgacctcaaaaattaaaaagttccttaaagcccatgctcgctttttgaaagcacaggaagaattgaaaaggtcacaagctcgttttgagagactcggtgatttacttgcttcagatattctgaaacgtggtgctaatgaagaagtttctagtatcaatgttgatgaagatccaaatgttccttatgaaaggagcccaaatgctgctatagctaagaagagatcaataccatactcaacaagtgaagaagcgaaagccgtgaagaaaagaagagagcgggactctgacacaactaggccagataaatataggtttgaaggtactattgcaggatttgaaaa

SEQ ID NO: 3857 - DNA, 439 bp, Zea mays
  unsure at all n locations
  Clone ID: LIB143-005-Q1-E1-C8
ccacgcgaccggatagaggccgaccaactttgacgtggacagaggctgtgaagagagacctgaaggagtggaatattgataaagagctcgccgcagataggaaggggtggaagtgtgcaattcaggtgccagaaccctgattgatagtttcgcttttcctccttaatcgtttgaccttttcttgtgtccattttagatcttgctggtccttgtgggttttatctcttttatgtgtttccccgtttcgttgttttcggttctcctttgcctttgtttcccttttctgttctttgggggttgagctctgaggttttcatacggggtttcatctctagcctaccccaacgtgcttgggacaaaaaggctttgttgttgttgttgttgttgttgttgcatgacacacttgagaatgaatgtgtttctttctgtntgctggtat

SEQ ID NO: 3858 - DNA, 445 bp, Zea mays
  Clone ID: LIB143-005-Q1-E1-C9
cccacgcatccggaaatctatatggtttcttccatttgatcagagtctcgagagcaatgatgcaactgaccgggctaaaatatttttccatggatggatcatgcggcctctaacagaaggtgtatattcagacatcatgagggaagatgttggtgataggcttccagatttcactgaaacatatgccgcacttgtccatggttcatattatcttcttggtctcagactattacgtcactcattacgcccattagaatcatacgattgtgccttcggacgtatacactgccttgatggactcacgcataactctcacatcaaattatgtatctggtcattctcctggtccaccgttcattgcacctagttactagttcccaaaaagcatttactacgtaatggattacttcagaatcacttacggtgaccctttaatatatgtcac

SEQ ID NO: 3859 - DNA, 296 bp, Zea mays
  Clone ID: LIB143-005-Q1-E1-D1
cgcgtccggaagtgaactggtgccgtgggccacattcatcaggacggatgagacctgctgtcgtgcgtatgcgagcgtcgataatcagggtgcttgggaatagagcgatatcaatccagctacgacgctacctttcatctttcctgttctgcttcggtccactattttgtcttccatgatcttacatcgtaggtcgttgcaggtggcgccaaagactttggtgtaatcgttgatctgtctggaactggtcctatcgtcggacgtacgagatttttggtgatccaaggtgaacctga

SEQ ID NO: 3860 - DNA, 236 bp, Zea mays
  Clone ID: LIB143-005-Q1-E1-D10
ttgcagacctgagggaagagattacttgcgaacgagaacgttccactcagatgtacgcagagagatcgtttcagcagggaggatttcgagagcgacttcatcttctgtgttgcatcgtctgcttaccagatcgaccgtggcagaggtcgtggacttaacgtttgggatgggttcactcaccgatacgcacagaagggtggagctgagttgggcaatggcgagaggaattgtgactc

SEQ ID NO: 3861 - DNA, 422 bp, Zea mays
  Clone ID: LIB143-005-Q1-E1-D11
ccacgcatccgcaaaaacttgctcggcaaattcaggatgttcttgcactgtgtagtggcagtttaccatcttggtgttatcagctgacgaaagcttgtccttttctgtttcctttcgaaacacgaaggcaatacttctattccacagcttttgggttgtctcgtgcacttcatcgtcttcagcaacaaccgggcaatgataataacactgcttttgaaagagaagtcaggattggtagattgcaacgccagaaagtccgtgtttctcgtaaccgtatcttggattctgcagctaaagttatggagatgttctctaatcaaaaggctgtcctagaagttgaatactttggtgaagttggaactggtcttggtccaactttggagttttatactctcttaagccgtgagctgcaaagggttgac

SEQ ID NO: 3862 - DNA, 407 bp, Zea mays
  Clone ID: LIB143-005-Q1-E1-D12
gaggcggcgcgggcggacaaggagcaggcggaggaggagttgtgccaagccacaatgggtatctcgcgtgactcgatgcacaagcgccgagccaccggtggaaagcagaaggcctggaggaagaagcgaaagtatgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcacta

SEQ ID NO: 3863 - DNA, 426 bp, Zea mays
  Clone ID: LIB143-005-Q1-E1-B6
ccacgcgtacgcacactgcgacccggagttaacgtctcagctgaagcgcgcggcgcggtcgaccgtgtcggcaatgccggggcgcaccgtggcggccggcgagacgcccgtgctgatgagcggcgcagggcacgacgcgatggcgatggccaggctcaccaagatcgggatgctgttcgtgcggtgccgcggcggcatcagccactcgccggaggagtcggtgatggacaacgacgtgtgggccgcggggctcgcgctgttcaacttcatcgaccagaacgcggtgtcagaagaactggatgccgggcagaacgtggtggctgtggcgctggcggtggcagagtcgtgatggttcggtggcgattcttttcagtgggagtaggcctgtagcctgcaactgtacataagacttgttattacattgca

SEQ ID NO: 3864 - DNA, 440 bp, Zea mays
  Clone ID: LIB143-005-Q1-E1-D2
gtccgggataattcaaagccttgtcccaaatgcaaacggcctattgaaaaaaatcagggatgcatgcacatcacatgcactccaccatgcaaatttgagttctgctggctatgtcttggtccatggtcagagcatggagagaggactggtggattttatgcttgtaaccgctatgagtcagcaaggcaagaaggagcgtatgatgaatctgaaaggagaagagaaatggcaaagaactcccttgagagatacacacattattatgaacgatgggcagccaatcagtcgtcgaggcaaaaggcactgggggaccttcaaagcctacagaatgacaagcttgaaaggttaagtgacatacaaagtcaacctgagtcacagctgaagttcattgtagaggcatggttacagattgttgaatgcagaagggtattgaactggac

SEQ ID NO: 3865 - DNA, 107 bp, Zea mays
  Clone ID: LIB143-005-Q1-E1-D3
cttgtccctcttggtgctgggtttgtgctggttgtcgcgcttggctgctcgtcgcgtgctctcctccgtggcttcttccgttctgctggctatgtcttggtccctgg

SEQ ID NO: 3866 - DNA, 349 bp, Zea mays
  Clone ID: LIB143-025-Q1-E1-H5
aacagatgggttgaatgcttatttgaacaagtatcacattgagctggaccctcaacttgaagctcttgttggaaggcatagtagaaaaccctggtcaaagttcatgaatgctgataaccaacatctagtatcacctgaggccatagattttctcgataagctcctgcgctatgatcaccaagataggctcactgcacgtgaagctatggcacatccctacttcctccaagtcagagctgtggagaacagtagaacgagaccacaataatcgttgtctacaccctcgaaatgaagttgttgctaatttctggaacatcataggctaaaaccgttcaataagcatctcgct

SEQ ID NO: 3867 - DNA, 228 bp, Zea mays
  Clone ID: LIB143-025-Q1-E1-H6
aggcgatggcgcagctgcaactgagccggtcaggcgatggcgcacgagagtcgagaggacgacgacgagtcgtataaatataatagcggcgtctaaataagatcctgtcaactgcacccgccattatcgatccatggtcgctcctggggttcatgttcatctgtaacgtgctcgcggtcatgtccgtctcgtgccggatttaatatttatatgcatgtatttgtgttt

SEQ ID NO: 3868 - DNA, 217 bp, Zea mays
  Clone ID: LIB143-025-Q1-E1-H9
aaaaaattgggttacaagaattatggcgtttgtcaatatgatcgtaatgtcgtaggatggtggaatgtggtcacaaactttgcgtatgttgggtctactggtggtgtctactctgaatctatgtatggatgtcatgagttccagttcctgtggtgttcgtatgatgtatatcatgagttaactctatctaaaatttcttcattatggtatttttaag

SEQ ID NO: 3869 - DNA, 416 bp, Zea mays
  Clone ID: LIB143-026-Q1-E1-A1
ggaaaacctccaaccctagccgcgatccgacaacgcctccatccctagccgactgctgcaagcttcagagctcaagagtcagggcgccatggcgacagagacggagaccttcgcctttcaggctgagatcaaccagctgctctcactcatcatcaacaccttctattccaacaaggagatcttcctccgggagctcatttccaactcttccgatgcgttggacaaaatcaggttcgagagcctcactgacaagagcaagctcgatgcgcagccggagctgttcatccacattgtaccagacaaggcttcgaacacgctctccatcatcgacagcggcatcggcatgaccaagtccgaccttgtcaacaacctcggtaccatcgccaggtccgggaccaaggagttcatggaaaccc

SEQ ID NO: 3870 - DNA, 270 bp, Zea mays
  Clone ID: LIB143-026-Q1-E1-A10
actatgtcgtctgtgcaggaggagcttaatcatacacatgacatgatccacagttacgtggagctctacagttacagtcacgtcgacgtgaggacgatggcgatacggtgtcctatccagctaggcaggcctagcggcatccagcgccgtggtgtggcatgaagaatctcgggcatgatgagtgagaccggcgtcgacccgtcgaagcggccgtatctctgacggatcatgcccttgcttaccgtctacgagatcttggacatcataggt

SEQ ID NO: 3871 - DNA, 392 bp, Zea mays
  Clone ID: LIB143-026-Q1-E1-A2
cgtctaccgattgggtgggatggtggaggacatgaatttctgtagagcttattgaggcaagccttcgtgtgcgttctctcaggtcacgtgatgctttgggttgctggaataatactcagcttgcagtcgagcgggtcgtgcgccacagtgttgcggaatgtatgttatcaatcgcttctgctatagcttttctgggttgctgtgtgtttgaaacctcactgtacatgtgcttacatgcatgaaggagcatggttgttggtttgtgtttaatcttcttgtgaattagcatgtgtaatttccttgtactggtttcatgtacagttaacctgcgcgaatttcaatggcattgatatacctagtatattgtgttgatcaatttacaggtccgggac

SEQ ID NO: 3872 - DNA, 441 bp, Zea mays
  Clone ID: LIB143-026-Q1-E1-A3
ggtccaggattcgcgggtcgcagctcaggcgtcagtgagcatgtgcggcatacttgctgtgctcgggtgcgccgacgaggccaagcagggcagcagcaagaggtcccgggtgctggagctgtcgcggcggctgaagcaccggggccccgactggagcggcctccggcaggtgggcgactgctacctctcccaccagcgcctcgccatcatcgacccggcttctggcgaccagcccctctacaacgaggaccagtcggtggtcgtcgccgtcaacggcgagatctacaaccacctggacctcaggagccgcctcgccggcgcaggccacagcttcaggaccggcagcgactgcgaggtcatcgcgcacctgtacgaggagcatggagaagagttcgtggacatgctggacggcgtcctctctttcgtgctgctggacactcg

SEQ ID NO: 3873 - DNA, 417 bp, Zea mays
  Clone ID: LIB143-026-Q1-E1-A4
cgccgtctgccttctgcgcctccatttcggcctctgtcccttgcaagttcaatctcacctccaaccatgggtaaagagaagtcccacatcaacattgtggttattggccatgtcgactctggcaagtcgaccaccacaggacaccttatctacaagcttggaggcattgacaagcgtgtgatcgagaggtttgagaaggaggctgctgaaatgaacaagcggtccttcaagtacgcgtgggtgctcgacaagctcaaggctgagcgtgagagaggtatcaccattgatattgctctgtggaagtttgagaccaccaagtactactgcacggtcattgatgcccctggacaccgtgactttcaacaagacatgatcactggtacctcccaggctgactgtgctgtccttatcattgac

SEQ ID NO: 3874 - DNA, 268 bp, Zea mays
  Clone ID: LIB143-026-Q1-E1-A5
gggccgactcacgcgtccgcctcactcccgttccatttccccatctcccagatccaattcgcgagttctccctcctctgccgccatggcgctctctgtggagaagacctcgtctggacgggagtacaaggtcaatgatcgctcgcatgcggacttcggtcgcctcgagattgagctggccgaggtcgaaatgcccggcctcatggcatgccgcgccgagttcggctcgtctatgcccttcgacggcgctaggatgactgagtctcacc

SEQ ID NO: 3875 - DNA, 261 bp, Zea mays
  Clone ID: LIB143-026-Q1-E1-A6
ctcgcgcctcgcttcgtctctcccattcccacccgctgaagcttcaaggagcttctcgtctgagaccgagctaacgagctcaccggcgggcaggatgctggcggcgtccagcaaggtctgctctacgctggcctctccgcacgcctccttgtccgccggtgctgcagcggctgcactggcgaactctcccgtgctgggctctgggatgctcccacgcgccgggttctgccagactgggagtcaccaacccgaagacgatcc

SEQ ID NO: 3876 - DNA, 385 bp, Zea mays
  Clone ID: LIB143-026-Q1-E1-A7
cgatcttcaagaaagaagaagcaaatagagcacacagtcgagtgtaaaccatccaaccaatcatggcttcgagttccaggagcaccgtgttttcacttcttctcctggtggcgctgctgctcagctgcagcggcatgagcagcgcggcgcggttgctggaagaggcgccgcccaaggaggagcacccacatcctgccgtgccggagctgccagaacctgagctgccgccgcaccctaccgacgtcgtgccgcctgagctgcccaaacccgagttaccaccgcacccggccgttgtccccgagctgccgaagcctgaggtgcctcatcaggtgccggagcagccgaagcccgagctgccaccgcacccgacaggcgtccctgagct

SEQ ID NO: 3877 - DNA, 405 bp, Zea mays
  Clone ID: LIB143-026-Q1-E1-A8
ctccaccgtattccagcaaagaccttggaccagtactatagcagagatgcttcccactgaatcactgatcgttgatcagtgttccaatattttggcaagtgcagctttgaataaattgaacagattggcctcgtggccattttcctgtatttatctgtagtcaggtccaattcttttctgttggtgagcgcaagttattcatagatgactcggtcatgggaatatttgtaatattatgtcatgtatcgttaaatttcagtttgtttggttcaactgcaagaactgttaacaagagtatcctggagctggaagctcgaacgcaactggttgtatctatatccttgaatgccgaataaaggaggggcaataaactgcagcgaaatatgtgctgtcagacattgttga

SEQ ID NO: 3878 - DNA, 427 bp, Zea mays
  Clone ID: LIB143-026-Q1-E1-A9
cggacgcgtgggcaacgacaccaccatgtcgtctgtccaggaggagcttaataacacacaggacatgctccaaggttacgtggagctctacaattacagtctctcctacgtgaagaccatggcgatcgggtgcgcgatccagctaggcatccctagcgccatccaccgccgaggtggggcagcaacaatctcggacatcatcaccgagaccggcgtcgacccgtcgaagctcccgtatctccgacggctcatgcgcgtgcttaccgtctccagcatcttggccaccacaggcacagacgagactgagactgagagcgacgacagtactgtttacaagctcactccggcgtcccgcctcctcgtaagcggcgcgggggcaccgacctcgtgcgacatatcgccgatgctggaccttctgaagcgcccc

SEQ ID NO: 3879 - DNA, 356 bp, Zea mays
  Clone ID: LIB143-026-Q1-E1-B1
cgacgacgcgtccgggaggtagaagaggagaggaagcgcgaggaagagaagagagagagggagaaaggcgaggaagttgggagggaattcgttgcacatgtgccgctacctgatgaaaaggagattgagcgcatggtattagagaggaagaagaaggagctgcttagcaagtatgccagcgattccctgctggttgagcaggaggaggccaaggagatgctcaatgtccgacgctagaagacggtctgtcctcgatttccatgtctccaatgaaagttattaactgatgtagtgctcctgacttaaagtactatagagttaagcagatgagtgttcttgtttttgttgcattcaaa

SEQ ID NO: 3880 - DNA, 407 bp, Zea mays
  Clone ID: LIB143-026-Q1-E1-B10
ggtccacgcacgcgtccggagtgtaactgcagggggactggaatggcgctggtgcacacaccaactacagcaccaagtcgatgaggagtgacggcgggtacgatgtgatcaagaaggcgatcggcaagctgggcctccggcaccgggagcacatcgccgcgtacggggacggcaacgagcgccgcctcaccggccgccacgagaccgccgacatcaacaccttcgtctggggcgtcgcgaaccgcggggcgtcggtgcgggtgggccgcgacaccgagaaggaaggcaaaggctacttcgaggaccggaggccggcgtccaacatggacccgtacgtggtgacctcgctgatcgcggagacaaccatgctgtgggagcccagccactcgaacggcgacgggcaaggc

SEQ ID NO: 3881 - DNA, 417 bp, Zea mays
  unsure at all n locations
  Clone ID: LIB143-026-Q1-E1-B11
cgagacgcccctctgcttccttttctctgtcgctcaaaagttgctggagccctcttctctctctcctctccgagccccaaccatggatgaggcgcaagttgtggagtcaaaggatggaaccatctcagttgcttctgcatttgttgctcatcangaagctgtacaagacagggatcacaaattcttgacaaaagcagtggaagaagcataccgaggagtcgattgcggcgatggaggtccatttggagcagttgtcgtccgtaatgatgaagtggttgttagctgccataacatggttctgaagcacactgaccctactgcgcatgctgaagtaactgcaattagagaggcttgcaaaaagctcgggaaaatggagctctctgactgcgaaatttacgcgtcctgcgagccatgccc

SEQ ID NO: 3882 - DNA, 361 bp, Zea mays
  Clone ID: LIB143-025-Q1-E1-H4
ctcgactaagccggagtacccggtggtggatcggaacccggccttcaccaaggtggtcggcaacttctctgcgctcgactacatgcgcctctccaccatctccgccgtctccgtcaccgttggctacctctccgggatcaagccggggatccggggcccgtcgatggtcacgggcggcctcatcggggtcatgggagggttcatgtacgcctaccagaactccgccgggcgcctaatgggattctttcccaacgacgccgaggttgcgcgctacaagcacaagcttcattgaggatccagctccattccgtctctcttttcgcaaccgtttcgcctgttcctttcctgattccgtgttaac

SEQ ID NO: 3883 - DNA, 274 bp, Zea mays
  Clone ID: LIB143-025-Q1-E1-F9
atcgccgccgaggcgcccgtcgtcttctcccgcgcctgcgagatgttcatcctcgagctcacccaccgcggctgggcacacgccgaggagaagacgcgccgcacgctgcagaagtccgacatcgccgccgccgtcgcgcgcaccgaggtcgtcgacttcctcgtcgacatcatgccgcgggacgaggccaaggacgccgacgctgccgccatgggagcatccgggatcccgcacggcgccgccggcctgcccggcgccgatcacatgggctact

SEQ ID NO: 3884 - DNA, 407 bp, Zea mays
  unsure at all n locations
  Clone ID: LIB143-025-Q1-E1-G1
acgaagcccgagttgcgagctgtcctccctccacccttctccttcactgtcgcagccgccccttggtagaagcttcgaggctgctgctgctgcgcccatggccgcggaaggcaagacgccgtcnctcgccgaggagtattcacttccaccacaggaagttccagtggaaaaggcagctgaggagaagccctctagtggtactgagtctgaagctgctccctcaaccaatgatgaaactcctccatctgtagaagacaagaatggaacttctgaagtacaagatgctgctgaaaatccagaggcagaagaaactaacactgctgcagaggaaacacctgctgtanaggaagcaagtgagactaccgangaagaagaagctgagaaacctgagattaagattcaaacaa

SEQ ID NO: 3885 - DNA, 360 bp, Zea mays
  unsure at all n locations
  Clone ID: LIB143-025-Q1-E1-G10
gcaaaaccatcagatctagcagaactctctcgacctcatcggcgttggcggagcgcgtgttgaccggagatggcgccgagcgggtggaggaggagcgcggcggcgcgggtcgcctggcgcccggccacggtttgcctgtggctcgcgctcgccgccgccgcactgacgctcgcccaggctaagaaggacctgacggaggttacccacaaggtctacttcgacatcgagatcgacggcaagcccgcaggccggattgtcatggggctttttgggaagactgttcctaagacggcagagaacttccgagctctttgcacangagagaaaggggtcggcaagagtggcaaagccctccactac

SEQ ID NO: 3886 - DNA, 330 bp, Zea mays
  Clone ID: LIB143-025-Q1-E1-G11
cacacgcgtccggttctatatcatcagtgctttcgtcagtggcgtcgactccgttggtttctccagacaagtgagggttgcagcttctggacacgagttccgtgactgtgtcgttcaacattgggacatgatgggctcagatcgtttgaaagccggctcccaagctgctcatctggtgctggatatccgcaagaggaacggtctcaaggaagagatgacacctctttcagactttgaggacaagctctacatttgtggctgttggtgatactgtttcatcagccgggtttaatcatcaattcgtctactgtaataacagcgacttcaata

SEQ ID NO: 3887 - DNA, 433 bp, Zea mays
  Clone ID: LIB143-025-Q1-E1-G12
caacagcgaaggagaaagcagaccaacctagccacccagggagaaagaggccaaaagggaggggagagtgtcgtcatggcttccattgtcgcttccaggagggccgttcctctagttcgcgctctggagaagctcatcgcagcgtcctccgctcccgggactggctccgccctcaggccggtggcagtcgccggcggcctccgcggctacaacaccggcgctccgctccgacgctacgagggggccgagtcggaagacgatagcgtccgcgagtacgatgggcggcacggcggccgggactacgctgtgcccagcctgttctcagatattttccgtgatccgcttagtgcgccgcacagcattggccgcctgctgaaccttgtggacgacttggcggtggcggcgccaggtcgtgcggtgcgccgtggctgga

SEQ ID NO: 3888 - DNA, 334 bp, Zea mays
  Clone ID: LIB143-025-Q1-E1-G2
cggaaagcctggcctctgggtcacctctagctcccgcaatggccgcgctctacaccctcatcgtccgcgaggaggagatacacatcacgcagcgagcgcgagatacacatggccgggacgaggacatggacctggtgatccccccggtgttcaacggctgcacccgattgctcaacgccgaggaccagaaggtggcacgagacctctactgggaagcggtatgcggcgaggatgcgtcggactggctcaaggtggagcagctcctccagcagagcattgccaagaacccgtttgtgggggaaccacacctggtgcttgcccaggtgtaccttaa

SEQ ID NO: 3889 - DNA, 308 bp, Zea mays
  Clone ID: LIB143-025-Q1-E1-G3
taaagagagtcgtattacgaggtgtcgtctcgatccctcacggtcactgtcgaagccgtcatcttccgcaacgacgaggctgatgttactgcgcgaatgggagctacatgtcggagggagtaggacatggaggtgtttatccttccggtattcgacttttgaatccgaatggccactgccgaggagcactcggtggctccagacttctactctgatgcgttaagcagtgatgaagcttctcaatcgctcaaagtggagcatcgcctttctcagatcattgctgctactcagtttgtggaggaaccaca

SEQ ID NO: 3890 - DNA, 326 bp, Zea mays
  Clone ID: LIB143-025-Q1-E1-G4
gggaaggggagggggagcgggaggggggcaagccagccaaaaagccgtacgcaaagcaagcagccccctgcatctaaatcaggcgttctgctcgcaccgccgccgccgccgccgccgcttccttctctcaccgacgctaattggagatcacgtctgggcctggctgctcgtcttccgtcctgggtacaattcgattgatgacctcatcagggaagaatgttttgcagtcttacatgagttaaagggatagaaagtgcaacaaccgtggaataaaggactcgtgcttttgagtaattcaggaggagtacatgcatcacgaagccttg

SEQ ID NO: 3891 - DNA, 355 bp, Zea mays
  Clone ID: LIB143-025-Q1-E1-G5
cacgcagctcagtctcgtccatccagtgctgtagaattttctttggtctgttggcaaggcagccatgaaaccccctcagctgccggcaggggagggggcctcctgggctcacgaggtcaagcaggccctccgtgagaaactccggcgctcctacggcgccggagctgcctccgccacaccggaggccaggccggccggcgaaccaagccgtggcgctgagtgccgcggctcggcggccgaggaccccataaggagagtcatgttcttggctccctggggtcacacataagaacacaaaccggccggccgagatctgggcatgcaagcttgcatggccatgtcctggtcagtcaga

SEQ ID NO: 3892 - DNA, 333 bp, Zea mays
  Clone ID: LIB143-025-Q1-E1-G6
aaagaataatcatagtcttgtaaatcaacaaggagttcaggtcccttgaaatacctcgatgatttacaagactatgattattctttagacatgtggagtcttggttgcatgtttgctggaatgatatttcgcaaggaaccattcttttatggccatgacaaccatgaccaacttgtgaagattgcaaaggtccttggaacagatgggctgaattcttatttgaacaagtaccacattgagctggaccctcaacttgaagctcttgttggaaggcatagtagaaaaccctggttgaagttcatgaatggtgataaccaacatctagtatcaact

SEQ ID NO: 3893 - DNA, 364 bp, Zea mays
  Clone ID: LIB143-025-Q1-E1-G7
ggtagaggttccgaggtagagagatagagaggaggagagggagggcgaggcggcggatccgtcactccgttcttctccgctgatctggaggaaggaggcgaggtacgcactgctatctccttccagttcgttcgagaagacggtcgttgggtgattcggcgggcgctcctgttctgtagtaaagttgtttgttttttgtctcttgtatgtttggtttcttgatcggaaacagaagtcccaaattctttcttttgcttggtcaagtgccaattgggaggcagaacggaagacagaacctccatgcgaactttagtcgcgctgatttcgatggaatcggaactgatttaggtgtattttagctctg

SEQ ID NO: 3894 - DNA, 252 bp, Zea mays
  Clone ID: LIB143-025-Q1-E1-G9
tcgccgggacacgcacgcatctgtattgagtccccgtagcgtctcgcctgttcagtttccgtctcttcccgcagctcggtttgccgaccagattccaccgttccatggtaaccacgcgaatcccgtgtctggttgcggcgattgccgtcgagcagtccaacgcggagcaccatcaagcggtggagatggaggttatcgtggagcagcagcacttcaggtcggccccgcggctgaggtacgtggacttcgtcc

SEQ ID NO: 3895 - DNA, 301 bp, Zea mays
  Clone ID: LIB143-025-Q1-E1-H1
agtcgtattaacatgttcactgacgcatcccgacagaatctaaatttactgaggttatgctaacacccacacatttggccatatctatggaatagtctgctggtggggagctatttgagaggatgtcgtaatgctgggtggacttagtgaggacgaggccagatttttctttcaacagctgacttcacgagttatttcttgccaatcagctcaaattcgccagcaagatttggatctagaaaacacactcctggaacatcctagatcacctccgctaaacatacgtgattttggttactcc

SEQ ID NO: 3896 - DNA, 417 bp, Zea mays
  Clone ID: LIB143-025-Q1-E1-H10
cccacgcgtccgaaagagtttgtcgacgcttgaagaaggacctaatgtgagcttttacacacttgatgaacagcttgagctcttgagcaaggtgttgaatgcaggggatgacatgattggggttaattcctaaaagaagaataaggtggcaagaatcgatgtcgcaatcacccagatgtcattgcttgttcctgattcacgacgagatgtatgcggttaggttgaaatccctcgagaacaatggggcgcacggtgctctcagattaagaagaagatggcgacgatagcacgagcatagatggcggcgagcgggcgcggacgacagcacaacggtcgcgcgagctgtggccagatgggttattttcatcttggtgcaggataactgacgaccccaaccccaagaggtggtgcacgacg

SEQ ID NO: 3897 - DNA, 374 bp, Zea mays
  Clone ID: LIB143-025-Q1-E1-H11
aaccaagccaaagcaagttgctaggtcctttgaaccagcaactgaagcttcctcgtctcatcatcgagaccagtaagcagcatggcggctaatctcaagtgggctcctgttctagccctcctcgtcgtcgttgctgccatggttggcactaccagcgccggcaacatcgcattgtactggggccagaacggcaacgaatgcagcctggcggacgcctgcaattccgggctctacgcctacgtcaacatcgcgttcctcacaaccttcggcaacggacagaccccagttctcaacctcgccggacactgcgaccccggctccggcagctgcatcggccagagcagcgacatccagacctgccagtcgctggggca

SEQ ID NO: 3898 - DNA, 436 bp, Zea mays
  Clone ID: LIB143-025-Q1-E1-H12
cgcatccgtaagaatgctgttctgcatgctaaggaacatattatggctggggatatcttccagattgttttaagccagaggttcgagagacgaacatatgccaacccatttgaggtttatcgagcattacggattgtgaatcctagcccatacatggcgtatgtacaggcaagaggctgtgtattggttgcgtctagtcctgaaattcttacacgagtcagtaaggggaagattattaatcgaccacttgctggaactgttcgaaggggcaagacagagaaggaagatcaaatgcaagagcaacaactgttaagtgatgaaaaacagtgtgccgagcacataatgcttgtggacttgggaaggaatgatgttggcaaggtatccaaaccaggatcagtgaaggtggagaagttgatgaacattgagagatactccc

SEQ ID NO: 3899 - DNA, 161 bp, Zea mays
  Clone ID: LIB143-025-Q1-E1-H2
tcggcccagcgtccgatgagatagtaggtcgcacaaaggcctgatttcttgatttgtcaggttggggggtataaatatgaaagttgttacgcacagataatcatgtatattgtgtcccggaaatgtgttacagattctgctcgagcagcttctgatgaggg

SEQ ID NO: 3900 - DNA, 349 bp, Zea mays
  Clone ID: LIB143-025-Q1-E1-H3
tgccacgcgtccgcccacgcgtccgatcgcagagccagagcaagggaagacgacgcagatctcgccacgcgaacacagttagatcgagggagtaagtgagagtgagagccatgacggagctgttcgacacggccgtgaccagcctcctccacctgccggaggtgctggaccgcctcgccgccgcagacggcgaccggcggtcggccggccaccacgcggcgcacggccacggccacggacgcgtccacgggctcggcggcggcggcggagcgccggtggacatcgtggagagcccccgcgagtacgccttcgtgctcgacgtgccaggcctctccaagtccgacatcca

SEQ ID NO: 3901 - DNA, 341 bp, Zea mays
  Clone ID: LIB143-025-Q1-E1-F8
ctagagcctctccagtctccactgctcggccgccgcctgccgcagcccgccgtccactggtcccgcctccctgcgtccgctccactactcctggcgtccgctccattgctaccatcgtccggcgttctgctcctgcgccctccctttgattcgttgccagttgtagtgtccggtcagatttgagctatggcagcaagcaaggattgacgaagcgtgcgttcccatcgcaccaccatgggctacacagagatcgacatccgcccctctgggagcggcaagctgcgtgagggattgacatactgctgactacgggagccgggatggggcatcgtgcgccgtgc

SEQ ID NO: 3902 - DNA, 362 bp, Zea mays
  Clone ID: LIB143-025-Q1-E1-E2
agaaacaaaggagtacggaggagacaaatatgacaatggtgtcatcactccaagaccaccacctgttcattatagcagaccatcaagaactgacaggaaccgtaactaccgaggaaactaccaggatggccctccacagcaaggaaattaccagaacaaccgtcctccaccagaaggtggttaccagaacaacccgccgcagcaaggaaactaccagacataccgctcgcagcaagatggaagaggctatgccccacagcagaattatgcacaaggtggtcaggatggtagaggttttggaaggaatgattacacagaccgttcaggctacaatggaccacctgattttcgaagtcaaactc

SEQ ID NO: 3903 - DNA, 356 bp, Zea mays
  unsure at all n locations
  Clone ID: LIB143-025-Q1-E1-E3
accacgcgtccgtttcattgtaaaaaaatattgtgatatgggagaagctattggagaaaatgagccatgcactttgttgcctacagcctgtaacctactaccacaccaagctaatctgggtgaggtatcncgtgctcagcgcactattgaagccgtggagaagctgttgctgcaggggatgggttcagttattgaatccaaggacattattggaatctacaggactccattattggatgaccacggacaagtccgttaccatattcaccaaaagcaagtacaggttaccggatgtcatcgtggaaacgcaaatgtccgttatgcatggcttccttgctccaaaagcactgtgcatg

SEQ ID NO: 3904 - DNA, 284 bp, Zea mays
  Clone ID: LIB143-025-Q1-E1-E4
aggcgggccctgttccccccgctggccaacctgcacacgtcgcgcgcgtcgcacaaggccgagctccggggcgtgtagtccgaggccgcgcggctctcggcgctcgtatcgtccgtggccgccgagcgggacaagctccggcgccagtgccactcgctcctgctcctcctgcacgaccaggcccaggcggcggcggcggctgtggcgcctgctccgagcctccacgctgcagcaagcgtcctgtcggcatgacggggatgatgctctgcctctgcctctgctac

SEQ ID NO: 3905 - DNA, 356 bp, Zea mays
  Clone ID: LIB143-025-Q1-E1-E5
acagcagctcaaaaacctaacacacctcaacaagcagagcaaagacccgggattcgccggcgcggtagcgagagcgagagatggacgggaggatgttcggtctcgagacccccctgatggtggcgctgcagcaccttctggacgtgcccgacggcgacgccggcgcgggcggcgacaaggcgagtggtgccgcggcgggcggcgggcccacgcgcacctacgtccgcgacgcgcgcgccatggcggccaccccggccgacgtcaaggagctcccgggcgcgtacgcgttcgtggtggacatgccggggctgggcacgggcgacatcaaggtgcaggtggaggacgagcgggtgctg

SEQ ID NO: 3906 - DNA, 387 bp, Zea mays
  Clone ID: LIB143-025-Q1-E1-E6
agcgagagagaacccaaacggagagagacaatcgagagagatggcaaactgttttggtgacgtcgtggacaattacaagctagacacaatgccaagatatatcggcaaaaagaagactcgagaagaccgggcacgagaggcctcctatctcagtaatgagaatgagaagtacaagaaagctaaagactatgtgaacatgctgaaggactggtacggcaatggagcgtcgacgctgtgcgtgatctacaaccagacgggcggaaccctgcggtacgtcgacgacaaggactggctgggctacccggggccgacgccctacccgacggagatcggcaacgggcagtgggcgtccttcctccacgtccacaagaccggcgcctcctccgg

SEQ ID NO: 3907 - DNA, 356 bp, Zea mays
  Clone ID: LIB143-025-Q1-E1-E7
cgtgtgcggtggcggcgggaggagacgaaagagaaatatgcaggcggtggcacgggcggcgcgtgggctcgcggctgcggctgcggctgcgcggccgtcggcgacggaggcagggcaccgcgggcaggtgcagcaagctcggggcatcgtggtgcaggtgagggacgggaatctggagcgggcgctgtcgatcatggagcgcaggatgcggtccagcggcatggagcgcctcatccgggcgcgcacccattaccacgtcaaggactcggagaagcgcgtgctcgcgcgtaaggggcttatgcaacgcgtccgttcccaggagctcggcaagaagctccgcgagattctcatcaaga

SEQ ID NO: 3908 - DNA, 380 bp, Zea mays
  Clone ID: LIB143-025-Q1-E1-E8
attcccgggcccgagtctcgtccaaacgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgaca

SEQ ID NO: 3909 - DNA, 398 bp, Zea mays
  Clone ID: LIB143-025-Q1-E1-E9
gacagcctgcctccatagtccatctcctctccccctaccgacaccgatcccattccccaggcccaagcgcccatggatcccaagcccgacgccagcgcgcccgccgcggtgccagcggagcacgcggcgtacccgaggctgtcaccggaggacatcgccccgccgccgccgcctgtcgtgccgccgtccggcgccaacccctacgtgctctccgccccgtcgcctaacccgcccgccaagagcgctagggagaatctgagggagatgttcggcatggtggggaagaagttcaacgaggccgcgcgcaagaccgagggcatcgccggcgacgtctggcagcatctgaaaactggacccagcatcactgatactgccatggggaggattgctcagatatc

SEQ ID NO: 3910 - DNA, 277 bp, Zea mays
  Clone ID: LIB143-025-Q1-E1-F1
aaagaggctgctcacatggacaccatcgccctacctgggctgctttcagaagtagtcccggtgcttctcgtcgatgggtgcatgctcgatataacctaccatcacatgacagagcagcaagcccggaccatttttggaactgcgagaacactaccaaccgaagtgttcacgtatgctcagacagactggttcctcttgttgggacaacataagaactgcgacatcaaatgacgcttacaccctcactttctcgaaagatgatcgccaatgtgggcaa

SEQ ID NO: 3911 - DNA, 396 bp, Zea mays
  Clone ID: LIB143-025-Q1-E1-F10
aacgcgtccggccgtccgcttccgtttccttggataaccacgacgcccgcccgccccccggcaagcgaaagcgaagcgagccaacccagccatggagaaggcgatcgatcggcagcgggtcctcctggcgcacctcctcccctccccctccgccgcctcctcgcagcctcagcttgcggcgtcggcgtgcgcggccggggacagcgccgcctaccagaggtcctcctccttcggggacgatgtcgtcgtcgtcgctgcctacaggacgccgatatgcaaggccaagcgaggaggcttcaaggacacctacccagaggacctcctcactgttgttctcaaggctgttctggacaacactagaatcaatcgagctgacatcggtgacatcgtcgttgg

SEQ ID NO: 3912 - DNA, 279 bp, Zea mays
  Clone ID: LIB143-025-Q1-E1-F11
cgaccgtacgcgtccggcggtccggttccgtttccttggataagcacgacgtccgtccgccagccggcaagcgaaagctaagcgagccaagacatccatggagaacgcaatcgatagggagcgggtcttcctggcgcagctcctcgcagcgggctcctccgcctcctcgtagcctcagcttgcggcgtcggcgtccacggccggggatatcgctgcataccagacgtcctcatccttcagggaggatgtcgtcttcgtcgctgcgtacatgacgccgat

SEQ ID NO: 3913 - DNA, 437 bp, Zea mays
  Clone ID: LIB143-025-Q1-E1-F12
gccagaggaagctagcagagtcgagagagagagagagagagagagagagagagagagagagagagcatggctggcaggagtttcctgattcggtcccccaaggaggaggagtccgacgccgccgtcagagaagctgtactgctgggagcaaagaacgccgcaatagctggtactgtggttgcagttcccacgttggttggctgccgtgtccttccttgggctaaggcgaatctcaactacactgcacaagcactcattatatctgcagcctgtattgctggcttcttcatcactgctgacaaaaccattctacggaacgcacgacaaaacaccatcgggaagcttgacaagtcaacctgatgcagagatgtagctgaagctgaaaaggttctctggttgccgcggcggttgatagggtgtcttttgccccatatgca

SEQ ID NO: 3914 - DNA, 196 bp, Zea mays
  Clone ID: LIB143-025-Q1-E1-F2
tcatccgagagactcgagaacggctggatgcagccagagcgctccacagatgtcgtccgctgatttgccattggaactggacgagctgcggctgttggacggcctcgccaagcgcccccgcgtgtagacgctcttcggggatctagatgcgcacgattgagtctaagatggctaaggctacttaaccgtcatcgga

SEQ ID NO: 3915 - DNA, 287 bp, Zea mays
  Clone ID: LIB143-025-Q1-E1-F3
cgtattacgccggctctgacctcgcatggcctcattatcatgcgcggccctgctcttgtgttacctagatggctctcttgacgtaagggagctttgattaaccgagcttcatgctcgtcatcgttctctataggggagctggtaatgctacatttgtgaacaggcatctcactggagtactttgacaccaattatgaaccaaccattggtgtggaagttcatccgtctcatttcaccactatctgtggtaagattaggttctacggctggaataccgcagggtaaga

SEQ ID NO: 3916 - DNA, 218 bp, Zea mays
  Clone ID: LIB143-025-Q1-E1-F4
ccaagaactaaccaaccaataatcaaggcttctccgccttctcctccggcttcttcggcttcatgctccgcaacaaggtgtgcccttggatcccaatcatcttctgcgctcattcgttggcaaacatgaaaaactttgaaaacgatctgaaccagctttctatggccttcatgtttgctgttatgggtctggtgacgaactattttggccccgctcgt

SEQ ID NO: 3917 - DNA, 340 bp, Zea mays
  Clone ID: LIB143-025-Q1-E1-F5
gttttgctgctctccgaccccgagctccgaaggccgcagcatcaggcgcggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcga

SEQ ID NO: 3918 - DNA, 363 bp, Zea mays
  Clone ID: LIB143-025-Q1-E1-F6
cgataacccagaggcctcgagaagggctggaagcaccgagagcgctccagagatgtcgtcggatgagttgcgattggagctggacgagctgcggcggctggagggcctcgccaagcgcccccgcgtccagaccctcctcgccaacgagatccgcaacattgaagctaagatggcgaaggcaactgaaccgtcaccggagccactagcggcggcttccgcgcccacggcggcggcgcgttctgatttgagctacgccacgttgggctcgttcagctgggaacaggacaacgagaagatcaggatatatattccccttgagggagtcgaacaagggaatgtggaggctactttcaagccaacatc

SEQ ID NO: 3919 - DNA, 354 bp, Zea mays
  Clone ID: LIB143-025-Q1-E1-F7
aacaaccacaactaatcgttttccatcctcgtcattcagtggtaatggttcatctgcaatatatcagaacaagagctccaccacgcagcagatgggtatgcagaatagaagacctacaactacatcagcagctcctacctatcccaatatgatgtaccctagcccccgaccgtacacccagtatgggaattcagtaaaaactggtcttccctacgggagtaacggttatgattccaggatatatggtcgatgtggtcttggtaatggtatggataacaagtacaggcccagggcatgtagtggatactatggttatggcaatgagagtcaggatggaacaattgagttaaacag

SEQ ID NO: 3920 - DNA, 388 bp, Zea mays
  Clone ID: LIB143-025-Q1-E1-E11
cacacgcgtccgaaagcaacaaggcagcagcacaagcaagaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgaggcggccaccgagggcggcggctgcgactgcaacacctgcaagtgcggcaccagctgcggctgctcctgctgcagctgcaactgaactggcccggcccggcgatggcgcacgagagtcgagaggaggaagacgactacgacgcgtataaata

SEQ ID NO: 3921 - DNA, 426 bp, Zea mays
  Clone ID: LIB143-005-Q1-E1-A12
catctccatccccatcccgtgacccgtgcacgccgccgcttcaagtcctaacaagccgcatcgcatcgcatgcgtgtgctgtccgaccgccatctccgcagccggttggcctagctacctcacctcacctcacgcaggcacactgcacacacacccatggtggtggcggcgatgcggcggccgtgcgctgtgccagcgctgctggtggcggcgacgctagtgcttctgctgctgctgctgtcaccgtcgagcgcgcagccgatgccgtccccggcggcggcgccgggccccgcgggcgggaccgggatcgactcggcgtgcctgaactcgctgctcaacatgtcggactgcctcccgtacgtgagccagcggagcacggcgcggcgccccgacgcgccctgctgcccggagctggcgggcctcgtc

SEQ ID NO: 3922 - DNA, 443 bp, Zea mays
  Clone ID: LIB143-005-Q1-E1-A2
acgcgtccgtaaaaaacttataataagcttgagtagggacaatgcaattcttctatttgatagggagacataacatgagagaataattgaagagggtagtacaattacttcattttctctatcagaagatggtgatttcctgcttgtaaatcttgtaagtgaagagattcatttgtggaacataagaaatgatcctgttcgagtcaaccgatacaatggccataagcacagccggtttgtgataaggtcttgttttggcggatctgagcaggcgttcattgctagtgggagtgaagattcacaggtctacatatggcatagagccactggtgatctcattgagactctcgctggtcactcgggcacagtcaactgcgtaagttggaatcctgtgaatccccacatgctcgcatcagcgagcgacgatcacacagttcgtatat

SEQ ID NO: 3923 - DNA, 354 bp, Zea mays
  unsure at all n locations
  Clone ID: LIB143-005-Q1-E1-A3
gtctgggcctctgcatttgcttggctgctgctcccttctcccaccgaccaactcgatcccgcgccatggatcgcgccgaccccgcgcggggccgccttgccgtgctctcctcccacctccgtggtgcaagggccgaagaggcngcagggctggagaggtcgccggtatccgcgccggcgcccgggccccgcgccggcgcgcttgccgtggtggactggaggaccgggaagcggcacgaggtcaaggtctccgaatacagcaccgtgcgcaccaccgacttcaagaacattaccactggaaaggacgacaatggtcttaagatttatgatcctggttaccttaacactgcccctg

SEQ ID NO: 3924 - DNA, 428 bp, Zea mays
  unsure at all n locations
  Clone ID: LIB143-005-Q1-E1-A4
gtccgcaagccaagcggaagcctgcgggtgagcgtccagatccacccgcccccttcggcattccccgccgctctagcctcctccgccgggaccgccgccgacgcgccacggngaaggcctgcggggatattgggtaagcagttgtgatcctgttctcttgctcggatgccgggttactatgacatcgatgacatcctcatggaggatgagcctatttcagttgttttccaagtaactgcaaatggtgttggcctgctagatcctggtgctgaaagtaactgtgtagacaagggcgccaaggtggacctcccattttggcttgcgcatgggctgctgtctctggaacaagctgtgtcaatanaccccacctccatgcttcacacagaaaacttggaaggagattcaagctgatgcggcctgtgtggatt

SEQ ID NO: 3925 - DNA, 447 bp, Zea mays
  Clone ID: LIB143-005-Q1-E1-A5
ggtccacccacgcatccggagatgtgttcactgccacagtactagatgtagagaaatgcaaagaactaaagatgggttcctacttgggagttgctgcagcttctgctaaccctcctcacttcatccatttgtgctacaaacccactgatgggaacgtcaagagaaagctggctattgttgggaagggtttaacttttgacagtggtggctacaacattaagaccgggccaggctgcagcatcgagctgatgaaatttgacatgggaggctctgcagctgtatttggtgcagctaaagctttgggacaaatcaagcctcctggagtagaggttcactttatagtcgctgcctgtgaaaatatgatcagtggcacaggcatgaggcctggtgacattgtaactgcttccaatgggaagacaattgaggtaaataacactgacgcagaag

SEQ ID NO: 3926 - DNA, 441 bp, Zea mays
  Clone ID: LIB143-005-Q1-E1-A6
ccacgcgaccgcaaccccctcctcgccgctcgccgttgaagaggtaggcccacgggccggcgagaatggaggcggcgacgatggcgtggacggcggcggtggtcggggcggggctggtgtactggttcgtctgggtgatgggcgcagcggaggtgaagggcaagcgggcggtggatctcaagatgggatccatcacgcgggacaaggtgcatgacaagtacacgcagtactggtccttcttccgccgccccaacgagacagccaccacagctgcgtctgctgagaatgtgccggccttcgtcgacaccttctacaacctcgtgaccgacatctacgactgggggtggggccagtccttccacttctcaccgtctctcgccggccgctctcaccgcgacgccacgcgcgtccacgatgagcgcgtcgccgacctcctcggcg

SEQ ID NO: 3927 - DNA, 379 bp, Zea mays
  Clone ID: LIB143-005-Q1-E1-A7
acagccaagaaaagcacatacccgagtcgccgaaacaacaacaatcccaatcccccctcgtcactcaaaactcgagcaacaatgtcgctgattcgccgtggaagcgcattcgaccccttctccctcgacctctgggaccccttccagggctttcccttcggctctggaagcagcagcagcagcagcctgttcccctcgttcggaggcaccaccaccagctcggagacggccgccttcgccggcgctcgcgtcgactggaatgagacgccggaggcgcacgtgttcaagaccgacgtgccggggctgaagaaggatgaggtgaaggtggagctggaggacggcaacgtgctccagattagcggccagcgcagcagggagc

SEQ ID NO: 3928 - DNA, 270 bp, Zea mays
  Clone ID: LIB143-005-Q1-E1-A8
ccacgcgtacggagctacaccatctatgcagttcttcatcctctggaagatgcgcctggttttaagctcagtgctttgatctggcattacgatttctctcccttcatggttcttatcattgcgattctcaatgacggtactatcacgaccatctctaatgacagagttaagccatctccattgcccgacagttggcaactgaaggagatctttgctacgggcatcgtgcttggaagctaccttgctcttatgactgtcattttcttctgg

SEQ ID NO: 3929 - DNA, 379 bp, Zea mays
  Clone ID: LIB143-005-Q1-E1-A9
ctcggtcccttccatctcctagccgccgccgccgccgccgcccaaaaccctacctaccctcttctccccctcactctcctttcatctccattctaatggcggcccaacccgtccggcgaagctgctagtgcttgtatctactatcttcatcaggtacttcgcgatcctactgaagtattccccgccgccgctgccatggccaccctcaaccctttcgaactcctcggcgccgacgacaacgacgacccgtcgctgttgattgcggcggcggcggctggctgctcagaaaacccgagggaaaaaagccggccttgggcctggctggaaaggtgcccaacctgccgggaacaacaagttcccgaacaagcccggtccttcc

SEQ ID NO: 3930 - DNA, 274 bp, Zea mays
  Clone ID: LIB143-005-Q1-E1-B1
cctacagtgagcaggagatcattataactctcaacagacggagcacagcgcagctacttgccacattcagtagctacaaggatcagttcactcatgcaatcaacaacgatctgcaagctgaccccacagaggagtttcgctcatcactgcgggcaatcatcccgtgcttcacctgcccagacagatacttcgataaagtcagtcaacaggctcttggaggcatgggcactgaatacgatgacgtcaccatggtcgtaactacgcacaccgacgt

SEQ ID NO: 3931 - DNA, 421 bp, Zea mays
  Clone ID: LIB143-005-Q1-E1-B10
gactcgctcgtggctgccctgctcatactgcttgccctcgccgtatcgtccacccgcaacgcacaggacgattccatggccgacaacaccgggacgttggcgggcggcatcaaggacgtgccggggaacgagaacgaccttcacctccacgaactcgcccgcttcgccgtcgatgagcacaacacgaaggccaatgctcttctggggttcgagaagcttgtgaacgccaagacacaagtggttgctggcaccatgtactatctcactattgaagtgaatgatggccaagtgaagaagctctacgaagctaacgtctgggacaagccatgggagaacttcaatgagctgcaggaattcaagcctgttgaagacggtgctagcgcctaacgatctctccttctccatgtgccagcctgaggct

SEQ ID NO: 3932 - DNA, 457 bp, Zea mays
  Clone ID: LIB143-005-Q1-E1-B11
ccggggccacccacgcatccgcagaaactctgtatagtcttggatatgaaaaaagtggagcagttctggaggaggaatcagggattattttacataaccctatggtgaaacttttcagagaacaggtgattgatggaaattgggataatgcggtggttaccatgaatacaattggccttcaagatgaaaacatcttgaaatctgcggcatttttgatattggagcaaaaattctttgaacttctaaaaaatgacaatgtcatgggtgctatgaagactttacgatgtgagatcacaccccttggtgttaatagaaaaagagtgcatgaactgtcgacttgtatgatttcttgttcttcacagcagttgttccttggtttttcaaagcttggaattgattcttctagttcacggttgaagcttctagaggaattgcagaaggtgcttcctccagctgt

SEQ ID NO: 3933 - DNA, 371 bp, Zea mays
  Clone ID: LIB143-005-Q1-E1-B2
caacctcacaccacaaacgctcatccagtgctcttttcttctagccgccgccgcaaacgcgtgccaacgctctgcgctcccatcctcccgttcgttgaaggtccttctcaacatggcctccaagacggataagttccgcctccaggcggagatcaacaagctgctatcgcgcatcatcaacagcttctactcaacaatgagatcttccttaaggagctcatttcacactcctctgatggcatggataatatcaggttcgacagtttgacggacatgagcaagctggatgccgacccggagctgttcatctacatcgtctctgacaagagcaacaatattctgacaatcattgacattggcattggtatgac

SEQ ID NO: 3934 - DNA, 432 bp, Zea mays
  unsure at all n locations
  Clone ID: LIB143-005-Q1-E1-B4
gtccggaatttaggaccacaacgaccgcatcgagaanagcgacgagcccatccgatcgctctcggccgaacgccgtgcattttttgccctgtccgttgtaccgtgtgcaacgtaccccgcgccatctagatcggtctcgatcacacatgcatatgatgctatgcaggcattatataatgttagcagatgatgatctataatgttagctgatgatggccggttttccatctgcatgcatgcaggcagatgacgatcgagcggatcggatgggcagacgccaccaaccccgcccgcccgacgtgaaacacggtgtcgattagcagggccgggtgggtggttgttgtcccgttcgcggggcaaccaacagcagcgggcagcggcgcaaaggatcccatatcctatcctgacggacgccgcccatatatgtcatgt

SEQ ID NO: 3935 - DNA, 445 bp, Zea mays
  unsure at all n locations
  Clone ID: LIB143-005-Q1-E1-A10
ccacgcgatccggaacctcgccgccgtctcatcgtcgtcgcccctattctctccttcatcgtcccgccccatccgccgctgccacgcacctcctccttctatctccttccagacgcggggacgctcgcccacggcggcggcggcagctgagtcctctgtcagtacgcttctcgaggtgcgcggactcaccgcatccgtgaaggagactgggcagcagatcctcgccggcgtcgacctcaccatccgcgatggcgagattcatgcgattatgggaaaaaacggctccggcaagagcaccctcacgaaagttctcgtaggccatcctcattatgacgtaactggtggtaccattctcttcaagggtgaggacctgnttgacatggagccagaggacagatctctagcaggccttttcatgagtttccaagcacctattgagattcct

SEQ ID NO: 3936 - DNA, 390 bp, Zea mays
  Clone ID: LIB143-004-Q1-E1-G11
agcacacagaagcacggagagaatagtgtgccgactagagctctcaaaatgctcgaacagaatgtcagaagccacggttagagtgatctgactatggacgagcccattcatgatatgcgtcatgatctccatgtaaactgataaggcgtcccagttcacaatgcgatgccgaagtggttcgcacgaagacccacctgcagcttatgtcaaatcaggtgcagaacaatatgcctgtccatcaccaacaaggtaaacggatctatcagtctcagatgattgtatattagattgacgaagtctgatcctccggctcgcagggctgacttccccttgacgcacacgcacactcagtagatcagtgctgatcccaatgcctccagtaaagtcatc

SEQ ID NO: 3937 - DNA, 401 bp, Zea mays
  unsure at all n locations
  Clone ID: LIB143-004-Q1-E1-G12
attcagttccctagcggcaacaaaccacccggcggcaagtttgtccccgggccgacggcgctcggcggctcaaaacttcttctctcccaatcggttctgcctcggccaaaacagctcttggaaaccggcttggcaagcagctatctgttggcttcttgccttagccaaatgaagatcatatgcctcacgatctctcttttttttgttcggctgaatctcagagaaaacgtcctgctccctccaccaggccgccaggacgcaacgtttctctctttttgatctgctgtttttttttcttgaatctggcgctagttccctggcctagcgcaggcatgtcttttcatttaccagagatggtcggccgattatggggcgctgtctctaaccttttanaacttgga

SEQ ID NO: 3938 - DNA, 304 bp, Zea mays
  Clone ID: LIB143-004-Q1-E1-G2
aaatcaggtgtgccagacgtaatgtcagcatcaaacccgggcgcgaactttcgtcttccacccaccgtgtctaatacctaggcatttcgatcctcgcgatagtgaaactaggtgctgtactatgatgtgctgtgctctgcacttactatgaagtaacatcaattcacaggttcaagaatttagtgctgcgcatgtggaagaccctgtcatcaccattatggcgcacttcgacctcgtcttcgacgcagacgtacaccagcctcaggtccatgtccatgatcacacggcgagacacgagcaccac

SEQ ID NO: 3939 - DNA, 344 bp, Zea mays
  Clone ID: LIB143-004-Q1-E1-G3
acagacccagcagctattgtggtcgtccctcagccgcgtcgcaccgcatcgcattctacgattcgaagctctctctgctcgcagccatggcgaagaattacccaaccgtgagcgccgagtacagcgaggccgtcgagaaggccaggcgcaagctccgcgccctcatcgccgagaagagctgcgcgcccctcatgctccgcctcgcgtggcactccgcggggacgttcgacgtgtcgtcgaggaccggcggtcccttcggtactatgaagtgcccggcggaactggctcacggcgccaacgcggggctggacatcgcggtgcggctgctcgagcccatcaaggag

SEQ ID NO: 3940 - DNA, 110 bp, Zea mays
  Clone ID: LIB143-004-Q1-E1-G4
acgcgtcggacagagctcgcagatagggtcgacctgcatgagacgatacacaccgcctagctatctcacacacgaggccgtctagattcgaacttcctgctgaccaattt

SEQ ID NO: 3941 - DNA, 335 bp, Zea mays
  Clone ID: LIB143-004-Q1-E1-G5
agcgcctcgaaggcaaagcttccagtagccacaggccaacgaaatcgcaacgcgaagctacggccaccgaccgacgttccaagaagcgaaacgaaacgaaaatgatgatgatgatgggagagagagcgcacgcgcctccgtggcagcactcgccggcggccagcggcgtcacggacgcggacgacgcgtctccgtacgccctcctagcggcgcttcagcattacctgccgtcgaacgaggtggcggcgtacgacgaagacgacgaggaggcggccctggcggcggcgaccgccgccgtcgacgcgtacgcctgcgacgagttccggatgtacgag

SEQ ID NO: 3942 - DNA, 335 bp, Zea mays
  Clone ID: LIB143-004-Q1-E1-G6
aggcctcggcaatcctgaccggatcaacaaagacgtagctacccccctcccgcgtccgtcgaattcgcctccgccgcctgctcgatccggtgggaactcgccgctgccgggttgttttcgctgggtgattaaggctcgggattcgagatctacgcgagtcgcgggcaagcagccatgagcgaggtgttcgagggctacgagcggcagtactgcgaggcctccgcctcgctctcccgcaagtgcaccgctgcctccgccctcgatggggagaagaagaagcagaagctgtccgagatccaatccggcgttgaggaagctgaatcgctgattcgtaa

SEQ ID NO: 3943 - DNA, 333 bp, Zea mays
  Clone ID: LIB143-004-Q1-E1-G8
agcatcaagcgcgggcacgagcactaggacacgcgcactgcatgcagccgccacacacatgctgacacgagacaagctgctagctggcaataggttcgccctggcgcagctctgacgaagatacgtcgcagcgccgttctcgtcaccgtcgtgctccactcggcctcagcttgggctgtctccgcgtttcacctcggaagggacgaaagcggtctcgtgaagggtgtgcgtccggcgctctgctagcgggccaaagctgtgtatgccgctcgctgcgcagtcacgcactacattcagaaccacggcagccgctttggaatttatcaaggtgct

SEQ ID NO: 3944 - DNA, 342 bp, Zea mays
  Clone ID: LIB143-004-Q1-E1-H1
accacaacagcgaaggagaaagcagaccaacctagccacccagggagaaagaggccaaaagggaggggagagtgtcgtcatggcttccattgtcgcttccaggagggccgttcctctagttcgcgctctggagaagctcatcgcagcgtcctccgctcccgggactggctccgccctcaggccggtggcagtcgccggcggcctccgcggctacaacaccggcgctccgctccgacgctacgaaggggccgagtcggaagacgatagcgtccgcgagtacgatgggcggcactgcggccgggactacgctgtgcccagcctgttctcatgtagtcgtcatct

SEQ ID NO: 3945 - DNA, 373 bp, Zea mays
  unsure at all n locations
  Clone ID: LIB143-004-Q1-E1-H10
ttgcttntgggtccatatttccacggttgnatctggtcgcccggcggccagaagcccagaacctttgctggcaggccgcgaaccaaccaaacagctgaagtctgacgacgagccttggttcagagaaacagggcactgggtttagagcccttcggatctagtattgtcgttcaccggcggcgaccaggccaaaccctagaaccttgccaagatgaggtcgttgcgagcggcgcagaccctagtctcccgttcccttttctcagcgcgccatctaagcggcgcagcctcccccgccacagccgccgccgcgggcgcgcggtggtgtgcagcgccggcgccaccgccccgttcgccgcttccatcctcgatggtg

SEQ ID NO: 3946 - DNA, 202 bp, Zea mays
  Clone ID: LIB143-004-Q1-E1-H12
gtccgcccacgcatccgccgttggccgccgaaaacgggaagtccgcaagggttgttccgctggcctcaaacaaggtggtgccccttttaatgggaaccaaatataacccaaccgtggcctccaagctccgaatgaagggcctcaaggccctccccttggagaacttttccccgaaactgaaaacctccggaacaacaatggg

SEQ ID NO: 3947 - DNA, 320 bp, Zea mays
  Clone ID: LIB143-004-Q1-E1-H2
ccgggccgaaccacgcgtccgaaaccatggggcaccagcaggcgcagcacggcaaggacgacaccgaggagctgcttgcagcccaccggcagctgtggtgccatgccctgggctacgtcaagtccatggcgctcaagtgcgccctggacctgcgcatccccgacaccatcgaccgctgcggcgggagcgccaccctgggcgagctgctcgccgccagcgagatcccggcgtccaaccacgactacctccggcgggtcatgcgcacgctgacagccatgcgcatcttcgcggccagccacgaccccgccaaggccgacgac

SEQ ID NO: 3948 - DNA, 326 bp, Zea mays
  Clone ID: LIB143-004-Q1-E1-H3
acgccgccgccggcgttggccggttcggcggcgcagttccgtgggcaggcgcagctcccgcgcttcgccgcgccgcgccgctacgacctgcgcctgcgccccgacctcgtcacctgcacattctcgggcactgctgccgtcaccgtcgctgtctccgcgccaacccgcttcctcgtcctcaactctgctgacctctcaatcgacagcgcctccatccgtttccgggatttggcgcctaaggaggtggtgtttttcgcggacgacgagatcctggtgctcggattctccaaggacctggtgctcggtgagggcgtgctcagtatgaa

SEQ ID NO: 3949 - DNA, 287 bp, Zea mays
  Clone ID: LIB143-004-Q1-E1-H4
ggcacggctccaccatcacctctcccctgccctgcccccaccgccccgcttccttccgccttgctccgttgcttcctcccaccacagtccactccactcgccggccctgcagctcagtatttgactgagactggtggtggagctgctagcagcgagcctgctacttcctggtcctgacggtgcgttcagacctcagaccagtgccgacgacgagctgtgaggagagggcaaggaaacaagcctgtgaggaaggcggcgatggagaggtacgacgtgatcaaggacat

SEQ ID NO: 3950 - DNA, 277 bp, Zea mays
  Clone ID: LIB143-004-Q1-E1-H6
cgcgtccaacacttgcttgccttcgccccttctgtctcgcttcgtccgtccttgtcccggttcgcccgttgcgccttcgtcttcctgctggtgctgctgtgcggctttggtgttctctgtgggtcggcgtgcttgcgtggctcctggctggtgtttgcgggttgtcctgtgccccttgtccttcttcgtggttttcctgtgcctgggctgtttctgccttgcgctgtgttctgcttctctttggctgtggttgtgtgtccgggctggctgtctgttc

SEQ ID NO: 3951 - DNA, 129 bp, Zea mays
  Clone ID: LIB143-004-Q1-E1-H7
acgatagcctcaggcagatggcccgaccactttcacttggattgtatctgggcgctaacatgaacactatggattgcagttgcagtcacttggagcaaccatgagttgatgggtatcatctgcatcaca

SEQ ID NO: 3952 - DNA, 112 bp, Zea mays
  Clone ID: LIB143-004-Q1-E1-H8
agggtctcgtcgggctgtgggcttgtgtcttggctcttggcttgtcgctcggttctgtccttcgcgctctcggttgcgtttgcgggctgtttgtggcgcttggctttgttgg

SEQ ID NO: 3953 - DNA, 390 bp, Zea mays
  Clone ID: LIB143-004-Q1-E1-H9
atcctccgtggtgttgccaaccctctgggcataaaggtgagtcgacaacaatgaatccccagtgagttggtgaagctgattgatattctgaacccttcaaacaaacctggaaggatcaccataattacaaggatgggggcagagaacatgagggtgaagttgcctcatctcatccgtgctgttcgcaatgctggactgattgtcacatggattactgatcctatgcatggaaacaccatcaaggccccttgtggcctgaagactcgtccatttgactccattctggctgaagtgcgtgccttcttcgatgtgcatgaccaagaatgaagccaccctgggggcgtccaccttgaaatgactgggcagaacgtgaccgagtgcatcggtgga

SEQ ID NO: 3954 - DNA, 301 bp, Zea mays
  Clone ID: LIB143-005-Q1-E1-A1
cacgcgtccgtatagctgtctgcctgcggtgtttgactatgcttaggacgctctggtgtactaaattcaatctatatgcgcatgatgtcagatgaacgcttaagatctgatgcaactgctgttctcattgatcgcccttctggacaaatcttgtcagcactgactggtcactcgaagaaggttacaagcgtagaatttgtaggcgactctgatcttgttttgaatgggtctgctcacaagagagtccgtatctggcggcatcctgtggatgggaattatccctgtgggtataccttgaatg

SEQ ID NO: 3955 - DNA, 382 bp, Zea mays
  Clone ID: LIB143-004-Q1-E1-G10
cacacaccctgcacgacgcatccgacctcgccatgtcaggcgcgcgacgggtctacagaacaacggcgggacctgcgtggccatcgccggcgctgattactgtgtcgtcgctgcggacacccgcctctctgtaggatacagtatcctcacgcgtgatcactccaagatctgcgacctggctgacaaatgtgtactggcatcttctggctttcaaggtgatattaaggctctgcagaagaacctagctgccagagaattgctgtaccaacaccagcataataaaaggatgagctgccccgccatggcacagctcctctccaataccctgtactacaagcgattcttcccatattacgccttcaatgtgctcggtgggcttgac

SEQ ID NO: 3956 - DNA, 348 bp, Zea mays
  Clone ID: LIB143-004-Q1-E1-E2
ggaccggagcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgacgaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtg

SEQ ID NO: 3957 - DNA, 361 bp, Zea mays
  Clone ID: LIB143-004-Q1-E1-E3
gcgggccgaaccacgcgtcggaccacgcgtccgcccacgcgtccgagcaaatccaatgcacctttttttgtctccgctttactgtgttgctcctatttaaatacgcctaataataaatgaagtaaacaagtaaccaattggatcttttgtccacgcaccttaatttgcatgcacaagtctaaatggacttatataagtctatggaagagtatctactgtcaattttgttataggcgaaaccgcaaaacagactacagtactgcacattgttggtttatcttatcaacaggaagccggaacagaaattgagcctatgggtgacctcaatactgaagctgagaaaaaacttggtcggcttgtc

SEQ ID NO: 3958 - DNA, 358 bp, Zea mays
  Clone ID: LIB143-004-Q1-E1-E4
cgcgggccgtaccacgcgtcggcccttcttcttcttactcctcctcctagcacagctagcgcctgctccccttcgcctgtgatcatgtcttgcagcagcggcaagtgcgactgtggctccagctgctcctgtggcagctcatgcaactgcatgtcgcctaacgtggagaccgccgccgccagcaacatcaataccacggtcctcgccgcgccgagcatcactgccagcgccggcggcttcgaggcggccaccgagggcggcggctgcgactgcagcacctgcaactgcggcaccaactgcggctgctcctgctgcagctgcaactgaccctgtcatgcgatggcgcacgatagtctag

SEQ ID NO: 3959 - DNA, 332 bp, Zea mays
  Clone ID: LIB143-004-Q1-E1-E5
aatcgctaacgactcacacaaatcgaatctggaaattcttcccccaatccgtcccaaactcgcctcctcacggccgccgccgccgccgccgccgccgctgctcggtaatccctcatcctccccacctgtccgctcgtcagcgtcatgtccggcaccaccccgacccctacacctacaccgacgccgctaccgccgccgccgccgccgccgccagccgctcgccccgcacggtacgacttcctcaactccaagccaccgcccaactacgtcgcggggctcggccgtggcgccaccggcttcaccacccgctcggatatcggaccggcccgcgc

SEQ ID NO: 3960 - DNA, 335 bp, Zea mays
  Clone ID: LIB143-004-Q1-E1-E6
acaccattcctcctccggatttcgcagtcagcggtggtgaaggtagcgggcgcggaggaagatggggctcgcgttcgggaagctcttcagccggctcttcgccaagaaggagatgcggattcttatggtcggtctcgacgccgccggtaaaaccaccatcctctacaagctcaagctcggcgagatcgtcacaaccatccccaccatcggtttcaatgttgaaactgttgagtacaagaacattagcttcacggtctgggatgtcgggggtcaggacaagatcagacctctctggaggcattacttccagaacacacagggtcttatctttgttg

SEQ ID NO: 3961 - DNA, 336 bp, Zea mays
  Clone ID: LIB143-004-Q1-E1-E8
acaccagggctcgcttcgaggagctcaatatggacttgttccggaagtgcatggaacctgtggagaagtgcttgcgcgacgccaagatggacaagagcagcgtgcacgacgtcgtgctcgtcggtggctccacccgcatccccaaggtgcagcagctgctgcaggacttcttcaacggaaaggaattgtgcaagagcatcaaccccgacgaggctgtggcgtacggcgccgctgtccaggctgccatcctcagcggcgagggcaacgaaaaggtacaagatctgctcctgctcgacgtcacgccactgtctctcggcctggagactgcaggtggcg

SEQ ID NO: 3962 - DNA, 366 bp, Zea mays
  unsure at all n locations
  Clone ID: LIB143-004-Q1-E1-E9
ctacaccagctgcngctagggccnaaccgcgccgctcccgtcccccgtggcccccggcagcgccgtgcgcctcacgctggcgaaggtgaaggaaggggtggaggtcgcgcagctcgtggagaaggtggccgcggccacccaggccgccggggacgccaaggtgagcttcggggagaacttttccccggcgcgggccaaggggtaccagttcgggatggtggcggtgttcgacagcgtggaggagctggacgccgtggaaggggacggcaaggtggaggaggccaaggcctcggtcaggccgctgctggacgaagtgatggtcctggacttcgtcgtcggagatgctccaacgcccgcgagcctctg

SEQ ID NO: 3963 - DNA, 363 bp, Zea mays
  Clone ID: LIB143-004-Q1-E1-F1
ccgggccgaacacgcgtccgaccaagagaagcagcaaccgttgctgctgccgcgtccacagaatggggggtttcgtgaagacccataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacatggacatcactgcacaaatcatatctgctactatagcgggtgatatggatcttgcttctgcctactctcatgagttgccacgatatggtcttgaagttggtctgaccaactatgcagctgcctact

SEQ ID NO: 3964 - DNA, 379 bp, Zea mays
  Clone ID: LIB143-004-Q1-E1-F11
cgtccaaccgaatacactaccaacgcaagtggtaccagctcgtccaatttcccgccgcaactgccaagggcagctcccccgacttcaaagcatatgtgaagattccttacagcgcatgatgtcaaatcggatccgtcatccacatcgtatcgcgtcgttctgcttgtactctgcttcttcctctatgtattaataatcccagcagcttgaaataataacaatgcatgcatgcatccatgatggaaattagaaataatgtttatgtccccaaccacgcctacttatgctctcgagttacttatttgctgctgtctctcaactgcatgcctatgtaatatatatacaataaaagattctagctaaaaaaaaaaaaagaaaa

SEQ ID NO: 3965 - DNA, 394 bp, Zea mays
  Clone ID: LIB143-004-Q1-E1-F12
tcttgcttatgggtccatctttccacggttgattctggtcgcccggcggccagaagcccagaacctttgctggcaggccgcgaaccaaccaaacagctgaagtctgacgacgagccttggttcagagaaacagggcactgggtttagagcccttcggatctagtattgtcgttcaccggcggcgaccaggccaaaccctagaaccttgccaagatgaggtcgttgcgagcggcgcagaccctagtctctcgttcccttttctcagcgcgccatctaagcggcgcagcctcacccgccacggccgccgccgcgggcgcgcggtggtgtgcagcgccggcgccaccgcccccttcgccgcttccatcctcgatggtgatgcctgccggggtttccg

SEQ ID NO: 3966 - DNA, 355 bp, Zea mays
  Clone ID: LIB143-004-Q1-E1-F2
acgcgtcggacggatcggaagcttacataagtttccatcgggcttcgccggtatggcgatccgcaaggggtcttcgtacgccgtcgcggcacttctcgcgctcgcctctgtcgccgccgttgcaggggaggtcttcttccaggagaagttcgaagatggctgggaaagtcggtgggtcaagtccgagtggaagaaggatgagaacatggctggtgaatggaaccacacctcgggaaaatggaatggagatgccgaggacaaaggtattcaaacctccgaggattacaggttctatgccatttcagccgaataccctgagttcagcaacaaggataagaccctggtgctgcagttc

SEQ ID NO: 3967 - DNA, 342 bp, Zea mays
  Clone ID: LIB143-004-Q1-E1-F3
actccctccacgtcgtctcggtcttcctctcctgtaatcccgtgacacgggtggctgcgacggcgaatcagatccctacccgtggcgttggtcgtgaattggcgccgtctccccctgccagccggattccctgctttgttctcaggcagcattttgttcactagtgtggtagctttgttgattggagtgcgcaatgggaggctgtgcgggaaaggtacgtcgtgatgacgaagaaaagcttgattttaaagggtggaatgttcatattataacaagcaatgagggctgggaccagaagattgcagaagcaaacagagatgggaaaactgttgttgcaaattt

SEQ ID NO: 3968 - DNA, 269 bp, Zea mays
  unsure at all n locations
  Clone ID: LIB143-004-Q1-E1-F4
ggcccacgcgtccgattacgccgccgcggacgagtcctcgcttggcctggaagccatggagctgtccgggccaaggtgaccgaccatctggttgccaaggtcggtcatcgcacaggacaggacgcataggaagcctatggttgtattgcattggagtcggttaggtgtagagagcccccccgacacaagggaaggcgtcaaattttctggtgggttgtagggtgtgatctgtctgtataaaagctgtggtaaangtggntaatgttcat

SEQ ID NO: 3969 - DNA, 250 bp, Zea mays
  Clone ID: LIB143-004-Q1-E1-F5
gttctcctgtgggttggtttggttgttgttcgggtctctctcggttttgctcttttggctgttgtcttcgtcgttgttgtgttggccctgccgggtttctttggttgtgcgctcttggctgctttttggggctcctctccttttggtctggtgtcggtggttgttgtctcctcctgtggctgtttgcctcgtcgtgctgggtgtcttgctggtgggctgctggtttcttcctggggccggcctttctctc

SEQ ID NO: 3970 - DNA, 331 bp, Zea mays
  Clone ID: LIB143-004-Q1-E1-F7
agaccggcggtcccttcggtactatgaagtgcccggcggaactggctcacggcgccaacgcggggctggacatcgcggtgcggctgctcgagcccatcaaggaggagttccccaccctctcctatgccgatttctaccagcttgccggagttgtggccgtcgaggtcaccggtgggcctgagatccccttccaccccggcagggaggacaagcctcagccgccacctgagggccgtcttcctgatgccaccaagggttctgaccacctgaggcaagtctttggcaagcagatgggtttgagtgatcaggacattgttgccctctctggtgg

SEQ ID NO: 3971 - DNA, 230 bp, Zea mays
  Clone ID: LIB143-004-Q1-E1-F8
acgcgtctagattggcggtcgcttcgttgttctttggtgtctggcggcctttggctcatcgctccctctctgtgctgcgctttgctgtgcggttgctcttgctcttcttggtggacttccccagtctctcccttgccgttttctatcaccttgccggagttttcgtcgtcgtggtcttcggtgcgcgcttgttcatctttctctgctgcttggtagggtgtcatctgtcg

SEQ ID NO: 3972 - DNA, 338 bp, Zea mays
  Clone ID: LIB143-004-Q1-E1-F9
aacatccatgaacatgaatgcaatggtccagtaatcttgaaggttaactcctgctgtagtcgggacctttcagagaaagtcattggagtttgctttgtagcacaagatttgaccaggcagaagatgattatggataagtatactaggatacaaggagactatgttgccatagtaaagaaccccactgagctcatccctcccatatttatgattaatgatcttggttcctgcttagagtggaataaagctatgcagaagattaccggtataaagagggaagatgcgataaacaaattgttaattggggaggtcttcacgcttcatgattaatggctgta

SEQ ID NO: 3973 - DNA, 338 bp, Zea mays
  Clone ID: LIB143-004-Q1-E1-G1
aacacaaatcgcctatcacaccgacctcatcgcgaccagacaaatagacacagctactcagcaagacccctatcttccatacctctacctactagctagtttcaggcctgcggctcgtgaacacctcatctattttagccacttttgccaccagcgaccaccgatcgatcagctagcaagccatctcgctcgcgtcacgaggaacccactggcggcgtcgcattgttgtcgctgtagcttgcatgctttccctaacaacgggccttttccccttccttttccctcgctccgcctcctgctctcgctgtgtataaaagcgcgtcactatcgcgctcatg

SEQ ID NO: 3974 - DNA, 316 bp, Zea mays
  Clone ID: LIB143-004-Q1-E1-E11
cacctcagggaagctggcatgtcaaccttcattctcactgctgaacttgctgctgctccttcagcagttggacgatgaggacaaactgcaacaagtgtcaaatgctctctcagagttcattcggaaagccacggtggtttgcggagaatgagaaatgttggagcggcgtgtaggatcaccgaatgcatagtacggctccatacttctgctctgtttctgcctgtaactcaactgtgaaaagttttaaactttcagaaagaaaaaccgtgagaggtgcaggttcaagttaatatgaataataaagtgtttttttatt

SEQ ID NO: 3975 - DNA, 311 bp, Zea mays
  Clone ID: LIB143-025-Q1-E1-C4
agcactttctccggcaaggaaccaaacaaaggtttaacccaagcgaaccctagttccaaaggcaggctccaaaaacatcgtcgcaagccgccttctcgccgcgccatcctccagatgtcttacgccatcggcgtgcccgagcctctctccgtgttcgtcgacacgtacggcaccagcgcgatccccgacaaggagatcctcaagattgtcaaggagaacttcgatttcacgcctggcatgatcatcatcaaccttgacctcaagaaaagcggcaacgggcgctacctcaagacggcggcctaccgccactt

SEQ ID NO: 3976 - DNA, 332 bp, Zea mays
  Clone ID: LIB143-025-Q1-E1-C5
atcgcgatcagagcaggagcaggcaacgcgcaccgaaatcttccaatccacaagactcgctacttcgcagttggcagagtcgcccgcagcgagccgctagcaaccaagcagaaatgtcgctggtgaggcgcggcagcgtgttcgacccactcaccgtggacctcttcgactccttcgacagcgtgttccgctccatcgtgccgtcatcgtcgtcggcggcggcgggctccgaaagatccgccttcgccagcgctcgcatcgactggaaggagatgcccgaggcgcacgtgttcaacgcagacctcaccgagcgtgaacaacgacgagtgtaa

SEQ ID NO: 3977 - DNA, 127 bp, Zea mays
  Clone ID: LIB143-025-Q1-E1-C6
atcgggattagactaggatgacgcaacgctcaccgttgtcttccaatccgcagtacgccctacttcgcagttggtaaacgctctcgcaggcagccggtatcacgagacaggaaatgtcgctcgtgag

SEQ ID NO: 3978 - DNA, 188 bp, Zea mays
  Clone ID: LIB143-025-Q1-E1-C7
accagtctcaatcgaagcagcatgtcggaacgcacatcgatgtcgtcccatctacttgtctcgcgacttcgcagtaggactatttgctcggaggtagcgtctttcgatagggtgcaatgtcgctagtgatgctccacgtcgaggggggcgtactccctgtggatctctaggtcttcttcgacagggtg

SEQ ID NO: 3979 - DNA, 352 bp, Zea mays
  Clone ID: LIB143-025-Q1-E1-C8
agggcatgacagaaatggctacagccggtctgccctggtggagtacccatgggacgggcaccaccagcggcactcgaggtcaccagatcctggcgtggtccgggactacgacaccgactatggcggtgcgcagggctacagtcagcagcctctgacgcagtggagtgcagggaaagtgcagcagcagagctacaatcctgagccgtcaaggcagtggagttcttcccaggcgcaccagggcggctacgcacccgccgagccgtcgaggcagtggagttcttcccaggcgcatcagagctacgctcccgagctaccgaggcagtggagctccgaacgccgtggctacgatgat

SEQ ID NO: 3980 - DNA, 375 bp, Zea mays
  Clone ID: LIB143-025-Q1-E1-C9
acccgtccgtcaccaaaggaagaggaagacgatgatgtctgggtcgaaggtgtacacccttgaggaggtggccaagcacaacaccaaggatgactgctggctcgtcatcggcggcaaggtgtacaatgtgaccaagtttctggaggaccaccctgcaggtgatgatgtcctgctgtcttccactgccaaggatgctaccgatgatttcgaagatgtggggcacagcaccaccgcccgtgcaatgatggacgagtacctcgtcggtgagattgatgcggccacgatacccagtaaggtgaagtacacgccccccaagcagccgcactacaaccaggataagaccccggagttcgtcatcaagatcctccagttttt

SEQ ID NO: 3981 - DNA, 392 bp, Zea mays
  Clone ID: LIB143-025-Q1-E1-D1
ggcccgacccacgcatccagtttctcgcgagccatcgcttctgcatccggaagaaatggccaagtcgaagaaccacacggcgcacaaccagtcgttcaaggcgcacaagaacggcattaagaaacccaagcgccaccgccagacctccaccaaggggatggaccccaagttcctgaggaacctgaggtattctaggaagggcaacaaaaagagtggtgaggctgaagctgaggagtaggaaggaaagcatggctttgtttcctctgtttttagctcagttccacctttaggacctggggttttgctaaagatggaacttaagtggtgttactgtatgatggcaaggaccttttgctgccgaaagttatgttttgaagttcatgccacccttt

SEQ ID NO: 3982 - DNA, 406 bp, Zea mays
  Clone ID: LIB143-025-Q1-E1-D11
cacacgcgtccgcccacgcgtccgctcgcttcgcagtcctactcgcactgtcgcacacacccgtccccatcctcttccggtctcgccctcccctcacgccgctcgccgcgtccggccgcggcaacccgacctgcgtcaatcgccatgactacctcaaggcgtcttgccgataggaagatagcacgatttgagaagaatatcacaaagaggggctctgttcctgagacagtcaagaaggcaaatgattatcctgttggacctattcttcttgggttctttgtctttgttgttgttggatcatctctctttcagatcatcaagacagcatcaaacgctggtttattctgaggacaattgccaattggtcacttacttttagtcactctaaaagactatacaagtggta

SEQ ID NO: 3983 - DNA, 386 bp, Zea mays
  Clone ID: LIB143-025-Q1-E1-D2
gggattgagtatcgagcagcatttcctctacataagcctcccggtgctaacttctatcctcctgacatggacaaagcggagtttgaactttggaagagtaaactgacagataaagaacaaaatgatgccactgggtttttcaccgtcataaaacgacatgactctctgtcttcatcgtcattaacacaatcagatggatcggatcagaccaagactaaagatgatctttttattgttccatactccaaggagtatagaccattcctagagaaagcagctgagcttcttgagaaagcatcagcgtgctctgattctccaagcctcaagaatttgctgagaaccaaggcgaatgctttcctttcaaatgattactatgaatccgatat

SEQ ID NO: 3984 - DNA, 369 bp, Zea mays
  Clone ID: LIB143-025-Q1-E1-D3
agctctgcatcccgtctgggcctctgcatttgcttggctgctgctcccttctcccaccgaccaactcgatcccgcgccatggatcgcgccgaccccgcgcggggccgccttgccgtgctctcctccaacctccgtggtgcaggggccgaggaggcggcggggctggaaaggtcgccggtatccgcgccggcgcccgggccccgcgccggcgcgcttgccgtggtggacgggaggaccgggaagcggcacgaggtcaaggtctccgaagacggcaccgtgcgcgccaccgacttcaagaagattaccactggaaaggacgacaagggtcttaagatttatgatcctggttaccttaacactgcccctgtt

SEQ ID NO: 3985 - DNA, 343 bp, Zea mays
  Clone ID: LIB143-025-Q1-E1-D4
acaatgcctcctgttggcgtccgcccccgttccggaaggcaagcccccctccggggaaattggccccaaaccaaggtgcaaggcccccggtgccggcaaaaaaaaaaacggttaaattgacaaaccccctgtttgaaaaaaggccgaagcagttcggcatccgcggcccgttgccgcccaagaaggacctgcaccggttcgtcaagtggcccaaggtcgtgcgtatccagcgccagcgccgcatcctcaagcagcgcctcaaggtaccaccggcgctcaaccagttcacccgcaccctcgacaagaacctcgctacgaacctgtttaagatgcttctcaagta

SEQ ID NO: 3986 - DNA, 300 bp, Zea mays
  Clone ID: LIB143-025-Q1-E1-D6
agtttcactctaatcaactgatctgcttccggacgacatggccatgtccatcaacctcactgcgcaaaaccattcgttcatggcacacaagaacggcattaagacagttaagctccatcgccatacctctagtaaagggatggacaccaaattcctgaagaatctgtagtagtctacgatgggcatcacaatgattcttgatgctgacactgaggagtatgaatgacagcatggttttgtttcctcagtttttatcacagttccaactttacgacatggggttttgcgaaagatcgacat

SEQ ID NO: 3987 - DNA, 358 bp, Zea mays
  unsure at all n locations
  Clone ID: LIB143-025-Q1-E1-D7
acggacgcgtgggccgcgatctccgtagcctccgtcgcgtcgagcatcgatcatgtcggcctactgcggaaagtacaaggatgagctcatcaagaatgctgcctacattggcacccctggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaagganggaagcgtcctccctggcatc

SEQ ID NO: 3988 - DNA, 360 bp, Zea mays
  Clone ID: LIB143-025-Q1-E1-D8
atccactcctactccttggctacacacagtgcgtatatgttcctcctaattcgccttcctgtttttgcaaaactaactctgaacggtgttctgttagaatcatgtgcacacaaaaaaaaaaaaaaaaaaaaaaaaaaaaaaaaaaaaaaaaaaaaaaagaaaaaaacacaatacaaaaaaaaaaaaaaaaaaacataaaagaaaaaaaaaaataacatccataatatcaaaaaacagcaactcaaatgctactcaaataaaacagctagtgtgatcaaaatcaatgacaccatgtaccataagaccattgatggcaaaccttttgttgatatcttcaatgatggagacgtcgtccctagc

SEQ ID NO: 3989 - DNA, 396 bp, Zea mays
  Clone ID: LIB143-025-Q1-E1-D9
gtccaaactgacaatggttctgtccttggcatcgagctggagagaggagaaaacgtacaaactgtgaaaaagaagctccagatagccctcaatgtgcccactgatgagagctcattgacctttggtgacctagttctgaataatgatcttagcagcattcgcaatgactcacccttgtttctcaaaaggaatcagattcaccggagcaattccacaccttgcctctcccctacaggtaagaatgttttgcaaagagaccggagtggacccattgaaatccttggctgttcaagtccttcatctcggatgaagcagcttgctaaggatgtcattaaagccataatgaatgatgttgacccagtcgctgttaacagtgggatgggtggtgcctactac

SEQ ID NO: 3990 - DNA, 370 bp, Zea mays
  unsure at all n locations
  Clone ID: LIB143-025-Q1-E1-C3
accacgcgtccgcccacgcgtccgcccacgcgtccgcccacgcgtccgatccaatccatccccgccaccacaggcanaggcaacccagaaggagccgccatgggctcccgctacgaggtggaggtgacggtggggtcggcgagcaacctgaagaacgtcaactggcacatcggcgacctctagctctacgccgtgctgtgggtggacgacgggcccatgtgctccacccgcgtcgaccccgacaacggccacgactccgtgtgggacgagaacgtggtggtccccgtcctacccgcctccgccgcgcacctgtgcgatgccgtcctccagatcgacctcgtccacgccgccagcgaccacgccgacacca

SEQ ID NO: 3991 - DNA, 401 bp, Zea mays
  Clone ID: LIB143-025-Q1-E1-E10
aaccctagctttacctccccacaagcgcctccaagatgaagctcgtcaggttcttgatgaagctgaacaacgaaacggtgaccatcgagcttaagaacggcaccgtcgtacacggaaccattaccggtgttgacatcagcatgaatactcatctgaagactgtgaagctgacactaaaagggaaaaatcctgttacccttgatcaccttagtgtgaggggaaacaacatccgctattatatccttcctgacagcctaaacctggagactttgctggttgaggaaacaccaagggtcaagcctaagaagcctacttctgggaagcccttgggccgtgggcgtggccgtggtcgtgggcacggtcagggtcggggacgttgagcatgctagctgcttttggaa

SEQ ID NO: 3992 - DNA, 362 bp, Zea mays
  Clone ID: LIB143-025-Q1-E1-A6
tcttcccttcgtcctccacgccccacccctcgcgtcgccgctatggccgacgaggccctggaccagccgccagacgcggccccgtctccgtctctggccccagcgacgccgccggcccccgccacctcgtcccccgcggcgctgctccgcccgcgtcgggaggcgttcgagcatgggctcctgcccatccccaagctcatcttcccggagggcatgctagcgcagaccctcgcccagctcaaggagaagctcgccgcctcagtccccgacgggcgctgcgcgctgcggccctggctgaggcgctgcagatcccgcaggagcaggcggcgctcgccctcggcacgctcgcggcggtgctcccg

SEQ ID NO: 3993 - DNA, 369 bp, Zea mays
  Clone ID: LIB143-025-Q1-E1-A7
ggcgatggagtaaatgatgcccctgccctaaagaaagctgatattggtatagcagttgctgatgccactgatgcagccaggagtgcatctgacattgtcctgacagaacctggcttgagtgtgataattagtgccgttcttaccagccgggccattttccagaggatgaagaactacactgtatgtcagaaggaaacctaacgaaataaattttcaaaaaatagttgctttttctgatccaccttcacctttgcagatctatgctgtttccatcacaatacgaattgtgctaggatttatgctacttgccctcatatgggagttcgatttcccaccatttatggtacttattattgcaattctaaatga

SEQ ID NO: 3994 - DNA, 355 bp, Zea mays
  Clone ID: LIB143-025-Q1-E1-A8
cttctagatgctcaaagtggaatgagtgtgtcccctagagttgctgcccaggatatgaaagaaagccaagaagttaaagaagcactgagagcgcagatggaagtgcaacgaaggctgcatgaacaagtggaggtccaaaagcgcgtgcagatcagaatggaagcacttgagaagtacatcgacagtatcctagagagcgcatgcaagatggttactgaacaatttgcttcgagtggcttcagtatctccaaccctgatctcccggagatatcccctggaggggtcatgtgtggctccacggacacgttgggctcgtcggtgttgaaccagctttctgtgagctccatcgactcgc

SEQ ID NO: 3995 - DNA, 389 bp, Zea mays
  Clone ID: LIB143-025-Q1-E1-A9
ctaggtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtggatgggcgtctacaacatcgaccccaagcgcgccatggagcttccggccaagtgcggcctcgccacgccgcccgactgctagcagtgtgctagccaag

SEQ ID NO: 3996 - DNA, 194 bp, Zea mays
  Clone ID: LIB143-025-Q1-E1-B1
taagataacttttgagatgcacaattcttattgggcgagtataatatcatcaacgggtacaatacaagcctgtaccattttgaatgctgaattagcatatctcttgcagaggctgcattgctacatgcaatggtagcgcactatgcagcagaccagttacatatttatttgcagcatgatgctctattgttacg

SEQ ID NO: 3997 - DNA, 424 bp, Zea mays
  Clone ID: LIB143-025-Q1-E1-B12
cagatgcgtgggtccacttgtgcggttcggctgtgtccttgtttctaaggatgcggggccataggagttctgtcaatatcgtggttttagcggtaaagagtgactgttctatgcgtttttgcaggatggatcatcacattatctgaagggactgctgcttgtgttttgctacattgtcatctccttatgctttttcgttttgagacagcatggaaatggaagcaacgatgatcagctgggtgtagcaagcaagccatggacgatttagggcgcctgagctggcagtagtttctcaacaagtagcgtggactttggtttgcacgattttgcatggaacactggatgggagacccgtgaagtttgactaaagtatgtagactgcgggaagatgctgttcagctgatgtgtgaatgtaagtacatac

SEQ ID NO: 3998 - DNA, 372 bp, Zea mays
  Clone ID: LIB143-025-Q1-E1-B2
acaaccctcaacgttcctaccagctgccaccgcctgtttacccgtgaatgtctccccgcccttgccgctggcgtggagcccatggccgtcgacgattccgcctccaagaatggccaagcgcaagcagctcaaggccgccgccggcgccgcggatgcagacgcggacgccgcttcggtcaaaaatcaaaatcaagtttgatattgatgctaacggtatcctttctgtcactgctgtggaggagggtacacggaagaatcaagagattacaattactggtgccaggactcagcccttcgacgatgtggagaggatggtcgacgaagctgacaagtttgcaaaggacgataaggaaaacacagatgccattgaca

SEQ ID NO: 3999 - DNA, 372 bp, Zea mays
  Clone ID: LIB143-025-Q1-E1-B3
gctcgaaagctcacgagcagcatcttaactcgcgatcacatcttttgaaagcctctcaggagcccaatgcctctattgctggtatcacgatagtcaagccacttcctgaacgagtctcacgaagagctccatctgcagtagaggaggatcaagacgacgatgaggaagaagagtgggttgaagttgacccaagtgagatggagttggctgatgagtctacttcaaacatgcaagaagatgagcactcctcaaaatcagatgatgacatggatgaccttgaagagttggatatctcgtcgtgtttcatgtgtgacctcaagcatgacaccatagaagactgcatggtccatatgcataagaagcatgggtttt

SEQ ID NO: 4000 - DNA, 246 bp, Zea mays
  Clone ID: LIB143-025-Q1-E1-B4
cggtcctagtatcccgggtccaaccaagccttcggatacggaacccgccaacctcctcccctccgctcccttgtgcctcctcctcctcccaacttttttccccccaaagaaccaatccgaaggcctcaaacctttaacacaagggtcaaccggtaacaaccccaagattaagttttaacaaaccccgccttccaatttccaaaccccggaataaaggcttggaaccaaaccttaacctgcaaaagg

SEQ ID NO: 4001 - DNA, 355 bp, Zea mays
  unsure at all n locations
  Clone ID: LIB143-025-Q1-E1-B6
cccacgcgtccgcttgcctacctcaaagtcggaagttttctcaacagctgctgatggccagactagtgtggagatcaatgttctccaaggagaaagggagttcgtgagagacaacaagtctcttggtagcttccggcttgatggaatccctcctgccccacgtggtgttccgcagatcgaagtcaagtttgatattgatgctaacggtatcctttctgtcactgctgtggacaagggtacagggaagaagcaggatattacaattactggtgccagcactctgccaaaggacgaggtggagaggatggtcgacgaagctgagaagtttgcaaaggangataaggagaagagagat

SEQ ID NO: 4002 - DNA, 372 bp, Zea mays
  Clone ID: LIB143-025-Q1-E1-B7
cgcgttcgcctactccttctccaacatcctcatcgagatccaagacacgatcaaggcgccgccgccgtcggagtcgaaggtgatgcagaaggcgacgcggctgagcgtggcgacgacgaccatcttctacatgctgtgcgggtgcatggggtacgcggcgttcggcgacaaggcgccggacaacctgctgacggggttcggcttcttcgagccattctggctgatcgacgtggccaacgtggccatcgtggtgcacctggtgggcgcgtaccaggtgttctgccagcccatcttcgccttcgtggagcgccgcgccgccgcggcctggcccgacagcgccttcgtcgcgcgggagctccgcgtggggcccct

SEQ ID NO: 4003 - DNA, 297 bp, Zea mays
  Clone ID: LIB143-025-Q1-E1-B8
cggacgcgtgggcggacgcgtgggcccgcctctatcctttctctccgcacaaggtgcccctgccgcctagccgccatgaggaagccgacccgacgacgaggaacctcagcgaaaggcagctccggcggcggtatcattaaggcggcaacactgccggcgaagcagatggtcttgtccggctaccgtggcaccgtagacgcgtttgactgcctccccgacgacctcgtgctcgccgtgttagccggcatcgcggcgcgcgcccggtgccccgccgatctcgctgcagccgcgctaccg

SEQ ID NO: 4004 - DNA, 418 bp, Zea mays
  Clone ID: LIB143-025-Q1-E1-B9
gctaacgtcactccgacgtccttttacaacattggtgatcttgagattcaagataatctagcacgagtatgggtagacattggtattcatgagccattgcttctggacatcctgcttaatgccttaacaacaataagttcagatcatgttggtattaagcaagtacagtttggagggtcagagtttttgaactggagtgaggacttgaagacagaagaagttggatatagtgtgtgcaaaatctaaatagcacaatcccgagatttgcagaagcagctacctttttagctaaacgcaaatgcaacatctggttcgaagttagggttttaaccaccttggtcctgcaaacgagaagaagaaaatggtgacaacacgatgaaaaattgacgtccaaacatattaacttctgcttgaaaag

SEQ ID NO: 4005 - DNA, 343 bp, Zea mays
  Clone ID: LIB143-025-Q1-E1-C1
gtaacggcagcgatgatattttagtcgtactcgtacagaagccacagccctctgctagctagctagctcctgctagaatggaaagtgcacgaggggaagctcagccggtgctgccgcatccgccgccgccgccgccggtgcaagagctcgccggcgctgcaaacgacatgccagctcggtacgtcgcgcgcgcaggcaacgagcccaaggtcacggtaaccgcgcctgtccccgtcatcgacctcgcccgcctgtgcgagccgggcggctgcgccgactaggcctccaagctccggctggcgctcgaatcctgcggtctcttcctggtgaccaaccactgcat

SEQ ID NO: 4006 - DNA, 435 bp, Zea mays
  Clone ID: LIB143-025-Q1-E1-C12
gagaaaggtcgctacaatgcatcccaagtgcctcctgaatggcatggatggctgcaccacatcacagatagcactggggataagctgctgaaccagaagactgctaggtaccttgtagagcacaagcagaactactccggtgagggtgaagagctgatctaccactccaaggggcatgctttgaatccgggacaaagggactggacgaggtatcagccctgggagccaaagaaagagcaagcctagctattgagtacattgtggggaagctactgaaatgtttgcatggcgttgggtcaggtatcaccgagctgaatggactctgaattaggtttgaacggggcccaaataaggtggtcctgaatatcaatatcatctttggacatgaagtgttgttgttactgctgtaaaaacagctttggggaaaatctcatg

SEQ ID NO: 4007 - DNA, 391 bp, Zea mays
  Clone ID: LIB143-025-Q1-E1-C2
agcaaagcgcttcgcaagcacaggcagtgatcggcaaccaaatccggacagtcttgagctctctcagtctcagcatttcagttcccagattcacatagccccagccccacaagtagcgaaatggcagctgctccgttcgcgattgccggccggctctcccccgttgcgcgcctcccggtccgcgcctggaggccggcgcacgggtttgcgtcgtccgggagagcccgctcgctcgccgtggcgtccgcggcgcaggagaacagggacaacagtgtcgacgtacaggttagccagaacggcggcaacaggcagcagggcaacgccgtgcagcgccgcgcgcgccgcgcgacagcgctcgacatctccccatccccgttcgggttagttgatc

SEQ ID NO: 4008 - DNA, 372 bp, Zea mays
  Clone ID: LIB143-025-Q1-E1-A5
ggagactccagaggcgcacgtgttcaaggccgacgtaccggggctgaagaaggaggaggtcaaggtggaggtcgaggacggcaacgtccttcagatcagcggcgaacgcaacaaggagcaggaggagaagacggacacctggcaccgcgtggagcggagcagcgggaggttcctgcgcaggttccgactgcccgagaacgctaagacggagcagatcacggccgccatggagaacggcgtgcttacagtcactgtgccgaaggaggacgccaagaagcctgaagtgaagtccattcagatctccggctagacctcggtctgcggtcgtcgtacctgcgtggtttgaggaacggcagttcgcctcggtcgttc

SEQ ID NO: 4009 - DNA, 407 bp, Zea mays
  unsure at all n locations
  Clone ID: LIB143-024-Q1-E1-G9
gagggcaaggcagtcgacactcgacaggtctccccaccctgcggccaccgggcgaggacgaactccttgagcgcggcgacggtggtgttgggatcgtacttgctgggcccgatgtcggtgccgtcggacagccggaacttcacctcgatcggctccttcacgccagccatctccacgggccgggtcacgagcgccttccaccccaccaacccctcctcttctctcaagttcccaccaggcaacaggagcaaccgccagggcacgggagggaatccgcacaggaattcagggggtaggaaagggctgccagaaatccgagcagggagggcaagcaccgatccggatccgacggaggatccgatcttctgcgcgacgatttanaattgcttcgtggggagcanagcggg

SEQ ID NO: 4010 - DNA, 382 bp, Zea mays
  Clone ID: LIB143-024-Q1-E1-H1
gtccgacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgacgaaggcatgccggcgttcgcgctcgtcaacaatgccacggggctcgcaatcaagcactcgctcgggcagtcgcaaccggtcaagctcgcgcccttcagcccgggccaagaaggacgcgtcggtggctgttgga

SEQ ID NO: 4011 - DNA, 411 bp, Zea mays
  Clone ID: LIB143-024-Q1-E1-H11
cacacgcgtccgcccacgcgtccgcccacgcgtccgcggacgcgtgggtttttcccatggaactatgattggcacagagatcaacctcatgttgatgaaagtgttataaaatcttcagaagtcactaggagatgtaagtcgggaccagtagaacatgatgctgtattgagggcaatgtcacgggcacttgaaataacagaggaagcgtacatgaaaattgtggaaaaggagcttgatagatacccagagcttgcattaatgggttcgtgtgtccttgtaatgttaatgaaggaccaggatgtatatgtcatgaatcttggcgacagccgagctatcttggcacaggacaatgatcactttgatcagtacgatagctcaagtttctcaaaaggagatttacaacatcgaaat

SEQ ID NO: 4012 - DNA, 371 bp, Zea mays
  Clone ID: LIB143-024-Q1-E1-H3
acgcgtccggcaaagaataagaagacataagcggcaacccccgtgcactgcgcccggctgcgcacggcgtgcgagcgcgccaagcgcacgctgtcatcgactgcccaagacgaccattgagatcgactccctgttcgagggcatcgatttctactccacgatcaccagggctcgcttcgaggagctcaatatggacttgttccggaagtgcatggaacctgtggagaagtgcttgcgcgacgccaagatggacaagagcagcgtgcacgacgtcgtgctcgtccgtggctccaccgcatcccaaggttgaaccacctgctgcaggacttctccaacggaaaggaattgtccagaaccatcacccccaacaa

SEQ ID NO: 4013 - DNA, 436 bp, Zea mays
  unsure at all n locations
  Clone ID: LIB143-024-Q1-E1-H4
aaccgaatcagcacagaaggccttgacatcccaattgacctaacaaataacctggggggggacccttaacaaggttaaaaggaatctaaaaaaggccgcccccaatattccaatccaattgcggataaatgcaaaattatcacaatctacgggacacgtgaccggagagataaatgagaagcttcaagagcgcagtcagattgccttggcagagattgctgcccagttacatattggatccgagcttgtcatcagtatcctcgagccgcggcttggaactattgtgaaaggaaggctanaaggcggacagctatacactccagcgtatgtctcacggattactgctatggttcgcggtgctgcagggggtataacagtngcaacaaacctggcatctgtttggaactccttgcaacaacagcttcatgagatgcat

SEQ ID NO: 4014 - DNA, 335 bp, Zea mays
  Clone ID: LIB143-024-Q1-E1-H5
gatctaaaactggccaagaatggactggaaagaagagggtacaaggaggttggtttccttagagaggtcgacgaagtagtgagaacaggagtgacgcctgcggagaggctgctgaacctgtacgagaccaagtggcaacgcaacgtcgaccatgttttcgagcatttgttatactgattactgaggatgacgccgccgaacgacgttggactgagcttgtagatgtaccccgtaccctaatacagagtctcgtcttgaatcattcaatgcctgacccggaagggctcatttccaggcacacaggaccaaaccttccggttggtggttaacggggg

SEQ ID NO: 4015 - DNA, 232 bp, Zea mays
  Clone ID: LIB143-024-Q1-E1-H6
cccacgcgatccggatcgccacccggatcactgaagttgggcagaggaggtccgaacatggtgtgtctggtacgatacattctgcccgatcgcaccaagatgtgtaagctgaagctttaacccctgaatgccatgtcaacttctcagttaaaggctcagttgacttgcgccatcaatatgatattcaaccatttgatgccgtgaatgtggaggatgacccaccaactatatg

SEQ ID NO: 4016 - DNA, 262 bp, Zea mays
  Clone ID: LIB143-024-Q1-E1-H7
aacgcaatggctcatccttgcttaattaccaaggtacctttgcagctgcaggtaggtaggtagctagccgccatagcaagctaggccgaagcagaggagtgatggccaaggtccaccccaacgccgcggagtccgtcgtcgccccagcagtagcaccagtaggctccgcccaggcagaggccgagggagagctgcccacggtgctgacggtgtggcgcaagtcgctgctcttcaactgcgacggcttcaccgtcaacgacgc

SEQ ID NO: 4017 - DNA, 434 bp, Zea mays
  Clone ID: LIB143-024-Q1-E1-H8
acgcgaccgcatctgctccgaatcgcgcgcgtcacagcaatagcacgctgcactcctgcacgcagctacctgaccacaccttatccggacggcgcgggcgccatggagcggaggctgtcggcgacgtccaggcggtccgcgccgtcggccatccaacggctgtcccacctggcgcagcgcgtcggcgccgtcaacctcaccgagggcttccccgacttccccgcaccgcctcacgtcacggccgccgccgtcgccgccattgccgcggacctcaaccagtacaggtttccttctccacgagacgtctttctccccgcgcagtcgcgtggttttgtcggagccaacgggaactgttcccattccacttccacttcactgcgactgactgcagctagcgtcgtgcaggcatgtgcaggggatctgcgaaatcctcg

SEQ ID NO: 4018 - DNA, 394 bp, Zea mays
  Clone ID: LIB143-024-Q1-E1-H9
aaaacatagctggatcctccttttagcagggaactgtcagccccaaataaatgatctctcatgctcattctttctttgtcatgcttttgtatgacctttggagcgagcatagaccactgaggggttgtcctaaatatgttaccctgcagccatagtcttttagtgacatgattttggatgagcaaaaccacaaaaaggagagcgagggggagggagggaaatgcaagctggtggacaatgtactgttgcaaagaggacgggtctacgttgtcaaatctgtgcttatattttttaccccgagctgtagaaagcaggaatgagcccttttcagaaaatagtgctggtccagacttgaagcttactgttgcatgaaagaggtcttgtataagcaata

SEQ ID NO: 4019 - DNA, 364 bp, Zea mays
  Clone ID: LIB143-025-Q1-E1-A1
aacacttccatcttcccgagctcgtattcgatcaattcccaattcaaataataatataacaacaatggtggttcccgtcatcgacttctccaagctggacggcgctgagagggccgaaaccctggcgcagatcgccaatggctgcgaggagtggggattcttccagctcgtgaaccacggcatcccgctggagctgctcgagcgcgtcaagaaggtgtgctccgactgctaccgcctccgggaggccgggttcaaggcgtcggagccggtgcgcacgctggaggcgctcgtcgacgcggaacggcgcggcgaggttgtggcgccggtggacgacctggactgggaagacatcttctacatccac

SEQ ID NO: 4020 - DNA, 304 bp, Zea mays
  Clone ID: LIB143-025-Q1-E1-A10
cattacgcgcccacaacccaccacaccagtgtcagtcatctcatcatggcgcaggcgtacgaggggtcctcctcgcagacgatccggtagccgccgccgccgccgaataacaaggaggagccggccccgccgccgccggcgaaggtcgagccgccaccgaaggagaatccaccgccaccggcaccgaaggaggagccaaaacccgccccggcgccggcgccgccgcacaatgtggtggaggtcccctagccgtggccgtacacgtgcccgtacccgtacccggcgtggccgtcagccgactgct

SEQ ID NO: 4021 - DNA, 422 bp, Zea mays
  Clone ID: LIB143-025-Q1-E1-A11
gaagcccgccccgccgccgcccaaggtggtggaggtcccctacccgtggccgtacccgtacccgtaccctgcgtggccgtccgactgctgctgccaccacggccacggcgggtgccactgctgctcctgcggcaaggcccccgagccggccccggcccccgccccggccccacccccgccgcagtacttcccgcagtacatgccccagccgtacccctgcaacccctgcggcggcggctaccggatcgtctgcgaggaggacccctcctacgcctgcgccatcatgtgattcgtttattatcaatatcatcccttgatgagtgtaccgtccgtgtgcgtaccatggccttaattaccattatacccaaccccaccctaaaaaaaaccccagtacgtcgtctcatcatcattccgtacctcct

SEQ ID NO: 4022 - DNA, 368 bp, Zea mays
  Clone ID: LIB143-025-Q1-E1-A12
aatctcctccagttcataggcacagcagcagaaagcgccaggagcttaagaacatggcgaacaggggcttgcatctggctctgttcctcgtccttctcgggctgtcgtccaatttggcagccgggcagatcctgttccagggcttcaactgggagtcgtggaagcagaacgggggatggtacaacttcctgatgggcaaggtggacgacatcgccgaggccggcatcacgcacgtctggctccctccggcgtcacactctctcgccgagcaaggctacctgccggggcgcctgtacgaccttgacgcgtccaagtacggcaacgaggcgcaactcaagttcctgatcgaggcgttccacagcaagggc

SEQ ID NO: 4023 - DNA, 363 bp, Zea mays
  Clone ID: LIB143-025-Q1-E1-A2
cccacgcgtccgagcgatcccactcccgatcagcagctgatcgctcactcttgcagctcgatcattctttagctgctctagctctagcctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgccgccgaggccaaggtggaggagccagctgccccggcggagaccgagccagctgccgccgctgagcccgaggcggcccccgtggcggcggaggaagagacgccaaa

SEQ ID NO: 4024 - DNA, 333 bp, Zea mays
  unsure at all n locations
  Clone ID: LIB143-025-Q1-E1-A3
aatgcagttggccgacacggcctctgggcgccggtccccgccgccggcgcccgaaggcgccaaggccaacaaccccttcaaccaccataccaaccgcaccccaaaaaataaccctgtggttaggttaaaggcctccattaataacttaccaaggaattacaacaaaaagatggtcaccaaggattcacggtgcctaagtcaaatgtttgctgctaaaattttcatgcatcgtttcttgctctcgagtgctgtccggacactanatcccaaggaagctgattggttctatacaccagtttacactacttgcgatttaactaacgctggactgcc

SEQ ID NO: 4025 - DNA, 342 bp, Zea mays
  unsure at all n locations
  Clone ID: LIB143-025-Q1-E1-A4
atagggtttttgatttagcccgccgcgccggtcaacccaaaaccccccaaaaaaacccttgccctccgccattcaatccaatggccttcttccccaacttcaaaaccgccaacggcctcaattccctcgaggtccacttcgccggaaaaacctaagtttctggtaactccattactaaggatgacattaacgtcatccccgcggtgccgtcaaaacctggcgctgagtttcctaatgccgcccgctggtacgagaccgtctctgcngctgtagcctcaagattccctggtaaagctgttggtgtaaaccagcctgcgggatcagctcctgccgtagctgctc

SEQ ID NO: 4026 - DNA, 252 bp, Zea mays
  Clone ID: LIB143-024-Q1-E1-G8
aaaaacatcaaaaaaaaaaaaaaataaaaaaaaaacatgacaaattaaaaaagaaaactaaaaccaatgcaagaatgcatcaggtggaaacgcgcatatcgatgggtgatcgtgccatcagagctgcacctttggcccttcaaagggtcgctcaatgtaacacctcatggatcaatgattctattcagtactagcagattctcaacatcaacgtgggtgtacacacggaatatccaatgtttgttccagtaa

SEQ ID NO: 4027 - DNA, 347 bp, Zea mays
  Clone ID: LIB143-004-Q1-E1-C2
ggactccagggtctgaaaaaggagttcagctataacaagatcctcaaggatctgaagaaggaattctgctgcaatggtactgtagttcaggacccagagctaggccaggtcattcagctccaaggtgaccagcgcaagaatgttgctactttcctagttcaggctgggattgcgaagaaagagaacatcaagattcacgggttctaagggacctgtaaatgcttgtgccctatattgtgtgcctcaacatattggggagcttgaagcatcgacagttgctagtcattgcttacttatataagaacataagtagtatttgctattgtcaagtgtgccttgcttgatgc

SEQ ID NO: 4028 - DNA, 360 bp, Zea mays
  Clone ID: LIB143-004-Q1-E1-C4
cgcgggtcgcaccacgcgtcggcccatcagctcacaggccggcagccgatcgatcgagctccgcggtcgctagcacagccggccactgcgcacgacggtgctggtaggttgcatgcacttgcaggatggcgcatgtcgctaagacgcttcgccttgtggccctggtggtcgtgtcggcagtggagctgtgccgcgccatcgacttctacgagcgggacctgacatcggactacgcgctgtgggacctgtacgagcggtggcacacgcaacaccgggtgcaccggaaccacggcgacaatgggcgccggttcgggagcttcaaggagaacgcgcgcttcatccacgcgcacaacaagcgcg

SEQ ID NO: 4029 - DNA, 333 bp, Zea mays
  Clone ID: LIB143-004-Q1-E1-C6
attcttcgtaagccttcaaaccgacgaatttgagcaactgcacccagagcgcgatccattgccggggaagaagcaacttgttgcgagcctcctctatggcgagctccgaccatggttccaccaccgcccccaaggacgtgccgggcagctacggcctgccgctggtgggcgccgtgcgcgaccgcctcgacttctactacttccaggggcaggacaagtacttcgagtcccgcgtggagcgctacggctccaccgtggtgcgcatgaacgtgccgccgggccccttcatggcgcgcgacccgcgggtggtggcggtcctggacgccaagagct

SEQ ID NO: 4030 - DNA, 288 bp, Zea mays
  unsure at all n locations
  Clone ID: LIB143-004-Q1-E1-C7
ttctttttggttctttgcgttttttttttgtttctgctcccctcgtgctgtcctttgccgggggtggggcttcttgttgtgtgcctcgtctttggcgtgctccttccnttggtctccttccgcgcccttcgtttttctgggtcgctgctgcttgccgctggtgtgcgtcgtgctgcttcgcctcttcttctgtgtcttctcttggcttgccctgttgtttgcgtcccgcgtggtgcgcttcggctctctcgtggtgcgcgtgtttgttcctccggtctctttcctggc

SEQ ID NO: 4031 - DNA, 335 bp, Zea mays
  Clone ID: LIB143-004-Q1-E1-C8
aggcaggtcggaccccgcaaatcgccccccaaaccaaccgggccggccgacacaagcagcatcccgtcggcggcgatggacctggcgtcgagcgacctcgcggcgctgggcgcggcggagctgatccgcgtctcggcgtcgatcccgcgcgcggctccgcgcaccttcgcgctgctcaccgcctgcctcgtcttcccgctctccttcgccgtgctcgcgcactccctcttcacccaccccatcctgctccgcatccggggcgccgcccactcggggttcgcgccgtggctcggcctcttcgcgtaccagttcatctacctcatcgtcctcttcac

SEQ ID NO: 4032 - DNA, 257 bp, Zea mays
  Clone ID: LIB143-004-Q1-E1-C9
attgctgatagtcaaaatagcatcatcttataagggtgtgcactaggataaatttaatccttttcatgttgctcatacttaattaattaagttgctgcaattttcatccattttgaccgaatgtgaatatacttatcaaggaattctttgtatgatctttaagaacgtgcgcattgtaagatttatgtgacctctgtacggcatagtataaggtagttttgcgtggaaaatcgacagtgcttactcaaaaggtgctg

SEQ ID NO: 4033 - DNA, 334 bp, Zea mays
  Clone ID: LIB143-004-Q1-E1-D1
tctccacctcaaatctctatcatgtctgcagcacatgtgtcacgctctttacgagtacaaatagcataaaatgattcttcaagtcttttaactggtctcaacagtgaaaagttttagagatgggttgttgttgggtctaactcaagatggagatagttttagcaaattctaatttttggtatcatggcaacaccaagtaatgatactagtaggatccaacaggtgattgggacggtgacactggaacttaaaaataagggtattgacatcaaaaatagtaaaatactagtgattttttttgcagccagagaagcacaagtcaaggatagttatg

SEQ ID NO: 4034 - DNA, 407 bp, Zea mays
  Clone ID: LIB143-004-Q1-E1-D12
acggacgcgtgggtgctgctaagtatttgatggaggactgtctttgtgtatgcttcctgcaggtgaaatgtgatctgtagtgatgctgtccccgaagttcagcaagcatacacaaagacagtcctgctgctaagtatttgatggagcgtggtgtggaccggaaggacttcaactcatatggtagccgtcgtggtaatgatgaagtaatggcaaggggaacgtttgcaaacattacgatcgtgaacaagtttttgaacggagaagttggacccaagaccattcatgttcctactggggagaagctttctgtttttgatgcggccatgagatacaaatctgatggccatgctactataatcctcgctggtgctgagtatggaagcggcagttctcgtgattgggctgct

SEQ ID NO: 4035 - DNA, 354 bp, Zea mays
  Clone ID: LIB143-004-Q1-E1-D2
acgcgtcggcagctgcgctagccaccgtcaacccgggccgcgccgcctcctccgcccgcctcgcgctctcgctgccgtgcggcgcgtgggtcggccgaagcgggctcgtccgccgcgccgccgccttctccgggacacggccgcgtttcgcgggcgccagggcgcagatcggggccgccgtgcctgccgtcgagcagttccagcgcaggatggcaacccaagctactgtgcatgccttcaaggatattctgaccagcctccctaagcctggaggtggtgaatatggaaagttctacagccttcctgcactaaatgatccaaggattgataagctgccgtactccatccgtattc

SEQ ID NO: 4036 - DNA, 340 bp, Zea mays
  Clone ID: LIB143-004-Q1-E1-D3
acgacgcgtgggttccttcctcccctggtcgcccccgcctccatggccctcgcgtgcgcgcccataccgctcccgagtccctaggacgcggcacgcacccttctcgcgggcgcgggcgcgggcgcggggcgcgggagcaggcatggcgtcgcaggtcgctgggtcaaccccggcggtggcggcgcttgggttccttctcccgaccttctgggagatcgaggtcacgtgcgccgccgcgatgatcctcgtggcgctttacgttgcctacgagctcctcaacccgcgctcctcgcaggcggcagcggcgggcgacgccgacgagctcctcgtgcgggggctg

SEQ ID NO: 4037 - DNA, 345 bp, Zea mays
  Clone ID: LIB143-004-Q1-E1-D4
ggacttctgcttactcacatgagttgccacgatatggtctcgaagttggtctgaccaactatgcagctgcctactgcactggccttctgttggctcgccgtgtgctcaagacccgtggtttagataaggaatatgagggcaatgttgaggccactggtgaggacttctctgttgagccagctgatgagaggaggcctttccgtgctctcttggatgttggccttattaggactacaactgggaaccgtgtctttggtgccctcaagggagctttggatggtggcctggatattcctcacagcgagaagaggtttgctggtttcaagaaggatgacaagcagctgg

SEQ ID NO: 4038 - DNA, 328 bp, Zea mays
  Clone ID: LIB143-004-Q1-E1-D5
aaaaacttgtttcgtaaccatcctattttttctctcgaattctttcttgtgattaaggcctggctaatttctattcttcaggtttgcagatcggcgcagttttggtcgcaaaggcgtggtcgttctcctcgagcatcgatttagggttcttcggctttctatgatcaggaggagttgctggattattttatcagggaacagaatggtgtgattcgttgattggattacagtctggatctctcttgcatcaaatggttgagcaaggcaaaccacgaagcatcccgacgaaggcgaagaaatcgccgttcgtggaggtagaggttgacga

SEQ ID NO: 4039 - DNA, 332 bp, Zea mays
  Clone ID: LIB143-004-Q1-E1-D7
acccacgcgtccgcggacgcgtgggttcgcaagccaccgcaaccgaagcgcgccttcgccgccgcccccgcccccgccgcctctgcgatccccgcaaggtcgcaaacatgtctaccgtgctccagcgcccgacccccggcacggtccagtgcttcggccgcaagaagacggctgtggccgtcgcctacaccaagccggggcgcgggctgatcaaggtgaacggcgtcccgattgagctcatcaggccggagatgctccgcctcaaggccttcgagcccatcctgctggcggggcgctccaggttcaaggacatcgacatgaggatccgcgtc

SEQ ID NO: 4040 - DNA, 335 bp, Zea mays
  Clone ID: LIB143-004-Q1-E1-D8
acccacgcgtccgcggagcgtaaggcgaaggagtagcagcagcaggcggcgccgagtagcggctccccatctcgagcttgccaccatggctagaggattgaagaagcatttgaagaggctcaatgcccccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctg

SEQ ID NO: 4041 - DNA, 413 bp, Zea mays
  Clone ID: LIB143-004-Q1-E1-D9
acgcgtccaatcaatatgttcttgttcttgaggatcttgctcgggaaaaggtaccactactgctatgctggaaactatgactgtggccctaaacttcatgttcatcatcattctgtcttcgtgtgcttttacagttcagtatgaatatctggtcaggcttaaacttcacaatgtgtttttatgtaatctcaaagttatggtcttcaaaatagattgttttaatattcttttgcaataaagccatggtattttcagtcgaactcttctcctttaatacatattagacatatatttgttttttaatgtttattcatttccaaacttcaacacttacaagttacaccccacaaaagctcttttgaacaatcatagaaatggtatttgtcatttgatggatcagatatgataacccc

SEQ ID NO: 4042 - DNA, 230 bp, Zea mays
  Clone ID: LIB143-004-Q1-E1-E1
accaaagcaaacgcacaggctcgagccaatccaccacccagccatgcctcccatgcgcaagtccccggcgacgattgcccctgccgcggggtccccgaggaagacgcggagcatggttgctgctgctgctgcagggaagcgggcaacggagcctgctccggcgaaggcagtgccggccaataaggaagacgatgcggcggttgccgagttgaaagggatgaagaggggca

SEQ ID NO: 4043 - DNA, 368 bp, Zea mays
  Clone ID: LIB143-004-Q1-E1-E10
gcctgccacaccaggaatcccgtttaatttatttatgctcaccaatttaagggcagaacttacggacctcaagctcttggttactcctgatcttctctaggcgactaggcacaattgccctctggcaaaatgccatcagtttatctttacatccctaacattatcgggtattttaggatcatcataaatttcattgcatttgcggtttgctattccaacaaggctctctttgctatcctgtacttcatcagctttgtccttgatggtgtggatggttggtttgcaaggaagttcaatcaagcatcaacctttggagctgtgttagacatggttacagatagggttagcactgcttgtttgttggccct

SEQ ID NO: 4044 - DNA, 338 bp, Zea mays
  Clone ID: LIB143-004-Q1-E1-A5
tgcgtccagatccttgtccctacgaccagcgacacgcactctgcacccagcgcgagagaaaactacatcgatcatcagcagcgagccagccggccgagcgagcagcaccgatggcggcgtacatgcgcgtgacgcaccgcgacgaggaaggcaagaaggtgacggagaagatgccggtcccggagacgcggcgcccggacacggccaagcacttcgagcgcaagctggaggagcagggcctccaccgcttcgagcggcacccggcgaacgcgccccggggcgtgggcatcggcgccccgccgcccaagtccgggcgcggcggcaagtacacctgggag

SEQ ID NO: 4045 - DNA, 334 bp, Zea mays
  Clone ID: LIB143-004-Q1-E1-A6
aacacgcgtccgacggtactccagccgctaccctgcgattccgccagtacgccaccaccaccgagcctggactaccgccgccgcccttcgccgatatcttcagcggcgaacagcgcccaccagatcccgcccctgcgatggagtccgtggtgaacccgaaggcatacccgctggctgatgcgcagctgacgatgggtatcctcgatatcatccagcaggccgccaactacaaacagcttaagaagggagcgaatgaagcgacgaagaccctgaataggggcatatcggagtttgtagtgttggcggcggacacagagcctctcgagatcctgct

SEQ ID NO: 4046 - DNA, 335 bp, Zea mays
  Clone ID: LIB143-004-Q1-E1-A8
agggagagaggacgttcatttccgcgtcgtctccgcccgcagccggcagccccaccacccaccacatggccgccatgccgggtggggcccacggcgccggcgccgcggacccgatgcaggtggaccagccgctcccccctgccgccgcaggcacagcacacgcccccgccgacgccaagcatgctggttctatgattgaagggagtgatccggtcacaggccatataatctcgacaaccattggagggaagaatggagagcctaaaaggactatcagctacatggcagagagagttgtgggaactggatcatttggaatcgtcttccaggcaaaa

SEQ ID NO: 4047 - DNA, 309 bp, Zea mays
  Clone ID: LIB143-004-Q1-E1-A9
aaagcagcgatccgaagctcaatcaattcactcaaacctcttccccaaatcttcgattagattctcgttgacaagaagactagaaccgaacctgaccatgtcgctgatccgccgcagcaacgtgttcgatcccttctccctcgacctctgggacccctttgagggcttccccttcggctccggcaacagcagcagtctcttcccctcgttcccgcggaccagctcggagaccgcggccttcgctggcgcgcggatcgactggaaggagactccagaggcgcacgtgttcaaggccgacgtaccggggct

SEQ ID NO: 4048 - DNA, 243 bp, Zea mays
  unsure at all n locations
  Clone ID: LIB143-004-Q1-E1-B1
aattcccgggacgttgagctcatctagggacacctgcgttgtcttgttgttgttgtgncttggccttttgttgccttggtgacaatgtttgccgcccggttccgccccgctatgtgtggcctgccggtacttggtggggtggtttcgttgtttccgtccactttatctgttgcctatcatttccttagtggatatttacttgcgccgttagtgttcgatatattcaacaccttctgaattcat

SEQ ID NO: 4049 - DNA, 273 bp, Zea mays
  Clone ID: LIB143-004-Q1-E1-B10
ccccatctagcagggatacgccctcccccacgccatccttcgtctcgacctggctggccgcgacctcaccgactacctcatgaagatcctgactgaacgcggctactccttcaccaccactgctgagcgggaaattgtcagggacatgaaggagaagctcgcctacattgccctggactacgaccaggagatggagactgccaagaccagctcttctgttgagaagagctacgagctgcctgacggacaggtcatcaccattggtgctgagcg

SEQ ID NO: 4050 - DNA, 379 bp, Zea mays
  Clone ID: LIB143-004-Q1-E1-B11
acgcgtccacccaagcgtccgcccacgcgtccgatcacaattcacacagcgaaccgtgaatccaacacagcaacatgcagagcagcgatccgacatccgatagatggacgcggtgatgttcgggctggagactcccctgatggcggcgctgcagcacctgctggacgtgcccgacggcgacgccggcgcgggcggcgacaacaagaccggcagcggcggcagcgccacgcgcacctacgtccgcgacgcgcgcgccatggcggccacaccggccgacgtgaaagagctgcccagcgcgtacgcattcgtggtggacatgccggggctgggcacgggcgacatccgggtgcacgtggaagaccatcgggtgctggtggtc

SEQ ID NO: 4051 - DNA, 357 bp, Zea mays
  Clone ID: LIB143-004-Q1-E1-B12
gtacccgcaagaagtcctttcggggcggtgatcacgccaagaaaccctcaagtacatgtccaagtaccagggacttgagatcacgcaggtggactgcgcacgggaggcaatgaggctgatccacgcggaagacaagaacctcaaggccgaggactcagcgtgggagctgaagaagaattcggcaacggcgtgagcaccatggtcctcgtctacaacgccaccggggccagcctgagcctggtggacgacgggaaagactggatgggctccgtctacagctcgccgatcccggacaccttccacaacgggcagtggatcgccatcctccacgtcaagcccggctcgctggcgcagggc

SEQ ID NO: 4052 - DNA, 344 bp, Zea mays
  Clone ID: LIB143-004-Q1-E1-B2
aactttattgacatgacattctaatctgatggagcaggatgaccaagaaggtgttagaaccgtagatgatgataatttcattgatgacactggagttgatccagctgatcgttatggcagcgataatgagcgacattcacctggacgttatgcacaggctgaggagggtgaggaggacgatgaaatcgaacgactcttcaagggtggtaagaagaagaagaagaagaatgatcgccctcgtgcagatattggccttatagtggaacaattcattgctgagtttgaagtagcagccgaagaagatgcaaacttgaataggcaatcaaaaccagccattaacaaac

SEQ ID NO: 4053 - DNA, 340 bp, Zea mays
  Clone ID: LIB143-004-Q1-E1-B3
accacgcgtccgatgcaccatgcggtttaccgtgttggggatctggaccgcacaatcaagtactacacggaatgctttgggatgaaactgctgaggaaaagggatgttcctgatgagaagtacaccaatgccttccttggctttgggccagagaacaccaactttgcagttgaattgacatacaactatggcgttgacaagtatgacattggaacgggctttgggcatttcgcaattgctaatgatgatgtgtacaagttagctgagaatatcaaatccaagggtggtaagatcacccgcgaacctggtcctgtcaagggaggatccactgttattgcct

SEQ ID NO: 4054 - DNA, 366 bp, Zea mays
  Clone ID: LIB143-004-Q1-E1-B4
ccgggccacatcgatccaaccccagccacgcctcggagacaggccgacagcccacgagcgagatccaacccaagttccgacgccgcgggcgagaccgatcagatccacctcagccgtctcggatggcgtcagcatcgacggcggtgcggatgctccccgacggcggcgctgacgacgaggagcggtggctcgccgagggcatcgccggcgtccagcagaacgccttctacatgcaccgcgccctcgattccaacaacctcaaggacgcactcaagtactcggcgcagatgctctccgaactgcgcacctcgcgactatcgccgcacaagtactacgagctgtacatgagggcgtttgatgagatga

SEQ ID NO: 4055 - DNA, 335 bp, Zea mays
  Clone ID: LIB143-004-Q1-E1-B5
aactagttaaatgtcgagagttaccatccttctaaaaaaaaaaaaaaaaaaaaaagaaaaggtataagaaaaaaaaaaaataagaaaaaaggaaataaaaaatgaaaaatcacaaaaggggtaatcaataaattttggaaaaaaaaaagggggggccgccctaggggttcaaggcttacttgcccttgcatgcaatttcataccccttctagattgtcccctaatttcatttccggggccgtctttttacaacttcgtgccggggaaacccttgggttttcccaatttaacccctttgcagcaaatccccttttcccaattgggggtaataccaa

SEQ ID NO: 4056 - DNA, 332 bp, Zea mays
  Clone ID: LIB143-004-Q1-E1-B6
tgtcacttctgtgacttctgtctgcgtctcgctctccggcgactggtgggccgccgccaccctaagttgcggaggtttacattggtctcttcgccggcgacgagcacccaccaggagtcttgacaagtttttccaatggaccaagtaccgaatggaaggcataaggtttcttttgcgaagccaagagtagttgtgctttcagattctgactctgactctgaaggttttgtagaagagctaactcctgttcactcaaagtcaaacgggaaggcttcatctgcgagcctaaaaactggtggaaaggcttcagccttttctaaaggtgaggcaag

SEQ ID NO: 4057 - DNA, 330 bp, Zea mays
  Clone ID: LIB143-004-Q1-E1-B7
acgaagctcctcctcgcgattccaatccacgcacgccatctccgactccgcgtccgcctcgcgcaggacatatattcagtgatggaacacaaggaggccggctgccagcagccggagggcccaatcctatgcatcaataactgtggtttctttggaagcgctgccaccatgaacatgtgctccaagtgccacaaggagatgataatgaagcaggagcaggcccagttggctgcctcctccatcgatagcattgtcaatggcggtgataatgggaaaggacctgcaattgctgcaactgtaggtgtggcagttcctcaagtcgaggagaag

SEQ ID NO: 4058 - DNA, 334 bp, Zea mays
  Clone ID: LIB143-004-Q1-E1-B8
aggacgcgtgggggacagcgacatattcaagtgctacgacagctgctccgacgacgtggaggaggccgtcgcccacctcaacggcctcgtccgggagcccaccgacgccaagttcctcgagctcaagtcgtggctctcctccacgctcggcggcaccgccacctgcgaggacgcctgcaaggacctgcccaagaccagcgacaaggacgacgtcgtcaacttcagcctcgacttcgagaagctgcagcgcgtcacgctcgacctcatcaccgatgcgtccggcaccatgtccgcaggcatcgccctgccaccctccaacgccggagcgccctcc

SEQ ID NO: 4059 - DNA, 340 bp, Zea mays
  Clone ID: LIB143-004-Q1-E1-C1
accttttcttgtgcgcagccgcagccgctgcttttcgttcgtcttcatcctacgcgagggcaaaacccacaaaccctctccctcccgtactccggcctacacatccaggggcgatgacgctgggtagctccggcgccggatcgagcgtcgtcgttccccgaaacttcaggctattagaggagctcgagcgtggagagaagggcattggtgatggaacagtgagctatggaatggatgatgccgatgacatctacatgcggtcatggactggtaccatcattggccctcacaatactgtacatgagggtcgcatctaccagctgaagttgttttgtgacaa

SEQ ID NO: 4060 - DNA, 392 bp, Zea mays
  unsure at all n locations
  Clone ID: LIB143-004-Q1-E1-C10
acccacgctnccacaccagngctcgcttcgaggagctcaatatggacttgttccggaattgcatggaacctgtggaaaagtgcttgcgcgacgccaagatggacaaaagcagcgtgcacgacgtcgtgctcgtcggtggctccacccgcatccccaaggtgcagcagctgctgcaggacttcttcaacggaaaggaattgtgcaagagcatcaaccccgacgaggctgtggcgtacggcgccgctgtccaggctgccatcctcagcggcgagggcaacgaaaaggtacaagatctgctcctgctcgacgtcacgccactgtctctcggcctggagactgcaggtggcgtcatgacggtgctgatcccgaggaacaccaccatcccgaccaag

SEQ ID NO: 4061 - DNA, 388 bp, Zea mays
  Clone ID: LIB143-004-Q1-E1-C11
gggcggacgcttgggcgagcgctatcatgaccggcggcacgctcaggttcatcggctctggcgcagcaccgctcggcaaggacgtgatggagggagtggccaagattttccagaagctgtgattgcccagggttacggaatgactgaaacttgtgggatcatatctttagagtacccagaaaaaggacaaattcgtcaatttggttcaactggagcacttgtctcaggagttgaagcaaaaattgttgatgtagaaacattgatatgtctgccaccaaatcaactaggagaaatttgtgttcgaggaccgaacataatgcaagggtatttcaacaatgtgcaagctactgaatttacaatcaagcaagggtggttgcatactggtgat

SEQ ID NO: 4062 - DNA, 343 bp, Zea mays
  Clone ID: LIB143-004-Q1-E1-A4
agcccccgctgtacaggagcgtcagggcccgagacttcatcgcaaagttcaacaccataggactcgatggccgcgcgctcgaccacttcaggctctagctacctggctacgtttcagattcgtcctttcatttgctttggtctctaattaataattccaaataataagcccgcggatggacctctgtctgtctgtctgtaatttagtttccaagtttaggtagtgtttggttactagggactaatttttagtccctctattttattccactttagtttataaattgcaaaatatggaaactataactctattttagtttccatatttgacaatttagttacta

SEQ ID NO: 4063 - DNA, 198 bp, Zea mays
  Clone ID: LIB143-003-Q1-E1-G2
accttccctccattcaagatcttccctctccggattctctctctgcctccagtccatagccactctgactatctgcccgattccgcctcccggttcctcggacaccctcgcctcctcggatagttcgggtcgacggtcggcctagcttcaatttcagggatggtgttctacctgacggcgcggtctcatggcggccac

SEQ ID NO: 4064 - DNA, 229 bp, Zea mays
  Clone ID: LIB143-003-Q1-E1-G3
gcatacactccgttcactctgctatttctctagattccgtctacgcctacaacttttgggtcctctcttctttccacgatatcgtttctagtggcttcggacacaatcgaaggtccggctattgggattgaactctgaaccaactaatcttgcgtcggactgtgacatcactgccggattgagatcatcgccacctatcatgggaatggcatcagtctgtcatatgtcc

SEQ ID NO: 4065 - DNA, 344 bp, Zea mays
  Clone ID: LIB143-003-Q1-E1-G4
cccgggccgaaacacgcgtccaacgcagtggaagaagcatatcgaggagtcgattgcggtgacggaggtccattcggagcagttgtcgtctgtaatgacgaagtagtagtcagctgccataacatggttctgaagcacactgaccctactgcgcatgctgaagtaactgcaattagagaggcttgcaaaaagcttgggaaaattgagctctcagactgcgaaatttacgcgtcctgcgagccatgcccaatgtgctttggtgcagttcatctctcccgaatcaagaggctggtttatggggccaaggcagaggctgccatcgccattggatttgatgacttcat

SEQ ID NO: 4066 - DNA, 317 bp, Zea mays
  Clone ID: LIB143-003-Q1-E1-G5
accccgctccgcctccactcctcgcgccgctgccgcatctcctctacaggtaagaaggagagaaagagggcgaaatggtgaagcacaacaacgtcatccccaacgggcacttcaagaagcactggcagaactatgtcaagacatggttcaaccagcccgcccgcaagcagaggcgccgcatcgcacgtcaaaagaaggctgtgaagatattcccacgaccaactgctggccctcttcgtcccattgttcaatgccagactctcaagtacaacatgaagtcaagggctgggagaggctttacccttgaggagttgaag

SEQ ID NO: 4067 - DNA, 312 bp, Zea mays
  Clone ID: LIB143-003-Q1-E1-G6
aatacacatgcagccaagaacaccttttggtgcatttcttgatcctgtggctgacaaggtttctttctctctccactgcccaccatttcctggcatgtttacaactaagaatatcagttctcaagatgagctactcacaggatctaatttaattgctctaattctttactgcagcttatggtagccgcgacattagttttactatgcaccaaacctttggaaacatcactgctcaatgatgggccatggcttctaacagtcccttccattgctatcattgggagagaagtagttactctgccaatctgcatt

SEQ ID NO: 4068 - DNA, 315 bp, Zea mays
  Clone ID: LIB143-003-Q1-E1-G7
ctccaccgtcgtccgccgccgccgaaggacggaaggagaagagggtacggccgtctcctcgcccccatggcccacgagaagaagctgtccaacccgatgcgggagatcaaggtgcagaagctcgtcctcaatatctccgtcggggagagcggcgaccgtctcacccgcgccgcaaaggtgctcgagcagctcagcggccagacccccgtcttctccaaggcgaggtacacggtgcggtcgttcggcatccggcgtaacgagaagatcgcctgctacgtcacggtgaggggcgagaaggccatgcagctgcttgag

SEQ ID NO: 4069 - DNA, 310 bp, Zea mays
  Clone ID: LIB143-003-Q1-E1-G8
agttcagcaagttgattagaagcattggcatggcttgttaattatatttgtggttcttagtctaaaatcacattgaagagggagacggacccaagtgatgcagttcatgtgtcatctgtatcagtctctatttttataagctgtcatatgttttctcgaaactatcttgtgttgattttgtgtgatgtgtacttttaatggcacagggccatgtatttccttggaaacgaccataagagtttgtatatggacttattttttctcccattttctttcttgagatgggctgtatatttgcttgaaagataag

SEQ ID NO: 4070 - DNA, 370 bp, Zea mays
  Clone ID: LIB143-003-Q1-E1-G9
agcgtgcttcctgctccgcttctctacgggtgggcatgccatgggcagcttcgggctgacaggcgtgtccgtgtgggaggcgctggtgctggagatcgtgatgaccttctggctggtgtacatcgtgtacgccactgcggtgtaagcgaagaggggcagcctgggcaacatcgcccccattgccatcggcttcatcgttcgggcaaacgtccaggatgggccgcaccctcgacggcgcgtccagtgaataccgccgtgtcgttcggcctcgccctcgtcagctggcagtgcggctaccaatgggtgtaatgagtcgggcgtctcatcggatgcggacactccggcgttatctacgagctgctcttcatct

SEQ ID NO: 4071 - DNA, 69 bp, Zea mays
  Clone ID: LIB143-003-Q1-E1-H10
gacccacacgtcaggtaacctcaactcagagggaatttgcacaaaccgcttcaatttggtgaaagggtt

SEQ ID NO: 4072 - DNA, 346 bp, Zea mays
  Clone ID: LIB143-003-Q1-E1-H11
aagaaacctaaagtcaccaggattttcacaaacccgattcgctcagtggacacgattcaataccccccacctcacacatgattcgaacaacgatgtctctgactcgccgtggagatgctgtctatgtattctctgatgacagatgggaccttgacgatggcatcccattaggctctggaagctccagcaacaacggactgtaccctgcggtcgaaggcactaacagatttcacacggccgcgttcgctggtgctcgaatgtaccgacaggaaactccagatgcacaggtcttcacaaccaacttcacagggctgagaaatgatgatgtgaaggtgcatctggaaga

SEQ ID NO: 4073 - DNA, 104 bp, Zea mays
  Clone ID: LIB143-003-Q1-E1-H12
gaagctacattcctaaaaccatctgcttcagccttcagcgagccccaagtttagtcggccgatcgattactgaagtagtatggcctcgccaagacggccctcag

SEQ ID NO: 4074 - DNA, 329 bp, Zea mays
  Clone ID: LIB143-003-Q1-E1-H2
cgtccaacataaggaccactcaaagttcaaaagaaagggtgaagatctcttttatgagcacaccctgtctctgaccgaagctctatgtgggttccaatttgttcttacacatctggacaacaggcagcttctgatcaaatcaaaccccggcgaagttgttaaacctgacgaattcaaggcgagaaacgactaggggatgcctatttaccagatgcccttcatgaacgggaagctctacattcatttcacagtggagttccccgactcgctggcgccagagcagtgcaaggctctcgagtcggtacttccgccaaagccttcgtccaagc

SEQ ID NO: 4075 - DNA, 324 bp, Zea mays
  Clone ID: LIB143-003-Q1-E1-H3
aacctacagcagctacacgctggcgctcccacggtcgacacgacggtgacgaccagtgccgcactctacctcggccccgaagtcgaacctgaaaattttggaaacaatggaagaggaagagtatagcgctgaaatatctaatgaacaagatggcgaaacagaatgaaatgctggtgagagtgatgtcttcagaaccagttgatgtagatgcagcatgtttacgaagagtacggatgatatttgactctgaggaagatgcctttcagttttatgtgacatatggttgtcacgcaggttttggtactacaagaacatctaacaata

SEQ ID NO: 4076 - DNA, 313 bp, Zea mays
  Clone ID: LIB143-003-Q1-E1-H5
acgcaatggggcatgatctgaagaagtttttgggtgtgatcgtgggtctgtgggttctctccggagttggaagcagctgtgacttcctcacgttgacatacattgccgtcctgatgctccacacggtgccaatcttgtacgacaagtaccaggacaaggtggaccatgtcgctggaagggcacacaccgaggccctcaagcagtacaaggtgctggatgccaaggtcctgagcaaaatccccaggggtgcggtcaaatccaaaaagcagaactagttaggataagccgcagattgtgaatgcccgtatcatga

SEQ ID NO: 4077 - DNA, 188 bp, Zea mays
  Clone ID: LIB143-003-Q1-E1-H6
actccatgtggaactatgtgaacattttggtggatctgctgttgggtctgtgggttcggtctcgatctggctgcagcggtcacctcatcatgtcatctttgattggagtcctgatgcttcacacggtgagagtcttgtacgatagatatcaggtgcacgtggaccatatcgctggttagggacacacg

SEQ ID NO: 4078 - DNA, 87 bp, Zea mays
  Clone ID: LIB143-003-Q1-E1-H7
agggatatatatgtgtttccaggtagttggagattcgaaacgaaccagtgatgtagatttgtttcatctaaatatatgctatagttc

SEQ ID NO: 4079 - DNA, 286 bp, Zea mays
  Clone ID: LIB143-003-Q1-E1-H8
agtgccatcgcttgtgacaagctatcgtcaattcgctaccctgcgagcaggcattggcctatggatgtggccggaaggctagcggaactgggcctgaggtacactgaggacacaagccgggatcgcccacacctgactgctgacactgtacgagagctgggacagctacacgtcaccagggacgaggaacaagcaacctccactttccggtgctcgattatgcaagagataatgcatgatcctcatgtctgcacagctgatggggtgaccaactactggctggcga

SEQ ID NO: 4080 - DNA, 76 bp, Zea mays
  Clone ID: LIB143-003-Q1-E1-H9
tccagcccatgctgacggtacccgaaccatacaatcagcttccgttggaggaaacgtatcaggatactgtgcccgt

SEQ ID NO: 4081 - DNA, 417 bp, Zea mays
  Clone ID: LIB143-003-Q1-E1-G12
gacccacgagtccgctttgagaaagacagctttttcaggaacatccttatcaggacgcatcacaatatacctgagatacttctgagtaagatactccctgtcatgctgtcctctgtcgagtctgcctcacttgagtttcgatcagtagctgctctatccataactgtttcgtgacatctgagtgcctaacttactatcgacgacttgactatcattgtcatgctatctgctgtcaatcattgtgctaccagtgaatgtcctatgcgacaaagtcatcagtatgagaaatctcagtctgctgaatcagtgtctgctcaaattgttcatcaagtagtatttccacatgtagcaactgaatgtaccgacactgatcgtacattacgttcactgatcatattatcaatgctcatatcacaa

SEQ ID NO: 4082 - DNA, 338 bp, Zea mays
  Clone ID: LIB143-004-Q1-E1-A1
gatgtttaccagaatgcccgtgcatgccttaggttgcgtgtggcgtgtgagaagcttaagaagatgctgagcgccaacccagaggccccactgaacattgagtgcttgatggatgagaaagatgtgagagggtttattaagagagaggagtttgaacacatcagtgcacctgtgctggtacgtgtcaaaggacccttggagaaggccttggctgaagctggcttgacaactgaaaatgtgcactttgttgaggttgtcggatctggttctcgtgttccagccataatcaagataatcactgatttttttgggaaggagccgagacgaaccatgaatgc

SEQ ID NO: 4083 - DNA, 377 bp, Zea mays
  Clone ID: LIB143-004-Q1-E1-A11
caactccgccctctcgcaatcatcgccgacgaggacaccgtcactggcttcttgatggccggcgttggcaatgttgatctgcgcaagaaaaccaattacctcctcgtcgacaacaagacgacagttaaacaaatcgaggacgcgttcaaagaatttactgcaagggaggatattgctattgtgctcatcagtcagtatattgccaacatgataagatttctggtggatagctacaacaagccagtccctgctattctggagatcccatccaaggaccatccatatgatccagcgcacgactcggtgctgtctcgagtgaagtatctcttctctgcggaatcggtggcgtctgataggcgatgaaggcatccttgtgt

SEQ ID NO: 4084 - DNA, 287 bp, Zea mays
  Clone ID: LIB143-004-Q1-E1-A12
ggaggaggcggagggggatgccatgggcaaggacgtcgtggtccagagcggcgcgggcggcggggatttcgccgccaaggagtacactgacccgccgccggcgccgctggtggacgctgcagagctgggttcgtggtctctgtaccgcgcggtgatcgcggagttcatcgcgacgctgctgttcctgtacgtgacggtggcgacagtgatcgggtacaagcaccagacggacgcttctgcgtctgcgtcgggggccggggccgacgccgcgtgccggcgcgtgggcg

SEQ ID NO: 4085 - DNA, 258 bp, Zea mays
  unsure at all n locations
  Clone ID: LIB143-004-Q1-E1-A2
gtgcgtgccttgggttgcgtgtggcgtgtngtgggcttgtgcgggtgctgcgcgccggcccgggggccccgctgggcgttgcgtgcttgctgggtgggggggctgtgggggggtttgttgtggggggggcgtttgggcgcgtcggtgcgcctgtgctggtgcgtgtcgtgggtcccttggtgacggccttggctggggctggcgtggctgctggtggtgtgcccgttgttggggttgtcggctctggttctcgtgttc

SEQ ID NO: 4086 - DNA, 348 bp, Zea mays
  Clone ID: LIB143-004-Q1-E1-A3
acgcgtcggaccacgcgtccgcccaagcgtccgcccacgcgtccggttatgaagagtggcaagtacactctcggctacaagaccgtcctcaggactctcaggaactctaagtcgaagctagtgatcatcgctaacaactgcccgccccttcgtaagtctgaaattgagtactatgctatgctggccaaggtcactgtccaccacttccatggaaacaatgtcgaccttggaactgcctgtggtaaatactttcgggtctgctgcctcagcattattgatcctggtgattctgatatcatcaagactacaccgggtgagcagtaaagaagcccctgcagtagggggatc

SEQ ID NO: 4087 - DNA, 423 bp, Zea mays
  Clone ID: LIB143-024-Q1-E1-F12
caccggaggcgcacgtgttcaagaccgacgtgccggggctgaagaaggaggaggtgaaagtggagctggaggacggcaacgtgctccagatcagcggcgagcgcatcacggagcaggaggagaagacggacacctggcaccgcgtggagcgcagcagcggcaggttcctgcgcatgttccgcctgccggagaacgccaggacggagcagatcagtgcgtccatggcgaacggcgtgctcaccgtcaccgtgcctaaggatgaggccaagaatgccgacgtcaagtctatccagatttccggctagtatgctcaatctcacaagcagatggtgtgccgtcatcgtcttgtgttgatcgatctggtagttcttaacatgccggttgtccataacatgccaacgtccgtgtaactgtgttatactg

SEQ ID NO: 4088 - DNA, 370 bp, Zea mays
  Clone ID: LIB143-024-Q1-E1-F2
cacgcaaccgcaaagctggacttgactgacgtcttgatggatcatggagctatcacgataccatgacgagaactttttgcacaccgtggacatggaggatggagaccggaaggtcaatcgtccagtgcatacaagttcctatagatccgagacatgtaaaaccttacatagaaaagagctgttttgtcgtttctgagtctttccccaattgcctaatgtggtggtagggcatccgttggcttgtaaaacaaggctgactacaactaacttagtgatcgcgacgcgtcagacatgacgaagttcaaaccagccggcagttttgccgggaatgttttacgaaacctttcccgggctgcagtcaaggtttccc

SEQ ID NO: 4089 - DNA, 249 bp, Zea mays
  Clone ID: LIB143-024-Q1-E1-F3
gagtactgcgagttcggccccgacttcgagcgctgcaagccctggctgcgcgcgcatgcgcccggcgtctaccccgacgaccttgtcgccgcctcctcctcctcatccggcggcggcgacaaggacgtcgacagggtcggggatcgcctccagggcgtcgggatctccgacggctccaccagcgccgcaagggatgcttccgcgtctaagccccaagaggcgaaacgcctgcctggtggtaagctcaag

SEQ ID NO: 4090 - DNA, 380 bp, Zea mays
  Clone ID: LIB143-024-Q1-E1-F4
gggtccacgcacgcgtccggataaatccctgccattagtagcacgcacaaaacaattggaataaggtgcaaccaaaacggttttccacggttcccggttggaaccaaccgaggagattgtcgtcacgctcgattggaggcctgattgggacgtactggggtctggggggaccgctgtgctgggcgtgcagcgggtcgccggcagcggcgcactgccggacgtgcccgggcggcgcgtacctgtgcccggggtgcgacactgggcacgctcgggcggtgcacgaacgggtgtgggtctgcgaagtgtgcgagtgcgcgccggccgccgtgacgtgccgcgccgacgccgccgcgctctgcgccgcgtgcgacgccgacatc

SEQ ID NO: 4091 - DNA, 361 bp, Zea mays
  Clone ID: LIB143-024-Q1-E1-F5
tcgtcagcagcttctgcttgctctggggggaaggagagagagagagcgagagagagagagagatctagtagagaggctagtaggtggtcctcgaacgaagatgttggcggtgttcagcgggcaggtggtggaggtgccggcggagctggtggcggcgggcagccggacgccgtcgcccaagacgaaggcgtcgcagctcgtggggcgcttcctggccgcgtccgagccggccgtgtccgtgcagctcggcgaccacggccacctcgcctactcccacaccaaccaggcgctccctccgcccaggtcgttcgcggccaaggacgaagtgttctgcctgttcgaaaggggtcctggacaacct

SEQ ID NO: 4092 - DNA, 154 bp, Zea mays
  Clone ID: LIB143-024-Q1-E1-F7
aaaagaaaaaattaagatatagtcaaaaaagataaaaaaaaaaaaaaaaaaaaaaaaaaaaaaaaatttaaaaaaaaaagtaaaaaagataagaaaaaaaaaaaaaagggcggccgtccaataggttcaagtcttagatatgcttgaagggaag

SEQ ID NO: 4093 - DNA, 222 bp, Zea mays
  Clone ID: LIB143-024-Q1-E1-F8
gatcgtggtttatccgtggtttctgaaaaaataaaaaaaaaaaaaaaaaaaaaaaaaaaaaaaaaaaagacaaaaggtcaaaaagttaaaaaacttaaataaacgtgcacccgtcctaaggagttccactcttctttcaccgtgacttctatatccgatccctcatctgtagtcctcctaattcgtataacgcgccgtctttctaagttatccgccttggaa

SEQ ID NO: 4094 - DNA, 419 bp, Zea mays
  unsure at all n locations
  Clone ID: LIB143-024-Q1-E1-F9
caggttgatatgaggccgcagctggcagctggcagcaacaaaaaggttccggtatcagttagacaggcacaatttcaccgaattgctgagcattatttgcagaaagcaaatttggatgtcattcgcagatgtgcagatactgaattggccattgctgatgctgtcaatgttgaaaagggtatttatgaaaggtcaaatagcanatcaatttatgtgaatctttgctctcaggctactcgccagcatgccaaggcaaaatctgataatgacacttcaactctaaccaaaaggactgaatcaggcagtgatcagatatcacaggaagctacatctgagggtaccaatgttagtggcagtgatatggaagaggatctanacagagcagctatctccaatcaaaagaatgaactagaggatga

SEQ ID NO: 4095 - DNA, 182 bp, Zea mays
  Clone ID: LIB143-024-Q1-E1-G1
cagacgcatgggcggacgcgtgggcggacgcgtgggaaaaaaaaaaaaaaaaaaaaaaaaaaaaagaaagaaacacaaaaagataaaaaaattaaataaacataaaaacaaaaataataaatcttcaaaaaagtaaaaaaaaattcaattcacaggacaatcaattttaaaaaatcatagaa

SEQ ID NO: 4096 - DNA, 421 bp, Zea mays
  Clone ID: LIB143-024-Q1-E1-G10
ggccaaagtccctcgtgactctttcagctgagtatgatccaaaggtggtaagtgcgccttcaaggatcggcgtggccatatcgctcaagccttgagatatgggtcaagtcaccttctgtaaaacagtacaagcgttacgtactgatactcgtgtccaagaacataaacttttggagcgatgcctagaacaaccctctcccttttagccttgtttttggtaagatccttgggcaaagaagtgttgtcagggagttggacttgttttgtggaatgtttccattaagagccaaccccacaccgatgattgcaaacagaggtttgtattagtgcagaagtttcactctgcgatattttttccccatgttttcctagtcgacgcaaaatgattttggaggtgattgaacacctaacgtcctgagtt

SEQ ID NO: 4097 - DNA, 391 bp, Zea mays
  unsure at all n locations
  Clone ID: LIB143-024-Q1-E1-G11
aatccgtgattggcattgtcactcgtgctcttctttgttctcgtcgtcgtcgtcaccatagagcgcgtctgcaagcgctcccaccccaaaaccccgcggacgcaccgacgcgcgagccataatgcgccgccaaagcctcgccaccgtactgctgctcctggtggccgccgcggccctggccgcccccgccgttgggcactctgagtcctcctgccccttctacgaccacggcggccacggcgaaccgcacgaacgccacggccatggccacagctgcggcggcggcgcggaccatgagcaccaccaccaccatcaccacggccatggacacggcgagatccagcggctgctcncggatgagatggcggacgaggcggatctcgagctcgag

SEQ ID NO: 4098 - DNA, 416 bp, Zea mays
  Clone ID: LIB143-024-Q1-E1-G2
gacaccacacctcttcctcctcttcctcctcctagcacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcgaggcggccaccgagggcggcggctgcgactgcaacacctgcaactgcggcaccagctgcggctgctcctgctgcagctgcaactgagccggcccgcccggcccggcgatggcgcacgagagtcgagaggacgacgacgacgaggcgtataaatataatagcagcgtctaaataagatcctgtcaactgca

SEQ ID NO: 4099 - DNA, 366 bp, Zea mays
  Clone ID: LIB143-024-Q1-E1-G4
aatcaattgatgcacctaccttcgaggcaaaccatgtgctgacgactgacattttgtgcgcttttacttaaaaaatgttggattgcatgataattctctccccttggttttgcagaccactctttgtactgcaagattgtccatttgttaattttgaatgtattgtctgcacaaagaatcagccgtgattgaatcctactataccatgagatcacttgggtgccctgtttcacgacggagaggatgaacactatgtcatctggttttggttggtaaaggataacacacatgagtgcctactctgctcacggtactttgtgcgcaaggtcactcgagatgagggtgatccagatggccatgatgacg

SEQ ID NO: 4100 - DNA, 390 bp, Zea mays
  Clone ID: LIB143-024-Q1-E1-G5
gaagaagctcgctgccgccggcaagctgacgagggtgaagaactccttcaagctgccggccaccgacgccaagcccaaggccgccaagcccaaggcacccaaggccgcgcccaagcccaagccctcgccgaaggcgaaggccaagaccgctgcgaagcccaaggcggcgtcgcccaaacccaaggccaaggccaaggccaagcctgtcgctcctgccgccgcgtcgcccaagccccgcgggcgccctcccaaggtcgccaagacctccgccaaggcctcccccgccaaggcagccaagaaggcggctgctcctgccaagaaaggaaaggcagcggcgggctcctaaaaaggttgcaaccccgaagaaggctgctgctgctggcgccccgg

SEQ ID NO: 4101 - DNA, 371 bp, Zea mays
  Clone ID: LIB143-024-Q1-E1-G6
ccacgcgaccggaagaagctcgctgccgccggcaagctgacgagggtgaagaactccttcaagctgccggccaccgacgccaagcccaaggccgccaagcccaaggcacccaaggccgcgcccaagcccaagccctcgccgaaggcgaaggccaagaccgctgcgaagcccaaggcggcgtcgcccaaacccaaggccaaggccaaggccaagcctgtcgctcctgccgccgcgtcgcccaagccccgcgggcgccctcccaaggtcgccaagacctccgccaaggcctcccccgccaaggcagccaagaatgcggctgctcctgccaagaagggaaaggcagcggcggctcctaagaaggtggcaacccc

SEQ ID NO: 4102 - DNA, 240 bp, Zea mays
  Clone ID: LIB143-024-Q1-E1-G7
ccacgcgtccgagtagatgcacgtgttgacaaacttgtccagttgcgaggtgaactgaacccactgcaggatgcttctggtggaaagaaaatatcgattaatgatcttgtcatcaaggctgcagctttggcccttcgaaaggtccctcagtgtaacagctcatggatgaatgattttattcggcaataccacaatgtgaacatcaacgtggctgtacagactgaacatggattgtttgtt

SEQ ID NO: 4103 - DNA, 396 bp, Zea mays
  Clone ID: LIB143-024-Q1-E1-F10
gacatggccgcgcgcgccaaggccgccgccgtcgacgaccacgaccccatgccgccaccgctgccgctcccatggccgcgcccagcgccgctcctcgtcatgctgtccctgctcgccacggcctcctacctggccctcacgcgctttcccgccgcgctcctcccgatcgcccctcgctctcgcccccacgacgcgcccgcgcacgcgcccggggacagctgcgcggggttctacgcgggcgcggggccggcgcgcgaggtgtgggcgtccgtcgaggagttcggggccgtgggcgacggggccacgctcaacaccgcggcgttccggcgcgccgtcgcggagctgggcgcgagggccgtcggtgggggaggggccaggctcgacgtgccccccggg

SEQ ID NO: 4104 - DNA, 263 bp, Zea mays
  Clone ID: LIB143-024-Q1-E1-D7
aaacaaacaagcacacagatgatggggttaatagaagtgttggagcaagtactggagcttcaagtgaagccaataatgtgcctggaaccgagaaggcacaggaagcaggttcacttgattctatatccaagtctaacaggaagaggacagctaaacgaactgcattttctgattcagattcagaagacctagacctatcaaaggaggaccttgtgaagctgcttcttgagaaagacgaatcattgaagtctaaagatgaagag

SEQ ID NO: 4105 - DNA, 429 bp, Zea mays
  Clone ID: LIB143-024-Q1-E1-D8
gaatcggcgcagcacgactacaggcatatggacgtggaagcgagccatgagtctccgcccttgcgcagcaagacgatgcgccgcctcctggtggcgaccaactgcgtgatgctcgcgcttggcgtcaccggtgggcagctcctcagccgcctctactttagcaagggcggacaccggcagtggctctccggatggctccagaccggtggctggccgctgctgctcccgccagtggcggcttcctacgtccgccgccgagcgcgcgaccggagcgccccggtgctgctcacccagacccagccgcgcatactgctggccgccgcggggctcgggctcatcgcgggcgtggacaacttgctctacgcctggggcctcgagttcctgcccgtctctacctccgcgatcgtcacctccacgcagctggccttc

SEQ ID NO: 4106 - DNA, 399 bp, Zea mays
  unsure at all n locations
  Clone ID: LIB143-024-Q1-E1-D9
catgtccgcccggcctcttccgtctcggagcgagaaatcagcggcatcgccgcgcgcatccgaagcgcacacgacaatgcagggcggatccagcggcatcgtctatggtggcctcaagtaccaggcacggtgtatcgccgacgtgcgcgcggacgccagctcgaccaccttcctcgccgggaccctcagcctcaaggaggagaacgaggtgcacctgatccggctttcgccggcggagagtgagctggtgtgcgatggagtcttctaccaccccaacgagatctgggatctcaaatcatgtcccttcgatcacanggtcttctccacagtctacacatctggtgagggctttggtgcgtcagtttggaagatcccagagcttaatgggcaatcaaactc

SEQ ID NO: 4107 - DNA, 350 bp, Zea mays
  Clone ID: LIB143-024-Q1-E1-E1
cccacgcatccgcggacgcgtgggcgggtggtgaccctatggtaccgcccacccgaactgcttctcggcgcaacggattacggggtgggtgtggacctgtggagtgcagggtgtatcctggccgagttgctcgctgggaggccaattatgccaggacgaacagaggtggaacagctacataaaatttttaagttgtgtggctccccaacagaagaatattggaaaaagtcgaagctacctcatgctacaatatttaagcctcagcagccgtacagaaagcgaataagagagacgtttaaggattttccacaatcagcactgcagttgatcgagacactacttgcaattga

SEQ ID NO: 4108 - DNA, 427 bp, Zea mays
  Clone ID: LIB143-024-Q1-E1-E10
aaaagaacagcttgagagctcctctccgatcccgacccaccgcctgcaactcttcttctctcctacgtgttcgtcagcccgctaagtgttaagatggcttcaagcgatggtcagacagaagctgcggccccatctgtccccaaaaaccctgctatggcatcatgccggaagaagaaaacagatgatgctaccttcctcgaagatctgaaagaccacatcgatgagttcatccatgcctccatggatgagcacaagtcctgctttaagaagacgatccagaagatgtttgggatgtcgaaggctgttgcagagagatccgcggcggaagcgaaggaagctggagttgaaagtgctttgccacttcagaccagtgtctcgcagtagaatttcacgttggtagtttcttgctcgatgccgggcttttttt

SEQ ID NO: 4109 - DNA, 389 bp, Zea mays
  Clone ID: LIB143-024-Q1-E1-E11
ggcgcctacgggcagcagggacacaccggtagcgcctacgggcagcagggacacaccggcggctcctacgccaccggcaccgagggcaccggcgagaagaaaggcattatggacaagatcaaggagaagctgcccggacagcactgagcggcgcctatacgtggctgtgctgggctgtgctggcgcgtcaaagccgtaatgttcagtgttccatagataataagataaacccatgaataagtgtccctacccttgatcatgtgacagggacagggacagtttcctgtacttgtggggtgaatttgtacgtgtgatacggtaactgggtccgtgtactgttcatgctacgttttcctacgtatatagtacagcacttgcgagtggcttta

SEQ ID NO: 4110 - DNA, 427 bp, Zea mays
  Clone ID: LIB143-024-Q1-E1-E12
ggtacattgagttttacgacgttatgtctgttccaatggcaattgctctgtctggtcaaccgctgcttggacaagcagtgatggttaaaccatctgaggctgaaaagaacttagttcagtcaaatgcgacatcaggtggtgcggcttcaggtggagcaagaaagttgtacgttggcaatcttcactcaaatattactgaagaccaattgagacaggtatttgaaccatttgggcaagtagagcttgtacagcttcctgtagatccaatgactggattgtgcaaaggttatggttttattcagtttgcacggcttgaagatgcaaaagctgcacagagcttgaatgggcagcttgatatcgctggcagagttattaaggtttcagctgttaccgatcatgtgggaatgcaagctagtggaacaactac

SEQ ID NO: 4111 - DNA, 379 bp, Zea mays
  Clone ID: LIB143-024-Q1-E1-E2
tactccatctacggcctcaacgacaaggtccccttctccgagcgcgaccgcaccgaccagccggcctcgctctacgcggccaccaagaaggccggcgaggagatcacgcacacgtacaaccatatctacggcctatccatcaccggcctccgcttcttcaccgtgtacgggccctggggccgccccgacatggcctacttctccttcacccgcaacatcctgcaggggaaacccatcacggtgtaccgcggcaaggaccgcgtcgacctggcccgcgacttcacctacatcgacgacattgtcaagggctgcctcggctccctggacacggccggcaagagcaccggcaccggcggcaagaagcgcgggccggcgccct

SEQ ID NO: 4112 - DNA, 372 bp, Zea mays
  Clone ID: LIB143-024-Q1-E1-E3
ccggtccgagatcacgggtcgacgacgcgtccggaggaggcttcgattttcggcgggcgcaataaatttcccgcatggctcggagggccgcgtcctcgctcgtctcccgctgcctcctggcgagggcccctgccggcgcgccgcccgctgccccctctgcgccgcgcatgacagtgcctgcagatgggatgcacaggctgttgccaggtgtccttcagaggttcagcactgcagcagcagtagaggagcccatcacgccgtcagtccatgtgaactacacaaagctcctcattaatgggaactttgttgattccgcatccggcaagaccttcccaactctggagcctcgtacaggggaagtgattgctcatg

SEQ ID NO: 4113 - DNA, 396 bp, Zea mays
  Clone ID: LIB143-024-Q1-E1-E4
aatatattcattatgcgaagaaccttattcaaccaaggctcactgatgaggcatctgatcatattgcaacctcatatgctgagctcagggatggtagtgcaaatgcaaagtccggtggaggtacacttccaattacagcaaggacactggaaaccataattcgtctatcgacagctcatgccaagatgaaactgaggcatgaggttctgaaatccgatgttgaggctgcattgcaagttctaaattttgcaatataccacaaggaattgactgagatggaagagagagaacagagagaaatggagatgaaacagcaagctgatcatgatgcaggtgcaaccggtggcactgtggatgggcatggaagctctggcaatgatccaatggatgtggatg

SEQ ID NO: 4114 - DNA, 415 bp, Zea mays
  Clone ID: LIB143-024-Q1-E1-E5
gacccaacgtcagttgcgataccatttggcacttttgagaaggttttgtcagatgggcttaataaggaagtagcacagagcatagagaagcttaagatcagacttgcccaagaagattttagtgctctaggtgaaataagaaaagtcgtccttaatcttactgctcctatgcaattggttaatgagctgaaggagaggatgctaggctctggaatgccctggcctggtgatgaaggagacaagcgttgggagcaagcatggatggctaataaaaaaggttggggcatccaaatgggaacgaaagaacactatttaacacacgccagggtgaacctggttaagaattaccttccaagggcggtccccgtgcagaagttggtgatggcaaataaggctttggcaatcaaaacaaaaa

SEQ ID NO: 4115 - DNA, 438 bp, Zea mays
  unsure at all n locations
  Clone ID: LIB143-024-Q1-E1-E6
caccagccagccatcgtcacactggtgagctctgcagtctgcactctgcttagctccgagcttcagtgccttcgttgttagctgttagctccacagtccacagttccacacacacgtccagctgcactgcaccaatggccgccgtcgaggtccaggtcccgactgccgctcccgtcgaggaggctgctgctgctgctgcagcgggagtggaggctgcccagctggccgccgtcgagaccccgaacgaggagaccgctgctccggcggcggagaccgaggtcgtcgccgctaaggagccggtgtcggccgaggccgagactgagtccaaggaggtcgaggtcgaggccgaggccgtanctgaggctgagccgaccgaggcagagcccaaggaagcagagcccgaggccgccgcgccggcagcagagacggaggctgctg

SEQ ID NO: 4116 - DNA, 403 bp, Zea mays
  Clone ID: LIB143-024-Q1-E1-E7
cacacgcgtccgcttctttctcagccatcgctctcccattgctcgcgcaggcgatgatggcagctacaaggttctgtccatgggctctccgagaactgactccgtctgttcccagtccaaagcggttccttcgtcgtccgccggtgccgccacggtgcccttgcatcaccgtcacggcccatgctcgccgttgccgaccaagaagatgccgacgttggaggagacgctccatcgcgatcagctccgagctgcctacatccagcggaagttctcaggcggcggtggcgctggtggtgacgtccagcgatcggacgccaacgtgccgaacggccttgggaactccctgaacaagctggagtaactgattaacgtaagcctgggctccccgggcacgttccaaaac

SEQ ID NO: 4117 - DNA, 355 bp, Zea mays
  Clone ID: LIB143-024-Q1-E1-E8
gagaacccgccgccgacgcagcagcaggagacgcgccaatgagagcccacaaggaggcgactatgacggccaactggaaaaagaatcgcatgaggaggctgaagatgaatcgccaatagatgatgcatagatccaagtacgctgatggggattgtggatggtggtgtcagcataattgtgtaacctctcttcgatgcatgagttcaaggacagatgtcacatcctagttcgtcgtcaatgtttgccatgggtccaatggcacgtcttggtaacctgcacttcattaggccatctatcctggtttcgatctatatccatagttctgtgctaacacaaatcagtcagtcgttttgtg

SEQ ID NO: 4118 - DNA, 406 bp, Zea mays
  unsure at all n locations
  Clone ID: LIB143-024-Q1-E1-E9
cacttcggcctcttcctggcgcgcaaggtctccctggtgcgcgcgctgctctacatcgtggcgcagtgcctcggcgccatctgcggcgtcggcctcgtcaaggcgttccagagcgcctacttcgacaggtacggcggcggcgccaactcgctcgcctccggctactcccgcggcaccggcctcggcgccgagatcatcggcaccttcgtgctcgtctacaccgtcttctccgccaccgaccccaagcgcaacgcccgcgactcccacgtcncggttctggctcccctccccatcggcttcgccgtgttcatggtgcacctggccaccatccccgtcaccggcaccggcatcaacccggccaggagcctgggcgccgccgtcatctacaacaaagacaagccctggg

SEQ ID NO: 4119 - DNA, 351 bp, Zea mays
  Clone ID: LIB143-024-Q1-E1-F1
atacgcgacaccatgccgcgcctcgccgccgccgccgccgccgtctcacgccgcgccggcgaggccctgcgccgcggcgcgtttgggggactgcggcctctctcctccctgcaaccgttaaacgccgcctccagcgacgaggtgctcgttgaaggaaagacaagtgcgcgcgctgccgtgctcaaccgccctggctacctcaacgccctcaccaccaccatgggagctaggctcaataaattttatcaatcatgggaggacaacccagacattggctttgtcatgatgaagggcagccgccgagcattctgtgctgggtgggatgttgttagattacatgaacttttcact

SEQ ID NO: 4120 - DNA, 422 bp, Zea mays
  Clone ID: LIB143-024-Q1-E1-D6
cactattcgttccccgcctcaccccgagccagccgtctcgctagggtttcgccgccgccgccgccgccgccgccgctatgcctcgccgcagctcaggaaggtctgccccacgcccagctacccgtgctgctccagtgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgatgctgtattaggtccccggaccattcagcatgagactgttgcctcagaagctgctgctgctgcccctgcccctccagtgatgaatgctgacgcttgcagcatccattctaatgctttccaagattgtctcaacaactat

SEQ ID NO: 4121 - DNA, 107 bp, Zea mays
  Clone ID: LIB143-024-Q1-E1-C12
aggagatagatgcgatcgtagtcatgcaccctcctatgggttcattcagaaacactgggctcattgatttcatcattatataaattattccctgacatgtatactca

SEQ ID NO: 4122 - DNA, 436 bp, Zea mays
  Clone ID: LIB143-024-Q1-E1-C2
cgcttcgccgaattccctgtcctccgcccgcttcgccgaatttcctctcctccccgcccgccgcccgtcaccgcggcttcgtctgcgcttgtccctcccgttccaaggagcacgtgcttctcgccgcgccgttcgcccgccgccgccgccaccggttcatcgccagctatgtcttctcaggtcgacagccgcagccagtccgccgggaagcgcgcgcgcaccgacggcagccggcgtgaggacgactgggtttgccccagctgcaagaacgttaacttcgcctttcgcaccacttgcaacatgcgcaactgcaaccagtccaggccagcaaatcaaacaagggcaagcaaaacccggctcgccaacccaaattaagaaggtacaataacccaagggagccaacgttgaagttaccttgtgggtgtggccccccaaa

SEQ ID NO: 4123 - DNA, 338 bp, Zea mays
  Clone ID: LIB143-024-Q1-E1-C3
gggtccacgcacgcgtccgcacacgcgtccgcgccgcccagaccgcctccccttccccgcctccggtgcccaaggccaggccaacagttttgaggtggtaatggcggaccaggctaaccaacccactgtccttcataagctaggtggccagttccacctgagctccagcttctctgaaggtgtacgggcccgtaacatctgcccttctttctcaccttatgaaaggagatttgccacgaggaactacatgacccagagcctttggggcccttcaatgtctgttagcggtggcatcaatgttccagtgatgccgactccgctttttgccaatgctccag

SEQ ID NO: 4124 - DNA, 378 bp, Zea mays
  Clone ID: LIB143-024-Q1-E1-C4
cagacgcgtgggcgcgacctcctcccccggcgtacctccggagatccaccccgacccaccaccgcgtgcctcggcaatggccggcgctccgactaccgtaaccaagtccccgccgtccctggtcccgccggcggggcccacgccaggcggctccctcccgctctcctccatcgacaagactgccgccgtccgcgtctccgtcgacttcatccaggtcttccccgcccctacatcggtgaaggacgactggagcccctcctccacgatcgcggctatgcgcgagggctttgccaaggcgctcgtgccgtactaccccgtcgccggccgcatcgccgagcccgttccgggggagcctgagattgagtgcacaggggaaag

SEQ ID NO: 4125 - DNA, 341 bp, Zea mays
  Clone ID: LIB143-024-Q1-E1-C5
ctcagacagaacaagggatcatcaagtgcagcaccagctaaggtaaccgcgaatcaggcaccctctactcagacagtgcctgctactccacctcaaacgtcagcagccccagatgcaccggcacctattgtacctgtcagtgcaccggctgcaactgctacagcctcagcagctcctgctgttgctgtctccactgaggcggatagttatggtcaggctacctcaaacctagttgctggcagcaacttggaaggaacaattaaatccattcttgaaatgggtggcgggacatgggatagagacactgtactacgttctctgcgggctgcgttcaacaatcc

SEQ ID NO: 4126 - DNA, 387 bp, Zea mays
  Clone ID: LIB143-024-Q1-E1-C6
cacacgcgtccggcacgcagtagtgcagcagcactgaagcactacttcctgcactcactgtgctagctgctcaaaccgtagtagtaacagtccatcaccatcaccatcaccaccaatggctcccaaggttgcgctcttccttgccctaagcctcctgttcgctgccaccgcgcatggctgcgaaccctactgttccggcccagtcgtcccaacaccaccagtcgtgccgactccgtcgtcgcatagccacgggcgctgcccgatcgacgcgctcaagctcaaggtgtgcgccaatgtgctgggcctcgtcaaggtcggcctaccgcaatacgagcaatgcctgcccaattgctggaggggctggtggaccttgacgccccattgtgc

SEQ ID NO: 4127 - DNA, 407 bp, Zea mays
  Clone ID: LIB143-024-Q1-E1-C7
gacaaagatggcgagcgtgcacaaggccaccacccttgttctcatgttctgcctgctagcgctggggagagcggagtacctcaagtacaaggacccgaagcagcccgtcgctgttcgcatcaaggacctgctgggtcggatgactctcgctgaaaagatcggccagatgacgcagatcgagagggaaaacgccacggccgacgcgctggccaaatacttcataggtagcgtgctgagcggcggaggcagcgtgcctgctcctcaggcgtctgctcaggcttgggccgccatggtgaccgagatgcagaagggcgctctttctacgcgtctgggtaaaccgattatctacggtatcgatgcagtgcatgggcacaacaacgttccacaagctactaatttccctcaaa

SEQ ID NO: 4128 - DNA, 397 bp, Zea mays
  Clone ID: LIB143-024-Q1-E1-C8
gaagcatttcggtcagtagatggattgtaggtaccaaaacgagttcgatttctgcataaggagacagcgaagtggcgattccacatcactatggagcataatgtttgctcggacagtagaactcaggaatagaggcaccgtttttggagtggggtggtatatgtgttgtatacagagatgagaggcgttagtttttgtgttgtcattgtcgctgtgcatccttattgttttaccccttgtccaaaaagggatgcattattatgttgagaggaacgttatagaggtttcgcaataaaatgcacctagccaattgatagtatgaatcagatatataatctaatttatgccataacaaatcactgcatgggcagaacaaggttaaaaaaaaaagggcggc

SEQ ID NO: 4129 - DNA, 377 bp, Zea mays
  Clone ID: LIB143-024-Q1-E1-C9
gcggtcaacatgcacgtagcttactgttgaagttgatattatctgtgctgtttgcgttgttgatgatggctgatgagatgattgatgatgatggcactgcagctgcctgcaccatttgctgtctgcacctattatgctgacaagtaagattccaatgatttatgcatcgccccatgcatctacatgctataggtgttaacccccattatagtatttggatttagatgtgtctgcactgatctatcatagtcctgttttgggtttttggatcataaggtctgcatgtgcacaattaatcgttgcatgcactggatgtgctgtcaattcatttctgcggtttgccaaacatgtcttatcgagaatgcataagcgcatgt

SEQ ID NO: 4130 - DNA, 418 bp, Zea mays
  Clone ID: LIB143-024-Q1-E1-D1
ggaggatttgatattagttcctttggtggtgttcaaggaggccaaacaatgcaaccaaaggttggctacatagcaatagatattctcacagatactgtagaagctgctgaacatcaatggaaatttcatctctggtgaagggatcgatgaggtggaggaaatcttgaaggctggtaagaaacccctgaaagtgctgggcccactagatgagaatgagcctgatggagagcctgatgatgacgatgaagaggttgaggataatgaggactagctgaattcgaagctgcagagtgtgaaggttgagcaagatgattgaccgagttggtatcgagatataagcctgtcgcaaggtcttgataactgagttatctacaatgctgttgatccttgggtttgtaatcggtttttgttatgaaaa

SEQ ID NO: 4131 - DNA, 417 bp, Zea mays
  Clone ID: LIB143-024-Q1-E1-D10
cactaaggtggtttatgatgagtacaatcatgaaagatatcctcctggagatcccagcaagcgtgcatttgcttactttgtcctgagtggtgggaggttcatatatgcatcactgctgcgtctcctcgtattgaagtttgtcctgagcatgtcagcaagtaaggacgtgcttgcccttgcttcactcgaggtggacctctccagcattgagccagggaccacggtgactgtgaagtggcgcggaaagccagtcttcatcaggcgccggacggaggacgacatcaagcttgccaacagtgtggatgtggcatccctgcgccacccagagcaggatgcagagcgtgtgaagaatcccgaatggctggtggtcattggcgtgtgcactcacctaggctgcatcccactaccgaacgcccg

SEQ ID NO: 4132 - DNA, 427 bp, Zea mays
  Clone ID: LIB143-024-Q1-E1-D11
gtccgaaggcacaacacctcttcttcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactgagccggtcaggcgatggcgcacgagagtcgagaggacgacgacgagtcgtataaatataatagcggcgtctaaataagatcctgtcaactgcacccgccattatcg

SEQ ID NO: 4133 - DNA, 363 bp, Zea mays
  Clone ID: LIB143-024-Q1-E1-D12
aacccgcattaggtgtgattgcaactgttgtattattctacccaaatatctgttaaaaaaatgtaaacaaaatgattgcaaccgatggtgtgttgtaattgcaactgctggtgtagtgtggatgcaactgctgagttgctctgatgtgattgcaacttctatataactatgtccaaaaatctgttaaacaaacaatgattgcaactgctggtctcgtgtaattgcaactgctggtctggtgtgattgtaacttctatataactatgtccaaaaatctgttaaacaaacaatgattgcaactgctgtctggtgtaattgcaactgctggtctggtatgattgcaacttctatataactatgtcc

SEQ ID NO: 4134 - DNA, 385 bp, Zea mays
  Clone ID: LIB143-024-Q1-E1-D2
aagaattccctcatagccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatgaagctccccttggctacagcattgaggacgttcgacctgccggaggcgcgaagaagttccagtctgctgcttactccaactgcgcaaagaagccat

SEQ ID NO: 4135 - DNA, 363 bp, Zea mays
  Clone ID: LIB143-024-Q1-E1-D3
actagttctagatcgcgatcgggatcggaggagaggtgccccgcgaccctgacgatgacgatgcctcgccgcgcccttctcttcgccgcggtgctcctcgcggcctccgccgccgcggtctccgggttccacctcgccggggacgagagcggcctcgtgaggggcgtgctcacagcggtccgcgagcgggccgaggccgaggccgaggacgccgcgcgcttcgccgtcgcctaccacaacaggaaccagggtgctgctttggagttcactagggtgctcaaatcgaagcggcaggttgtgaccgggaccctgcatgacctgatactggaggcagctgatgctggaaaaaagagtctgtacaga

SEQ ID NO: 4136 - DNA, 395 bp, Zea mays
  unsure at all n locations
  Clone ID: LIB143-024-Q1-E1-D4
gaagctgcaatctttttgcagcagccactaaacctgtaccaagtcttcttgcctgagggcagaggcaggctccgtcagtcacgccggcggcgtacagatcatggaggactttggcggctggaatatgcagtatgcagcagagctatgcctgccaagccgccgggacgacgacgacgacggcctcctcggtgacttcctangcggcggcggtttggacatccgttctgaccatggcggcctcaacctgccctcgtcgcaccctgctgtccagaaccttgtgccctgccacggcggcgtgagtctttccgtttccgacgccttcatgggcctggacacggcggatatgctcgctagcgtcaccggcgcactggactgcagcctcctcgacacgtttg

SEQ ID NO: 4137 - DNA, 325 bp, Zea mays
  unsure at all n locations
  Clone ID: LIB143-024-Q1-E1-D5
gaatttctagtttgaaggaattatgctgggctcttcatatgagatggttgtggctacataaaactgatccagcaggccttgggcaaacctccctatacaagttcctaaaaaggcaagatctttcttctccactgttttggtctcagaagtgggaaatggagcacgcactctgttctggacagataaatggctcttggctcctaggttattcgccatcattcctaaaaggattgctaatangagaactgtcctcgaggctctttccaacagaaaatggatatctgatataaaaggtgccttgtcggttggacctaaattggaaaac

SEQ ID NO: 4138 - DNA, 337 bp, Zea mays
  Clone ID: LIB143-024-Q1-E1-C11
caacgcgtcagcctctctccgcggctccgccttccgccgcgaacacgccgctgtctcgacgccttgtcctcctccttcagcaagatggcggagattgagataacaacagcacctgctgacttccgcttccctacaacaaaccagacaaggcattgttttactcgctatgtcgagtaccacacgtgtttgaatgccaaacgggatgatgctggtgtttgcgaaaaatttgccaagtactacaggtccctttgccctggagaatgggttgagaaatggaacgagcagagggagcatgggacgtttccaggacctctctgaaatgtacgcccgagacctc

SEQ ID NO: 4139 - DNA, 418 bp, Zea mays
  Clone ID: LIB143-003-Q1-E1-E12
gacccacgagtcaacttagagccaccaacccgggatgcagcccactacgcgggaaatgcaggccatggccgccgccggccagcacatctccctcgacgacctccgcgcggcagcaggcggcgtgcacgacgacttcctgcaccagatgcgcggaggcctgccgccgtctgcatggccggaactgtcgtccgcggcaggagggaaggcgccggatggcggcgcgcatgcggagcacatgcagcaccagccgcagcactttggtgggggtgcggtcctgtaccacgattccgccttgctggcctctcggctccggcagcaccaaatcagcggccgccgctgggaggccgtgaagcagatggtgctgcagcagcgggcctatcagaggcacgaacaccatgtgttgcttcagggcaagggg

SEQ ID NO: 4140 - DNA, 332 bp, Zea mays
  Clone ID: LIB143-003-Q1-E1-E5
acgcgtcgacaacaggctgttccaattaggcctgaagaaatacggcaagggggactggaggaacatatcgcgcaactacgtccagacgcggacgcccacgcaggtggccagccacgcgcagaagtacttcatcaggctcaactccggcggcaaggacaagaggaggtccagcatccacgacatcaccacggtgaacctgacggacgacgagcgggcgccctcgccgtcgcggtcctctctgatcaccaccaccaccagccatccaaacgcgccggctccggccgcagtggtgatacgcggtcccttctcgtcctcgtcggcggcggtggccg

SEQ ID NO: 4141 - DNA, 313 bp, Zea mays
  Clone ID: LIB143-003-Q1-E1-E6
actagatcgcgagcggccgcctttttttttttttttttagtacgatcgaacttgtcctcgtcacttgataaaaccatttacacaaaaccatatcttacagagaccaggaaccaaaatcgagaaatatcacggaacaaaaaagcagaatccttcttgcgagccgcagctatttgcagcaagacttcccattcccactaacggctgcccctgcccctgccaatcatgtcgttgtagtgcttgagcgactcctgccgctgcagccgcatctccatgttgaacttgtggatgaacgcctccacgcggcggttcagct

SEQ ID NO: 4142 - DNA, 316 bp, Zea mays
  Clone ID: LIB143-003-Q1-E1-E7
acatcccccttgcaagtatagtctcggcggctctagaagacgatgggcaaggacgacgtgatcgagagcggcgctggcggcggcgagttcgctgccaaggactacacggaccctcccccggcgccgctgatcgacgcggctgagctggggtcctggtcgctgtaccgcgccgtgatcgccgagttcatcgccacgctgctgttcctgtacatcacggtggccaccgtgatcgggtacaagcaccagacggacgcgtcggcgtcgggtgccgacgcggcgtgcggcggcgtgggggtgctgggcatcgcctgggcct

SEQ ID NO: 4143 - DNA, 169 bp, Zea mays
  Clone ID: LIB143-003-Q1-E1-E8
acagcctcgctccccgcctggtcttcgctgctctgttgttcggtctgtttttgccacctgttcgctagcggttctcgcggccctgcgttgtccgtctctgggtacgctgtgtcgccgccggcgctgtgctctggctcctctcgttggtggtccaggtgctgctggtgct

SEQ ID NO: 4144 - DNA, 371 bp, Zea mays
  Clone ID: LIB143-003-Q1-E1-E9
gcaatccactgagttctgtttgttgagacgcatagagctagctgctagcgtcgacaatgtcgctcgtgaggcgcagcaacgtgttcgaccccttctcgatggacctctgggatcccttcgacaccatgttccgctccatcgtcccgtcggcgacctccaccaactccgagactgccgccttcgccagcgcccgcatcgactggaaggagacgcccgaggcgcacgtcttcaaggccgacctccccggcgtcaagaaggaggaggtcaaggtcgaggtcgaagacggcaacgtgctggtcatcagcggccagcgcagcagggagaaggaggacaaggacgacaagtggcaccgcgtcgagcgcagcagtggc

SEQ ID NO: 4145 - DNA, 324 bp, Zea mays
  Clone ID: LIB143-003-Q1-E1-F1
ctcctctcctctcgccggcgcatcgcccgactgtcagtcagcctcagccatggccgcggaggaggagcagggcttccgcccgctggacgagtcgtccctgctcgcctacatcaaggccacgccggcgctcgcctcccgcctcggcggcggtggcagtctagactccatcgagatcaaggaggtcggcgacggcaacctcaacttcgtctacatcgtgcagtccgaggccggcgccatcgtcgtcaagcaggcgctcccgtacgtgcgctgcgtgggggattcgtggcccatgacgcgggagcgcgcctacttcgaggcctccac

SEQ ID NO: 4146 - DNA, 412 bp, Zea mays
  unsure at all n locations
  Clone ID: LIB143-003-Q1-E1-F10
agctccgccgcccggcgcgaccttgcatccaccagcctgccctctccttcgcgtgaggcggccccggcgaccgcgtcggcagtgcaagaccagaccgaggcttctcccgttggaaggttccagccatggcgagcgccgatctgctgcggaaggaggaggagttctactcctccctctttgattccgcaaaaggcgacggcgtcaagtcgcgctcgcaggtgattgagaggaagattgaatccctcgaggacatggccaccaacgtcagcaaccggagatcaagaagatggttgaacgaccgcttgctgattgagcttgtcncacgccttcatgttgaagaaatcaaaggcctctttgctcctccaccatggggtgaggagctgcccttgtcagcattctgcaggacaagtgt

SEQ ID NO: 4147 - DNA, 129 bp, Zea mays
  Clone ID: LIB143-003-Q1-E1-F11
attcccggtcagacccacgaatcaaggctgatgcccggagcgaacttgaatccatcacactgcgctcaccttcatatgatgcaacatccgcgaatgcatctgtattgcaaaaatagacaaatgcttcgc

SEQ ID NO: 4148 - DNA, 340 bp, Zea mays
  Clone ID: LIB143-003-Q1-E1-F2
ccgggccgatcacgcgtcggcctatctctgaaactactgctatttttgcaggtgttgatgtcaccaacgagcccattcgagttttgcctactgtgcactacaatatgggcggtattccaacaaactaccatggggaggtactggatatcaacggtgataatccagatgctgttgttcctgatctaatggctgctggtgaagcagcctgtgcatctgttcatggtgcgaatatgctacgctcaaattcgcttcttgacatacttgtttttggcagagcttgtgcaaacagggtagcaaatatttctaaaccacgtgagaagcagaaacctctggaaaaaga

SEQ ID NO: 4149 - DNA, 326 bp, Zea mays
  Clone ID: LIB143-003-Q1-E1-F3
ggccctagtcctctgtaacttctccctccgccgccactcccctcccattcaccgccaccgccaattccataccgtcctccgccacctctgctgagagcgagaagagatggcaggcaagggtgatgggccggcaatcggcatcgatctcggcacgacgtactcttgcgtcggcgtctggcagcacgaccgtgtcgagatcatcgccaacgaccagggtaaccgcaccacaccctcgtacgtcgccttcaccgactccgagcgcctcatcggagatgcggccaataaccaggtcgccatgaaccccatcaacaccgtctttgatgcca

SEQ ID NO: 4150 - DNA, 327 bp, Zea mays
  Clone ID: LIB143-003-Q1-E1-F4
gaacgttatgtcagaaggtgcatatatgcttttctacatgaggtctttcccccgaccaccaagaatatacatcgagaaggggccgactgttccatccgcgaagcgccacacatcaaagtattccaagggctctaaacacgagcgcgagcagacagagttactcctctcggcgaacgatccagcatacggtgtttatgactttagacccgatggcgagggctacacgcaagatcagcaagcagagttgagatccagggaattccatcgcgccgacgatgccttcgcagactcggttagcgcggacttctcggaggccacgtcaagcga

SEQ ID NO: 4151 - DNA, 312 bp, Zea mays
  Clone ID: LIB143-003-Q1-E1-F5
acccacgcgtccgcccacgcgtccgcccacgcgtccgtgaagaacaaggttttctccattgatctcgtttcagatgaaccttcagtgattgcttgtgatatggctcatactccattggagccatcctctatagatgttgcaatattttgtctttctttgatgggaatcaactatccaagttatttagaggaagcaaatagggttctcaaaccaagtggttggcttgttattgctgaagtgcgaagtaggctagacccgagcaacggaggtgctgatcctgaaaagttttctaaagccattatccagcttggc

SEQ ID NO: 4152 - DNA, 314 bp, Zea mays
  Clone ID: LIB143-003-Q1-E1-F6
accacgcgtccgcccaagcacgtccggttcctccccgcgtcaagctcggcatccagggattcgaggtgtccaagctggggttcgggtgcatggggctgacgggcgcgtacaactccccgctggacgacgaggccggcatcgccgtcatcgcgcacgctttcagccgcggagtcaccttgttcgacacctccgacgtatacgggcccctcaccaacgaaatcctcctcggcaaggcgctgaagcagctgccgcgggagcaggtgcaggtggccaccaagttcgggatacggcatgacgagagcggcacgcggacc

SEQ ID NO: 4153 - DNA, 316 bp, Zea mays
  Clone ID: LIB143-003-Q1-E1-F7
acgccactccccaaccgtcccatgacgcaggctcagcactagcagccatgccgcacctcgtcctgcttctcttcctcggcctcggcgggctcctgcccgcggcgtcggccgccgacgagcagttcgtgttcgacggcttcaagggcgcgaacctcagcctcgacgggatggccacggtcacgccggacgggctgctcatgctcaccaacggcaccagccagctcaagggccacgccttctacccggcgccgctgcggttccacggggcgcccgacggcacggcggcagcgatggagtccttctccacggccttcgt

SEQ ID NO: 4154 - DNA, 247 bp, Zea mays
  Clone ID: LIB143-003-Q1-E1-F8
atcccctccacgctccctttcccttcctctacctcccctaccccgccgccccgcaatggccggcctcctccacctccagtccacgcttctaccctcggcatccgctctccgccgccgcgcgggcgcgccggtgccctgttcgtcccgccgccgatgccgggtcaaggcaagattcgggagattttcatgccggcgctcaactccaccatgaccgaaggcaagattggtccctggaacgccgcccaag

SEQ ID NO: 4155 - DNA, 328 bp, Zea mays
  Clone ID: LIB143-003-Q1-E1-G1
ggcccacgcgtccgcccacgcgtccgcccgtttcgagccagggcatcctcgcgtctcgctctcacccctcctcggcgcctccccgaccacagtgtaaagcccctgtcccttcctcccccccgactcgcccctcatggcgaggaggcgctgctgatgcctcgcggcgtcggatcggacgcggcggccacgacacctagccgcttgcggtggcgctcgcctacgcgcccaatccgccgacgctgctcctcggaccccccgagagattcaggccccgtctcgcctcgtcctgcctagtgcctaggtgaggctctggccttcaaaggtgcgt

SEQ ID NO: 4156 - DNA, 400 bp, Zea mays
  Clone ID: LIB143-003-Q1-E1-G10
ctactactcaagtatccatccttattgagtacagtgttgatccatggactcggaaggagttgtagcagcaaaggtggcagatgagactactaaaccggcaatccaagaagacggcgccgagagcaaggccgggatgactgatctgctgatgctgaccgacaagtcgcagctgcaggcgctggcgatgctgctgcggaacaacgaggagctcatgatgagccaggcgatcaagtcggagacggagcgcattgagtacctcaagacggtgagcgactgctacacgcggacgatgaagctcctcgacgattccatggcggccaggaccacgtacgagcgttcgggcggaatgaggagcctcgtcgcccgggacatggacgactacgtcgtctacggcctcaac

SEQ ID NO: 4157 - DNA, 391 bp, Zea mays
  Clone ID: LIB143-003-Q1-E1-E11
cccacgactcagggacagccactgcaactcctcccaaatcctcccacccggtttagccggctccgctgccaccgccgcgactccacctctgtcgccaccatggtcaagtccaaggccatcagggtccacgagctgggcggccccgaggtgctgcggtgggaggaggtggaggtcggggagcccggtgaaggggagatccgcatcaggaccaccgccgtcggcgtcaacttcatcgacatctactttcggaagggggtctacgccgcgcccaccatgcccttcaccccaggaatggaagccgttggcgtcgtcaccgctgttgggcctggcctcactggcaggaaggtgggcgatgttgttgcatatgccggcaaccccatgggctcctatg

SEQ ID NO: 4158 - DNA, 409 bp, Zea mays
  Clone ID: LIB143-003-Q1-E1-G11
agacagacggtggccggacaggtttcttcaactcgatcaccctgaagcccggcgacttctgtggcgaggagctcctcggatgggcgctcgtccccaagcccaccgtcaacctgccactgtccacccggacggtgaaggcggttctcgaggtcgaggcgttcgctctccaggccgacgacctgaggttcgtcgccagccagttcaggcgcctccacagtaggaagctgcagcacacgttccggtactactcccaccactggaggacctgggccgcgtgcttcatccagcacgcctggcgccgcctgaggaggaggaagatggccaaggacctgagtctgagggagtcgttctcgtccacgggaccgtacgaaggcgatggcgacgacgcctcctcccctgaacagagtat

SEQ ID NO: 4159 - DNA, 359 bp, Zea mays
  unsure at all n locations
  Clone ID: LIB143-003-Q1-E1-B9
gacccacacgtcaaccgcnngctatcagcttctgaacccgtcatcaggaccaacgctctcccttcgaaatgcgaacctgcgccatagcgacatctgctgcagtcacgatgtgacgagcagagataccgtggatgaagacttcagggacttcgaggctgcgtggtgatatcatgtatcttgttcatacatcatgttatcgagagtttgtttttctttctactgtcggtattcaatcaactgtggcttctgctggcactctgttcctgttaagatagcttccatctcaaaacctacatacaaatttatagacaattgttgtacctttttttagtattaaatttatttatataataaattta

SEQ ID NO: 4160 - DNA, 337 bp, Zea mays
  Clone ID: LIB143-003-Q1-E1-C1
cacgcgtcgaccaaggtcgcctccaacgtcgtcgccagcgcgcagcccgtggagggcgacggcggcgttggcagcgtcaggcagttcaacttcacctcagtcatgccgttcagcttcatgaaggagcgtctcgagttcctcgacgcggacaagtgcgagtgcaagaacacgctcatcgagggaggcggcatcggcgtcgccatcgaaacggcgacgtcgcacatcaaggtggagcccgcggccggcggcgggagcgtggtgaaggtcgaatccacttacaagctgctgccgggcgtggaggtgaaggacgagatcgccaaggccaaggagtccgtca

SEQ ID NO: 4161 - DNA, 414 bp, Zea mays
  Clone ID: LIB143-003-Q1-E1-C10
agtcacgccaatcagcaccagccaccgtggcgatgacggaggaggcggaggcgaaggcgaagggcaacgcggcgttcgcggccggccgtttcgaggaggctgtccagcacttcagcgacgccatcgcgctcgcgcccgacaaccacgtcctctactccaaccgctcggcggcgtacgcgtcgctctggcgctacgcggaggcgctagatgacgccaagcggaccgtggcgctgaagccggactgggccaagggctactcccgcctcggcgccgcgcaccttggcctcggtgacgcgcccaaggccgtcgaggcctacgagaaagggcttgcgctcgagccgtccaatgaggcgctcaaatccggcctcgcacaggcgcgccagtccgcatcggcgccgagacgtccggtgggct

SEQ ID NO: 4162 - DNA, 355 bp, Zea mays
  Clone ID: LIB143-003-Q1-E1-C12
cgccggccgccccctaatcccgccggccctgtgtgtgttccgcgctaccagccatggcgtcgccgttctccgtgccttcgctgatcatggaggaggaagggcggttcgaggcggaggtggcggaggtggagtcctggtggggcacggagcggttccggctcaccaagcgcccctacaccgcccgcgacgtggtcctcctccggggcacgctccggcagagctacgcgtcgggggagatggccaagaagctgtggcgcacgctcaacgcgcgcatgtcgctgccccgcgccgagcgcacgcgggcgccgtacgtcgagctcctcaagcccagcatcgccgatcgcgatcacggctt

SEQ ID NO: 4163 - DNA, 323 bp, Zea mays
  Clone ID: LIB143-003-Q1-E1-C3
gcacactcctcctggggaccaacccggtgcacaagagcgtgccggtgcttctccacgccgggcgcgccataaacgagtcccaggtcatcctgcagtacatcgacgaggtgtgggcggggacggggccggacgtgctgccggccgacccctactagcgcgcggtggcgcggttctggggcgcgtacatcgacgacaaggtggagtcagcgtggctggggatgctgttcaggtgcgcgaacgatgaggagagggcggcggctgtggcgcgcgcccgcgaggcgctcgacgcgctggaaggcgcgttccgggactgctccagcggg

SEQ ID NO: 4164 - DNA, 327 bp, Zea mays
  Clone ID: LIB143-003-Q1-E1-C4
gaaagcaacaaggcagcagcacaagcaagaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgaggcggccaccgagggcggcggctgcgactgcaacacctgcaagtgcggcaccagctgcggctgctcctgctgcagctgcaactgagctggcccggcccggcg

SEQ ID NO: 4165 - DNA, 317 bp, Zea mays
  Clone ID: LIB143-003-Q1-E1-C5
aggaagcccgcagtaaatttgatgtggaaacagagccgcctaatgcagttgagattgaaccagcgaacggttttctaaactcggaagggctggcatcactgaagttcagaaggatatcatcatccttgtcaatgggaaggataaactgcaaggtttactactgtaaagaagatgaagtttgtctctaccaatcgattgcttttgatgtcaaattccgtgaagaggcggaaccgaacccagcacaaattacgctatcctatactgtttcgccaagagataattcaggtagcacacaactactggctgctaaaaagaat

SEQ ID NO: 4166 - DNA, 313 bp, Zea mays
  Clone ID: LIB143-003-Q1-E1-C6
acgacggcgatgccgcctccgtcgatcctgtccgtctcgtgccggatttaatattagatctatatgcgtgtttttctgcgttattactacatctacatgtgtctgtctgtggtgtgtctctctgacggccccatgcgtcagcgtcactgcttgcttcagttctgcatctcactctgttgaggtgaaaaactgataacatctttgcagtgctagaaaacctgagaacctcatgatatctaagtaactgagccaagagagagagagagagagagagtatctaagtaccttgatccacttggacagcacagttaga

SEQ ID NO: 4167 - DNA, 286 bp, Zea mays
  Clone ID: LIB143-003-Q1-E1-C7
actgaacatccgtgaagctcatgtcttctcaacgactgatggcttttgtttggatgtatttgttgttgatgactgggatacaaaggaaacagatactttgctacagattctcaaggagacagcggcacgaaatcatgcctcattatcaaacccaaccaattctgcagcctcagaaagagtactggaactacaagagaagattggtgattcaaatattgacaggaatttcattgatattatatatggattagctggttcatatttttaatgctacaatgttattgct

SEQ ID NO: 4168 - DNA, 313 bp, Zea mays
  Clone ID: LIB143-003-Q1-E1-C8
acttgatgtttcttcttgtgaggatggtgatgttaacacagggggaactggtggttctaagaacaagcttttcctggatatgcaagcattaaaagccaaaatatcaggtctggcctcgaatctctctgctgaggctggggggaaaggtgcagataagaagaaccttactgaccaaagagacttgtttcaacgaatcttagattttgtcaagtatggtgactgccctgaagaatcaatcaagattgctggaaaacgtgatgttttaagggtgtcatcgtggtctgaattaatccagttgaatttcttaaagcgg

SEQ ID NO: 4169 - DNA, 204 bp, Zea mays
  Clone ID: LIB143-003-Q1-E1-C9
aattgttaaaattggtcaagatcggatcggaaagaagagggcacaaggatgttggtttccttagagaggtcgacgaagtagtgagaacaggattgacgcctgcggagaggctgctgaacctgtacgagaccaagtggtaacgcaacgtcgaccatgttttcgagcatttgttatactgattactgacgatgacgccgccgaatc

SEQ ID NO: 4170 - DNA, 407 bp, Zea mays
  Clone ID: LIB143-003-Q1-E1-D10
cgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcacctccgacgacgtgggcctcgacgccgaccgctgcaaggtgctggtgaacatcgagcagcagtcccccgacatcgcgcagggcgtgcac

SEQ ID NO: 4171 - DNA, 363 bp, Zea mays
  Clone ID: LIB143-003-Q1-E1-D11
aaataacacacaacagcatctcaaaaatctaacacactgcaacaagcagagcaaagacccgggattcgccggcgcggtagcgagagcgagagatggacgggaggatgttcggtctcgagacccccctgatggtggcgctgcagcaccttctggacgtgcccgacggcgacgccggcgcgggcggcgacaaggcgagtggtgccgcggcgggcggcgggcccacgcgcacctacgtccgcgacgcgcgcgccatggcggccaccccggccgacgtcaaggagctcccgggcgcgtacgcgttcgtggtggacatgccggggctgggcacgggcgacatcaaggtgcaggtggaggacgagcggg

SEQ ID NO: 4172 - DNA, 330 bp, Zea mays
  Clone ID: LIB143-003-Q1-E1-D2
acgcgtcgacagacgcgtgggttaaagcatgtgcgggcggatgggctcacgcgtgtgtccacgaacggtcagatggagcgtgggtacgtcgacgactacgtcgacgtctacatggtccggaacgtgtacgtcgagttccgcagcgtcgagctcggcgaccgcgccctgtaggagctgctcggccgcgtctacgcggggttacgcatcgacgaccatgtcgcgcccgtgatggacgtcctggagggcagctactactcgtgccaagacctcagctgcgacttctggcgggtctgcgacttcatggacgtcacgtgcgtccgcttcgacgtg

SEQ ID NO: 4173 - DNA, 318 bp, Zea mays
  Clone ID: LIB143-003-Q1-E1-D5
aatcaggaggtgaggaggaacaggaaaggcgtgctgcaggtgcaggacggctctgagatccgggctctcgtggagaacaaggcggagttcgctaggttcgtcgacgacaggttccggaagctcgacgccgatggcgacgggaagctgtcggtgaaagagctccagccggccgtcgctgacatcggtgccgccatcgggctgccggccagaaggtcgtcgccgcaagcggaccacatctacgcggaggtcctaaacgagttcactcgcgggaagcaagagtccgtgggcaaggccgagttccagcgcgtgctgtccgac

SEQ ID NO: 4174 - DNA, 306 bp, Zea mays
  Clone ID: LIB143-003-Q1-E1-D7
ctaatgttgagagatatttcacacccaagatcggcattcgaagtgcaaagttgaaattacatgtgtgcttttgaaacttaaagggcaaatacacaaaccgacacttatctacatggttttccacccatcacagtgcatcttgcttatctacttaaacgcactcgtttggtctcaaataatactgccacagcatgcagggaccatctctttgtttctttgatgtctcatggcacaattattgggctgcttagttgctatattctaaaaaagaatctttttttttttggtgtagtaggaatgtaggat

SEQ ID NO: 4175 - DNA, 382 bp, Zea mays
  Clone ID: LIB143-003-Q1-E1-D9
cccttctctccctctcatgccgctggttgatctctcgtcatctcctcctccaagcacggatcctctcgtcgtctcctccaagcacggatcaggaacactgaaattctatctcaaccggttctgccgactgggtaacttgaattcgaaagatgaggcatggtttggaagtcttccaagaagcagtcgtacccatgctgatatgaacagagatgaattggaactttgttgctgcagccttaagcaagagtggtaatacttttgacacaacaaggtctatggtactcatatctgaatcagagaaagctaacctaaatgattaggcaaggaggctcctttctaagcctatcaagtttttcaatgagatgcaagaattgtttattga

SEQ ID NO: 4176 - DNA, 351 bp, Zea mays
  Clone ID: LIB143-003-Q1-E1-E1
tcgcgggccgaaccacgcgtcgaccacaggctgttccacttaggcctgaagaaatacggcaagggggactggaggaacatatcgcgcaactacgtccagacgcggacgcccacgcaggtggccagccacgcgcagaagtacttcatcaggctcaactccggcggcaaggacaagaggaggtccagcatccacgacatcaccacggtgaacctgacggacgacgagcgggcgccctcgccgtcgcggtcctctctgatcaccaccaccaccagccagccaaacgcgccggctccggccgcagtggtgataggcggccccttctcgtcgtcgtcggcggcggcggccgaggcc

SEQ ID NO: 4177 - DNA, 123 bp, Zea mays
  Clone ID: LIB143-003-Q1-E1-E10
ggccgacccacgagtcaacttgtcctcaacagccgttagggcgtccacattgtagaagcctcctgggtgtgacaagaatacgttcccattggtttcagtccgggagggatatcgactaacatt

SEQ ID NO: 4178 - DNA, 314 bp, Zea mays
  Clone ID: LIB143-003-Q1-E1-B8
agccggaggctcctgctcctgctggtccccaggagccggccgccgaggcggaggaggttgctgctcctgaggagcccgagaaggccagcgagtgaggccgtgcgcacgcagcggcggcggccagggcccaggggatcggcgtgcgcgcgtggcggggtagtcgctcgcgcgcgtacatggcagtatgacacgggattttgctgttcagtacgctacggttattactggcgtctctctctgtgtgtgtgtgtgtctcgtacgtagcccggtacgtagctagcagtgactgtcgcgtggacgtgtccggtgcgggc

SEQ ID NO: 4179 - DNA, 413 bp, Zea mays
  Clone ID: LIB143-002-Q1-E1-H6
ctcttttccccaaggcaaccaaaccatctcgattctcgactcgtggggaagtttcgctctcgccggcgtcgacggcctagggttcgaggaacgtccgtccgtccgtccggggaaggagcggtagggaggcggagatgatcgaggtggtgctcaacgaccgcctggggaagaaggtgcgggtcaagtgcaacgaggacgacaccatcggcgacctcaagaagctggtggcggcgcagacggggacgcgccccgagaagatccgcatccagaagtggtacaacatctacaaggaccacatcaccctcaaggactacgaggtccacgacggcatgggcctcgagctctactacaactgagccgccgcccctctctccctctcgtcaggttggtctgaattctgaagtcatgggtgc

SEQ ID NO: 4180 - DNA, 380 bp, Zea mays
  Clone ID: LIB143-002-Q1-E1-H7
gtcgaccttcagagctgcgacgttacgggggaatctggatcttggcggactggacaattgggaggcgtcgacgggcttctaaagcgtggctggacaattgtgagatgtgacatcttgaaagcctttgccatgtcaggtgcgctcgcatggcaggcatcataataaagatgttggttttgtgtgctgggtgggagatcgcacagggaattgtttttttatccctgggttctcccgccctttgtgtcgccgtgccctgcttcgtgttgtttggcttcacgttctacgcttcatcaccggtgctgcttcaaattgaacggatcttctcgtctcgcggcgtgctgcaaattgaacggggctacatcgcaacgcagcacaggacg

SEQ ID NO: 4181 - DNA, 371 bp, Zea mays
  Clone ID: LIB143-002-Q1-E1-H9
cttgtgatgcacgctggatctctgccgccgcagcgttcaagttcgcgccgtcgcacgacgtgacggaggtgagcaaggccggctacgacgcctgctccggcagcaaccccgtgaagtcctacaccggcggcagcgcctccgtgaagctgtcggccccagggaagcgctacttcatctgcagcgtgcccggccactgcgccgcgggtatgaagctggaggtcaccgtcgccgccgccgcggtcaccgccgcgccggcccccgccaagacgaccaagccccggcaccagaggagcgtctccccgaccccggcccctgccgcggctccggctgcgccgtccaccgacgaaatgcccaacgtgtcctcccccaac

SEQ ID NO: 4182 - DNA, 56 bp, Zea mays
  Clone ID: LIB143-003-Q1-E1-A1
cacgcgtctgacacgctgccatgcaaggacgtcctggcctaattagtcatagcacc

SEQ ID NO: 4183 - DNA, 392 bp, Zea mays
  Clone ID: LIB143-003-Q1-E1-A10
acgcttttgctccctcgctcgcggctctcggcttcatctacacgctatggtctcacagccgtatacgctgctcgcggatcccgctatttctccaacgctgctcgaccgccagccgttcgcctcatcatggcagcgtcgtcgacggcctgctcggtcgacgacgtcagcgtcaaggatgcgagctgcacaaacgttgacctcaccacctattccgggaacgttcttctcattgctaatgtcgcatcgcactgtggcgtacctaactcgatgctacactgagctggcccagctctactagaagtacacggaccacggcttttagatcctgtctttcccatgcaactagtttggtgcgcaggagcctgctacgaatgaagagattgtccattttg

SEQ ID NO: 4184 - DNA, 415 bp, Zea mays
  unsure at all n locations
  Clone ID: LIB143-003-Q1-E1-A12
acccacgcgtccacccacgcgtccgcggatgcgtgggccgcgaccacccggcctgcgtcgcgcagccagacctcgccgccgccgccgccgcgtcctgccgcctcgcgctcgccctcaagggcctcccgcccgtcttccacgaactggagtgggacctcgtcatggtcgacgcgcccacggggtggacgccgcaggcgcccggacggatggccgccatctacaccgccggcatggcggcgcgcgcgcgcaggcccggggacggacccaccgacgtcttcgtgcacgacgtcgatcgacccgtcgaggacaacttctccaaggcgttcctgtgcgagggatacctcgccgagcaagtcggccggatcaggcacttcgtcatcccgtcncaccgctagaatgaccgcacaccattctg

SEQ ID NO: 4185 - DNA, 320 bp, Zea mays
  Clone ID: LIB143-003-Q1-E1-A2
gaaaatgcgtcagatgcaaacgctgatggtttccttgataaaactgagttcaatgatttccttaatccaagtgattcggataatcgcaaaatcaacagtttgctctgcatacgagagataatgcacagggatcaagatggtgatggaaagttaatctttgacgaatactttactgggctacatgaccatagacatggttatggtgacgagaatgcagatatttcgcagattgggaagataagagttgcgacggatcggttttacaaacgtgagatagataatgatgggtttagttcggagcatgaactacagcctgttct

SEQ ID NO: 4186 - DNA, 315 bp, Zea mays
  Clone ID: LIB143-003-Q1-E1-A5
tcgagacattcgtcacctcagggaagctggcatgtcaaccttcattctcactgctgaacttgctgctgctccttcagcagttggacgatgaggacaaactgcaacaagtgtcaaatgctctctcagagttcattcggaaagccacggtggtttgcggagaatgagaaatgttggagcggcgtgtaggatcaccgaatgcatagtacggctccatacttctgctctgtttctgcctgtaactcaactgtgaaaagttttaaactttcagaaagaaaaaccgtgagaggtgcaggttcaagttaatatgaataataa

SEQ ID NO: 4187 - DNA, 249 bp, Zea mays
  Clone ID: LIB143-003-Q1-E1-A6
aggtaaacccgatcttgattccaacatcatcagcgcattcattaaagtgacgttccatactaatgctccgcacacgcctgccaaatatgaaacaggtgtatctacggtcttcagtgtcatgcgtatcttctcggagaccaatgatgctgctaatgcatacggtcatgagcataaggattaaccgcttgcgatgaatatgtgctcaacgtcgacggtggccgtagcacagtatgagatgtctctccgcac

SEQ ID NO: 4188 - DNA, 79 bp, Zea mays
  Clone ID: LIB143-003-Q1-E1-A8
agactttctcacagtcgccgccgctgtacattgtccactgcgctctgttcaacgactttgacacatcgacgggaaacgg

SEQ ID NO: 4189 - DNA, 357 bp, Zea mays
  Clone ID: LIB143-003-Q1-E1-A9
cgtcagctttcggtgcgaggagtttgttcaactgcacccttagcgcgatccattgccggggacggtgcaacttgttgcgagcctcctctaaggcgagcgtccgaccatggttccaccaccgtccccaacgacgtgccgggcagctactgcctgccgctggcgggcgccgtgcgcgaccgcctcgacttctactacttccaggggcatgacacgtacttcgagtcccgcctggtgcgcttccgctccaccgtggtgcgcatttccgttccgccgggccccttcgtggcgcgcgacccgcgggtggtggcggtcctgtacgcctagagcttccccgtgcgcttcgacatggtcaatgtg

SEQ ID NO: 4190 - DNA, 296 bp, Zea mays
  Clone ID: LIB143-003-Q1-E1-B1
ggaccacgcgtccgccaacgcgtccgcccacgcgtccgcccacgcgtccgggctcgcgccctcctccagcagccagcagtcgctcccggcgcaggtggcgcgcacgcagaaggtcgccgacaaggtcgcgctgtgcctgcccagcgacggcaggtccacgtcgggcgacagcgtcggcgtggccatcttcggcggcggcccgctgttcttcgtccccccggaccgcggcgacttcaccacgatgctggccggcactgcgccgctccacgccggagccggagccggtgcccccgggt

SEQ ID NO: 4191 - DNA, 390 bp, Zea mays
  unsure at all n locations
  Clone ID: LIB143-003-Q1-E1-B11
ccacacgtcaggtttgacccgtgctcggattattacgtgaacgcgtaccncaacgacccggacgtgcagagggcgctccacgccaacgtcacccgcctcgaccacccctggtccgcctgcagcgatgtcttgagacgctggactgacagcgccacgaccgtcctgcctattctcacggagctcctcaacaacgacatcagggtctgggtgtacagtggagacaccgatgggagagtgccggtcacttccagcaggtactccgtgaaccagctccagctcccagttgccgcaaaatggagggcatggttcagcnagcactcaggcgccggagaagtgggcggctacgtcgtgcagtacaaaggcaaggagaaaggcancttcacctggtca

SEQ ID NO: 4192 - DNA, 407 bp, Zea mays
  Clone ID: LIB143-003-Q1-E1-B12
aagttgacatctcaccaggaagaaagagatgcagtttttgccaagatagaagtttctcaggttcatttggaactgttgaagcgtactaatgttctcaatgatgcattctatatatcacatgatggagtaatcggaacaataaataactttcgcctaggacgtctttctaatgtagaggttgagtgggatgagataaatgctgcatggggtcaggctgcactgctgttgcataccatggctcagtatttcaccccaaaattccaataccggatcaagattcaccctatgggaagctatccaagagtcacagacatccagaataacacatatgaactgtttggtcccgtgaatttgttctggagcacccgatttgacaaagccatgacatggtttcttacttgcctgca

SEQ ID NO: 4193 - DNA, 328 bp, Zea mays
  Clone ID: LIB143-003-Q1-E1-B2
gaaccgaagacatcaaccaatgcttcagataattcaagcactagcagcggccaatcagggagcaatgtgaacaagaaagaacagtctgcactgcgagctgtcatcaagtgtgttgaggatcgtgaactagaagctgagtttccactggagggtcttcggaagcaacttgaagaactagagaaagccaagaccgagaagaagaaggcagcatcaagcgctaccagtggcagcagcggcggccctgcaaccaagcgcatccgtgcgagcactggaggcccaatgcctcctgccaaagcacgtcgtctcactaacaatgcttgcgtgtctt

SEQ ID NO: 4194 - DNA, 118 bp, Zea mays
  Clone ID: LIB143-003-Q1-E1-B3
acgcgtcggacaattgtttaacatgaaagagcacatttgacagatacatctcagtatgtggaccatacagcttattgtgtagcgaagtacgactgtactggatgaagtgacgcagggt

SEQ ID NO: 4195 - DNA, 326 bp, Zea mays
  Clone ID: LIB143-003-Q1-E1-B4
ggccgacgcgtgggcgaacacgtgggcacagacagcagccacagcggagcttaattagcaatcattgactatgggtgcgctcttgccatggctggcatggttgctcgtctccctcgtcggcgtctacctcctcggccatctcgtgcaggcccgtcgtcgtcgtggtctaccgccgggaccccacccgctgcccatcatcggcagcctccacctgctcggtaaccaaccgcaccgctccctcgccaggctcgccatgactcacggcccgctcgtgtcgctccgcctgggctcggtgaccacggtggtcgcctcctctccggccgccg

SEQ ID NO: 4196 - DNA, 315 bp, Zea mays
  Clone ID: LIB143-003-Q1-E1-B5
agatccaccacaacagcgaaggagaaagcagaccaacctagccacccagggagaaagaggccaaaagggaggggagagtgtcgtcatggcttccattgtcgcttccaggagggccgttcctctagttcgcgctctggagaagctcatcgcagcgtcctccgctcccgggactggctccgccctcaggccggtggcagtcgccggcggcctccgcggctacaacaccggcgctccgctccgacgctacgagggggccgagtcggaagacgatagcgtccgcgagtacgatgggcggcacggcggccgggactacgc

SEQ ID NO: 4197 - DNA, 111 bp, Zea mays
  Clone ID: LIB143-003-Q1-E1-B6
agatccaccatgggaacgatggcgaaatcacgtcactactatccaccgacggacaaagtggccagaagggatgggacactgtcctcgattccctccagttgtcccattcca

SEQ ID NO: 4198 - DNA, 388 bp, Zea mays
  Clone ID: LIB143-002-Q1-E1-H5
atttagcttcctcctcctcacctactagcaggcacagcaggcagcagcatcgatcggatcggagcagcacagcgcgcgtcaccgcaagctcaagtgtcttcttccttgcttgcttgcctgctgcttacctctcagttccccactcacgtcccttgccgtacgtacgtgcgtccaacacaccaggtgaaaatgggctcggagacggagacggtcaacgtggaaggcatcccgttcccggcggagatcaccgtcggcaaccctctctccctcctaggcacaggtatcacggacatcgagatccacttcctgcagatcaagtacaacgccatcggagtctacctccacaacgccggcggcggcgacagcaccacgcccacgctgctgggcc

SEQ ID NO: 4199 - DNA, 207 bp, Zea mays
  Clone ID: LIB143-024-Q1-E1-A3
ccagccctcaacgttcctaccagctgccaccgcctgttacccgtgatgtctcccgcccttgccgctggcgtggagcccatggccgtcgacgattccgcctccaagaaggccaagcgcaagcagctcaaggccgccgccgccgccgcggaggcagaggcggaggccgcttcggtcaaaaaaaaaagaaaaaatagaaagaaagaaaag

SEQ ID NO: 4200 - DNA, 350 bp, Zea mays
  unsure at all n locations
  Clone ID: LIB143-024-Q1-E1-A4
gacgcccgtcgcctccagatacgtgcctccggcggaaaatcggtatcgagctcgctttgttcgaatcttctgtatagccagcaaggaggcctctccatctcctccgggaaggctgtgcagcaatggagaagtataacagcaagactcagttagcacccttgagagataccccatttgctctccgtggtgctcttggtagttcaagctcataccttgagcaagccaggggctacacgtcttcncctctagcagctctgcgaccaaagatgtcttcaactactggaaatccgactctggaatccaatttgccccttgtcacctcctgtacaaaacggccggtggtcgcccaa

SEQ ID NO: 4201 - DNA, 289 bp, Zea mays
  Clone ID: LIB143-024-Q1-E1-A5
gggtccacgtacgcgacccctcgggtccacacttgcaccgatctagcagccaacatggggaccaaacacttggctctttgcctccttgttctccttagcataggcatgggcatggacatccctgctgcaaaccgcatactgggttaaggcccccggggaggaggtggcggtggtgttaccggtggccgcagtggttacggtggaccatgcgtatggtccggatcacggtatagtcatggcggtgagtgtgcaagtgctgctggagggtatggacatggtggcggcggcg

SEQ ID NO: 4202 - DNA, 322 bp, Zea mays
  Clone ID: LIB143-024-Q1-E1-A7
gagacctcacgctcttcggtaagttgagttcatcatcatccatcgtcggcccgtgcccgtctattataattcggtttttgttttacaaattatatatattctctcgattttaaaattttcccttttgattctacgggttcttcatcttctaagcgcgtgatatgtaatgtaacattttcctagaatcacgtgcgatcgcgaggcatgttctccggaagcacaagccggagctgctgggcggcggcaggctggagcagacggcgatggtggacgtgtggctggaggtggaggcccaccagctgagcccgccggcgatcgccat

SEQ ID NO: 4203 - DNA, 361 bp, Zea mays
  Clone ID: LIB143-024-Q1-E1-A8
cggacgcgtgggcaagcagcagcagcaccagcacccagtagtaacacagtaaccggcagaggccatggcgagatcaaggcggcgggaaggggaggccggaggagacgagcggaagctggtcctgggcaagtacgagttgggccgcctgctggggcacggcaccttcgccaatgtgtactacgcgcgggacctgagcgccgccgccggcacgggcagcaccagcgtggccatcaaggtgatcgacaaggcgcggctgcagcgcatggatgggaatgatggaccagctgcgccggggattcccaatcatgcggatggtgcacaacccaaacttggggggcatccggaaggtgttcccaagccg

SEQ ID NO: 4204 - DNA, 388 bp, Zea mays
  Clone ID: LIB143-024-Q1-E1-B10
ccacccgtccgaacacgcgaccgccggtcctcatgggtgcgattattttacatggatcgatgtgggagcaaaaggctatcctagattcaatgtagtttcatcaattatgctcaattatggatgttcagaggcatctaatttcagtgtgtactgcaatacttgggtccacctgtacttggtttaagaatcgctccgctgtcttccacagccgctcagccgatctcatccatggcctccggcgcacggctatgcccaggagacacgccctcaacgaagatcagtgcatataagagataagtatctcgactattccatagcacatgtatgcatccaaggcctgttccccaatatcaatttgtgcaggattcaaaggaactttaacctgagc

SEQ ID NO: 4205 - DNA, 403 bp, Zea mays
  Clone ID: LIB143-024-Q1-E1-B11
cgtcagggcaaggaggcgggccagagcgccatcgacgctgtcagggcgagggtcggcgcggactgcctcgtcgtgggcgaggagccccggccgccgcgcgtgttccgggaggccgggcctggcgaccgtgaccacggcggcggccttgggctggtctacctcggcaacctcgtgaagcggaacctgtacaacctcggcctcatcaagtcgtgctcgtgaagcgggatgctcggctcggctcggccccaagaaaaagacacgggcggtttctcaaggagacccacccgccattgacgtactgtgtacgtacaagatcgaggaaccggcgccgacggcatcaactaaacaccgcgacatgtagcgccgcgcaagcagggtgaaattcgggtcgggcatgatgttg

SEQ ID NO: 4206 - DNA, 426 bp, Zea mays
  unsure at all n locations
  Clone ID: LIB143-024-Q1-E1-B12
catcacatagcttttgagatgcacaattcttattggacgagtataatatcatcaacggctacaatacaagcttgtaccattttgaatgctgatttagcatatctcttgcatatgctgcattgctacttgcaatggtagcgcaatatgcagcanaccagtgagatatttatttgctgcatgatgctccaatgttaccaacatgctacttctaacagtagcactatatgcttttctcatgtgcaaatcttattggctaggtagcatgtaattctgctgatgtacatcaatgttcttgttttacatactgcatgtactttataacctcgtgcagttgtctgttttctttatcatagagtgatgtcctcacacagttgcaaaatgtcctgctgaaaattgcaactacccaaattatggatttggtactac

SEQ ID NO: 4207 - DNA, 271 bp, Zea mays
  Clone ID: LIB143-024-Q1-E1-B2
tcaccttgcccgcgccgccgctcgccgtttgcccctcgtctccgcaccgcgcgctgttgtccatccttgtgcagcaaaaatgacggctggctacattgttggctcactggtcggatcctttgccattgcatacctgtgtgacacatttatctctgacaagaaggcatttggaggtagcacccccaagactgtttctgagaaggagtggtggcaagccacagacaccaagttccaggcctggcctcgcactgctgggccaccggttgtcatg

SEQ ID NO: 4208 - DNA, 426 bp, Zea mays
  Clone ID: LIB143-024-Q1-E1-B5
catagtggaaagtttattcttccattgaacatcccactgagtgtaatgcatatgcagaaatgcatatgcagaaattgaggtagcatataactgccgcaagggaaaatatggtgtagcagatgaggatataatcttatatggtcaatgtgtttgaattggtccaaccattgatatttcttcgcggttgctagacttgagagtcgcagttttgcatagtcctatattctatctgcactaagagtaatatatacagccaagcggacgtttggtttaacatttacaaggtatgtttggtccttttgttttttggaattaatggttgtccgatggctgtcattcatatgagttctaatatcaagcccccttaagttactcatcatcaaaagtttcaatgtgaatgttttaaatgtagatttaaagggttga

SEQ ID NO: 4209 - DNA, 413 bp, Zea mays
  Clone ID: LIB143-024-Q1-E1-B6
catgcaatcacaacgaacaaaagctctcgatctcaccgacaccgaggaagaagagatcaatggcgtccgagcagggagtcgtgatcgcgtgccacagcaaggctgagttcgacgcccacatgaccaaggcccaggaagccggcaagctggtggtcatcgacttcactgccgcctggtgcggtccatgccgcgccatcgccccactgttcgtcgaacacgccaagaagttcactcaggtcgtcttcctgaaggtggacgtggacgaagtgaaggaagtcaccgcggcctacgaggtcgaggcgatgccgaccttcaacttcgtcaagaacggcaagacggtcgcgaccatcgtgggtgccaagaaggacgacctcctggccctgatcgagaagcatgccgcgcctgcgcctgcg

SEQ ID NO: 4210 - DNA, 375 bp, Zea mays
  Clone ID: LIB143-024-Q1-E1-B7
ctcagacagaacaagggatcatcaagtgcagcaccagctaaggtaaccgcgaatcatgcaccctctactcagacagtgcctgctactccacctcaaacgtcagcagccccagatgcaccggcacctattgtacctgtcagtgcaccggctgcaactgctacagcctcagcagctcctgctgttgctgtctccactgaggcggatagttatggtcaggctacctcaaacctagttgctggcagcaacttgggaggaacaattaaatccattcttgaaatgggtggcgggacatgggatagagacactgtactacgtgctctgcgggctgcgttcaacaatccaaaaccttccggttgattacttaaatccgggaat

SEQ ID NO: 4211 - DNA, 399 bp, Zea mays
  Clone ID: LIB143-024-Q1-E1-B8
cacacgcgtccggcaagcaatccgaattctctgcgatttctcgagatctcgaccacccctactagttttggttcctcctttcgttcgagagagcgtttctagtggcaatggcgaagagcgagggtccggcgatcgggatcgacctcggcaccacctactcgtgcgtcggcgtgtggcagcacgaccgggtggagatcatcgccaacgaccatcggaaccgcaccacgccgtcctatgtcagcttcacggacaccaagcggctcatcggcgacgctgctaataacaggtcgccatgaaccccaaccagaacgttctccgatgcaagcggtttatccgcatgaggttctcttgaccgtcagtgcagagtgacatgaagctatggccgttcaatgtcatccc

SEQ ID NO: 4212 - DNA, 340 bp, Zea mays
  Clone ID: LIB143-024-Q1-E1-B9
catttatattctttgtatcccttttggagatttatgacaaaagggggaaaaaatttgcattaaaacctaactttaatcctaagttaccaaattttaaaagacctttaaaaaagggaaaaattatttacaaaaaaaaggaaatcctaagaaaaacattaaattaaaaaaatttaaaagtgcattccaagtcaagagcatcacgtttaatttatgacacacttgcacctatgaaaagtaatataaaagttgtctatactttgacctaaatatgtgcttttggcatttgagtacaaaagtgttattttctgaaatgcacatatttaaggggaagaaactatat

SEQ ID NO: 4213 - DNA, 217 bp, Zea mays
  Clone ID: LIB143-024-Q1-E1-C1
ataaaattgggttacaagaattatggcgtttgtcaatatgatcgtaatgtcgtaggatggtggaatgtggtcacaaactttgcgtatgttgggtctactggtggtgtctactctgaatctatgtatggatgtcatgagttccagttcctgtggtgttcgtatgatgtatatcatgagttaactctatctaaaatttcttcattatggtatttttaag

SEQ ID NO: 4214 - DNA, 416 bp, Zea mays
  Clone ID: LIB143-024-Q1-E1-C10
agactcccgacccgatctcccaccgcgtcgggaactcgggatcctcctgcccgcctacccgcccgcgcgccgccgtcccgttcgccagaaccatggacggcatcgagggcctgctggcccgcgacttcggcgtccggccgcagggcaaggccgcccccatggccggcgcctcccgctccaccggatccagcgccggcgccgacgcatgggccagctacggcagatccaccccggccccctccgcggccccgtcctacgacgacctcttcggcgcctcgctcttcgactcgttcaagggccccaccaccaccacaaccaccaagcccgccgcgccttcgcctgcccccgcgtacgacgacgacatcttcgacgcggtcccgggggctgcgccctccagctcccggttcaacaacggc

SEQ ID NO: 4215 - DNA, 323 bp, Zea mays
  Clone ID: LIB143-024-Q1-E1-A2
cccacgcatccgattgcttcttcagcggtgcgagctgcaatcaaagttaaggcatcagtcatcatttgcttcacctcttctggacgagctgcaaggctcattgctaagtacaggcccagcatgcctgttctaactgttgtcattcctcgtctaaagacaaaccaactgaattggaatttcacaggtgcttttgatgcaagacaatcactcatagttagaggcctcttccctatgcttgctgatccactacacccagctgaatctaccagtgctacaaatgagtctgtgtttaaagttgctcatgaccatgggaaagcctcggg

SEQ ID NO: 4216 - DNA, 391 bp, Zea mays
  unsure at all n locations
  Clone ID: LIB143-023-Q1-E1-H1
gtaggtagagagagagagagagagtgaccctaccgggcgggagagagccaggaagaggagggcgacgatggcgtccggctggggcatcaacgggaacaagggccgctgctacgacttctggctggagttcagcgagtgcatgagccgctgccgccagccctccgactgcggcctcctccgcgaggactacctcgagtgcctccaccactccaaggagttccagcgcaggaacaggatctacaaggaggagcaacgtcagatcagagctgctgctcgcaaggccaaggaggaagctganggtgcccctgctgttgcagcacaccattagtctctctgtctattttttgtgttgttgttttctgttaactcatctttggttcagttatgatgc

SEQ ID NO: 4217 - DNA, 392 bp, Zea mays
  unsure at all n locations
  Clone ID: LIB143-023-Q1-E1-H10
gttcccgctgcagcccgtgggccgcctggtgctcaaccgcaacatcgacaacttcttcgcggagaacgagcagctggccttctgcccgggcctcatcgtccccgggatctactactccgacgacaagctgctgcagaccaggatcttctcctactccgacacgcagcgccaccgcctcggccccaattacctgctgctaccggccaacgcgcccaagtgcgcacaccacaacaaccactacgacgggttcatgaacttcatgcaccgccacgaggaggtcgactacttcccctccaggtacgacgccgccaggaacgcgcccaggtaccccatcccgaccgcccacattgccggccgccgagagaagactgtgattnagcaagagaacaact

SEQ ID NO: 4218 - DNA, 331 bp, Zea mays
  Clone ID: LIB143-023-Q1-E1-H11
atccttttttacagagataatagcatcagtttcagatataaaatttgcaagggatggaagacacattcttagtcgtgattatatgacactcaagttgtgggatctaaacatggattcaggcccagttgcaacttttcaggttcatgaatacttacgtcctaagctttgtgatttatacgagaacgattcaatttttgacaaatttgagtgctgcctcagcggcgatggactccatgttgcaactggttcttatagtaatttgtttcgtgtttttggttgttctcctgaaagcgtggaggcatcaacgttggaagccagcagaaatcccatg

SEQ ID NO: 4219 - DNA, 356 bp, Zea mays
  unsure at all n locations
  Clone ID: LIB143-023-Q1-E1-H12
actgcaacagccaagtgcaagtgatcgagctcccccctcctcatcagtcgctaagcacagcgcacttgcaggatggcgcaagtctctaagacgcttctccttgtggccctggtgttcgtgtcgtcngcggcngtggagctgtgccgcgcgatcgacttcgacgagcgggacctgncgtcggacgaggcgctgtgggacctgtacgagcggtggcagacgcacaaccgggtgcaccggcacaacggcgaagaagggccggcggttcgggacgttcaaggagaacgtgcgcttcatccacgcgcacaacaagcgcggcgaccggccctaccgcctccgcctgaaacggttcggcgaca

SEQ ID NO: 4220 - DNA, 401 bp, Zea mays
  Clone ID: LIB143-023-Q1-E1-H2
gcgtccgaaatccacgagcgcgaggcacgacctacatcgaatcggccacgaagcaccatggcggcctcacgcgcgctcctccccagcccgcaggcgagccctgcgagcgcgcgggtccgcctggccgcggccgtgccgtcgtcgctcacgctcgcggcgcgcggcggggccggcgcgcgtctccgcgtgcggtgcgcgatcctgtcgtcgcccgcgcccgtggcgcccaccgagtccaggccggcgcgccggatctcgccgtccgcgccggacagcgcgctgcggcacatgccggcggtgctggtcgccgagatactgagcgaggccgggctggccgtgctgcggcagttcgcggacgtggagtgcgcctaccgcatgtcccccgcggagctcctcgccaa

SEQ ID NO: 4221 - DNA, 392 bp, Zea mays
  Clone ID: LIB143-023-Q1-E1-H3
aaacatcctggtgggcggcgccttcgacggcgcgtccatgaaccccgccgtgtccttcggccccgccctcgtcagctgggagtggggctaccagtgggtgtactgggtcgggcccctcatcggcggcggcctcgccggcgtcatctacgagctgctcttcatctcccacacccacgagcagctcccctccaccgactactaaaagccgaagccgaccgacctaggggtgcgcagcgcagctagcgcatccagctctctctccccgctcgccgccgtttagtttctctcgtgcacgtgcatgcatcgtcgactgtctcaggccgccgctgcgccggcgccgctcgcatcgtttgcttccttggaccagcagtcgtcgccgtcaggctgaactg

SEQ ID NO: 4222 - DNA, 378 bp, Zea mays
  Clone ID: LIB143-023-Q1-E1-H4
ctccatcctcgtccctgcaaatcctgcaaacacaaccgcccgttttcccccccggaacaggaaaaacgggaaaaaaaaggtaaggcccgttttcggcccattcggcccggccccaagcacctgtaacgaactcctcaatctcaagagcaagatgggtcccggcggcaagatgaacgagaaagagcgggagaagcaagagcagctcgcccgagctaccggtggcgccgcgatgcagcggtcgccggtggagaagcctccgttcactctgggtcagatcaagaaggccatcccgccacactgcttcgagcgctcggtgctcaagtccttctcgtacgtggtccacgacctggtgatcgccgcggcgctcctctacttcgc

SEQ ID NO: 4223 - DNA, 371 bp, Zea mays
  Clone ID: LIB143-023-Q1-E1-H5
acagtggtgcttttgcatgggagattattccggttcaagttcctgttggtagaggaaaacccccaacattaattgagagagatgaaagcctggataagtttgacccagtaaaactaaagaaacttcggccaagtttcaaggagaatggtggtacagttacagctggaaatgcttctagtataagtgatggagctgctgcattacttttagtgagtgggcagaaggctcaagagcttggccttcaagtccttgcaaggatcaaaggttatgctgatgcagctcaagctccggagctttttacaaccactccagcacttgcaataccacaagctatcgcaaatgctggattagagtcatcccgtgttgatttc

SEQ ID NO: 4224 - DNA, 319 bp, Zea mays
  Clone ID: LIB143-023-Q1-E1-H6
gtccacactggtgcttttgcatgggagactaatccggttcaagttccagtcgggacacgagaacccccaccattcattgacagagatgaaagtctgccataagtttgacggattgcaactaagtaaacgtcgtccaagttttagggagactggtggtacagttacagctggcaatgcttctagtacatatgatggagctgcggcattacgtttagtgagtgggcagaaagctcaagagcgtggccgtcaactccatggacgggtaacaggttaagctgatgcatctcaagctccggaactttttacaaccagtccagca

SEQ ID NO: 4225 - DNA, 326 bp, Zea mays
  Clone ID: LIB143-023-Q1-E1-H7
agtgcctcatgggcggacgcgtcggcggtgccctggtcaccgcgacatggggatactgctccccgaggtggtgcagctgtcgtaggagcaccacgcgactcgcgcccatatggacgccatggccaagcgcattaccaatgtggagtagactcagaatcagatgacggtgttcctcacgcgtgccatgaacaccccgagcttcaacccgatgctggtcgaccgggacggccttggcagctgcagcaaggagctctacgacgcgctctccacaaagcgcctgcgtgccatcgactaactctcgcgcgacggtcatatatgccgcactg

SEQ ID NO: 4226 - DNA, 421 bp, Zea mays
  Clone ID: LIB143-023-Q1-E1-H9
acattctcgaattacgattcccaatccagcaaaccctaccagccttttgcaaactcagagagggacccgatggcacccaaggcggagaagaagccggcggcgaagaagcccgcagaggaggagcccgcggccccggcggagaaggcccccgctgggaagaagccgaaggcggagaagcggctcccggcgggaaaatccgccggcaaggaatgcggtgttgacaagaatgggcggaagaaggccaagaagagcgtggagacgtacaagatctacatctgtcaagtgctgaagcaggtgcacccggacatcggcatctcctcaaagggcatgtcaatcatgaactccttcatcaacgaaatcctccagaaactccccggcaaggcggccaaactcgcccgctacaacaagaagcccaccatca

SEQ ID NO: 4227 - DNA, 327 bp, Zea mays
  Clone ID: LIB143-024-Q1-E1-A1
ggacatgtgtactacttcctggaagatgtatacccacgtatgactgggcgtcgccccctaaagacaccgtccttcattaaggcgctatttgctgatgacaatgttgtggtggcacagccacccaatgctgggattggtgctggtgcaaggttcggtgctattggtgtagatccccaggctcaatgatgaattactttcagtgacctgagggccgaggctgtgactgatctgggatgcggcagtttgtattctctgcgcaaattgcggaactggcccggaggaaattggatcgtgatgggcaaacaggccaatccctgttgcagaaac

SEQ ID NO: 4228 - DNA, 423 bp, Zea mays
  Clone ID: LIB143-024-Q1-E1-A10
cagctcaagatgtttcaatttgccgaaacagtaaagatggatcgtcacctgttaatgccagtgggttatcaaccaagcttccatgcacaggtgacgatccatctttgcaaatttttcttccaagtcaaccttccactgttccccttcagcaagaattgagtgagcgttctgatactccaaatggagtccaccctaacgattggaggatatcgcttacgcttgccgctggtggagggggcaatgaagagtctacaagtgttggcggtctaaaatcacaaccaaaagtttcatcgaaagaggcaggagttgaacctttacttgatgctgcttctgctcttggaagcatgaacaatgacagatgcactggatctaatctaaatcctaaaaggattgaaaatataatttctcatcctcgccaaacgc

SEQ ID NO: 4229 - DNA, 327 bp, Zea mays
  Clone ID: LIB143-024-Q1-E1-A11
cagcacatgcaattgctcactcaggaacatagaacccaacgcatggcttctcccaagccgctcctcctgctcgccacctcgttcctgagctgcggcctcctgctggccgccgactacgccccaatgaccctgaccgtggtgaacaactgcccctacccggtgtggccgggcatccaaggctactccgggcacgacctcctggatggcggcggcttcttcctctcgccgctctcccacatgtccttcgcggcgccgttccacccctggtcctgccgcatctgggcgctctcgggctgcgcgggcgcctgtgcgcagctccactgcgcc

SEQ ID NO: 4230 - DNA, 427 bp, Zea mays
  Clone ID: LIB143-024-Q1-E1-A12
agtttctacaacatgagtttgtgaacataagcaaaccgcatgctgaacgtttaattggggagatgggacctgatttcagtcaaaaaatggcagttaagagccttacttctcagcaattagttcgaatacatcaattatttaggcaggctaagttcgatgatcccagcggcaattgtcttagtcctgcgggtgaatataatttacgcctgggtatcataaaagagttgcaccctgatatggttgcgacacatgcaagcagccctcaggtttttgaaggtcacccatttattgttgaagctgggataagcattggtggaaaagatgttaaacaaggtctaaatatttttaggtttgcaaacagaataccacttctctttgaacaaggtgctgatgtcatcacaagaactgctgcaaaaaggatctcttg

SEQ ID NO: 4231 - DNA, 400 bp, Zea mays
  unsure at all n locations
  Clone ID: LIB143-023-Q1-E1-G9
accacgcgtccgcccacgcgtccgcccacgcgtccgcggcggtagagaagcccgtgctgcccctcgtgtatcaccggaacttgcagcgtttgtcctcttgtcaattcatttctcatttagctcgaagctaatgcgtgcgatttttcatggttgttgtgctggaatgttctaaatcttagattttcagtgaccccaacaatctcgctgcccccgattctcctgcttcatatatttgattactcanagcacgcgatgctcccctgaagtagtaaggaaaatgctgactctgctcttgctgaaaatattgtacagaaagacacaattccattttggtggatgcaattggaggattcagcgagatgcttgcctctacacggaggtgctatgtatttggaggcaa

SEQ ID NO: 4232 - DNA, 395 bp, Zea mays
  Clone ID: LIB143-023-Q1-E1-F2
ccacgcatccggcgagagagctgacaagaatcgactgccatcaatggctctggcgccggcgcctctccagtgcttcctcacgagcagcagaccggccgtatgcacggcgacgccgcccaataagcgcgcgaggaggccgtcgaggatctcgtgcagggcgtccggcgatgacaaggacaaggtcccgtcgtcgggagggagcgatcttggggtcaagcagctcgggaagctggccatggtcgcgctggccgccggcgtgctggtgctcggccccgtcgacggtgccgtggcggccaagtccggcggcagggtcggcgggcaggcgttccggtccgcgccccggtcgtccggccctcggatcaacaactccaggaccaacatctacatcaaccccg

SEQ ID NO: 4233 - DNA, 166 bp, Zea mays
  unsure at all n locations
  Clone ID: LIB143-023-Q1-E1-F3
agatgatcagcttgtcatcttcgatgcttctgatggccctccctaacctgtcggtcaatggggttctgatgcaaaatcgcgtttttgcctgccaaaagctcggcttctactttggcagtggatgccttcgctcccttcaccacagtactgcttttacnggactcct

SEQ ID NO: 4234 - DNA, 211 bp, Zea mays
  Clone ID: LIB143-023-Q1-E1-F4
agtggctctccagtagcagcctaccagatctacggaatgcgatatggcagtataggcgctcaaggactccgtccaggatctactgcacggcatcccgctacgacaagtccacagtcgcgtcgtactgacggacctatcttggggtcacgtaactctggaagctgtccaacgtctcgcaggcccccgccgtgctggaactcgtgtccgtcta

SEQ ID NO: 4235 - DNA, 416 bp, Zea mays
  unsure at all n locations
  Clone ID: LIB143-023-Q1-E1-F5
accacgcgtccgctgatctgctgctagctggggatcctgcagaggctaccgcgttcttcttgtctggggtgcacagtgcatgggcagtgggtgaactggtagagagcaagatggggaattgcatcgacaccacggcgcgggtggatcacagcatgaacaatgctgcctacccatcaaaagtgaccagcaagacaagtttgtcgtcaatcccttccacaattaagagcaactcaagtcgttcaacgctgactcttccatcaatgagagatcgaaatgagcttcctactcctcggacagaaggtgaaatcttgtcatcttctaatttgaaggcattcacgttcaatgatctaaaanatgcaaccaagaacttccgaccggacagccttcttggggaaggagggtttgggcatgtttac

SEQ ID NO: 4236 - DNA, 426 bp, Zea mays
  Clone ID: LIB143-023-Q1-E1-F6
acactcacttcgtcgaccccgccgcggcatctgggggcccctccaacgcgtccccgagccttacgggcctcgcccgcggcgggcagcaggtcgccgcctgccgcgccgcgcacgtcaaggccatcgaggtgcttgtcgagctcgcctcgctccagacctccttcctcacgctcgacgaggccatcaagaccaccaaccgccgcgtcaacgcgctcgagaatgtcgtcaagcccaggatcgagaacaccatcagctacatcaagggggagctcgacgaactcgagcgcgaggactttttcaggctcaagaagatccagggctacaagaagagggagatcgagcgccagatggccaacgccaggctattcgcagaggaacagctcgccgaggatctcgcgctgaagaggggcatctccgtgggcgctg

SEQ ID NO: 4237 - DNA, 419 bp, Zea mays
  Clone ID: LIB143-023-Q1-E1-F7
acagacccagcagctattgtggtcgtccctcagccgcgtcgcaccgcatcgcattctacgattcgaagctctctctgctcgcagccatggcgaagaattacccaaccgtgagcgccgagtacagcgaggccgtcgagaaggccaggcgcaagctccgcgccctcatcgccgagaagagctgcgcgcccctcatgctccgcctcgcgtggcactccgcggggacgttcgacgtgtcgtcgaggaccggcggtaccttcggtacgaggaggtgcccggcggaactggctcacggcgccaacacggggctggacatcacggtgcggctgctcgagcccatcaaggacgagttccccaccctctcctatgccgatttcaacagcttgccggagttttggcgtcgaggtcaccggtgggcctga

SEQ ID NO: 4238 - DNA, 381 bp, Zea mays
  Clone ID: LIB143-023-Q1-E1-F8
aggagtagtcgacgcgccgtcactgaatcctcagatcacggctagccgtaatcacgccactctgctgactcccggcgagcagtgtaacattttccttcagccatgggcaaggagaagactcacatcaacattgtggtcattggacatgtcgactctggcaagtcgaccaccactggccacctgatctacaagctcggcggtattgacaagcgtgtgattgagaggttcgagaaagaggccgcggagatgaacaagcggtcattcaagtatgcctgggtgcttgacaagctcaaggccgagcgtgagagaggtatcacaattgatattgctttgtggaagttcgagaccaccaagtactactgcactgtcattgatgcccct

SEQ ID NO: 4239 - DNA, 271 bp, Zea mays
  Clone ID: LIB143-023-Q1-E1-F9
agcgaggacaatacacagtgcgctactgacatgtctatggtcaccagtatactgggccgtatgcatcatcacccgcagcagtatcatcattaccattaagggctgcggctcgcgcactgtcaccagagcctgttccggcatggacgctgtcgcattggacccgttgagcatagatatcgcggagctggggcagctagtggatactatcacgcttgtggtgtacatgttccagtgctctaggcgtgcagatgttcatgacggcattcatgta

SEQ ID NO: 4240 - DNA, 424 bp, Zea mays
  Clone ID: LIB143-023-Q1-E1-G1
attcccacgcccgatcgatggccagtggcggcggcaacgcggcggcggacgccaagcacgtcgatgcggaggtcgtcatcgtgggcggcggcatcgcggggctggcggcggcgctggcgctccggcgggcgggcgcggcgcgccgcgtgctggtgctggagcgccacgcggggcatcgtgccaccggcgccgcgctcaccatcttccccaacggctggttcgcgctgcgcgcgctcggcgtcgcgcacaagctcgcctcccgctacgacgcctacgaaacgtgcgtgcgccccgtcgccgtcgccgtcgcccatgcttgatctcgactgacctgctgaatcgcatggctgcgcacagattccaggtgaccaatctcgagaccggggcgacgcaggtgtttcgctttgccgggatcaaggaacag

SEQ ID NO: 4241 - DNA, 355 bp, Zea mays
  Clone ID: LIB143-023-Q1-E1-G10
acttggcctcgtcaatccaccaccaccgtcgtcgctgagctcctcctccggcttcgcttcgctgtcttgcctcctcctcggtcgaagaagaagaagaagaaaacatgtgtccgggatccgtggagtcgtcgtcggcggcggcggcgggcaagagcgtgtgcgtgatggacgccgcggggccgctgggccacgcgctcgtggaccgcctcctccggcgcgggtacaccgtccacgccgccacgtacgcccgcgacggggaggagggcgcagttggggacatggggggtcggggcttgccgagggtagtggggaggggcgcacacgtgcagtttggtggatcgcagtggaggattca

SEQ ID NO: 4242 - DNA, 400 bp, Zea mays
  Clone ID: LIB143-023-Q1-E1-G12
ctgatattgggcggctgccctacctccaagccgtggtgaaagagaccttcagactgcatcctgctgccccgctgttgctaccgcggcgtgcccaggccgacgtgaagatgatgggctacgtgattcccgaagggtctcgagtgttcgtaaacgtatgggcgatgggccgagacgaggagacgtggcctgagcctgagaagtttatgcccgagaggttcctggggaagaagaagacgcaggcggttgatctcaggggcggggacttcgatctcatcccgttcggtggaggacgccggatctgccctgggatgccgctggcgatcaggatggtgcatctgctgcttgcgtcgctcttgaatcagtttgcatggaagcttccggctgagctagagaggaatgg

SEQ ID NO: 4243 - DNA, 384 bp, Zea mays
  Clone ID: LIB143-023-Q1-E1-G2
agttggggatgggtctcggtgcagtatttgtgaaccagctggtaaaatttgacgagaagctcaaggaggacctcgacaagatgcttgagcgcgccaggctagccaacgagcaacgctacattgatgatgatgaatagctgttcagatttgtttgtcagtgacctgtattttttgcaacatgttgtcagtacacatggtcaggactgtggatcccccatgacttagttgttgcctcagcttccacatttcaactgtggccttgtaataaaatgtcgttgcccaatggatctgatgcatcagagaaagtaagcgatcatattcaaagcccataatttgtagcttacaattgtggccccgagcacctcgtccgcaacccgtttggtc

SEQ ID NO: 4244 - DNA, 381 bp, Zea mays
  Clone ID: LIB143-023-Q1-E1-G3
gttggagcgagtgcaacgcacccccacccagctgctaagacccgagaacgaagctcgtatcgtccagcttaaccgcacccagctttcgcgactgggatttgtctcgagatcgatcgatcgcgttccatcagagagcatgatcaccttcgtgccttgctcacgcgccaggtaaagctcaatctcagctcgctggttttccagtcgcttcatggttctagcggtcgatccgattcctggggcttgtcctcacccgtgccttgccgcgtacggttcttcgtgatgtcaatgattgcttcgtcctgagaactttcctcggctcgaattcatgcgatttcagttctctccgtgcagaattggtcacgactttacagcataataccg

SEQ ID NO: 4245 - DNA, 372 bp, Zea mays
  Clone ID: LIB143-023-Q1-E1-G4
acgcatactcctcatcagcttccttccacattcgtctcgagatctcgccccgtcgccatggacgcgatcgaaaacgtggtggatccccccgcgacttcgccaaagacagcgtccgcctcgtcaagcgctgccacaagcccgaccgcacagagttcaccaaggtggcagcgcggacggcgatcgggttcgtcgtcatgggcttcgtctgcttcttcgttaagctcatcttcatccccatcaacaacatcatcgtcggttccggctaggcttacacgagtacagggcgactagcatgggagtagtgcaatacttttgggagcaatagataacgaggatcctggtctttcgaatagtattgttaatgaaattttt

SEQ ID NO: 4246 - DNA, 423 bp, Zea mays
  Clone ID: LIB143-023-Q1-E1-G5
agcttcagttcagaacttcagtgttgtgtctgtggacgaggctcaaatttctgctaacctcatcaaacatgggccattggcaatcggcatcaatgctgcctacatgcatacatacatcggaggcgtgtcatgcccatacatctgtggcaggcaccttgaccatggtgttctccttgttggatatggtgcttctggtttcgcccccattcgcctgaaggacaagccttactggatcatcaagaactcgtggggcgagaactggggggagaacggatactacaagatatgcacgggttccaacgttcgcaacaagtgcggcgtcgattccatggtctctaccgtgtccgcagtccacgcctcgaaagagtagactctggtcagcggtgataatcgtgattccatatattgtagaactataatccc

SEQ ID NO: 4247 - DNA, 146 bp, Zea mays
  Clone ID: LIB143-023-Q1-E1-G6
aaaaaaaatacaaaaaaaaaataaaaaaaaaagagaaaaaagaaaaaaatttatgcaaaaaaaaaaaagcaatgggacattggaaatcagggcggaaggccgacaagatgcagacatacatcggcggcgtgtcaagctcatacatc

SEQ ID NO: 4248 - DNA, 411 bp, Zea mays
  Clone ID: LIB143-023-Q1-E1-G8
cgggccgacccaaacgtccactcaagtcgcgggacgacgcgtggcagttccacgacaggatgcagaggttcctgaagaaggcggacgacgagatcatccgggtgcagtgccaggagagcgtggcgctgtcgctggtgaaggagatcaccgagtacttccacggcgactccgccaaggaggaggcgcaccctttccggatcttcatggtcgtgagggacttcctggcggtgctggaccaggtctgcaaggaggtgggcaggatcaacgagcgcaccatcgccagctccgcgcgccacttcccggtgcccgtgaacccgatgatgccgcagctgttcccgcggctgcacgcgttgagagccgggttctccgacgacgagagctcagccgcttcggtgtcgtcgccatgaccga

SEQ ID NO: 4249 - DNA, 79 bp, Zea mays
  Clone ID: LIB143-002-Q1-E1-F6
aataaaaacaaaaaaaaaaaaaaaaaaagaaaatgaaaaaatgcaataaaaagaaaaaaaaaaagttacacgtacgcac

SEQ ID NO: 4250 - DNA, 428 bp, Zea mays
  unsure at all n locations
  Clone ID: LIB143-002-Q1-E1-F7
acgccgtcttccgccgtctcaaggccaagcccgagaacaagatgtgcttcgactgcaacgccaagaaccccacctgggcctccgtcacctacggcatcttcctctgcctcgactgctccgccgcccaccgcagcctcggggtccacatcaccttcgtcaggtcaacgaacctcgactcatggactccagaccagctgaagatgatggcattcggaggcaacaaccgggcacatgctttcttcaagcagcatggatggaccgatggcgggaaggtcgaggcaaaatacacatcaagagccgctgaactttacaggcagatgcttaccaaggaggtcgctaagagcgccacgaccgataatgccctgccatcgtcacctgtcgcatctgaggcttcnaagccgccatccgatgacttccctgaattcaaa

SEQ ID NO: 4251 - DNA, 418 bp, Zea mays
  Clone ID: LIB143-002-Q1-E1-F8
cggacgcgtggggttcggaacactgatggaatattcagcttatgttggctgtttctcccagacggacaagatctcacatagtcataaagctaccagaaaatacagagaatacttggaacatattttggaatatctgacatcatttctgtatcgcacagagccattgcaagacattgataagatttttttaaagctggagagtgaattcgaggaacaatgggccaatgaaggaatacttggatgggggaataaagggacagaaaaagagtctgaaatagatctcgattactacagcacagttgaagaacttgttgagcttggcccagaaaaattaaaacaggctttagctgctcgaggtttgaagagtggcggtactgttcaacagcgtgcagatcgtcttttcttgttgaaggttaca

SEQ ID NO: 4252 - DNA, 341 bp, Zea mays
  Clone ID: LIB143-002-Q1-E1-F9
acacaattcacacagcgaaccgagaaaccaacacagcaacaagcaaagcagcgatccgacatccgagagatggacgcggtgatgttcgggctggagactcccctgatggcggcgctgcagcacctgctggacgtgcccgacggcgacgccggcgcgggcggcgacaacaagacgggcagcggcggcagcgccacgcgcacctacgtccgcgacgcgcgcgccatggcggccaccccggccgacgtgaaggagctgcccggcgcgtacgcgttcgtggtggacatgccggggctgggcacgggcgacatccgggtgcaggtggaggacgagcgggtgctggt

SEQ ID NO: 4253 - DNA, 414 bp, Zea mays
  Clone ID: LIB143-002-Q1-E1-G1
ggacgacatggagcgagtgctctccgacatgctcgacagcgtgtcatgcaaaccggacgtttggaccatgaacatcatcctcagcctcttcgggaaccggggcgaggttgaactgatggagagatggtacgagaagttccgaggctacggggtcgagccggagacccgcacgctgaacatcctgattggcgcctacgggaagcggcggatgtatgacaagatgtccgcagtcatggagcacatgcgcaagctcgcgttcccgtggacgaccgcgacgtacaacaacgtgatcgaagcatttgctgaggccggcgacgccgggaacatggagcacgcgttcaaccagatgcgttccgagggcatgaggccggacactaagaccttctgctgcctgatcgacgggttcagcagggc

SEQ ID NO: 4254 - DNA, 298 bp, Zea mays
  Clone ID: LIB143-002-Q1-E1-G10
ggactatctcagcgatttccgaaccctccccacccccacacccacccgatccaaccgagtcccggcggcgatggcggcggcgacgaacgccgatttggaggtggccgacttcaacctcaatgacaacaacttcagggacaaggaccccggccaagttcaacaacggcccccggcttccggcttcggttcaacaaccgcgggcaacaaccccccccttaggaccaaggcccgcggtttccgcaaggaccttaatctcctcggctacccgagactcgcgctttggcgcgggggagacgcc

SEQ ID NO: 4255 - DNA, 410 bp, Zea mays
  Clone ID: LIB143-002-Q1-E1-G12
ccctggagctcgcctttatcatcgcagagaggctgaggaagaggaggatgcgatcggggctcaacagcagcctgccactgccgccactggctttctgagtagccggagccaaacacaaaggagggtaggaatagctgtggtgactcggaagagaaagagacagtcgacgccttgttttgttgatgcttagtgtggtgacctggtggtggtggtggtgggtgttcttggcacaagttacatgctggggatagctataggaggtacctgttgaggtgtgtaagacagtagctagcaaccgtatgccttggtttcctgtttgggtgcgtgacttgccgactttctagctgcttccgggggtttgaactccggtaagggaaggattaaaaggataatcggagtgcaatgcttgc

SEQ ID NO: 4256 - DNA, 369 bp, Zea mays
  unsure at all n locations
  Clone ID: LIB143-002-Q1-E1-G2
tactgtcctcacatatcactaacccaaggagtgcaagaaacttttcattgttcacctatccgaaagagagtattttgctgttccaaggaatctgaaactgcttgctgttccactgtttgaactctacgacaatgttcagaggtacnggcctgtcatctctaccatcccgcagcagctttctaggttccagttcaacatggttagctcttagggtgatgatacaagaaaaccaatgtggccaaagcagctcttcggttgctgagctagctgatcaacgtaccctgactgattttatttcattgtgctggatttttttatatagactactactatctagacatgcatttctgattgtattgttgttgaatt

SEQ ID NO: 4257 - DNA, 310 bp, Zea mays
  Clone ID: LIB143-002-Q1-E1-G3
accacacgtccgcccacgcgtccgtaagaaagttctatcaacaaaatcaacacacgcgaccaccaattcatagtcagagacacaaacccaaggcatcaagggccaaagcctcgcagcggatgctgtcggccggaatctcggctggccactagcgggagggagctccaggccatcgacgacgagtggctggacgcggcgcggctcaagaccttctcggagtgcgtcagggacgccattgcgggcctcggagtcgcgggccacgtgaaccaccgcacgctccaggagtgggaccgcgccaccgggggggtac

SEQ ID NO: 4258 - DNA, 396 bp, Zea mays
  Clone ID: LIB143-002-Q1-E1-G4
gtttgaagcagaagaaggctcacctcatggagatccaggtcaacggtggcactatagcagacaaggtggactatggttacaagttctttgagaaggaggtccctgttgatgctgtgttccagaaggacgagatgatcgacatcatcggagttaccaagggcaagggttatgaaggcgtggtcactcgctggggtgttacccggcttccccgcaagacccacaggggcctccgcaaggttgcctgtatcggtgcatggcatcctgctaaggtgtcgtacactgttgctcgtgctggtcagaacggataccatcaccgcactgagatgaacaacaacgtttacaagattggcaaagccggacaggaaagccatgacgcctcaactgagtttgacagac

SEQ ID NO: 4259 - DNA, 422 bp, Zea mays
  Clone ID: LIB143-002-Q1-E1-G5
cgcaccgacgccgtcgccgccacgctcatccagaccaacgtcgacgcgcgcgaccaccagttcatagtcggcgccaccaacccgggcctcaggggccagagcctcgcggccgtgctgtcggccggcatgtcggcgggcaagagcggcagggagctccaggccatcgaggacgagtggctggccgcggcgcggctcaagaccttctccgagtgcgtcagggacgccatcgcgggcctcggcgtcgcgggccaggagaagcagcgcaggctccaggagtgggaccgcgccaccggcggctacgacaggtgcgtgtccaacgaccaggcgcgcgacatcgccgccagcctcggcgtcacgtccgtgttctgggactgggacctgccgcggaccaaggaagggttctacggcttcagggggtccgt

SEQ ID NO: 4260 - DNA, 428 bp, Zea mays
  Clone ID: LIB143-002-Q1-E1-G6
agactgccttgagaatagcgattgggctactagaaaagcagctgctgatacattatgtgtctttgctacacattctggtcacttgataggtgacggaatagctccaaccatttctgctcttgaagcttgccgttttgataaggtaaggcctgtcagagatagcatgattgatgcagtacagttgtggaaaaaactgactggagaagatgcaactgacggtagaaataaggatctaggtgatggtgaagggaaactggactcaagacggtcaatgcaaagtggtggaaaatcagaatgctttgatgattgctctccagattcacctagtaacatgaagggaagtagcatagctgaaaaggcagcagttcttttgaagaaaagaccagcattaactgacagggaactgaaccctgagttcttcaaaaagc

SEQ ID NO: 4261 - DNA, 197 bp, Zea mays
  Clone ID: LIB143-002-Q1-E1-G9
accgtgaaaactcaattttatttgttattattcaaagggatacatgaataatacccggaaaattgtacatacgaaaccaaacaaacatgaagtacattatatatcctaaaaaacacaggaaacatctcacaacacagcgacagccacggaccattcagcatcagttaacctttcttccacgtccaaattggattggg

SEQ ID NO: 4262 - DNA, 378 bp, Zea mays
  Clone ID: LIB143-002-Q1-E1-H1
cggcgccgcttccgatcgggttcgctgtgttcatggtgcacctggcgacgatcccgatcactggcaccggtatcaacccggcgaggagcctcggcgccgccgtcgtgtacaacaacagcaaagcctggagcgaccaggtatttacacacattgtccacgattgcagcactcactcatttgttggttgctaatttgctgttgctgcatgcagtggatcttctgggtgggcccgttcatcggagcggcgatcgcagcgctataccaccagatcgtcctccgcgccagcgccagggggtacggctccttccggagcaacgcctaggaccatctcgtcggcgggctattcagctcttcctcctccgcagtttaaggtgaacg

SEQ ID NO: 4263 - DNA, 409 bp, Zea mays
  Clone ID: LIB143-002-Q1-E1-H10
gcaagatcaagctgctgttgagtcacatagaaaggctgctgccgcagcagctgctggtaaattcaaagaggaaattgtgccagttcatacaaagattgttgatccaaaaactggtgaggaaaagaagatcgtagtctctgcagatgatggaatccgagtggatacttctcttgcagtcctgtcaaaactcaaaccagcattttcaaaggatggcagcactactgctgggaatgcaagccaagtgagtgatggtgctggggccgtcttgctaatgagacgggatgttgctatgaagaagggtcttccagttcttggtgtctttaggacctttgccgctgttggagttgatccaactgttaagggtaatgggtcctgccgttgcaatccctgcagcagtgaaagctgctgg

SEQ ID NO: 4264 - DNA, 425 bp, Zea mays
  Clone ID: LIB143-002-Q1-E1-H3
agcgacttcgctccgcttccgccgatcggcttgccccgtcgatttcgccaacccctcgacccgatcgactccattgatcgtacctcgtcgtccggttgtcgatggccaggacatctttcaaaatggagcacgacctcgagaaaaggcagtccgaatctgccaggatcagggataagtatcccgacagaattcctgtgattgttgagaaagctggcaaaactgatgtccccgagattgataagaagaagtaccttgtccctgctgatctcactgtcggccagtttgtctatgtggtgaggaagagaatcaagctgagcccagagaaggccatctttgtctttgtgaagaacaccttgccaccaactgcctctttgatgtctgcaatctacgaagagaacaaggacgaggatggcttcctttacatg

SEQ ID NO: 4265 - DNA, 422 bp, Zea mays
  Clone ID: LIB143-002-Q1-E1-H4
gcatcgcctcctccggccggctcgggctccccctgcccttccgccccttggtccggccaatccggccccttcggcggggccaccgccttcgccgggaaacggccacgttccgcgggcgcaagggcccaaattcggggccgccgtgcctgccgtcgagcaattccaccgcaggatgtcaacccaagccactgtgcatgccttcaaggatattctgaccagcctcgctaagcctggaggtggtgaatatggaaagttctacagccttcctgcactaaatgatccaacgattgataagctgccgtactccgtccgtattcgtcttgagtcagctatccgtaactgtgataacttccaggttaccacgaatgatgttgagaaaataattgactgggaaaacacatctccaaagctggtcgacatac

SEQ ID NO: 4266 - DNA, 405 bp, Zea mays
  Clone ID: LIB143-002-Q1-E1-F5
agctgattgttggtggatcaacttttggaaatgtagctattgcagatcaaacctcagggcagaagttaggtgttctaaaatcagatcatggaccattggcaataagatccttatcttcctgcacaaattcacacatgatatttgctggttcgtcagctggttatgcacattgctgggacttaaggactttgaggcctctctgggaaaaaagagtcagcccaaatgtcatctacagcacacgtcatttgcccggtgacacggcaacgctggcagttggaggcattgacggcgtgctccgcgttatatgccaaaggactggtgacatcattcgcagtcttgtcgttgacgcagatctcccagcagaagccacatctagattccggcagcaaatagagaacaaacgtg

SEQ ID NO: 4267 - DNA, 410 bp, Zea mays
  Clone ID: LIB143-002-Q1-E1-D7
agttttgtgaggagaggaatttcatatgtgtgaagagaagcaaggcacgtggcgcttgctaggtgtcaaatagaaagaccgaacccaaaccatcgccgtgttcatggacaccgcgtcgagtttagtcgtggtacgctagatgattgtgcgagctgaaggacatggatcagaatcttgtggatgcatcaagccagcaccagaatggaagatgctcaccaagtggtcgtcaattaacaacactaacatagtgtttatcccaggattataagtttgttctgttgtggatggtgctaagtgtcggtgggctcagccttcttatataagtatatcacatctttagcttctttattgaggactgtcacttaagctagcatgtattttaaaacttataaatgttttatacattcaaa

SEQ ID NO: 4268 - DNA, 427 bp, Zea mays
  Clone ID: LIB143-002-Q1-E1-D8
acaccttctcaaaaaaatcccccattttcttcgaggcgaggagagcgtgaaagacagggcaccggcagcgacgatgtcggggcgcggcaagggcggcaaaggtctgggcaagggcggagcaaagcgccaccgtaaggtgctccgtgacaacatccagggcatcaccaagcccgcgatccgtaggctggctcggaggggcggcgtgaagcgcatttcggggcttatctacgaggagacccgcggcgtcctcaagatcttcctcgagaacgtcatccgcgacgccgtcacctacaccgagcacgcacgccgcaagactgttaccgccatggacgtcgtctacgcgctcaagcgccagggccgaaccctctacggcttcggaggctaagctggatgcctcttccccttgctgtcctggatgcccgtttgt

SEQ ID NO: 4269 - DNA, 349 bp, Zea mays
  Clone ID: LIB143-002-Q1-E1-D9
agcgcaatggctcatccttgcttaattaccaaggtacctttgcagctgcaggtacgtacgtagctagccgccatagcaagctatgccgaagcagaggagtgatggccaaggtccaccccaacgccgcggagtccgtcgtcgccccagcagtagcaccagtaggctccgcccaggcaaacgccgagggagagctgcccacggtgctgaccgtgtggcgcaagtcgctgctcttcaactgcgacagggtcaacctctacgacacgcgcggcgacatggccctccgcgtgtgagaggaaacgcgggccattcccgcccgcggctccccgccaacgtcgtgctcatggacccc

SEQ ID NO: 4270 - DNA, 405 bp, Zea mays
  Clone ID: LIB143-002-Q1-E1-E1
acgcaacgtccccgctcctttgccggcgtcgcgcccaggcgcgggccctcccagcaagtcgcctccctccgcctacccgcgtcgccgtgcagccccccgccgcgccggtcgcgacgcgcatcggctcctttgacaaggtgctggaggcgctgatcggcgggaccgacttctccgaggaggatgcggaggcgacgctgaagctgctgctggacgagaaggaccaggcgcgcatctccgccttcctcgtcctcctcagggccaagggcgagaccttcgaagagatcgtggggcttgcgaaggcgatgttgagctgctgcatccgagtcgatggtccggatgacgccgtcgacattgtcggggacaggcggcgacggggcagacaccgtcaacatctccaccgggtcc

SEQ ID NO: 4271 - DNA, 391 bp, Zea mays
  Clone ID: LIB143-002-Q1-E1-E11
gtgcctgcgaggtggcggtgcgtgggggacgcgtcgcgggctggccgcggccagcagctagccggcgtcgtccggctcggcgcggcgcggcgtgcagccagcggggctgtccctgtcctccggggcaagcaaactgccgggccccgtgcgggccctcctctccggttccgaggccccggccaaccggccggcggagggcaaggaaaggaagggcccgttaaggctgtccttggccctccccgcggacgcggtggcctccgagggccgcggggtgagccgctccagggccgtctcgggggcgctgcgcgcgctcaagctgctcggcgtcgacggcgtggagctgccggtgtcctgggccgccgtgcaacccgggttcgggggcctgtttcaa

SEQ ID NO: 4272 - DNA, 377 bp, Zea mays
  Clone ID: LIB143-002-Q1-E1-E2
ggtcgaggccgcgtccaggacgagcatcgagagcgagccgccattgcctagaggactcggcgagagctctattcgattcgagactcgagagcatagccgtgcactgggaagaggacgtctacgagcagatgagcgggctggagctggagctgggcctgagcctatgcgtcctcatcgacgtcgtctacgagcagtggatgcgcgacaccctccccgccgatgacatccccgtgccgccggccatggcagtcaaaactgaggacgccgaggatctatcgcccgccaatcacgaaagccaaccagcacaaggggatgtatggcgtgattttgccttggtaaatctctgattctttatgctctacattgtacaagtgcct

SEQ ID NO: 4273 - DNA, 388 bp, Zea mays
  Clone ID: LIB143-002-Q1-E1-E3
ccatgagcaaatgctcagtaaggctcctcctatcccccaaacgctgccaaatgtgccaaacgaggagctcgcacctgactcttgtgatgagcatgcagacaaggtagatgaaggtggcaacacatccaagtccatgtcaggctcgtcgagtggccatcctgtgcctgaagctgaatcgctggctgcagaaaacacgggtgaagcatcagcagttgaggttgccaaccatcaagtgcctgaagcgagccgtagagaaagcattccaagagttccttcgtctctgcagaatgctgctattgcaacccagaagccaaagcatgacaggctattgaccttggccgcacttgggttgactcttgctattatggcaacagtgatcaagaagttc

SEQ ID NO: 4274 - DNA, 361 bp, Zea mays
  Clone ID: LIB143-002-Q1-E1-E4
acgctcagcccgtgtaaaccaaaccccgcttcggcggcggccgcgactggcccacgagccttctcgaaccgacgcatccgccacccatgctgcgctgccacacgccaccgcaatgcgcccgcgcgccgctccgccatcacggaatgtgggagtcgcctccggctgcggcacccgcggtggtagtgcggtgcgcgcggggtgcgccgcaggtgtccgggatcgacgcagcttcgccgggccacgccgctgtcacggccgcgttagctaacgcggaagggggtgacgcgcggcccagcctggccgagcggctgcggttggggaacctcctggaggaacggctatcgtaccacgagagtttcat

SEQ ID NO: 4275 - DNA, 369 bp, Zea mays
  Clone ID: LIB143-002-Q1-E1-E5
aactttattcaatttttgttgtttaattgatcaaattcaattctttattatcattaagggagattccagcatcaagttaagaatttgaacaaaaaaatgtccatgcttttaagttttttgttggcacttatgactagtgcagttttttccttatgcttgtactccttttggatcatgtttttaactttttatttgatgaaatgctcttttaagatcatgttcccttcaacgctacttggaactggggaaaagtggacaatgatgaagacaataagtgttactgaatatttaaattatgaagcaggaaaattttcgaagagtaaaggtattggagtctttggtaatgatgcagaggatacaaataatcct

SEQ ID NO: 4276 - DNA, 355 bp, Zea mays
  Clone ID: LIB143-002-Q1-E1-E6
gccacggccaccacagggagcagtcgagcaccctatagcaaccatatgccctccgcgccgtgctctggcccttcccccgacaccgccagaatcccgagacctgccggcgccgccaacaagaaaatggcgtgcctctgctcgccgacgagccacccggggtcgttccgctgcagtcggcaccgaaccgcgccggacggcgccgaggcggtgcccggcgccaccagggcgcggtccgtgcgcgcgctgctgctccagaggatcggcggcatccggcgcgagcccggccgccaccaccgccgccgcggtgtcggagtcggggacttccagccgcgcccctccaggctgcgcctcatga

SEQ ID NO: 4277 - DNA, 393 bp, Zea mays
  Clone ID: LIB143-002-Q1-E1-E7
gtcttggtagacatggagcagatccagtactccgagaagtacttcgacgacacctatgaatacaggcacgtcgtcctcccgcccgaggtcgccaagctcctccccaggaacatccttctctccgagaagcagtggcggttggtgggtgtgcagcagagccgcgggtgggtgcactacgcgatgcaccggccggagccgcacatcatgctgttccgccgcccgatcaactagcagcagcagcaggaggaagcggctgccgcgcatgtgctgcccaagtgaagcctctgctggcgaccacgaatgttaacaacccctagccctcttttcatctctagaaggggcgtcgctgttgtgttgattaatccctctggctgttggttgggaacttgggat

SEQ ID NO: 4278 - DNA, 415 bp, Zea mays
  Clone ID: LIB143-002-Q1-E1-F1
attcagggtatctctgcagttggtgcattttttgagctgcttagtcaacccagcttaagtgtgcagcacccagaagaaaacaagcaggttgctccagctgagctatgcccaatcctgaagaggctttacagaatactgataaaaagggagctcccagcaagggacattcttcaagccctgagggacgaaacgatgaatgatcctcgggaaaggattgagatggcacaaagccatgcattctaccgcccgtctctccttggaaaaccatgatctagttagtcttgtagattagtagaatataaacggacgctgtgctgcaagtttctccactgtgcttgctgtccttgtgtccgagctacatggggatggggctttgtcagttgtccaattctttgtgcttcctcattgccatggt

SEQ ID NO: 4279 - DNA, 337 bp, Zea mays
  Clone ID: LIB143-002-Q1-E1-F10
agcccgtgcaatccgatcccgatggcggcccggccggacgcgcgcagcggctactgcgccgcgacgcgcaccttccgtagcaagcgcgcggacgtcccgctccccgccgacgcggacctggacgtcgtcaggttcctcgcgtcccgccgccacgcgggcgttgtcgcgctcgtcgacgctgccacgggccaccgggtcacgttccaggaactctggcgcgcggtggaaggggcggccaccgcgctcgccgcgccgccgctgtcgctccgcaagggccaggtcgcgctcatcctctccccgaactccgtccacttccccgtcgccgccctcgcagcca

SEQ ID NO: 4280 - DNA, 349 bp, Zea mays
  Clone ID: LIB143-002-Q1-E1-F12
gtggcaatgggaggtacgatcatttaacgaggcggttgaaatgatatcggcatcaaggtgtacgggatggactggactggtcatggtggaagtgatggtctacatggatatgtgcaatctcttgaccacgctgtcaatgacttgaaaatgtacctcaagaaagtatcagccgagaaccctggtcttccatgcttctgcttcggccattcgacgggtgggggtatcattctgaaggctgcacttgatccagacgtagaaacgctcatcagcggtgttgtcctgacatcaccagctgtccgtgttcagcctgcccacccaatcatagcggccatggcaccgatttttgccc

SEQ ID NO: 4281 - DNA, 449 bp, Zea mays
  Clone ID: LIB143-002-Q1-E1-F2
cggtccagattacgggtcaccaccgtcgaggggagtcagccattgatgaaagtatctgccctggcaattgcatagcctgcaatgaccatgttgcacttacgcaccctgaccttgacaaggagactgaggagttcattgcagatgtgcttggggtcgaggtgtttacgcagactattgctggaaatatccttgtggggagttactgcgccttctctaacaggggtggtttggttcatccccatacatccgttgaagaccttgacgagctctccacgctcctccaagttcctcttgtcgcaagaactgtgaacagaggaagcgaggtcattgctgcaggcatgacagtgaacgactggactgccttttgtggctcggacacgacagccaccgagctctcagtcatcgaaagcgtcttcaagctgagagaagggcagcccactgcgattgtg

SEQ ID NO: 4282 - DNA, 421 bp, Zea mays
  unsure at all n locations
  Clone ID: LIB143-002-Q1-E1-F4
cttcggttctcctccagatctctaagaccaggagcccggtgaatccaccgcgcccgcagcgatgtcggcgagcagcacccccgtagacgcctcgggggagccgatcccgacttcgtcggtgctgatggcggcgtcgaagcacatcgcggtccggtgccgcccggagaacgttgccttcctcaactgcaagaagaaggaccctaaccccgagaagtgcctcgagaagggccgccaggtcacacgctgcgtcctcagcctgttgaaagaacttcaccaaaagtgtcccaaggaaatggatgaatatgctggttgcatgtattactacaccaacgaattcgacttctgccgtaaggagcagcangcttttgacgaagcctgccccatttctgagtagatcttgagagttttacgtgcagtggtc

SEQ ID NO: 4283 - DNA, 378 bp, Zea mays
  Clone ID: LIB143-002-Q1-E1-D6
cgtgatttaaagccagagaatcttcttttggattcaaaatgcaatgttaagattgccgattttggcttaagtaatattatgcgtgatggtcactttcttaagacgagttgtggtagcccgaattatgcagcacctgaggtcatatctggtaaactatatgctggtcctgaagttgacgtctggagctgtggagttattctttatgctcttctttgtggcactctcccatttgacgatgagaatattccaaaccttttcaagaaaataaagggtggaatatatacccttcctagtcatttgtcaccttcagcgagggacttgattcccaaaatgctggttgttgatccaatgaaaaggattacaatacgtgaaatccgt

SEQ ID NO: 4284 - DNA, 412 bp, Zea mays
  Clone ID: LIB143-002-Q1-E1-B8
acggcgtgcccgggcccgcggtggcggtatccccggcgcagaggctggccccgacccagctgacgccgtccagcgcgccgccccacgccgggggcgcgatgcccatgcccaggaagcggttccgcaccaagttcaccgccgagcagaagcagcggatgcaggagctgtcggagcggctcgggtggcggctgcagaagcgcgacgaggccatcgtcgacgagtggtgccgcgacatcggcgtcggcaagggcgtcttcaaggtctggatgcacaacaacaagcacaacttcctgggcgggcacagcgcccgccgcagcgcctcctcgcgcgcccccgcccccgccgccgcgtcgctccaaaccccaaccgccggcgccggggctgctgcagcaccgtcattcaacccgtcgag

SEQ ID NO: 4285 - DNA, 353 bp, Zea mays
  Clone ID: LIB143-002-Q1-E1-B9
ataaggctatatcaatcatggcgaaacctgaattccctgagttgatagattttaatccaatccatgcaactgacgtccaactaccttcaggtggtacatttgtgatcgcccattgtttggccgagtccaagaaagcagagacagctgcaataaattataataaccgcgttttggagtgtcgcttatcagcgattgttcttgccatcaaacttgggatggataggaaaaaagctatctcctccgttacaaccctctccgatgttgaggggctatgtgtttcttttgctgggagagaaggttcatctgatcctgcagtagctgtgaagaaacttctgcatgaggacccatataca

SEQ ID NO: 4286 - DNA, 341 bp, Zea mays
  Clone ID: LIB143-002-Q1-E1-C1
tggaaagcttcaagacgttgaagattggctatatgaagatggtgaggatgagacacagggagtctatatttctaaactggaagatcttaagaagattggtgacccaattgaggcacggtacaaggagtcgacagaaaggggttcctctgtagatcaactggtctactgcatcaacagtttcagagaggctgctttgtccagtgaccaaaagtttggccatatcgacatatctgagaaacagaaggtcatcaatgagtgctctgaagtagagaactggttgagagagaggaagcagcagcaggacgccctagctaagcaaaccgatcctgtgctgctcgtat

SEQ ID NO: 4287 - DNA, 320 bp, Zea mays
  Clone ID: LIB143-002-Q1-E1-C10
aaaagcaacaatgcagcagcacaagcaagaaccacacctcctcgcttcgcctgtgatcatgtcgtcatgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgacgcggccaccgacggcggcggctgcgactgcaacacctgcaagtgcggcaccagctgccgctgctcctgctgcagctgcaactgaactggcccgg

SEQ ID NO: 4288 - DNA, 310 bp, Zea mays
  Clone ID: LIB143-002-Q1-E1-C12
gtcacccctcctcgtccgtcgcctcacaaggcgaccagcgggcggaccctccgcggcgcaaccatggggctcttcactgtgacgaagaaggccaccacgcccttcgacggccagaagcccggcacctccggcctccgcaagaaggttactgtattccagcagccccattatctgcagaactttgtccaatcaacattcaatgcccttcctgtggatcaagtaagaggtgcaacaattgttgtctctggtgatggccgctatttctcaaaagatgctgttcagatcatcacaaaaatggctgctgccaatg

SEQ ID NO: 4289 - DNA, 327 bp, Zea mays
  unsure at all n locations
  Clone ID: LIB143-002-Q1-E1-C2
ctgtcaacggttgggcggtcatcaagttcgtcgccgacaacccaggtgtgtggctcatgcattgccatctggacgtgcacatcacctgnggcctggcaatggctttcctagtggaggacggctatggcgaactgcagtcgctggagccgcccccagttgatcttcccatgtgctagtggaggacggatatttgtgttgaggaagaaagcctggtcacgttgtatgttaattgttactcttttttggtggaggggggcgtgttcgtgatcttaaattcttaggggacttaattttccagcttgttggtttgaaatttcctctgtaaat

SEQ ID NO: 4290 - DNA, 419 bp, Zea mays
  unsure at all n locations
  Clone ID: LIB143-002-Q1-E1-C4
attacatgtttcgatccgggtcactgcgcggtaggcccggctggtgatgtggggctcggttcggttcttcgtcgcgttgctttcttcctttcctcnccttcccctcccacgtacgccggtcgccggcacgcgctcgtgacgcgcaagtcgcaggtcgcagcaaccgtaacgcgccgcgagcccgcatggcggcctgactcggcgccacgcgtttgctcctccggccaccatcctggctccttccttgtcgccgtttcctcggctatatagccgccagcctggcggaaggagaacggccaaaccagcacccgccgcccacaggaacatcgccgcccagatcggctgcatacctgttcttcttctgggcgccggagttcgcatcgtcggctcgtcgttcggtaacttgggggagcaatggg

SEQ ID NO: 4291 - DNA, 124 bp, Zea mays
  Clone ID: LIB143-002-Q1-E1-C5
acccacgcgtccggccaagtgtgcgtgtggtaccgttgcgatagaataatcagcatgggtagtggtgtcgggtcctttccctgaaactgaaagaaagcagcggcgtgcctgtcgccttccggct

SEQ ID NO: 4292 - DNA, 424 bp, Zea mays
  unsure at all n locations
  Clone ID: LIB143-002-Q1-E1-C7
gcattaaggactgtgataaggctgtcgagagaggaagggaactgcatgctgatttcaagatgatctcaagggcacttaccagaaaaggaactgctcttgccaaacttgctaaatcatcgcaagactatgatgctgccattgagattttccagaaggcgttaactgagcaccggaacccagatacactgaaaaaactaaatgatgcagaacgagcaaagaaggagctggagcaacaagagtactatgacccaagaattgctgacgaggagcgagaaaaaggtaatgagttctttaagcagcagaaatatccagaagcagtgaaacattacaccgaagctctcaggagaaaccccaaggaccccagggtatacagcaatagggctgcctgttacaccaagctangggcccttcctgaaggtctgaa

SEQ ID NO: 4293 - DNA, 426 bp, Zea mays
  Clone ID: LIB143-002-Q1-E1-C8
acggacgcgtggggactcttccattccattctattcccgcttccacacgtcggtcggcgcccttcgcgatcgtgtcgtttcttcccgcagcctgcctgcgtgtggggtgatggctaggcacttcaagtacgtcatcctcggcggcggtgtcgcggcggggtacgcggcgagggagttcgccaagcagggcgtcaaccccggcgagctcgccatcatctccaaggaaccagtggccccttatgagcgccctgcactcagcaagggatacctcttccctcagaacgctgcaagactgccaggcttccacacgtgtgtgggcagcggtggagagagactacttcctgaatggtactctgagaaaggcattgaactgatcctgagtactgagattgtgaaggccgaccttgcttcaaagactctgaccag

SEQ ID NO: 4294 - DNA, 332 bp, Zea mays
  Clone ID: LIB143-002-Q1-E1-D11
agcacaggtacggccaccaccaccggccaggaagcaagctcaaaccctaaccgccggcgacgccagcacgatggcccgctacgaccgcgcgatcaccgtcttctcccccgacggccacctcttccaggtcgagtacgccctggaggccgtccgcaagggcaacgccgccgtcggcgtccgcggcacggacaccgtcgtcctcggtgtggagaagaagtcaacccccaagctccaggactccaggtccgtgcgcaagatcgcgtgcctggacacccacatcgctctggcatgcgcggggctgaacgcggacgcacgcgtgctcatcaaccgcg

SEQ ID NO: 4295 - DNA, 402 bp, Zea mays
  Clone ID: LIB143-002-Q1-E1-D2
gcgtcgaggaaagcgtatgtgtggataattacacaaagtgaacttcatgtcaccatcacacatacgctttccatttcagcggaggcgatctagcacgatgcgcattgcctagtacagtacaagcagggagggtttcttctgaccgaaggaggggaagaccattccagcgagaatcgatggatatctcagccaaaaaaggttaaaagacgagggggggaggaggaagtgaaacgaaatgggaaattctgccgttggcgtacgtgaagatgaagggaggaacaaataatctccctttctcgtgtcgcataataacagagacagtgtgttttccgttttcccgtttgccgtgtctcgcttctctgctcctctcttcactgctgcggggtccgcgtttcttggggg

SEQ ID NO: 4296 - DNA, 394 bp, Zea mays
  Clone ID: LIB143-002-Q1-E1-D3
gggggacacgcacgtctggctcccgccgccgtcgcactcggtggcgccgcaggggtacatgcccggccggctctacgacctggacgcgtccaagtacggcacccacgcggagcgcaagtcgctcaccgcggcgttccacgccaagggcgtccagtgcgtcgccgacgtcgtgatcaaccaccgctgcgccgactacaaggacggccgcggcatctactgcgtcttcgagggcggcacgcccgacagccgcctccactggggccccgacatgatctgcagcgacgacacgcagtactccaacgggcgcgggcaccgcgacacggggggccgacttcgccgccgcgcccgacatcgaccacctcaacccgcgcgtgcagcaggagctcgcggactg

SEQ ID NO: 4297 - DNA, 416 bp, Zea mays
  Clone ID: LIB143-002-Q1-E1-D4
gggtcgacgcccgcgtccgaagcaagcgtacatgcgcggcaagagggtgctcgagatcaaccccaggcaccccatcatcaaggagctccgcgacaaggtcgcccaggacaacgagagcgaggagctgaagcacacggcgaggctggtgtaccagacggccctgatggagagcgggttcaacctccccgaccccaacgagttcgcgtccagcatctacaagtcggtgcagaagggcctggacctgagccccgacgcgaccgtggaggatgagaacgaggccgaggagcagccggaggtggagaaggagccggagccggagccgtcgtcctacgacaaggacgagctttaggctttcggatttgttttcaagtctagctagctcccgctttactaggaatgtgaatcagttacggcct

SEQ ID NO: 4298 - DNA, 382 bp, Zea mays
  Clone ID: LIB143-002-Q1-E1-D5
gagaaggaatccgatccatccaagccaagccaaggcagagaagaagaagaagaggaggaagaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacgccatctacgccatcaccaagaacaactagctagtcatccttgccgacgacgatccatgtctctgtatctgcgtctgttcatatgcctgatgccgacttgtgctgtatgtagttgcttgacttcagtcgtgttttggctacgtacccaccccaagcca

SEQ ID NO: 4299 - DNA, 400 bp, Zea mays
  Clone ID: LIB143-002-Q1-E1-B7
gccgctgatccaattaaacctatggaggctgccgcgttcagcaacacaaaggacaccgcttctccaccggagaagaaaccttcccaaccaactccatcaaagaagaagaacagaaaaggcggcctgtcgctgttcctgagcggcgctctcgacgacaccccaaaaccaagcctccctgcccccgctgtgcctgccacaccgaagcccgaaggacccgcctggggcggcgtgaagataaccaagggacccgcttcgcttcgagacatccagaccgagcagagcagaacaaacgagcccgcgtcggccaaggcgaaggaccgccacgagaactcgccggacagcgccggccgcgcgacaaggctctcctcgttcatccccgacgcgcgttccagcccaatag

SEQ ID NO: 4300 - DNA, 421 bp, Zea mays
  Clone ID: LIB143-023-Q1-E1-D7
acaatgacctccttatgctcccgttagtcatgctcgttcttctgatatcaaagaccatagccgacagctttaacaaaggggtttatgatcagattgtggtgatgaaaggcttgccattcctggaagctcatgccgaaccatacatgacgcacttggttgctagcgatgttgtgtctgggccactgatctccttttcaggcgtcgagagagtggggaatatcgttcaggcgttgaggatcacaggccacaacggatttccagtggtcgatgagccacctctatcagaggctccagaacttgttgggctttgtgctcagattccatctgctggtcctgctgaaaggtaagggcttcatgaaagagaagatgaaaaccagcggtagcttcgtgctggaaagatttggtgccttcgattttgcca

SEQ ID NO: 4301 - DNA, 418 bp, Zea mays
  Clone ID: LIB143-023-Q1-E1-D8
acgaaaccctaacgccgccgccgcttcacaggtaagccgccgtcatggtctccggttccggcgtatgcgcgaagcgcatcgtggtggacgcgcgccaccacatgctgggccgcctgtcgtcgattatcgccaaggaactgctcaatgggcagaaggtggtcgtcgtccgctgcgaggagatctgtatgtcgggtggactcgtacgccagaagatgaagtacctccgctttctccgcaagcggatgaacaccaagccatcccatgggcccatccacttccgcgccccgtccaagatcctgtggcgcaccatccgcgggatgattccgcacaagaccaagaggggggaggcggctctggcgaggctcaagacgtacgagggcgtcccgccgccgtacgacaagaccaagcgcctggtcat

SEQ ID NO: 4302 - DNA, 383 bp, Zea mays
  Clone ID: LIB143-023-Q1-E1-D9
agcgccgccgccacagcaacccttgcagccccaatcccccacggcgaccatggccggcgcgcaggagtccctctccctggtgggcacgatgcgcggccataacggcgaggtgacggcgatcgcgaccccgatcgacaactcgcctttcatcgtctcctcctcccgggacaagtccgtgctggtgtgggacctgaccaacccggtccactccaccccggaatccggcgtcaccgccgactacggcgtccccttccgccgcctcaccggccactcccacttcgtccaggacgtcgtccttagttccgacggccagttcgcactctctggctcctgggacggcgagctccgcctttgggacctctccaccggcctcaccacccgcc

SEQ ID NO: 4303 - DNA, 410 bp, Zea mays
  Clone ID: LIB143-023-Q1-E1-E1
aagaggacggcggcgatggcgaagaggctgctcccatctctgaaccgggtgctggttgagaagctggtgcagcccaagaagaccgccggcggcatcctcctcccggaaacatccaagcagctgaatgctgctaaagtggtggctgttggccctggtgagcgcgacaaggcaggcaatctgatcccagttgctctgaaggaaggtgacactgttctcctgccagagtatggtggaactgaagttaagcttgcagctgataaagagtacctcctcttcagagagcacgacattttgggcacacttgtggactgattcagagcatcagcaagcctgtcactagtcgttggttctagacttctagtgtgagatgcgtagtatcagattctgggatcaaaatccctaagaactct

SEQ ID NO: 4304 - DNA, 416 bp, Zea mays
  Clone ID: LIB143-023-Q1-E1-E10
caatctttcatgacccaacccagcaagtgttcgaccacgacatgctatcgaaggatgacgagatgggtgacgcagagattgacctgcagccgatgatcagtgcagctacagcgtttggcgaccctgatctgctcgcggacatgcagatcggcaagtggctcaggtccccagataatgcgctggcaagggacagcgccgtcaatgtcgttggtggcaaggtcaagcaggaggtctctctgaggctgcagaacgtggaatcgggggaggtggaactggagctggagtggataccactcaatcagtagagttcaaatccacctgtaggctatatgtgatgcatgtttcatgtgtgccacacaagtcctgatgctcttgatcatcttcagtttgtcagggtgcctgcagtgttgtagact

SEQ ID NO: 4305 - DNA, 403 bp, Zea mays
  Clone ID: LIB143-023-Q1-E1-E11
aaatctttcatgacccaacccagcaagtgttcgaccacgacatgctatcgaaggatgacgagatgggtgacgcagagattgacctgcagccgatgatcagtgcagctacagcgtttggcgaccctgatctgctcgcggacatgcagatcggcaagtggctcaggtccccagataatgcgctggcaagggacagcgccgtcaatgtcgttggtggcaaggtcaagcaggaggtctctctgaggctgcagaacgtggaatcgggggaggtggaactggagctggagtggataccactcaatcagtagagttcaaatccacctgtaggctatatgtgatgcatgtttcatgtgtgccacacaagtcctgatgctcttgatcatcttcagtttgtcagggtgcctgc

SEQ ID NO: 4306 - DNA, 413 bp, Zea mays
  Clone ID: LIB143-023-Q1-E1-E12
gctaggttcctcgtccgcctctctgtcctagtctcgtcagcaacagcacagtgttgttactgacgcgccttcactctgttgacctgcatctagccaagtttatttggagactccaacctttggtctcccaaacttggagctcccaaggggagaggttctgccaaaattttggcttctgagcatccattttcagggggaggttctgccaaaatctgctcctgtgaacatagatttctcaaggggaggttctgccaaaatttcctcctgtaaccaccagctttccagggggagattctgccaaaatttcctgcactgatcatcattcttctaaggggaggttctgccgaagttttcttgtgtgacgacgacgatcagtttccagggggagattctgccaaaattttctgcactga

SEQ ID NO: 4307 - DNA, 368 bp, Zea mays
  unsure at all n locations
  Clone ID: LIB143-023-Q1-E1-E2
agcaagcagaaggacctcccaattttttgttggtgagtccatgaaggatgatgcgtctgtggtattcgcctattacaaggatggtgccactaatccgacattcctctatttctctcatggtcttaaggagatcaagtgctangcgtgcggcgaaattagttacccatgttgggtactatctatgtactattattatatccaaaactatagttgtcctggctgaattgaactcaaaagggtttgtttgagaaaaaattgtcccaagattggattgcttgttaaagctcaatattgttattgaagtgttattgcttaaaaaaaaaaaaaaaaccaaaacaaaaaaacaggacacacacataccaaaagaa

SEQ ID NO: 4308 - DNA, 386 bp, Zea mays
  unsure at all n locations
  Clone ID: LIB143-023-Q1-E1-E3
agcgacagaggagacggccatggtggcagcgatggagctcgagatcctatgcatgaatttcgggtgcgtcctcgcggctctgtccgacgccaagatccccgacaagggctgcctgctcccgctcatctctaagctgctcggctacgccatcgtcgccgcatccaccaccgtgaagcttccccagatactgaaaattttgaagcatggaagtgttagaggactaagtgtggcatcctttgaacttgaggttgtcggctacacaattgctttggcatagtgtattcataaaggacttcccttttcagcttatggggagctagcttttctgttaatccaagcaattattttggttgcaatcatttactattactcancaccaatgggaa

SEQ ID NO: 4309 - DNA, 384 bp, Zea mays
  Clone ID: LIB143-023-Q1-E1-E4
atgggaacagcggaatggaaggcagcgaacagtcctgcttactataagcgtggcgactatgtgcctggattgaacgttgatggaatggatgttcatgctgtgaagcaagcgtgcaaatttgcacaacatcatgctgttgcaaatggcccaattgtccttgagatggatacctacacgtaccatggccactctatgtcagatccatgaagcacttaccgcaccagggatgacatttcaggtgtcaggcatgaacgggacccaattgaaagggttagaaagttgcctttggctcacgacttggcaactgctgctgaactcaacgatatggagaaagaaatcaggaaacaagtatatgacgccattgcaaaagcaaaggaaagttct

SEQ ID NO: 4310 - DNA, 255 bp, Zea mays
  Clone ID: LIB143-023-Q1-E1-E5
tcagaagtccaatgcagacagcgatggtaggagcgacggagctctagatcctatgcatgaatttagggtgcttcatcgcagctctgtcggacgccaaaatctccgacaagggctgtctggtcacgctcatcgcgaaactgttctggtagtcgaacgtcgtgagatccaccagggtggaacttcgatacgtattgctcagtttgaaggatagactggttacaggactaagtgtggtagcctttgagtttgacgttg

SEQ ID NO: 4311 - DNA, 279 bp, Zea mays
  Clone ID: LIB143-023-Q1-E1-E6
acgattttagtgggctgacccccgagaaatggctgcttggcgctgttggtgcggtgagggttgctgtgagaggcttgtcggcatcaggtagcctgttgagaccaccatcccaatagcagttttagtctcctcgccatttcatgaccacggcgacctgccttccacgatgtacattgctgcttgctattctgtgtaaagcaactgcttagcatgacaaagtaaatgagttcgttttgaaggaaaatccatggtaaatacaagatgttggtgtgattatat

SEQ ID NO: 4312 - DNA, 303 bp, Zea mays
  Clone ID: LIB143-023-Q1-E1-E7
agcgaccggagcacgaccgacggtccgttcgacgtgacggtatcgggcacgctcgatcacttcgtgtggcccgacggcacgaccgcgttgcccgcgctgtcgagcctcacgggcgggatcgcgacgcaggtcgaaagctggctggccgaacccgtgcgcacgcagccgtggggctgtatcggcggcacgttcgacgagaccggccagatcgcgctgccggccgacgtcgtcgtgaccgacctgccggccgatgcggccgtgcacgaccgcttcgtcgatttcacgtcgcattacgtgttcgac

SEQ ID NO: 4313 - DNA, 388 bp, Zea mays
  Clone ID: LIB143-023-Q1-E1-E8
accggggattgcttctctagtttatataaatctcaacgggaacgattctggatgtaattctacacaaacgaacaaggcccaaagaagaaatatgggatgccacgcgctttggtgcctagctccttgatgacttgatgacatagctacgaaggaaatagctttacatctcgctgttctaggcagcagaagtttttgtttgcactttgcaaaactgtatatccttctcagctgtctcattgtaacccattctttttctggtttctttcctttattttccagcttggagttcagattctttctttatattaactgtgaatagatagtacacatctgaggttctttgcatgcgaacagtattcgtatagtcaatataaaattgtccttataa

SEQ ID NO: 4314 - DNA, 262 bp, Zea mays
  Clone ID: LIB143-023-Q1-E1-E9
aagtaggtggccggaccgtggtggcatcgcgaattcaactccgcatctgaattggcattcggcagcgcgccaactgcataggacgagatggcgctcataacaatcggtattgctagccatgcggtcatcgggcagaaccttgccgtcaacattcctcagtgtgggtgtctcagctgtatgtacaacaagataagctcacatgtggactagaccgtgctccgtgccaaggcagaacgaaaccttcccgtccatccacttccat

SEQ ID NO: 4315 - DNA, 218 bp, Zea mays
  Clone ID: LIB143-023-Q1-E1-F1
gtccgaatagcaccctgccattagtagcacgcaggagagcagtggtagtaggtgccactcacacggttttcacggttgccggctgggagcgaccgacgagatcgtcgtcacgctcgatggaggccctgatggcgacgtactggtgtctggggggaccgcagtgcggggcgtgcggctggtcgccggcggctgcacactgccggacgtgtccgggcggc

SEQ ID NO: 4316 - DNA, 290 bp, Zea mays
  Clone ID: LIB143-023-Q1-E1-F10
acacgcgtccgcaccttgatcaggcctgatgggaagaagaaggcttacgtgaagctgactcccgactatgatgctcttgatgttgccaacaaaatcggcatcatctaagtgctgcattaggcatcctaattcatctgttgtgtcctagttctatgtgaaaccagagttttctagctatggctctcaatcgctccattaccatgtgttatgcacacttctgaatttgatatcatccaagtgaccttttgaactagtttgcgttctgcacttcattacacttggacaccgtc

SEQ ID NO: 4317 - DNA, 370 bp, Zea mays
  Clone ID: LIB143-023-Q1-E1-F11
agcatttgcgtggtggctgctgcacgcagctgggcgcggagtgcgtgggcacgttcatcctcatcttcttcgcgacggcggcgccgatcgtgaaccagaactacggcggcgcgatcagcccgttcggcaacgcggcgtgcgcggggctggcggtggcgaccgtcatcctgtcgacggggcacatctccggggcgcacctgaacccgtcgctcaccatcgccttcgcggcgctgcgccacttcccctggctgcaggtgcccgcgtacgtggccgtccaggcgctggcatccgtctgcgccgccttcgcgctcaagggcgtcttccacccgttcctctccggcggcgtcaccgtgcccgacgccaccatctc

SEQ ID NO: 4318 - DNA, 273 bp, Zea mays
  Clone ID: LIB143-023-Q1-E1-D6
aggccggcggcgccatggccatgaggctggacatgtccgcgctcgagaccaacttcgccaacctgaccgcctccgcctgtgacgacacgtacttctccgccgaggcccccgacatgccgttcatggtgctcgtcatctgcgaggacgtcgactgcttcaaatcggccatcaaggacatggtgaggactcagaaagggacgagcacgcttgccttcatcttcgagatcggcctacatcgtcgccactgattccagggccagcatggtcggttat

SEQ ID NO: 4319 - DNA, 359 bp, Zea mays
  Clone ID: LIB143-023-Q1-E1-C10
aggaggaaccagtagcggaggcttcgattttcggcgggcgcaataaatttcccgcatggctcggagggccgcgtcctcgctcgtctcccgctgcctcctggcgagggcccctgccggcgcgccgcccgctgccccctctgcgccgcgcaggacagtgcctgcagatgggatgcacaggctgttgccaggtgtccttcagaggttcagcactgcagcagcagtagaggagcccatcacgccgtcagtccatgtgaactacacaaagctcctcattaatgggaactttgttgattccgcatccggcaagaccttcccaactctggaccctcgtacaggggaggtgattgctcatgtggctg

SEQ ID NO: 4320 - DNA, 363 bp, Zea mays
  Clone ID: LIB143-023-Q1-E1-C11
cgcgtctgctggtctgccaagaggaggaaaggaaggagagagatggcttgccctgcgcagtccatgctctccgccagcggctgcatcttcctgaggagcaagcctcaggcggcatcccaagtgcgagggggcatcatcggcggtggccgcaacagcaggccgttcctgctcacctgcaacgcttcctcttctccgtcaccttcctcgccggcgccggcgcatgaagaccccgactgcaacgaggatgagtgcgccccggagaaggaggtaccgctctcctcctcctcccttcgccagctgtcttggaactctgcgtgcctcgttgcggcagcagtagtagatagatgcttacgccgttacagc

SEQ ID NO: 4321 - DNA, 360 bp, Zea mays
  Clone ID: LIB143-023-Q1-E1-C12
actcacaccgagacatctactcggatcagatctccaccgggcataagctccccatccatgaccaccttcaccgcgacctccctgctcgtactgacgcccgcggctgtgtccgtatcacagtttccaagaggcatcaacagatgtatgaacaacagaaggacgttccgtctcaggaacatcacttcctcttctcagtctccttccatgccagcgacttcccattaagacttcaaatgcaacgttgacgactgcacttcagaaacagatgtacttctcgcgtccttcatccatctccaactgtctcgggactctgcatgcctcattgctgcaacactgatacataaatgcttacgccgttac

SEQ ID NO: 4322 - DNA, 359 bp, Zea mays
  Clone ID: LIB143-023-Q1-E1-C2
atcgcccatgcagccggcctaagcccacagaccattctccatcatctactctcatccccacgatggtcgccgccgccacgacgccgcactcactcctcctccaacgcgccgcgattccgggcgcgccgtcgagggcgtcagccgacgccgctcccgtccgcctcccggtatgcgccgcaaggatctcgtgcgcggcggtggcggcgccatccacggccgcagccgccgcagatgactaagtggagcgcggcgtctataacttcgcagcgggtctagcgacgctcgctctctcagtgctcacgcgggcgcatgcggagctggtggacgacaacggctaccggatcagcatcgaggagatg

SEQ ID NO: 4323 - DNA, 152 bp, Zea mays
  Clone ID: LIB143-023-Q1-E1-C3
acaatgatacatcaccatgcagctctaaaccttatctgaagttagtttaaaatatggtttatgcaagtgttccagatatttcctacgatggattcgaggcttgtgctgaacttgtgctaccctgttaatagatctatgggaacgatgactgc

SEQ ID NO: 4324 - DNA, 345 bp, Zea mays
  Clone ID: LIB143-023-Q1-E1-C5
agacgagctcgatcgctccacttccccgatcgcacgccaatcagcaccagccaccgtggcgatgacggaggaggcggaggcgaaggcgaagggcaacgcggcgttcgcggccggccgtttcgaggaggctgtccagcacttcagcgacgccatcgcgctcgcgcccgacaaccacgtcctctactcgaaccgctcggcggcgtacgcgtcgctctggcgctacgcggaggcgctagatgacgccaagcggaccgtggcgctgaagccggactgggccaagggctacgcccgcctcggcgccgcgcaccttggcctcagtgacgcgcccaaggccgtcgacgccta

SEQ ID NO: 4325 - DNA, 312 bp, Zea mays
  Clone ID: LIB143-023-Q1-E1-C6
aaaaataagccaagtggaagtgaagcttatagctgtatatacaccgtacgtcgtcgtcgtcgttccggatcgatctcggccggctagctagcagaacgtgtacgtagtatgtaatgcacggagtgtggagctactagctagctggccgttcattcgattataattcttcgctctgctgtggtagcagatgtacctagtcgatcttgtacgacgaagaagctggctagctagccgtctcgatcgtatatgtactgattaatctgcagattgaataaaaactacagtacgcatatgatgcgtacgtacgtgtgt

SEQ ID NO: 4326 - DNA, 395 bp, Zea mays
  Clone ID: LIB143-023-Q1-E1-C7
atacctagccgccgccgcaggcggccccccatcgccgccaagatgcagatccttgtgaagactctgacggggaagaccatcactttggaggtggagtcctccgacaccattgacaatgtgaaggccaagatccaggacaaggagggcatccccccggaccagcagcggctcatcttcgccggcaagcagctcgaggacggtctcaccctcgccgactacaacattcagaaggagtctaccctccacctggtgctccgcctccgcggtggcgccaagaagcgtacgatgaacacgtacaccaagcccaagatgatcaagcacaagcacaagaaggtgaagctctccgtgctgcagttcgataaagtggacgacgccactggcaacgtgatccgcct

SEQ ID NO: 4327 - DNA, 427 bp, Zea mays
  unsure at all n locations
  Clone ID: LIB143-023-Q1-E1-C8
acccacgcgtccgcccacgcgtccggtccaagacattagagcttccatggaaggaagcagcacactagcaagccgagagtgactgactgcacctgtggtcatggaaatggaattggaaaccagtagcgttttgtatttgcctgttgattcttatatttatttttaggaagtgggggaatgtgtagcaactaggaagcgagggaacaacatccagttgatgtgaagcattcatggcacagtaggcaatagtggcaaaggggtactatacatacacacttacgggacgcacaacataaataaagaatggttgaataatanactatttattttggggacacnaccctaggatcaacccctacttgtttcgagtttgaatactgatttgtatcaacaggcaataaataatgcgctttgtaaccttttaaaa

SEQ ID NO: 4328 - DNA, 168 bp, Zea mays
  Clone ID: LIB143-023-Q1-E1-C9
aattatgggtgctctaaagacgcatctcatagaagacatactctaaagttgtatcttatagaagaaatttttcgggtgtttggtgtagctctagaggctagaactaatatttgctatatgaactttgggtctaaacttggcctatgaagatgtccatgtagcttgggg

SEQ ID NO: 4329 - DNA, 415 bp, Zea mays
  Clone ID: LIB143-023-Q1-E1-D1
caccgaagtgaatgttatggtgcagaattgtgttggccttgaactccaggattcgtcttactatctcgctcccagatgggtggcgatcttccgtcgtatttacaactggaggctagcaaagctctctaccggaaagttgtcagaagcttatgttctgactcagcacctgtatcaggctcctacagcagctggctcaaatggtaccacacaagggcttactgctaacaccgccagcagcgatgctgtggatcacatcatgatgcctgctgtttcaaccggcatcacactagacgaaatcattgagatcagttgtgacctcgatgctgttgatgcgcagaccgtaactctggcaccacgactgcctgtgcatgttcatgaagaacctcaggcacttgctgacaacaaccgcgtgcat

SEQ ID NO: 4330 - DNA, 418 bp, Zea mays
  Clone ID: LIB143-023-Q1-E1-D10
gtttatgccgcccacttctgctgcagaaacagtccgaatatgtgcttttccagccagccgtttgggattgcaagatattgggatcagtcccgattgcaatccagagaacagggctagcccaagacagctgtttaactgggctctggaacctgctgctgatgaaactctagacaaattatacgagcttgggtacctggacgcagctgtatgggctgagcagaattatgctgagcttatcgccaagaatgatcaatcccttgtcgctgattgaattgagttcagtttgcccagaagtaattttggtatccaaagctgagttcatgagaatccatgcctgtaatatattgtaaagatagcaccgtcattgtcgaaggtggcattgttctgcattggatttgggtgtttatgccagcatttt

SEQ ID NO: 4331 - DNA, 397 bp, Zea mays
  Clone ID: LIB143-023-Q1-E1-D11
ggcttgcgggcgatggcggcggagcagaccgccgagcagttccggggccaggcgcggctgccccacttcgcgtccccgcggcgctacgacctgcgcctcacgcccgacctccccgcctgcgtcttcactggctcggtggcggtttccatcggcgtggccgcgcccacccgcttcctcgtactcaacgcagccgagctcgacgtcgcgaccgggggcgtcagcttcgcgcctcagggctccgaccaggtgctacaacctttggaggttaccaacgtgccagaagatgagatcctgattattcgcttcaatgaggtgctttctatcggggagggaactttgacgattgcattcaagggggactttgaatgataagatgcatggattctacagaagtgtg

SEQ ID NO: 4332 - DNA, 286 bp, Zea mays
  Clone ID: LIB143-023-Q1-E1-D2
cactcgtccgccctctcatctggtccactacattaaagcttccatagactgagatagcagactatcatcgccgagagtgactgactgctcctgtggtcatcgtaatgggactcgaactcattaacgttttgtgtctgacggttaattcgtatagttagcattaggaactgggggaatgtgtaacaactatgaaaccagggagcaacatccagttgatgtgaatcattcatggcacattaggcaatagtagcagtggggtactatacttacacacttaggggacgca

SEQ ID NO: 4333 - DNA, 423 bp, Zea mays
  Clone ID: LIB143-023-Q1-E1-D3
atcaggacccctcgtcccctccagttgtggaggccgccactgcgccagcgccacagtgcccgtcgaccgccacctgcactctgcgccgcgcctgccgcctgcgccgctgcgcgcagcgcgcaagcaacgccgccggccgcccccacgcacgcaagcagctttgcgccctcgctttgcagcttgctccggcaatggcgctgatctctggcgctcccaacgaagacggtatcatcgtcgccggcttgtccaggcgtaaggtctgtgtctcacgccagaagcctactactgccactgctgcatcacccaagaaccagcgccccctgtgtctctgcctgttcctgcagctgccaaccgtaacactcggcgatcacctcttggttgtaagctaatttatttatgttctacatagttgatgacaaaact

SEQ ID NO: 4334 - DNA, 354 bp, Zea mays
  Clone ID: LIB143-023-Q1-E1-D4
gccggaattgccccaaccccaaccttcttcccccaacaatcctcccccaacaaaattaagcagggacggaatggctctcaaagcagcgtacaactacctgcacgtccccgtcgtccagtgcacgcccacacaagcagcagcagtcctcggcgtcctcctcctcctcgccatccggctagccgcggcggcgaggagctcgtccgcgacgtcccccaaatggaagcagcacaggctgccgccgacgcctccggggaagctccccatcatcgggcacctccacctcatcggctcccacccgcacgtctccttccgcgacctccacgccaagtacggccacaacgggctgatgctggt

SEQ ID NO: 4335 - DNA, 369 bp, Zea mays
  Clone ID: LIB143-023-Q1-E1-C1
cccacgagtccgcccacgcgtccgcccacgcgtccgcccacgcgtccgatggaagccgatcgtagacggggttcaccagaaaggagggatatttttctgtcagatttggcacgtatggagagtctccaattccacttttcagcctaatgggcaggctccaatttcaagcaccgataagccactaaagcctcaagtgagagccaatggtatagacgtggctactttcgcagttcctagacgcttagagactgatgaaatccctttggtcgtcaatgatttcagggtagctgctcgaaatgcgattgaagctggatttgatggtgtcgaaatccatggagctcacggttacctgattgatcagtttctaaa

SEQ ID NO: 4336 - DNA, 373 bp, Zea mays
  unsure at all n locations
  Clone ID: LIB143-023-Q1-E1-D5
aggccggcggcgccatggccatgaagctggacatgtccgcgctcgagaccaacttcgccaacctgaccgcctccgccggcgacgacacgtacttctccgccgaggcccccgacgtgccgtccatggtgctccccatctgcgacgacttcgacggcttccaggcggccaccaaggatatggtgaagaataagaaggggacgaccacgcttgccttcatcttcgacaagggcgtcatcgtcgccgctgattccagggccagcatgggcggttatatatcctcacaaaccgtgaggaaaattattgaaataaatccttacatgctggggacaatggctggaggtgctgctgattgccaattttggcatangaacct

SEQ ID NO: 4337 - DNA, 408 bp, Zea mays
  Clone ID: LIB143-023-Q1-E1-A2
atcaccaactgccattgccatctactgacctgtgacctccgcatttccaaacagcccgagcgagctagagctagcagagcggcaggcacctccctcctcaaggaacatggcccgcacgcagcagttggcagtagtggcgaccgccgtggtggccttggtgctgctggcggcggcggcgacctcggaggcggccatcagctgcgggcaggtggcgtctgccatcgcgccctgcatctcctacgcgcgcggccaaggctcggggccctccgccggctgctgcagcggcgtcaggagcctcaacaacgccgcccgcaccaccgccgaccgccgcgccgcctgcaactgcctcaagaacgccgccgccggcgtcagcggcctcaacgccgggcaacgccgccagcatccccc

SEQ ID NO: 4338 - DNA, 58 bp, Zea mays
  Clone ID: LIB143-023-Q1-E1-A3
gtagccgtcgtagaatcagagtcgacggacgcatcaaaccacgaagtggcggacgcgt

SEQ ID NO: 4339 - DNA, 81 bp, Zea mays
  Clone ID: LIB143-023-Q1-E1-A4
gtcgaggacgcgtccgaaaccaaaaatgttgagcagatcaggtgacccggaaatgcagtacttggaaattacacaaaaatg

SEQ ID NO: 4340 - DNA, 341 bp, Zea mays
  Clone ID: LIB143-023-Q1-E1-A6
agttatttgaaaagattaggttaccctgaattgcattcttcaaatttcctcgaccttgatttgttgtcgtcttctgggaattcctgtgacgaggaagtttttgagaggtcatcactgatcaattcacctatggatgtggtcagcgttgaatcatctacgtcgtacagtgaacaaggacacactgatgagggaagggatgacatggatctttcccgttcaagcagccaggtctcagacgttcgggactattctgaccggtttgcgcactgggtcgcggatggaggcatgctttggtaaaaggccatggacttttgtcttgcttgacaactcggtagaatctg

SEQ ID NO: 4341 - DNA, 399 bp, Zea mays
  Clone ID: LIB143-023-Q1-E1-A9
acacgtccgaatgtaatggctggttttgtactttcaagtgttgctaatcctgttggtgccgttagtgaattcattgctcagttgcagattttagagttgcttgacaatgctattttcactgccggctacaaagctgtgttgcatattcactctgttgtcgaagagtgtgagattgttgagctcatagaggaaattggcatgaagaaaaagaaagaagaagatccaaagaagaaaaagccaaagaggaagcctctttttgtgaagaacggtgcaattgttgtttgccgcattcaggtgaataacttgatatgcatagagaagttctctgatttccctcagcttggaaggtttacacttagaactgaaggaaagacggtagctgtaggcaaagttgttgat

SEQ ID NO: 4342 - DNA, 387 bp, Zea mays
  Clone ID: LIB143-023-Q1-E1-B1
gcgagaaacagacgcgtatacccaggcggcggttgaggaggaggagaagaagaagaagaagatggcttcctccgcgtacgcctcatggtccaagcggtggatccgtcccgaggtgtacccgctgttcgtgccgatggccgtggccctgggtatctgctcgtaccagcttgtgcgcaacatcacgggcaaccccgatgtgcgggtgaccaaggagaagagggcggccggcgtcctggacaaccacgacgagggcgagaggtacgccatgcacgggctcaggaagttcgtccgcgggaagaagcccgagatcatggcttccatcaactccttcttcgcccgacctcacaaggacgattaagccagattccgtcatggatggatgagtat

SEQ ID NO: 4343 - DNA, 406 bp, Zea mays
  Clone ID: LIB143-023-Q1-E1-B10
cggacgcgtgggttttttcttgccgccttgtctgtttttgttgcgtgcggtgcaggacgagtgggccgtgtgcaaggtgttcaacaaggagctgcaggcggcgaggagcgagccattattggcggcggccggcgcggcggagctcgagcgcgtgggctcgctgggcttcctcaacgagctcctcgactccgcggagctgccggccctcatcggagccgacgtggacgaggtgatcgacttcaagggccccgcgtccgtgtcggacgcgagctacctcccggtgaagatggaggaggagcacgcgctgctgcagatgcagcagtgccagtaccagccgccgcccccgatgttgtacccgagccagtacttctctctgccggcgatgaactccggccaactccccccg

SEQ ID NO: 4344 - DNA, 381 bp, Zea mays
  Clone ID: LIB143-023-Q1-E1-B11
acaagatctgccgctgccaactggggggcctcaccgccacccgttcttggaaaacagcacgctacttacttgacagtgaatggagatacgtgccgcgttgggattctccaactccaaccaagacgaacgatttcatcccactaatcctttttcttttcttttcgtttttatttttaatttcttggatcggttcttgatcacctgttcttccttatgaccttatccagaaaattagattatcaagtgcttctatttgtttgtgcatctcttgtttgcgcctgcgatatggaccttttttggctcctcaacaaaagacaagattagcctttcatgttggtagttacaacctgtggcgtctcttgttgtgcacgtgcattttgt

SEQ ID NO: 4345 - DNA, 413 bp, Zea mays
  Clone ID: LIB143-023-Q1-E1-B12
atggcatcagacactgcaacattgaccaacgtcgtacgaactatgtgacttcttacaacaacaacatcatctacaaatgcctttatatgtctcaagcactttggggtacgctatcgatgaaaccccgtatgataccctcaaagctcaacccccacttgaacatataagggatacataggcattcgagaaccgattccaactaaacggggaaacacataaaagatatacaacccacattgaccatcaagatgcatcatgatcacagaacgacacggtctaacaactgtgcatgatatacatgactagatacgtattctgaagtaataacttgcatatattattggtaataccgttaccgttcaatcacatgttgtgcacgtgcattttgtgtgaggatccaaacccccgacgat

SEQ ID NO: 4346 - DNA, 403 bp, Zea mays
  Clone ID: LIB143-023-Q1-E1-B2
caggacacgacgcagcgccgaagcacctaggatggcgcccgagattcagagcctgtgtccgagtacgacggccgcgctcctcctgctggccgcctgcctcgccgccgcggtggcagcgctcgacgctgcggactacgccaggccgccgctgcctgcaggcggaggcggccggcgcgtcctcttcgccaacgggctcgggctgacgccgcagatggggtggaacagctggaaccatttccagtgcgacatcaacgaggcggtcgtccggagcaccgctgatgcgctcgtcgccaccggacttgcaaaggctggctacacgtatgtcaacttagatgactgctgggcggattccgagagaaccaaagagggatacatggtcgctaaccccaagacattcccatca

SEQ ID NO: 4347 - DNA, 333 bp, Zea mays
  Clone ID: LIB143-023-Q1-E1-B3
gagaacccccaaaaggtgccctttaaggactaaggaacgtaaaataagccacaaccaaagaaggaaaaggggaatgcccggatccggcccattaagcaagactgggaaccggttggttttccgaaaaaaggacccaccgccgctgccaagaaagatgagaaggccgtcaacgccgcgcgccgctccggcgccgaaattcagaccatgaagaagttcaacgctggtattaacaaggcggcgtccagcggcacatccctcaacaccaagcgcctcgacgacgacacagagaacctcgcccatgagccagttccaagtgacctgaagaaaaatctc

SEQ ID NO: 4348 - DNA, 383 bp, Zea mays
  unsure at all n locations
  Clone ID: LIB143-023-Q1-E1-B4
gttccaaaaatttaacttagtccgagttggaaccaaaaggataggccaaattgaaggtatttccacaaattagcccaattatggatgttcnaaggcatcaaatttcagtgtgtactgcaatacttgggtccacctgtacttggtttaagaagcgctccgcggacttccacggccgcgcatccgatctcgtccacggtctccggggcacggcgatgcccaggagacaagccctcaatgaagagcagtgcacacaacagaaaggtatctcgactattccaaagcacaagtatgcatccatagcctgttccccaatagaaattgtgcaagattcaaaagaacttcaacctgaaccagcgagagtatcgatacaaagactgtttgaa

SEQ ID NO: 4349 - DNA, 419 bp, Zea mays
  Clone ID: LIB143-023-Q1-E1-B5
acagttctatatttacaaagaggccagatattatttttaagtggctcgggccccatggtagtgattgtggcatagtgaatgtgaacatacctactaatggtgctgaaattggtggagcatttggtggagaaaaagcaactggtggtggacgagaagcagggagtgattcctggaagcagtacatgaggagggcgacttgtacaatcaactatgggagcgagctacctctagcccagggaatcaattttggttaatcctgcagaaatgttgcgcgtggatctcggtgttttctgcagacgtggatgccgtacggaaagaactgatgcaaccgcatttgagatctcagcagacttgagcagcatttattggcgtcagttgtgaaacttaaactgcacgagcatcttgtacataaataaaat

SEQ ID NO: 4350 - DNA, 399 bp, Zea mays
  Clone ID: LIB143-023-Q1-E1-B6
aaattttcagagctaatggcgatataaatggacttaaatcacactgtaatagtcagattgagggagtcatggaaatgtggaacaaaaacgaggaattccgcaagcagtatgttgagtcaaataaggttagcacactaaagagattagggacccatgatggacggaaacttggccctgatgaggaccctccagtcatatcaagcagaagaccaagcagcatctatccattgtctgcctcaagcccgggagtggccactttagcttcaataccagcacctgtggtagctgctccagctgcagtctctgccaaagaggactcctttcctgttttggaagccccccagaccagcaagcgcaccaagtcaaaagcatctgatatctgtgcccaagacgagaaca

SEQ ID NO: 4351 - DNA, 357 bp, Zea mays
  Clone ID: LIB143-023-Q1-E1-B7
gcaacagccaagtgcaagtgatcgagctcccccctcctcatcagtcgctaggcacagcgcacttgcaggatggcgcaggtctctaagacgcttctccttgtggccctggtgttcgtgtcgtcggcggcggtggagctgtgccgcgcgatcgacttcgacgagcgggacctggcgtcggacgaggcgctgtgggacctgtacgagcggtggcagacgcaccaccgggtgcaccggcaccacggcgagaagggccggcggttcgggacgttcaaggagaacgtgcgcttcatccacgcgcacaacaagcgcggcgaccggccctaccgcctccgcctgaaccggttcggcgacatgggg

SEQ ID NO: 4352 - DNA, 411 bp, Zea mays
  Clone ID: LIB143-023-Q1-E1-B8
agcgcatcgcggcatcggcatctccacaacgccctctcacgctcatgcccacggacacttcacctcgcgccgccgctcggtggagctcagcgtctccgctcgcgccataccctgtataatcctcaatggctgccgcaaggggcattaacctgctcctgaagagaactcactagaactagtctgctggttcgtcgcagcttttctcatttcggggaaagcatgaagaatcctctgctggactgagagcattggctcttcttggagttagtgcctctgagtcttttgactttatctacactaacatctgctgatgaaactgaccatagcttggcagcctcagattatccctggacatatggcgggatcatgagctcgtatgatcacgcatcaattcagcatgggcatcaagtt

SEQ ID NO: 4353 - DNA, 400 bp, Zea mays
  Clone ID: LIB143-023-Q1-E1-B9
agcggcggcgcgggcggacaaggagcaggcggaggaggagttgtgccaagccacaatgggtatctcgcgtgactcgatgcacaagcgccgagccaccggtggaaagcagaaggcctggaggaagaagcgaaagtatgagcttggtcgccagccagccaacaccaagttgtcaagcaataagacagtgaggatggtccgtgttcgtggaggtaatgtgaaatggagggctcttcgccttgatactggtaactactcatggggaagtgaagctgttacgcgcaagacccgtatcctcgacgtggtctacaatgcatcaaacaatgagcttgtgaggacacaaacccttgtgaagagtgccattgtgcaagttgatgctgccccattcaagcagtggtacctc

SEQ ID NO: 4354 - DNA, 400 bp, Zea mays
  Clone ID: LIB143-023-Q1-E1-A12
cagcgtcgcatcctacgatccaaagctctctctgctcgcagccatggcgaagaactacccgaccgtgagcgccgagtacagcgaggctgtggagaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaaggaggagttcccaatcctcgcttacgccgatttctaccagctcgcgggagttgtggccgtggaggtcaccggtgggcctgagattcccttccaccccggtagg

SEQ ID NO: 4355 - DNA, 325 bp, Zea mays
  Clone ID: LIB143-001-Q1-E1-H7
cccacgcgtccgcggacgcgtggggaacttcttcaagctgccggccaccgacgccaagcccaaggccgccaagcccaaggcacccaaggccgcgcccaagcccaagccctcgccgaaggcgaaggccaagaccgctgcgaagcccaaggcggcgtcgcccaagcccaaggccaaggccaaggccaaggccaaggccaagcctgtcgctcctgccgccgcgtcgcccaagccccgcgggcgccctcccaaggtcgccaagacctccgccaagggctcccccgccaaggcagccaagaaggccggtgctcctgccaagaaggggaag

SEQ ID NO: 4356 - DNA, 343 bp, Zea mays
  Clone ID: LIB143-001-Q1-E1-H8
gttagattcatggcaagggagatacagatattaagaagacttgatcatccaaatgtcatgaaactggaaggtttgattacttcccgactatcatgcagcctttatctagtatttgaatacatggagcacgatcttgctggactttgctcctccccggacatcagattcactgaagcacagctcaagtgctacatgaaccagttactgtcaggactggagcattgtcattcacgccgtgtggttcatcgtgatatgaagggcgctaatctcctcgtgaataacgaaggggttctaaagatagctgattttggacttgcaaatttctttgatcccaacaaaaagc

SEQ ID NO: 4357 - DNA, 464 bp, Zea mays
  Clone ID: LIB143-002-Q1-E1-A1
ggaaccggccgagaatcccggggccaaccaagcctccgaggaacggcaacaactccggaaggaaggctccaacggtccaacaactccaacccggtccaacttgctccggtaacaaaaccaacccgggccaacgccgaagcaaccccccctccgtcctcgccagatccggcgccgcctccgccctcacttacactagcacgcacggcggacacgtcgcctcccccgcgcgatctgatgcaggcgcacgcggtggccaacggcgatgcggtggaagcttaactcctccgtctacaagcgcgtgccgtccagggaaaccgccatggaacccgacgtcgagacgccaatgagaatgacggacggcggcggcagcggcgccgggccgtcctggcgcatgtcgttgccgcatgtctgtgtcgccacgctcacctcgttcctccttggataccaccccggggtggtgaacg

SEQ ID NO: 4358 - DNA, 377 bp, Zea mays
  Clone ID: LIB143-002-Q1-E1-A2
ccgcagcgaacgagaaagcagaccaacctagccacccagggagaaaggccaaaagggaggggagagtgtcgtcatgggttccattgtcgcttccaggatggccgttcctctagttcgcgctctggagaagctcatcgcaacgtcctccgcgcccgggactggctccgccctcaggccggttgcagtcgccggcggcctccgtggctacaacaccggcgctccgctccgacgctacgatggggccgagtccgaagacgatagcgtccgcgagtacgatgggcggcacggcggccgggactacgccgtgcccagcctgttctcagatattttccgtgatccgcttagtgcgccgcacagcattggccgcctggtgaaac

SEQ ID NO: 4359 - DNA, 356 bp, Zea mays
  Clone ID: LIB143-002-Q1-E1-A3
ccccaatttcgtccctttcacaccggagaacgggcgagcagagccgcgcaaagcagaacgcggaagcaagaggaggcgatcgactactcgaccagccctctccgctcttgtctccgatggcggctcgcgtcctcgcggccctcgcccttgccctcgccctcgccctcgtcgccgtacccgctcccacgcgggcgtccaacgacgagggggacgcgctctacgcgctgcggcagcggctgtcggaccccaacggcgtgctgcagagctgggatcccacgctcgtcaccccctgcacctggttccacatctcctgcgaccaggtcggccgcgtcgtccgcctggacttgggcaactcc

SEQ ID NO: 4360 - DNA, 372 bp, Zea mays
  Clone ID: LIB143-002-Q1-E1-A4
agccagtggcgacctccagctccagctccagctccacacgcgggcgccaccaaggagctgagccgagcccggcactgtcggcggccatgtccgcgccgcgtcgccgcatggccactgcctccccgtcgctccgcttcctcggcctgctcaagcaagccgacgacgccagctcccagtcccacggtgtccaggagctggagctcgactagcgcgacgtcgtctggtcctccggcagcgcgacctcctcgtcctcgacatccgcggcctcctcgccgtccccgaccgcgtccccgagcgccagcctcgggaggccgatttccgccacgtcccggccacttctccgccggcagcatggggctgtccgcgctcctc

SEQ ID NO: 4361 - DNA, 424 bp, Zea mays
  Clone ID: LIB143-002-Q1-E1-A6
agccagccatgccggggcggcgggcgatcgaggtccggcagctgctgccggccggcggtgacgccgcgacgccgaggtggcgcatgtcgctgctggagaacacgttcagcgggttcgtgcagggcgccggcgccgaagccgtgttcgcggatgggtccctgttcagcccgttcctgttcggcaagttctttgacccagccgacccgttcccgctgtgggagttcgagccggacgtgctgctcgccgcgctgcgccgcggcaacgccaggaccgccgtcgactgggccgagaccgactccgagtactacctcacagcctacgtgccaggtggaaggagatgcgacgtggaggtgagcggggacgcgatgaacgtggtcgacatcagcggcctctggcgggcgccgccggcggacggccgggactg

SEQ ID NO: 4362 - DNA, 409 bp, Zea mays
  Clone ID: LIB143-002-Q1-E1-A7
aggtggccggacggtggtggcatcgccaattcaactccgcatctgaatcggcactcggcagcgcgccagctccatagtgtaggaggaggagatggcgctcacaagaatcggtcttgctggccttgcggtcatggggcagaaccttgccctcaacattgcagagaaagggttccccatctctgtgtacaacaggacaacctccaaggtggacgagaccgtgcagcgtgccaaggcagaaggaaaccttcccgtctacggcttccatgaccccgcgtcctttgtgaactccattcagaagccacgggtggtgatcatgctcgtcaaggccggcgcgccagttgaccagaccatcgcgacgctcgcagctcacttggagcagggcgactgcatcatcgaatgggggaacgag

SEQ ID NO: 4363 - DNA, 395 bp, Zea mays
  Clone ID: LIB143-002-Q1-E1-A8
cgaccctggatctccaaccccgattttccccagcagaagcaaacccgagcaaattgagcgcttgaagcttcacccggcgaagcagaatcgaatcggagccgcacgccacgccgcgatggggatcctcctccggtccctcctcgtcgcctcgctcgtcctcagttcgctcgtcttgcacgtcgcagcggctaaaactatagatccttacaaggttctaggagttgacaagaatgctagccaacgggatattcagaaagcctttcacaaactttctctaaaataccaccctgacaagaataaaggaaagggcgcacaggaaaaatttgaagaaataaacaatgcatatgagatcctatctgatgaagagaagaggaaaaactatgacctctacgggg

SEQ ID NO: 4364 - DNA, 258 bp, Zea mays
  Clone ID: LIB143-002-Q1-E1-A9
aacacgcgtccgcaacctcggcaccgactctgccgcctcaggcgaggcaaaccgccgagatgtcgccgtgtcggagcgctccgcccccaatcgccgctgggcatggcgagacctccgcgacttcaccccgttcagcctcgtggacggtctcgggagcgcgctgtcgcaggtggcggagaccctgggccgcccgctggagcgcctggcgccgtcgcggctgctgtcccggaaggtgcccgaggacaaggcccggtcccg

SEQ ID NO: 4365 - DNA, 392 bp, Zea mays
  Clone ID: LIB143-002-Q1-E1-B1
attaattattgaggacacaggtgtcggaatacaactgcaagcacaaaatcgggtttttacaccgtttatgcaggctgacagttcaacttcaaggaattatggcggtactggcatcggtttaagcatcagcaagtgtctagctgaacttatgggtgggcagataagtttcaccagccatccttctgttggaagcacgttcactttctcagccacactgaagcactcatacaaagatatttcgggtgattcaagtaggagcttgacagaggcactaccaactgcttttaagggaatgaacgccatcttggtagatgggagacctgtacgtagtgctgttacaagatatcacctcaagaggttgggaatacttcttcaagttgtgaacaatatga

SEQ ID NO: 4366 - DNA, 351 bp, Zea mays
  Clone ID: LIB143-002-Q1-E1-B10
ggcgacggtgaaggtgatccccaacgcggggcacctgccgcagcaggaggacagcaagctcttcaaccgagtcctcctcgacttcctgctgcgcccttcgtccaccgccgcctgacctccaacggcagcgcccaagccaaacagcttagcttgctcggctgccttcttctttggttatccattatcatcctgccgcgcgcgtttccggcgttcttgtttgtttgtagagtggaggaggcgctgccgccttctgtttttgtttgagggtggcaatgtgcagaccctacctgtttggttgtgctgtgaaaaaaagttgctgtgggctgtggaaaaagattttatcattatttt

SEQ ID NO: 4367 - DNA, 346 bp, Zea mays
  Clone ID: LIB143-002-Q1-E1-B11
ggacatgccgcggaccagggaagggttctaccgcttcagggggtccgtggcggcggccgtggtccggggccgcgccttcgcgccgcacgccgacgtgctgtggatggagaggtccagccccaacgtggccgactgcaccgccttcgccgagggcgtcaaggcggcgtgccccgaggcgatgctcgcctacaacctctcgccgtccttcaactgggacgcgtctgggatgacggacgccgagatggccgccttcatcccgagcgtcgcgcgcctcggctacgtctggcagttcatcacgctcgccgggttccacgccgacgcgctcgtcaccgacacgttcgcgcgg

SEQ ID NO: 4368 - DNA, 416 bp, Zea mays
  Clone ID: LIB143-002-Q1-E1-B12
atcctaaaaccctaacccctagccagcgctccgccgccatccgccggcgagatggcgttgtacctgctgttcgagtcggcctccggctacggcctattccatgcgtacggtatcgatgagatcgggcagagcgttgaggccgtgcgctcctccgtgctggacctcgaccgcttcggcaaggccgtcaagctcactgccttcaatcctttctcctctgccgtcgacgcgctcaaccagtgcaacgctatctctgaaggaatcatgaccgatgagttgaggagcttcctggagctgaacctgccgaagcctaaggaggggaagaaggccaaatacagcctcggcgttgtcgagcccaaggtccggtcccacatctccgaggtcaccggaatcccctgtcagagcaacgagttcgtcca

SEQ ID NO: 4369 - DNA, 386 bp, Zea mays
  Clone ID: LIB143-002-Q1-E1-B4
ccggcgaggccgccaagctcgcgcggtacaacaagaagcccaccatcacctcccgcgagatccagacctccgtgcgcctcgtcctcccaggagagctcgccaaacatgccgtctccgagggaaccaaggccgtcaccaagttcaccagcaattgagcagcctgcagcgtccacggatttgttaggtctccccttcttacaagggttcttcgtcgtgtcctctacccctccccgcctatgtatgtgctgtgaaatcgttgatgttctcgtcgggtgaacaaaggccagtagctagcttgcctgcttcataaatcgtgccggattgtaatgggcctcttagatttgacgcccctaatttgggaaagagttgtaccggtggcttcccgg

SEQ ID NO: 4370 - DNA, 286 bp, Zea mays
  Clone ID: LIB143-002-Q1-E1-B5
acggacgcgtgggcggacgcgtgggcaaggcaccacacctcttcttcttcttcctcctcctcctagcacagctagcgcctgctccccttcgcctgtgatcatgtcttgcagcaacggcaagtgcgactgtggctccagctgctcctgcggcagctcatgcaactgcatgtcccctaacgtggagaccgccgccgccagcaacatcaagaccacggtcctcgccgcgccgaccaacaagggcaacgccgggcggttccaagccgccaccgaaggcggcggctgcgac

SEQ ID NO: 4371 - DNA, 92 bp, Zea mays
  Clone ID: LIB143-002-Q1-E1-B6
aaaaactacagtacgcatatgatgcgtacgtacgtgtgtatagtttgtgctcaataaaaaaaaaaaagaaaaaaaacaacgaaagagagaac

SEQ ID NO: 4372 - DNA, 346 bp, Zea mays
  Clone ID: LIB143-001-Q1-E1-H4
aggcatgttgtctgttctaatgcctgttctctgcgaactatctttgtctgtttcggtggaggctgccggcgtgaagcactggccaccgggtgctgcacgtcaacggccaacagggggcaccgtgcaggtgggcagaaacagccagcgacaacagtagggcacagggatgtatatggaccttccacatacactagacttttgcaagcaaccaaagatactctcagataataagttcaatgaatcaaaaggaaaactggtgtctgatgagatcatcataaatctgctgtcaagacgcctggaagagggagaagaaaagggtgaattggggttcatccttgatggcttt

SEQ ID NO: 4373 - DNA, 371 bp, Zea mays
  Clone ID: LIB143-001-Q1-E1-F6
cctagagcagccaagaaaagcacatacccgagtcgccgaaacaacaacaatcccaatcccccctcgtcactcaaaactcgaccaacaatgtcgctgattcgccgtggaagcgcattcgaccccttctcccttgacctctgggaccccttccagggctttcccttcggctctggaagcagcagcagcagcagcctgttcccctcgttcggaggcaccaccagctctgagacggccgccttcgccggcgctcgcgtcgactggaaggagacgccggaggcgcacgtgttcaagaccgacgtgccggggctgaagaaggaggaggtgaaggtggagctggaggacggcaacgtgctccaaattagccgggaacg

SEQ ID NO: 4374 - DNA, 360 bp, Zea mays
  Clone ID: LIB143-001-Q1-E1-F7
cgttcgttcccaggacgagtcacagcagccggccagccgcacagagtggtggagcctaggaacagaggaggcgccgagccatctccgcagcctgcgaccggggaacgggcgggaacggacttctaacttagagagagcgcgggcgagagaggtcaaccgcagccggaggcgatggaggtggtggcgctggtgagcggcggcaaggacagctgcttcgccatgatgcgatgcatggactacggccacaaggttgtcgctttggctaatcttatccccctcgacgacaccgtcgatgagctcgacagctacatgtaccaaactgtggggcaccagattgtggtgagctacgcgaaatgcatg

SEQ ID NO: 4375 - DNA, 331 bp, Zea mays
  Clone ID: LIB143-001-Q1-E1-F8
agcagttacactcatggaatctacacttcagctgtcaaatattgaccttatttttgcatacacgatcaaaggaaaaacaggcagttccatgagagccacatcatttgttcagaatgatattctgagtccaacccttgatgatgctgtgaatttactaggtgactactcgacatggttgagttctagcaatacccgcgaagcaaatgtatatttggagtgtttctgtgaaagatgggatgcactggttgctccggaagaaagggctctgttagatccaaatgggcttgttaatgaaggggagaaactcaccataaaggcactggaaggcttc

SEQ ID NO: 4376 - DNA, 129 bp, Zea mays
  Clone ID: LIB143-001-Q1-E1-F9
aaaaaaaaaaaaaaaaaaaaaaaaaaaaaaaaaaaaaaaaaaaaagaaaacaaaacaaaaagataaaaaacataaataaacataaataaaaagataggaaatctgcgcgaggggcaccaactttcggtt

SEQ ID NO: 4377 - DNA, 342 bp, Zea mays
  Clone ID: LIB143-001-Q1-E1-G1
ctctgccccaggccagaatcaagggagggtgaagcaccgccgctgaccgctgtccccggctccccgccgccgcacaaagacgagaggaagaggttcccggcggcgccacgactatgtcgtcgatgatgaacgcgctggcgaactggctggcgaacccgcgccgcaacccgctggcgcgcctccacatgcacgccgtctcctcgcgcctcaggaaatacggactgaggtacgacgacctctacgacccctacttcgatctggacatcaaggaagcgctcggtacgctgcctagggaggtggtcgacgcccgcatccagcgcctcaagcgtgccatggacctct

SEQ ID NO: 4378 - DNA, 414 bp, Zea mays
  Clone ID: LIB143-001-Q1-E1-G12
ccaatttgcaggagaactggagaatagtagatttcttctctcaccacccagagagcctacacatgttcaccttcctctttgacgatgttggcatcccactcaactacaggcacatggagggctttggtgtcaatacctacaccttgatcaacagggatggaaagcctcaccttgtgaaattccattggaagcctacttgtggtgtgaaatgcttgctcgacaatgaagctgtgactgttggaggcacctgccacagccatgcgacgaaggatctatatgattccatcgcagctgggaattaccctgaatggaagctctacatccagactattgatcttgaccatgaagataagtttgacctttgacccccctcaggtcaccagaacctggcctgaggatatcatcccgctgcag

SEQ ID NO: 4379 - DNA, 363 bp, Zea mays
  Clone ID: LIB143-001-Q1-E1-G2
atcttgttcaggacatggatggagttacccatgtgatatctggagtgttggttgtattcttgttgagctttgcacgggtgaggcgttattccagactcacgaaaacttggaacatctggctatgatggagagagttcttggacctttgccgtaccatatgcttaagagggcagatcggcactctgacaaatacatcagaaaaggacgcctgaattggcctgagggttgcacctcgcgggagagcatgaaagctgtgatgaaattgtccaggcttcagaatctggtgatgcaaaatgtggaccaggctgcgggagatttcattggtcttttgcaagggctcctgaagtatgacccaacaagccg

SEQ ID NO: 4380 - DNA, 386 bp, Zea mays
  Clone ID: LIB143-001-Q1-E1-G3
agaaaaggtcctcctttctactgtataactgcatgtatatctcttaacttaattttctgtttggatctgcagatcggctggtacgcacactgacaagaagaaataaagcatttcaagttcatgaatgtggcagccagagattatcaactgtgttttttccctacctctagaaactagacatggcaaagtatttttgaccgaaacattgtttgttagtaatgtattgaaccacctcgtggtattttgccccaaaaaaaaaaaagttgagagagaaagggaaacagatggaaaaaaagggaaacgaagctggaagggagaagtcaatagtaccgagcggagaatcaagaaagatgctaccaaaaaaaaggggggggcgccccaaaggg

SEQ ID NO: 4381 - DNA, 239 bp, Zea mays
  Clone ID: LIB143-001-Q1-E1-G4
agcccacgcgtccgcaccactctacgcaagcaatccttcggacttcggtgggggaaatggaggccgccgccgccgccgagacggggctcgcccagaaaccggttgtgctgtacccttcgccggggatgggccacctggtctccatgatcgagcttggcaagatcctcggcgcgcggggactgtccgtaataattgtcgtcgtcgagcctcccttcaacacgggcgctaccgcgcctttc

SEQ ID NO: 4382 - DNA, 348 bp, Zea mays
  Clone ID: LIB143-001-Q1-E1-G5
caaagcgatactagctagtccctaccaaagcatacttcctgaaacactcttgcaatccactgagttctgtttgttgagacgcatagagctagagtcgacaatgtcgctcgtgaggcgcagcaacgtgttcgaccccttctccatggacctctgggaccccttcgacaccatgttccgctccatcgtcccgtcggcgacctccaccaactccgagactgccgccttcgccagcgcccgcatcgactggaaggagacgcccgaggcgcacgtgttcaaggccgacctccccggcgtcaagaaggaagaggtcaaggtcgaggtcgagggacggaacatgctggtcatcag

SEQ ID NO: 4383 - DNA, 341 bp, Zea mays
  Clone ID: LIB143-001-Q1-E1-G6
acggtctagaatccgggtcaacagcgtcagcaccgtcgcacatctagcagcaaccttcgacgtcgtggggaaatggacgcccccccgccgccgagaaaggggtcacccagaaaccggttgtgcgggtaccctccccggggaatggcccaccggtcctcaataatacagctgggcaagatgggcagatcgcgacgactgtccgtaatcattgtcatggtccagcctcccttcaacacgggcgctaccgcgccatacctcgccggcgtctccgcagccaacccggtccatctccttccatcacctgcccaaagtcgagcgcctcccgcccgtcaagaccaagc

SEQ ID NO: 4384 - DNA, 377 bp, Zea mays
  Clone ID: LIB143-001-Q1-E1-G7
cttctccacgccgctcagcctcctctctgtttcagccgtggagcatcagcaatccacatcatctcccttggccgagcggttcccttgcggcgcccaggatccttcccagacgcgctcggctccctggtctgtcaccttgccggcgttcccctccacctagcatgcccgtcaggccctctcttcgccaccctgccatggagctcgtcccatgcccaacgccggccaacctcacttcccatggtcgtcccttcctccttcctccctatggtcgacggcctcaccttccatggcttccaagatctgctcaacatccattctagcgcgcacccctgcttccgtttcctggtggccgacgccccctccctggaactcgcccc

SEQ ID NO: 4385 - DNA, 351 bp, Zea mays
  unsure at all n locations
  Clone ID: LIB143-001-Q1-E1-G8
gaccacgcgtccgagaatgccaccagcatgcatttacaggctttgaggagattgacggttccanattctacanggccacaccatccaacttggcaatgggtcagttacaaccggcttactggccgggaccggtccaaagaagattaagataacctggcaatcaatccttccgctcacagaggaaaggagatatgaggcatgacctttgatatacaagagaaagaaagaggaagagaggatttgtttcttgacaagctaagcatgacgcctccaggccaactagacaagcgtgagagaagaagttttagtatgacgcggaaggcagcaaaactggatctgaacatcaatgat

SEQ ID NO: 4386 - DNA, 414 bp, Zea mays
  Clone ID: LIB143-001-Q1-E1-G9
gcaagggtggcgacgtctctagcaacaagcctcaggacatcgacgggttggtggactgttcgagaagcagcccgggcagtgctggcaccagcgcagcttcaggaaaggtgcagacgtcgtctccgaagctaccgcacaagcagtactccttcgtgtcggactccggagaggagagcgatccggataagctggtggagagcgtcttggacagcctgcagaaagcacggggcggctcgaagctgcacaactgagcgtctgctgccatcgaattattgtttttgcaacctaacgagtcgtgcttatggtggtggccatggctgactgtcaaggacagcggcgcctgcaagcatcaacccgaaaaaactgttgattaaacctcgtcttttacttggactaggccgtagtacaatcgga

SEQ ID NO: 4387 - DNA, 351 bp, Zea mays
  Clone ID: LIB143-001-Q1-E1-H10
gcgttcctcaacatgaagaacgattacaaggatggaacgttctcacaggtcgtgtccaacgccctcgacatgaagctcagggacgacctcgatacgctcacgaagatcaggaaccaccgtggtctgcgtcactactggggcctccgtgtccgtggacatcacaccaagaccactggcaggcctggaaaaactgttggtgtctccaagaagcgataagctacatatctatcgacaaatctcagatgtactagtgttggttcatgttcaaactgtcttgactaacggtttctgttgggacagtttcctgaaattatgttttgccctagggtaatcttgcagttatggaacctt

SEQ ID NO: 4388 - DNA, 343 bp, Zea mays
  Clone ID: LIB143-001-Q1-E1-H11
ctcacgccgccgctaccgctctcgctgccctcctcctcgtcctgtgcctcgccgccgcgttgacccgccacggcagcggaatctgccagcaggcggggaggacgccgacgaggaagatgctgctggccatgacaagcttcgacgacgacgacgctgccgcctcgccctcggcatccggtcatcaccgccatcctcaccagcaccaccagcaccaccaccaccaccaccaccacgcgggcaggcggcgatggaaccggcggcaggggaccattccaccaccgtcagatgctggcgaggccgaggcggtcgacccgcgctacggtctgcacaagcggcctggttc

SEQ ID NO: 4389 - DNA, 259 bp, Zea mays
  Clone ID: LIB143-001-Q1-E1-H12
tctccgctgcttactcgaactgcgcgaggaagccatcctgatatctctgtcgtcatccccatcctagtatcgtagaaaccacctgcattttcatttggatctccctaatccctccggctagctgctttccagtgagcaagggatatcaaaggacacttcccgtcttcctcccgtggctgtctgtcatctggctctgaaacgatggcagtcctgcaaattactgctgctgcctctccccctgtctctgtgagtgggttcg

SEQ ID NO: 4390 - DNA, 377 bp, Zea mays
  Clone ID: LIB143-001-Q1-E1-F5
ccacaacagcgaaggagaaagcagaccaacctagccacccagggagaaagaggccaaaagggaggggagagtgtcgtcatggcttccattgtcgcttccaggagggccgttcctctagttcgcgctctggagaagctcatcgcagcgtcctccgctcccgggactggctccgccctcaggccggtggcagtcgccggcggcctccgcggctacaacaccggcgctccgctccgacgctacgagggggccgagtcggaagacgatagcgtccgcgagtacgatgggcggcacggcggccgggactacgctgtgcccagcctgttctcagatattttccgtgattcgcttactgcgccgcacagcatttggccgccctg

SEQ ID NO: 4391 - DNA, 371 bp, Zea mays
  Clone ID: LIB143-001-Q1-E1-D3
gagcctggaggggcggtacgacgtggtggtgtgcctggacgtgctcatccactacccgcgggaggaggcgcgcgccatgatccgccacctcgcgtcgctggcggacaagcggctgctcatcagcttcgcgcccaggacgctctacttcgacttcctcaagcgcgtgggcgagctgttcccgggcccgtcaaaggccacgcgcgcctacctgcacgccgaggccgacatcgaggacgcgctccgccaggccggctggcgcgtcgctaaccgcggcttcatctccacgcagttctacttcgccaagctcttcgacgccgtgcccgtcggctcctcgacgtagccgtgtaggccgcccgccgtgtgcctgtgtg

SEQ ID NO: 4392 - DNA, 355 bp, Zea mays
  Clone ID: LIB143-001-Q1-E1-D5
agctgcatcagcgtatcagcacttagggtctactattgttattggtgtagccaagggattgcaaatgggaaaaatggtgtaaaaacgctgcatatttttttttgcctaagctacagctgtgctacagcaaattttgattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaacaaaaaaaaaaaaaaaaaaaaggggggggccccccaaggattccaacgttaagtaccgcagaaggaaagtgaaagacccccaaaaggggcccc

SEQ ID NO: 4393 - DNA, 372 bp, Zea mays
  Clone ID: LIB143-001-Q1-E1-D7
ggaaagctccgacaagctcctggggagttgcctactcttaatgattgggagaaccatctaacaacaatttttcctgaggttaggttaaagagataccttgagatgagaggtgctgatggtggcccatggaggagattgtgtgcgctgcctgcattttgggttgggctgctgtacgatgaggaatcattacaaagcattttagacatgacttttgactggacacaggaggaaagagagatgctaagacataaggtaccgttgactggtctgaagacaccatttcgcgatggatatgttagagatttagccgaggaagttctaaaactggccaagaatggattggaaagaagaggatacaaggaggtccgtttc

SEQ ID NO: 4394 - DNA, 412 bp, Zea mays
  Clone ID: LIB143-001-Q1-E1-D9
agctgctctcgtccctagaaataaagcagctcctccgcggggcggcgaactactacccatcgccaaaaccctagccccgatccggtcgaggagcactacttcttggcatggcgggcacccctagccaggcaagcctcctgctccagaagcagctcaaggatcttgcgaagaaccccgtggatgggttctccgcagggcttgtagacgatagcaacgtcttcgagtggcaggtcaccatcatcggcccgcccgacaccctatatgatggaggctacttcaatgcaataatgaccttcccccagaactatcccaacagcccgccatcagtaagatttacttctgggatgtggcaatcgaatggttacccggatgggcttgtttgcatttctattcttcatccacctggtgaaga

SEQ ID NO: 4395 - DNA, 348 bp, Zea mays
  Clone ID: LIB143-001-Q1-E1-E1
ccgggaagctgccctgccactgccaggctgccacaccgaggtgctcccttgactccctctcctctcctcttctcgcgcacgtggtctgtgcccgtacgcggcggcgctgccgctcaccagaccggccgccgccacgtctgcttccgcgcctccccgcctcctcaccgtccgcccccttttacctgcctgatcattttattataaatgtggggcgagagaactcatcataagcactggcatcaaggtcatggtacctcggggaattccaacaacaaaaagcatgataagcggcagccaaaatttataccagacaattatagctccgtcgatgaggttactactgctctg

SEQ ID NO: 4396 - DNA, 301 bp, Zea mays
  Clone ID: LIB143-001-Q1-E1-E11
aaaaaaaaaaaacaaaataaaaaaaaaaaaaaaggaagaagaacaagaatgctctacactgaagtaaacatacataaaaacgtcaaagcgcatctatataatcaacgggagcgacttcacaggccgatcatttttacaatgtgctgcgccgggacaccactcgggttatgcaacgttggcggcctctgccacatacgcctttgtcaagttggagtaacacctaagagccgtggacgggtcgtccatcgcgctagttgcgaaacctccgtcgttactctgagtcgccctcgtgccggtccat

SEQ ID NO: 4397 - DNA, 340 bp, Zea mays
  Clone ID: LIB143-001-Q1-E1-E2
gctagttgcaagagattatgatatgaatagccctaacccatttgacaaatctgacattgtcagcattgttcctgtatgcaagcatgtggtctactcatctattgatggtcgaaacttactggaatcatcgaagatggcattggataaaggaaaattagatgatgctgtgagctatggaacaaaggcattgtccaaaattatagctgtttgtggtccataccatcgactgacggctaatgcatacagccttcttgctgtggtgctttatcatactggagattttaatcaggcaactgtatatcaacagaaggcacttgatatcaatgaaagggagcttggt

SEQ ID NO: 4398 - DNA, 342 bp, Zea mays
  Clone ID: LIB143-001-Q1-E1-E3
gtaactaaaaaacagaaggaccctggcgagagcgagagagggggagaaaaggggaaaaaaagaataataagaaggtgggaagagcgagggagctgcgtgcataacccagagccagagggagggagggaggtcccctgcagcacccagcagtgtcccctgcaactttgtttgaagcaaaacaaaagtaccaggcttttttcgggggaggggcggttagatttcgctcttcccccgaaaaaagcctggtactttttttcttcttctttcttttgtaattttaaccctttctttcatctttttttcctggtgtaaagtaaacgtggactttgtcggtttatggac

SEQ ID NO: 4399 - DNA, 355 bp, Zea mays
  Clone ID: LIB143-001-Q1-E1-E5
aggtgtggccgtcgtctcccgttcggaacgccaagccccccctccggcgaaatggcccccaagcgaggtggcagggcgccggtgccggccaagaagaagacggataaagtgacgaaccctctattcgagaagaggccgaagcagttcggcatcggcggcgcgttgccgcccaagaaggacctgcaccggttcgtcaagtggcccaaggtcgtgcgtatccagcggcagcgccgcatcctcaagcagcgcctcaaggtaccaccggcgctcaaccagttcacccgcaccctcgacaagaacctcgctacgaacctgtttaagatgcttctcaagtaccggcctgaagacaaggctg

SEQ ID NO: 4400 - DNA, 368 bp, Zea mays
  Clone ID: LIB143-001-Q1-E1-E6
atggaactggtaaaaccacatttgtgaaaaggcatcttactggcgagtttgagaagaaatatgagcccaccattggtgttgaagttcaccctctggattttagcactaactgtggcaaaattcgcttttattgctgggacactgctgggcaagaaaagttcggtggccttagggatggctactacattcatggtcagtgtgccatcattatgtttgatgtcacttctaggctgacatacaagaatgttccgacatggcacagggacctgtgcagggtctgtgagaacatccccattgttctttgtggtaacaaggttgatgtcaagaacaggcaagtcaaggccaagcaagttacattccaacggaag

SEQ ID NO: 4401 - DNA, 346 bp, Zea mays
  unsure at all n locations
  Clone ID: LIB143-001-Q1-E1-E8
agattaaaccttccgtacccatatccacctgctgctccgaccttccagtcttctccgtangggcttcgctccatagatttcgccgcaaggggcaacggcacacccaccaactgacctgacccacgagggatccgcagatgaagatcattccggtcccttgcctggatgacaactatgcctacttaatcgtggacgagagcaccaagaaggcagcggccgttgaccctgtggaaccggagaaggttctcaaggcggccggcgaggtcggcgcctacgtcgactgcgttctcaccacccatcaccactgggatcatgctggtggcaatgagaagatgaggctgcaggt

SEQ ID NO: 4402 - DNA, 324 bp, Zea mays
  Clone ID: LIB143-001-Q1-E1-E9
aatcctccttccccgatccagtcccgcagcaacgccgagggagagcgaggagagacagatacagatcgcgcgctcagatgtcgtcggactcctcgtcgtgggcgcgcgccctggtgcagatctcgccctacaccttctccgccatcggcatcgccgtctccatcggcgtctcggtcctcggcgcggcatggggtatcttcatcacggggagcagcctcatcggggccgccatcaaggcgcccaggatcacatctaagaacctcatcagtgtcatcttctgtgaggctgttgcaatttatggtgtaattgtggcaatcatcctcc

SEQ ID NO: 4403 - DNA, 365 bp, Zea mays
  Clone ID: LIB143-001-Q1-E1-F1
gtcatctccaagtgcgtgcgccggccgccccctatcccgccggccctgtgtgtgttccccgctaccagccatggcgtcgccgttctccgtgccttcgctgatcatggaggaggaagggcggttcgaggcggaggtggcggaggtggagtcgtggtggggcacggagcggttccggctcaccaagcgcccctacaccgcccgcgacgtggtcctcctccggggcacgctccggcagagctacgcgtcgggggagatggccaagaagctgtggcgcacgctcaaggcgcaccaggccggcggcaccgcctcccgcaccttcggcgcgctcgaccccgtccaggtcaccatgatggccaagcacctgg

SEQ ID NO: 4404 - DNA, 360 bp, Zea mays
  Clone ID: LIB143-001-Q1-E1-F10
atggcacgataaatagtaacaccaaggaaggagataatgagaaggggggcactgaagaggatgatgaacctgttgtagtagttgccaaaatgtgggagaacagcaagtttgctgactatgattcatctaaggagaaggacaatgatggtgactcacaggttgatttggaatcaaacaagggggatgcaggtcttgacagcaatgggttgcactcaactaaggagaacagtggcagggcatcaccaactaaacagcaccagcagtataagaagaagcctttgctgaagagattcggtggtctgctaaaaaagaaaagcgaaaattagcataaaaccgtctgatgataatccttggtccaac

SEQ ID NO: 4405 - DNA, 329 bp, Zea mays
  Clone ID: LIB143-001-Q1-E1-F11
ctgcgatcgtggtgcctgcgcgcatgcagtcgagcgacgacgaggaagaggaggtgatcgatgagaacggcgagattgtcaagaggaagaagaagaagggccttaaggagaaggtcaaggagaagctggcggcccacaaggcccacgatgagggcgaccaccaccagacgcccgcgccgcccgtggtggtggacacgcatgctcaccaccaggagggagagcacttcccggcgccggcgcctctcccgcacgtggagacgcaccaccccgtcgtcgtccacaagatcgaggacgacgacacgaagattcagaccccaccacaggcaccg

SEQ ID NO: 4406 - DNA, 341 bp, Zea mays
  Clone ID: LIB143-001-Q1-E1-F12
ggaaatgggtcgatgatttcttccaaaatgaatatttgctaaattacatcattgcgacttacataaaacctcaggtttccattcttagtggaattgtcatgggtggaggagctggtgtttcaatacatggaagatttcgagttgccactgataacacgatttttgcaatgccagaaacagctctaggcctctttccagatgtaggggcctcttattttctatctcggctaccagggttctatggagaatatgttggtctaactggtgccagattggatggtgcggaaatgcttgcctgtggcctggcaactcattttgtcccgtcaaagaggttgccattg

SEQ ID NO: 4407 - DNA, 204 bp, Zea mays
  Clone ID: LIB143-001-Q1-E1-F4
gaaatattcttcccgtcgaaagacggagagaggaaaatggacaagggcaaggcaagagagaggcgtcctcgtttgatctgctgccgcagtgcgaacacgaacacgaacatcatcgccggagttttaaagatgttcctcatggactggttcaacggggtactggcattccctgggctttggcaggaggatgctaagatcctctgt

SEQ ID NO: 4408 - DNA, 357 bp, Zea mays
  Clone ID: LIB143-001-Q1-E1-D2
caaaaccatcatttggaagctgggctgtcggtgagggacaatgaaggatttgttgaaaataggttggatgctgttgttcttgatttagttgatgatgaagcttctggtatgcaagcgcagaaaactcgatatcactggatgaaggtggacaattggagctatgtcagctacagttattgatctgtgttcacttttgaaatactaaaataggaaagtaactatacaatgctgctaacttgacaatcattgcatgaaagcatcatatgctagtgctccgtgtttattgctgccctagccatccggatagtccatcgcccgtcgtgggcctcgtggcacatcctagatgttttgccccgc

SEQ ID NO: 4409 - DNA, 373 bp, Zea mays
  unsure at all n locations
  Clone ID: LIB143-022-Q1-E1-G7
agatcgccaataatggagtttccgcaccaccaccaccaccacggccatcgccgcgacgacgacgaagacgaccgcagaggcccgcctcccccggtctacggcggctacggccagccaccgccacccgacccgtacggccgcgcgcccgtcgaccccgatccgtacggtcgacctccgccccagtccgcgtacggtggggccggggacgcctacggccacagcggccaaggctacgcgcccccgccggcctacggcgccgggggcgggtacggcaacgtcgtccacgtcgcgcacgaggtcggcgacgagaggccttactacggcggcggcggcggcggtcttggtggcgcctacggaggcngtggctccgagt

SEQ ID NO: 4410 - DNA, 380 bp, Zea mays
  Clone ID: LIB143-022-Q1-E1-G8
acacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaagtggccgaggcgcccaaggcgaagaaggcgcccaaggagaagaaggcgcctaaggagaagaagccgtccgcggcgaagaagccggcggcgcaccctccctacgctgagatgattgtagaggcgatcgctgccctcaaggagaggaaggggtcgagctcggtggccatcagcaagtacgtcgaggggaagcacggcggcaagctccccaccaacttccgcaagcagct

SEQ ID NO: 4411 - DNA, 410 bp, Zea mays
  unsure at all n locations
  Clone ID: LIB143-022-Q1-E1-G9
caacaccggctaaccctagcttctgtttggctgttgccttgcgggtggcggctgctttggtgcgctgcgcagtgcgctccgtccgtccgtcgaccggaaggccgtcccctggcccctgctcgtcgtcttcctcgggcgctcgtcttcctccgaacgcgcgcgggccgccgacctgcttgttctcctggaggagcgcgcccggcgggcaggcgacgcagtccagcggcgggttgaggaagaaggcgagcgaccggtggatccccgtccagccgtcccctgctcctcttcctcgggtcgggcgctcgtcatccactcttcctccagccctccatctgatccccgtacgaccgtcncctgctcgtcttcctggtgctcggctgctccagtgctcggcccctgctgcagtgctg

SEQ ID NO: 4412 - DNA, 325 bp, Zea mays
  Clone ID: LIB143-022-Q1-E1-H1
tatgagactgcgaccattccttcttcgctccttcgccgccgctatggttaagtactcgcatgagccgggcaaccctaccagatcgggcaatgccatggtaagggaccttagggtccacttcaagaacacaagggagagagcttttgcgcttcgcaagctgcctttgaccaatgctaaccgataccttgaggatgttattgctcacaagcatgcaattcccttccggacatactgtggaggtgttggtcgcagcgcacaagcaaagtctcggccactccaatgggcaaggtctctggcctgttaagtcatccaggttcatattgga

SEQ ID NO: 4413 - DNA, 223 bp, Zea mays
  Clone ID: LIB143-022-Q1-E1-H10
acgcgtccgcatgggaatattgctcccaaccttccatcgaaatgaaggtctggagacacctaatggcatttctcatattgacaacatgtcttcagtgatatctcaagcagtgcacggggagagttaccaagttgatgagttttctctagaaatttcactaccgccggttatagccgccaatgagcgtgcagttagattatatatgaaacaaaagatatagcag

SEQ ID NO: 4414 - DNA, 376 bp, Zea mays
  Clone ID: LIB143-022-Q1-E1-H11
ccaacgcgtccgcccacgcgtccgcactgcctcgtgtggccgtcgtctcccgttcggaacgccaagcccccctccggcgaaatggcccccaagcgaggtggcagggcgccggtgccggccaagaagaagacggataaagtgacgaaccctctgtttgagaagaggccgaagcagttcggcatcggcggcgcgttgccgcccaagaaggacctgcaccggttcgtcaagtggcccaaggtcgtgcgtatccagcgccagcgccgcatcctcaagcagcgcctcaaggtaccaacggcgctcaaccagttcaaccgcaccctcgacaagaacctcgctacgaacctgtttaagatgcttctcaagtaccggcctgaaa

SEQ ID NO: 4415 - DNA, 280 bp, Zea mays
  Clone ID: LIB143-022-Q1-E1-H2
gcgtccgaaaagaggctgtgggtgcaccggtttctcaccagcgatgtgatgctctggaagagacgaaagacgcttttgttcctcaaaaagaagacataaacgagctggacgcaccgagacaagatcaagatgaagacatggttatcattgatggtgagaatctgatggaatagactccagcagaagatccacctgtgaccgattatgaactcacgggtaaatcagaattccaagagcagcaagtggacgattacgagaagtgtttagcaaccctggatga

SEQ ID NO: 4416 - DNA, 413 bp, Zea mays
  Clone ID: LIB143-022-Q1-E1-H3
aaccgacatcgatgtcccctgggagtttcgctgacacgccttcccctggaagagcttcatctagtgcctgtttggttcgatgaacttgccacacttttaacttttctgctaaggtaacttttctgctaaggtcagttctttaattcgaacgactaaatttagacaaagtgtgacacatttaaacacgaaccaaacataactcgccagagaagcacttgttgtctctcgatttctttttcatgtctgtcgcattggtcttctcctcaactcgctggccgctgacggtagatgcacaactcataatttaactgatcgagacgatgaactaatgaattcaaaatttaaataaatataaataaaacaatctttttccaacaaaaactgatgtgtactattctttttatacaaataac

SEQ ID NO: 4417 - DNA, 386 bp, Zea mays
  Clone ID: LIB143-022-Q1-E1-H4
tgagcttaatcttccgcgtgttcctcctcctgctcttcctctccgtcaccgccggccagttcgccatcctcttcaagaccacggcgtacagcgggccgatcaacttcaccaacggaggggacatcgctgtgtcttcggtggttcaggtggtcggcctcgtcctctgcctgcacgccgctgccaagatctcccaccgagctcagaacatcgctgcgctggctagccggtggcacgcgctggcgacgtgctctaacgactccacctacgtgaccaccccgaacagttccgggaacctcgcgcctttccccgcgcacctgttcctgagagactactcggggagtgacctggagtccctggacagcgcgtcggttcagggcagctcccac

SEQ ID NO: 4418 - DNA, 403 bp, Zea mays
  Clone ID: LIB143-022-Q1-E1-H5
aaccaccagccgagttcgcagcggcactccacggtccaggcccagcagcctcttcggctcttcgttgggggtgcgtggacaccggaaattgcctcggggattgcgttcctgatctaagcccggcatgaagggctgctcagagcggttgctgctcctgctgctgctggcatcgtcgttgttactgtccgtcgtggttgccgcgcagcagacttgccctgccgacctcgacagcaaatgcgacggtggcgcgcctgatgactgggatggggaattcttccccggcgtcccgaaaatcaagtatgagggtccagcaagcaggaaccctcttgcttataagtggtataacaaggaggaagtcattctcggaaagaagatgaaggactggatgcgcttcagtgttgcg

SEQ ID NO: 4419 - DNA, 365 bp, Zea mays
  Clone ID: LIB143-022-Q1-E1-H6
aaaaaaaaaaaaaaaaaaaaaaaaaaaaaaaaaaaaaaaaaaaaaaaaaaaaaaaaaaaaaaaacaaaaaagaaaaaaaattaaataaacatacaaaaaaaaatgggaggccgtccaaaaggttccatgctttcatatcaatggggggggcccctcaaaggtttcaaactttccttcccctttcatttcactggcagcctttttaaaaggtccccctagtttcattcccggggttcccattttaaacccccttgccgggaaaccccctggttttacccgctttatcccccttgaaccaaacccccttttcccttcctggcttttccccaaaggggcccccaattttcccccttcccaaaatttgc

SEQ ID NO: 4420 - DNA, 422 bp, Zea mays
  Clone ID: LIB143-022-Q1-E1-H7
aaggcttcttaagcttggttaccaagctgttgcatatattgaagcttctgcggtgatttaccaagatggaaagattttaatagaagttgaccatctacaaggagtgtcgactccatatcttcaaattaaagggacaaataaagaaattgttacctctgctggttctgcactctgcttggatggttcatacacaacaaagagttatcttcaaattattttggagagcttaccagctgatggtaatgtatctattggtattcacaatcaacaagctgcaaggctgcaggaactggttgagttcatccagtcacagggagggagctttaattcagatttatcgtcaccaatacgagaaacttcctctacagatagtgtgattgatgatatgcagtccaggataaggaagcttgagagatggaata

SEQ ID NO: 4421 - DNA, 426 bp, Zea mays
  Clone ID: LIB143-022-Q1-E1-H8
aaaattaatctaacaacgaacgacaactccacgcagagcaacaatggcgccgccgatgaaggtgtacgggtgggccgtgtcgccgtggatggcgcgcgcgctggtgtgtctggaggaggccggcgccgactacgagatcgtccccatgagcaggtgtggcggcgaccaccgccggccggagcacctcgccaaaaacccgttcggtgaaatcccagttttagaggacggtgatatcacgctctaccaatcacgcgccatcgcacggtacgtcctccgcaagctcaagccagagctcctccgcgaaggcgacctcgaggggtcggcgatggtggacgcgtggatggaggtggaagcccaccacatggagccggccctgtggcccatcatccgccacagcatcatcgggcagtacgtcggccgcgagcg

SEQ ID NO: 4422 - DNA, 335 bp, Zea mays
  unsure at all n locations
  Clone ID: LIB143-022-Q1-E1-H9
tcagctcacactccggcagccgagcgatcgagctccccggtcgctagcacagccggccactgcacacgacggtgctggtaggttgcaagcacttgcaggatggcgcaggtcgctaagacgcttctccttgtggccctggtggtcgtgtcggcggtggagctgtggggggggatcgagtgcgacnagcggggacctggcatcggacgaggcgctgtgggacctgtacgagcggtggcagacgcaccaccgggtgcaccggcaccacggcgagaagggccgcgnggtnnggggggggggggggggggggggggttggggggggggggggtggggggg

SEQ ID NO: 4423 - DNA, 423 bp, Zea mays
  Clone ID: LIB143-023-Q1-E1-A10
aaaaaatagcatgtaaatctataaaatcaatttccatctctcaccctatgaatttgagataggtttaaatgataactttggaaagtggtgaatgtcacattctaaaaaagtagcctattccattagtaagattccaattcctcaaaatgaaaggaaacaaacgggaccttaatctatttcttgtaaaagcatggattgggttggaattgtcaccatggttctaaaaaaactaattgcacttacatttattgtctattaaatctcaaatggacccctagtgtcttgtttagggcctgggcatccaataaaactctcgacactctaggcggtgcacatagacacaagacagtgtttaagtggcgcggaaacacgaaaaagcgtctgcctggctggcttggtgagctatgtgtgactgcaggaaaa

SEQ ID NO: 4424 - DNA, 409 bp, Zea mays
  Clone ID: LIB143-023-Q1-E1-A11
ttcccaagaaagggaatctagctattcacggtctcccagtaggaagagtgaaatgaggcatgagaagaagcctgatgatggagaaactaactcatctaggagtctcagtgtctctgacaataatgatgatagaaaaaaggagacactgttaagtggtgatgataaagaggatcacgaaatacagctcaaacaaataagacaggacatggaacttttgcgtgatgataaatctctcttggagataattttggatgagaagaatgctgaagtgcgcaagatttctagcagattaaatgatcttgatctgcagctaaggaaggagaaagaggaatgccacaggatgacctcaaaaattaaaaagttccttaaagcccatgctcgctttttgaaagcacaggaagaattgaaa

SEQ ID NO: 4425 - DNA, 419 bp, Zea mays
  Clone ID: LIB143-022-Q1-E1-G6
acggacgcgtgggcggacgcgtggggtggtggcacctcagcaatgactggatttgaggacaggttccagagagaggcacatctgtctacttcagcattctgtccatcacttgtgaagccacctgaatacatgcccgagaacctaccagggtactcagcctggttggctggtgcgatattggctaaggtcgttttccctgacaaccaccatgtgaccaagggcgagtatgatgacacggggccgtccattgtgcacacgaagtgcttttagagatacatgccttgaactatcacggttggtgcaccagttgctgcagtacatgtcgcagttgtgctcgtacctgaacgttgcggtcttgctggtgctgatgcagctatgcatgtgtcgacaccttactctagccatagttcatacctgac

SEQ ID NO: 4426 - DNA, 408 bp, Zea mays
  Clone ID: LIB143-022-Q1-E1-F11
ccacctctgagagaagatgacagggatgggcattatgtttttgctgttggagataacctcacatctcgctataagatcaatgcaaaaatgggagaaggtacctttggtcaggtgttggagtgttgggacaaggaaaggaaagaaatggtggctatcaaaatcattaggggcattaaaaagtacagggatgctgcaatgatcgaaattggcatgctcgagcagcttggtaaatatgatgaaagtagatctagttgtgttcaaattcggaactggtttgactatcgtaaccatatctgtattgtctttgagaggcttggaccaagcttatatgattttctgcgggaaaacagttaccgctcattcccaattgccctagttcgggagattgccaaacaactgttggaatgt

SEQ ID NO: 4427 - DNA, 398 bp, Zea mays
  unsure at all n locations
  Clone ID: LIB143-022-Q1-E1-F12
ggagctccctccttatgaccctgactggtactacatcagggctgcatctgtagcaaggaagatctacttgagacaaggcattggtgttggtggcttccagaagatttatggtggccgccagaggaatggctcacgcccacctcacttctgcaagagcagtggtgccatttcacgcaacatcctccagcagctgcaggagatgggcatcattgatgtcgatcccaagggtggacggcgcatcacctcccagggaaggcgtgatctggaccaggtggctggaagggttgctgttgaagcttgagcaatctcatatttggtttctatgatgtcatgtttgattgttgagatggctacactttatttgcactttggattangatttttgtgttaagagaact

SEQ ID NO: 4428 - DNA, 419 bp, Zea mays
  Clone ID: LIB143-022-Q1-E1-F2
agctgaacttcgttgtattagacgagaatttgcttcgcatgttgtttggtctaactttgtaatgtctgtatttgctaattgatgctgacatatgcagaactttgctatgcatcatgctttgtgccaagacaaaagttgccacagttcgacttgcatcttactttgctgaaggtgctaaagatgctgcaaagaaattggataaatcagagttcactcaagagcgaataatttcagaattttatctagccttagtgactggcatacttgatgatgatgacgttgttgttacccaagctacagggttagttcattatcctggagttgcatacggactttatgacacatgttcctcaggacagccatcaatgagcaaactatatattcttaacagacttgcacatcagaatcacacactggtc

SEQ ID NO: 4429 - DNA, 396 bp, Zea mays
  Clone ID: LIB143-022-Q1-E1-F3
gatgtataccataatgcccgtgcatgccttacgttgcgtgtggcgtgtgagaagcttaagaagatgctgagcgccaacccagacgccccactgaacattgagtgcttgatggatgacaaagatgtgagacggtttattaagagatacgagtttgaacacatcagtgcacctgtgctggtacgtgtcaaaggacccttggagaatgccttggctgaagctggcttgacaactgaaaatgtgcactttgttgaggttgtcggatctggttctcgtgttccagccataatcaagataatcactgatttttttgggaacgagccgatacgaaccatgaatgcaagcgagtgtgttgcgtggggctgtgctctccaatgtgctattctcagccccactttc

SEQ ID NO: 4430 - DNA, 423 bp, Zea mays
  Clone ID: LIB143-022-Q1-E1-F5
atctgctcctgccaggctgccacacctccgccagcgctagggttttcattttcactcgctgttgctggtggttgttacccttcctctctctctcagccgtcaccctcggagccgcagtcgccgtagcagatcttctctctaatcctatcggtcaacagctgcttgctcgggacgggaaccggaggtggggttgcgatggcgctgcagtacgtggaggcgcagcggcagttgcgcccggacctctccgactggtacgcctccctcgccgacctctaccagcggaagctatggcaccagctcaccctcaagctcgaccaattcttacagctccaggtcgcacagaccggagacactatcattcagctctacaacaatttcattgtcgactttgagaacaagattaatctgctcaaacttgcccat

SEQ ID NO: 4431 - DNA, 427 bp, Zea mays
  Clone ID: LIB143-022-Q1-E1-F6
acaataaggtaaggggtgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgtcgtcgccaccctccggcgccgccatcccggtggtggacctctcggtgacgcggcgcgaggacctagtcgagcaggtgaggcacgcggccgggacggtgggcttcttctggctggtgaaccacggcgtggcggaggagctgatgggcggcatgctccgcggggtgcgccagttcaacgagggccccgtggaggcgaaacaggcgctctactcca

SEQ ID NO: 4432 - DNA, 428 bp, Zea mays
  Clone ID: LIB143-022-Q1-E1-F7
gaaaacctccaaccctagccgcgatccgacaacgcctccatccctagccgactgctgcaagcttcagagctcaagagtcagggcgccatggcgacagagacggagaccttcgcctttcaggctgagatcaaccagctgctctcactcatcatcaacaccttctattccaacaaggagatcttcctccgggagctcatttccaactcttccgatgcgttggacaaaatcaggttcgagagcctcactgacaagagcaagctcgatgcgcagccggagctgttcatccacattgtaccagacaaggcttcgaacacgctctccatcatcgacagcggcatctgcatgaccaagtccgaccttgtcaacaacctcggtaccatcgccaggtccgggaccaaggagttcatggaagcccttgctgctggcgc

SEQ ID NO: 4433 - DNA, 428 bp, Zea mays
  Clone ID: LIB143-022-Q1-E1-F8
agcattgatcatatctgttctggtgtctgttgggtggattggctatgaggtatgcttatttatgtcaaagccgtattctaactccagaattatcaagggaatattgttgcattgcctcacaaaattagattggtttctcggcagtgtttgaagctggagaccaggagtgttactttaaactgcacctttctactttcaagaacctgtccattttgtattgtttggattcatttgtttgcaccttacttgtttatgcatatgtttcattatttcagaagtcattgatatccctgcaatttctttcttgcagatttactccaaatcaacagatgtatttaatgaacgatggcagcatgcctggattattcctgccttctggcatgtcttgtctttcttacttctttgtgtcatttgctacctgtgggcac

SEQ ID NO: 4434 - DNA, 403 bp, Zea mays
  Clone ID: LIB143-022-Q1-E1-F9
caaaggagagatgacgctctaccgtcgtgtcctgctcctccgtcgcctctcccacctccacccctcgcccgttccggccatctgctcctcaccaccacccaccctcgcggggctgctcacccccatggggcgccgccacttcgccttctcgtccgccgaggaggccgccgccgagcgccgccgccgcaagcgccgtctccgcatcgagcctccaatcaacgccctccgccgcgggccacctcccccacgggaccccaacgcgccccgcctcccagacaccacctccgcgctcactggcccgcgcctcagcctccacaaccgcgtccagtccctcatccgctctggtgatctagacggcgcctcagccgctgcccgcgccgccgtctcctcgcgcgtccggccc

SEQ ID NO: 4435 - DNA, 420 bp, Zea mays
  unsure at all n locations
  Clone ID: LIB143-022-Q1-E1-G1
agcgcctccaccaccccgaccccgccgtcgcaacaggccaagacgcagcagtagaagcaccaccaccaccaccaccggcacacgaccccggcggcagcgagtgccggttctgcgagatgacgcggcagcaccagccgcagtgcgcgcggcggctgccgaagcgcatcatcctggtgcggcacggcgagagccagggcaacctggacatgtcggcctacaccaccacgcccgactaccgcatcccgctgacggcgctgggcgtggagcaggcgcgcgccgcggggcagcgcatccgcgacgtggtggcgggcagcggcaactggaaggtctacttctacgtgtccccctactcgcgcacccgcgccacgctgcgcgagatcggccgcgccttcncgcgggaccgcgtcatcggcgcccgcg

SEQ ID NO: 4436 - DNA, 419 bp, Zea mays
  Clone ID: LIB143-022-Q1-E1-G10
tgactggggcggtagcatcagaaggactgaagggttcaagatgagcaacagcctgaatgcgtcgagatttccgttttgtgctgtggtcatggcttctacaaaccagagaatcgtgctattgcagcaggttgaagggcccaaatcacctgaagagatgataacagttcttcaacgtgttgttgaagaatgtgctacatcacttgttgctgctaggattgaagctgaagagagactaaacaaccagcgattgcgtgaggaacaagatgctgcttacagagctgcacttgaagctgatcaggccagggaacgtgaaaggttagaggaactggaaagacgtgaaagagaggctgcagaggctgagaaaaagcgtaaagaagaagaggaagctgtagcaagggcatcccaagaagcagctgaga

SEQ ID NO: 4437 - DNA, 386 bp, Zea mays
  Clone ID: LIB143-022-Q1-E1-G11
cccacgcgtccgccctttgcaagtatagtctctctgctaagcgaagcgaagcttcaagctagtctcggcggctctagaagacgatgggcaaggacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgacgcggcgtgcggcggcgtgggcgtgctgggcatcgcctgggccttcggcggcatgatcttcgtcctcgtctac

SEQ ID NO: 4438 - DNA, 389 bp, Zea mays
  Clone ID: LIB143-022-Q1-E1-G12
caaacccagcagctattgtggtcgtccctcagccgcgtcgcaccgcatcgcattctacgattcgaagctctctctgctcgcagccatggcgaagaattacccaaccgtgagcgccgagtacagcgaggccgtcgagaaggccaggcgcaagctccgcgccctcatcgccgagaagagctgcgcgcccctcatgctccgcctcgcgtggcactccgcggggacgttcgacgtgtcgtcgaggaccggcggtcccttcggtactatgaagtgcccggcggaactggctcacggcgccaacgcggggctggacatcgcggtgcggctgctcgagcccatcaaggaggagttccccaccctctcctatgccgatttctaccagcttgccggag

SEQ ID NO: 4439 - DNA, 432 bp, Zea mays
  Clone ID: LIB143-022-Q1-E1-G2
accgaactcccttgctaggttcctcgtccgcctctctgtcctagtctcgtcagcaacagcacagtgttgttactgacgcgccttcactctgttgacctgcatctagccaagtttatttggagactccaacctttggtctcccaaacttggagctcccaaggggagaggttctgccagaattttggcttctgagcatccattttcatggggaggttctgccacaatctgctcctgtgaacatagatttctcaacgggaggttctgccagaatttcctcctgtaaccagcatctttccatggggagattctgccaaaatttcctgcgactgattatcagtcttctaatgcgaggttctgccgaagttttcgtgtgtgatcacgacgatcagtttccagggggagattctgcccaaattttacgcattgaccatc

SEQ ID NO: 4440 - DNA, 429 bp, Zea mays
  Clone ID: LIB143-022-Q1-E1-G4
aatctacttcttccccgcgctgcctgctgcctgctcgagcttggagatggcgttggtgcggcgatgcctctgtggatccgaggaagactgcagagcgcttttgggcatggaaaatctccggctgttctcctacagagagatcagagcaggcacaaacaacttcgatcagagtaacaagcttggacgaggtggttttggaactgtctacaagggagttctaagagacggcactgaatttgccgcgaaggttctgtcctcggaatccgagcaggggatcaaggagttcctagctgagatcgagagcatatcccaggtgaagcacgcgaacctcgtcaggcttctgggctgctgcgtacagaggaaaaaaaggatactggtgtacgagtaccttgcgaacaacagcctcgatcatgcgctcaaaggagcagc

SEQ ID NO: 4441 - DNA, 318 bp, Zea mays
  Clone ID: LIB143-022-Q1-E1-F10
acgcgtccgctagtccaaggtctcagcctcgtcctcatccaagtcctatagctgaagttccggtgcatagccagctcatgctgtcgtccccatgtctcggtggtcgtggctagcgatgctgtgccgcctgtgatagcgacgacaacagagagttagtcggtggcatctacgtcaactagcacagtgacagctgcgacaaccgcgactacgccttccgcgcactctgcaatcgttgcaagcaggcacacctcctcgtcgacgctaacacccctcgcgactccaagtagctagcccgtgccgggggactggatctgcagc

SEQ ID NO: 4442 - DNA, 326 bp, Zea mays
  Clone ID: LIB143-001-Q1-E1-A1
agacacatgtgacaagcctcatctcagccgtgcaggaccaagtagttttgcttcactccggcattccatccatatccatccatcagaattctcagtctccacagcagcaaggcgcacgaccagcaccagcagccggcaacaaaagacacagcagcgatggcgttcgtgccggtgtgcgtgcagtgcgggacgcggagcaacccgtgccggtgcaaggtggtcgggccgacgctggggttcgtcgcgttcgtggtggccggggtcatcgaatggccgctgggggccgccgtgtacctgttccgccaccgcaagggacgacgcatcat

SEQ ID NO: 4443 - DNA, 407 bp, Zea mays
  Clone ID: LIB143-001-Q1-E1-A10
ctaaaaccatctgcttcagccttcagctagccccaagtttagtcggccgatcgatcactgaagtagtaatggcctccgccaacagctggaccctcgagatcgcgtcgccggtggccccgcagcgcctgttccgcgccgccgtgatggactggcacaccctggcgcccaaggtcgcctcccacgtcgtcgccagcgcgcagcccgtggagggcgacggcggcgttggcagcgtcaggcagttcaacttcacctcagtcatgccgttcagcttcatgaaggagcgtctcgagttcctcgacgcggacaagtgcgagtgcaagaacacgctcatcgagggaggcgggatccgcgtcgccatccaaaacgggaacttgcaaaatcaggggtggaccccgcggccggcggcg

SEQ ID NO: 4444 - DNA, 162 bp, Zea mays
  Clone ID: LIB143-001-Q1-E1-A11
ttcagaccgcaccacgttcactcaggcgtcacgtggcagcgctacggtcatagtctatacgcaacgctagctcaagtcggggcgcggggtcgctgtttccgtgtactatatgctctcggcacctcggatcagtagtgcctgctacggttggcttgtccccac

SEQ ID NO: 4445 - DNA, 413 bp, Zea mays
  Clone ID: LIB143-001-Q1-E1-A12
agatcatcagaatcctcaccactaggagcaaacctcagctgattgctacattcaatcattacaatgatgcatttggccaccgaatcaacaaggatctgaaggctgacccccaggacgagtacctcagaacgctgcgggcgatcatccggtgcttcagttgccctgacaggtactttgagaaggtggctaggcaggccatagcggggctaggcacagatgagaactccctgaccagggtcatcaccacccgcgctgaggtggacctcaaactgattaaggaggcgtaccagaagaggaacagcgtgccgctggagcgggccgtcgcgggggacacctccggcgactacgaaaacaagctcctcgcgctccttggggcaggattgatgagccgtactggtgcgctggtgcctttc

SEQ ID NO: 4446 - DNA, 279 bp, Zea mays
  Clone ID: LIB143-001-Q1-E1-A2
acccacgcgtccgtgctctgctccatagaagatgaatgaagagagagatggtgaagaaggctttggcaaatggcaattgccgcagcaagccatgtcggcgccactgaccggcttagtgattggtataatttggtgtggcagcagccaggattaatgcgctggtcttttatctttactactagtttggtctcgtccggtatcttatttttctttccccttttcgagtctgtactgaaactgctgagagatttgcagttttgatctatcatatcctttggt

SEQ ID NO: 4447 - DNA, 315 bp, Zea mays
  Clone ID: LIB143-001-Q1-E1-A3
actcgcggatcgatccacgcctctacccagtcgtacacgctaggtcgcaaactcaacacacagtcagcctcaaacctctttctcgtccgaatccagaacttccatccatggcagtgtcatcagggatggtcttctccgtccgcccgccggctccggcccggccctgcgcttgctctgccacggcgagggcgcgccccgtcggcgacggcgccaagtggtgggcgccgctgctggggtggtccgggcagccggactacatcgatgcgcggccggcgtccgaggacgagcctctgccgcgggggccggcctcggcct

SEQ ID NO: 4448 - DNA, 352 bp, Zea mays
  Clone ID: LIB143-001-Q1-E1-A4
acgacggggacagagattcgttgatagcccaaagccatacaacagaaggaaagcgcgcggtatgcaaacaaggatggattcgagtgaccacggcgaccgccaaggtccgagagcctgtgaagaattgccaggcaagatggataacgaccgtgccgatcgtcaacgcttgaaagcctgcgaattcccagccaagatggacaacaaccatgccgatcgtcaagtttcgaaagcctgcgaatcgaaaggcaatgcctgtgaattgccaggcaagatggataatgaccaccccgtccgtcaaggtttgaaagcccgtggactactgcaacctaagtcggatgccagtggaggtggc

SEQ ID NO: 4449 - DNA, 340 bp, Zea mays
  Clone ID: LIB143-001-Q1-E1-A8
atcgacttcgagttcctggggaacgcgagcggggagccgtacacggtgcacacgaacgtgtacagccaggggaagggcgggcgggagcagcagttccggatgtggttcgaccccacggcggccttccacgcctactccgtgctgtggaaccccgcccacgtcgtcttctacgtggacggcgtccccatccgggagttccggcgccgcggcgacgggaccgtgccgttcccgacgtcgcagccgatgcgggtgtacgccagcgtgtgggacgcggaggagtgggccacgcagggggggcgcgtccggaccgactggtccagagcgcccttcgtcgcgtcgt

SEQ ID NO: 4450 - DNA, 351 bp, Zea mays
  Clone ID: LIB143-001-Q1-E1-B1
cggacgcgtgggcggacgcgtgggaggagctcacggtcgaggattttctttatgatgatgattacaagatagatctttctgggtctaatctggatgtcattaataacctagaagggattgttcagctggaatatccagatcacaatttgccgcaagggttagcccctaatgcataccttgacatgaatagttgtgggcagagtgccggggctgttttcctgcacatgccagatttgctcacaacaatgacttcagcaccttctgcattcctgaagccaaaatgcgctctctgggactgccccaggcctgctattggatcagaaagatggcataattattgcagcatgtatc

SEQ ID NO: 4451 - DNA, 416 bp, Zea mays
  Clone ID: LIB143-001-Q1-E1-B10
aggggcggagcagaacagcctggtgatcaagggcgagggcgagaaggaggatagcgaggacgaggccgccccgcctccgagatacagcggtcgcatcgagctcgcgccagaggtttacaggatggacaagatcaaggcggagatgaagaacggcgtgctcaaggtggtcgtgccgaaggtgaaggagcagcagcgcaaggacgtgttccaagtcaacgtcgagtagatgtttccaaatagaagcaagtgccggtacgggatggaggattggaggggcactgccaaactaggattcctctctctcaatctgatctggattctggaatcagatttctcttctttcaattttctccgtcaacctccaacaattatgaattaagcaacgtcgcttcagttttcgtgtcaaggccggtgga

SEQ ID NO: 4452 - DNA, 416 bp, Zea mays
  Clone ID: LIB143-001-Q1-E1-B11
aggtcactattgctgtgaaagggcagagccttccttctggtgaaagcaaggatgatagtgccgtgcctgatagagcacagttcaatagagacgatttccctgttcagtatgatgctgcaaagttctttgtcattaaatcgtacagtgaggatgacatccacaagagtgtaaaatacaatgtgtgggcaagcacaaccaatggaaacaagaagctcgatgctgcttatcaagaagctcagtcgaagggttctgcgtgccctatattcttgtttttttcagtgaatacaagtgggcagtttgttggtgttgctgaaatgacaggggctgtcgattttgagaaaaccctggggtattgggaacaagaccagttgaaatggttccttctctgttaagtggcacattgtcaaggacgtgcc

SEQ ID NO: 4453 - DNA, 130 bp, Zea mays
  Clone ID: LIB143-001-Q1-E1-B12
agctgcacccgccattatcgatccatggtcgctcctggggttcatgttcatctgtgtaacgtgctcgcggtcatgtccgtctcgtgccggaattaatatttatatgcatgtatttgtgtttttctgcgtt

SEQ ID NO: 4454 - DNA, 362 bp, Zea mays
  Clone ID: LIB143-001-Q1-E1-B2
gctggaggtgtacaacagcatcatcgtcgagtcggggcgggcggggctaccggtgcggatgttctcgtcgggccgctctgccggtggccctaagattgcagccacgacgtgggcggaggcagtgagcgtcttcatcatggcggcgggcaacctggcgtgggacgtgttcaccacggagcacgaggtggaggccatcctcaagggcagcctcaacctcctggcggggctaggcggctttgccgtggaggccgtcgtcggcgcggctgtcaccaaggcggtcgcaaacgtcggcgccggcgtctttgcttgctctctcgccggcttcgtcgtgggcgccatagccgggctgattttcgtccggg

SEQ ID NO: 4455 - DNA, 369 bp, Zea mays
  Clone ID: LIB143-001-Q1-E1-B3
acgtctctcagatcgggaggcgaaaccaaggcatacatatacatatttgtagtggtaccatcataacaagtaaagatggtgaagttcacggctgaagagctccgtgccatcatggacaaaaagaacaacattcgtaatatgtctgttattgctcatgtggaccatggcaagtctacacttacagattcccttgtggcagctgctgggattattgcccaggaagttgctggtgatgttcgcatgactgatactcgtgcagatgaagccgagcgtggcatcacaatcaaatctactggtatctctctttattatgagatgactgatgagtcactgaagaactacaagggtgagagggatggtaaccaatac

SEQ ID NO: 4456 - DNA, 360 bp, Zea mays
  Clone ID: LIB143-001-Q1-E1-B4
gcgattcgagttaaaaaagaacatacacaatcatatcaccaggccagggcacgcacaagcgagctgatctgcagcattatttggctgattttttaatcattgacggcgggcgaacatatggcggatgactcgttcgacctccccagcgctagcgaggaggaggtgatgggaggcctggatgaggacgaggccatgaaggacctcgagaccgggatggacgatgaggactatttgccaccgacgatgaaggttggggaggagaaggagatcgggaacgaggggctcaagaagaagcttgtcaaggagggcgaggggtgggatcgccccgagcttggagacgaggtggaagtgcattacact

SEQ ID NO: 4457 - DNA, 366 bp, Zea mays
  Clone ID: LIB143-001-Q1-E1-B6
acgaaacatagctacctactactcaagtatccatccttattgtaagtgctcttataagctactactagttacaagctggtttatatttaactacaagtagcaacgatttgtcttagtatatatggttcataatacatatatattggaactgagataatatatgcaggagtacagtgttgatccatggactcggaaggagttgtagcagcaaaggtggcagatgagactactaaaccggcaatccaagaagacggcgccgagagcaaggccgggatgactgatctgctgatgctgaccgacaagtcgcagctgcaggcgctggcgatgctgctgcggaacaacgaggagctcatgatgagccaggcg

SEQ ID NO: 4458 - DNA, 363 bp, Zea mays
  Clone ID: LIB143-001-Q1-E1-B7
atcgctcatcaatcgccagaggagttgttgatcgaggtgagtgaggttgaaaagcacaccatcgtcatggacggcggatactacggcggtcgcgatcagcgctacagcggcgggtactacggcggcggtggcatcgcaacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgacgggaaggtggtgctggcgccggcgaaccccaaggacgagtaccagcactggatcaaggacatgcggtggagcacgagcatc

SEQ ID NO: 4459 - DNA, 399 bp, Zea mays
  Clone ID: LIB143-001-Q1-E1-B9
ctccgcctccctgcctgcataccctgaccggaccccgatcccgccggcgtcgcgcggaatcgcggcggtcaaagcctatacgccaccccacctcacgtcgcgccgcgtcgccgcggtttccgcgtgctagtgctctcgggagctcggatcagaggggcgggctagggttcgccaatcgccagcgtgggtgctgccgtcgggcgccggcggctgagtagtacgaggagagatggacgcgttcctgcacaggctcaagcggctggacgcgtaccccaaggtgaacgaagatttctacaagcggacgctctccggaggcatcgtcacgctcgtcgccgccgtcgttatgctgctctcctcatctccgagacaagtcatatttttattcgtcaacagagacta

SEQ ID NO: 4460 - DNA, 70 bp, Zea mays
  Clone ID: LIB143-001-Q1-E1-C10
aaccaactcttgctcacgcttccatgccactccaatgcggcatccaaaactctgtcggttacgttcgcaa

SEQ ID NO: 4461 - DNA, 110 bp, Zea mays
  Clone ID: LIB143-001-Q1-E1-C11
ctcatccatcgttccaccaccagtctcgcacagatacagcctctatttctgattcgatggatgtgatgttaactcaaacatggtagcctccaaggatagctaaggagtca

SEQ ID NO: 4462 - DNA, 360 bp, Zea mays
  Clone ID: LIB143-001-Q1-E1-C2
gaaagctgctgcaaaagctcgggcatcatcctcggttctgcgaccaatagatgcccgtcgtggtcatgaagctgatgtcatctccagcgacaatgccagtgtcaggagcggcatgagtggtgactacagcggcacaaaggaatcaaacatcgagatgaaactttctccacttcagaactcatacccccaaagccttgcaagccaggatgaatatgataccggcacaccaaccgcaagcagtctaagcagtccggtctacatccacaagcttgcctctcactctcagttcagtgcagcgcctcgccctgcgcctcctgaaagatttgtgccagctatggtacggccacccgttcctaccac

SEQ ID NO: 4463 - DNA, 329 bp, Zea mays
  Clone ID: LIB143-001-Q1-E1-C3
ctttgccagactgaaaagaaagagagcagacatgaattgttgcgccgcgtagctgcgggtggaggggtttttagaaccataagaggcctaagtgccaaattcctgaggcaaatcgtaatgacattgcaaatcaagcagatgatctagtagagtcaatggaatctagggacaccattcctgatcgaaaacttcttgcaagattagttatagtaagagaagaagctcggaatatgatgggaggtggcctgttagatgagagaaatgatcgtgggttgactaacctccctgaggcagaggtaaactttttgagcaagctcgttgctcttaaa

SEQ ID NO: 4464 - DNA, 202 bp, Zea mays
  Clone ID: LIB143-001-Q1-E1-C4
atcgggagtacagtaacgattagtgagtggtcctgtattgagcctgggtgcagcctctgccagtataagtgctctacgtgttatacatttttttatgtccatgaaacattgatccactgagaaaatatatcttcaggtgccaatctacgacaaaaaaggaaagaaaaaaagagaaaaaaaagagcaaaaggaaagaaaggag

SEQ ID NO: 4465 - DNA, 247 bp, Zea mays
  Clone ID: LIB143-001-Q1-E1-C5
atctgacgattgctgggacgacggcgaaactcatcggctgcagaccccaacgctccgctgtactacaaaggatggtatcacctgttctaccagtacaaccccaagggccccgtattgggccacatccttttggcccaatccgtttccccccaacttattaaattggttgcccctgaacccggcatctaacccaacatcccgttcgacaagttccgcggccggtccggctctcggaacatttcttaag

SEQ ID NO: 4466 - DNA, 364 bp, Zea mays
  Clone ID: LIB143-001-Q1-E1-C6
cggacgcgtgggcggcgtcggagctcacgaccacgaccgcttccacgccctcgaccccgaacccccaatcccggacgcgaccgctgaaccctagcatactccggccatctgctgccggccccggcgatcccccgccatggcctcccccgagggcacaacgtgggtcttcgactgtccccttatggacgacctcgcggtcgccgccgacttcgcggcagcccccgcgggaggatttttctgggcagcgccgccgtcgctgcagccgcaggcgccagtgcagtctgtcgttgccgcgtcggctcccaacccatgtatggaaatcagtagctctgtggactgtggtcaggaaaaagaacagccaacc

SEQ ID NO: 4467 - DNA, 367 bp, Zea mays
  Clone ID: LIB143-001-Q1-E1-C7
aggtagctgtagactgtagttctgttcctccccactcactcctgcgcttcctcgccgcgcggttccttctccctgatcctcctttggcttcgcggttcatggcgatgtggagggccgccgctaggcagctggtcgaccgggcgctcggctcaagggccgcgcacacgtctacaggcagcaaaaagatagtcggggtgttctacaaggccggggagtatgccgacaagaaccccaacttcgtcggctgcgtcgagggtgcactcggcatccgcggctggctcgagtcgcagggccatcagtacattgtcaccgatgacaaggaaggccccaactgtgaactggagaagcacatttaagacatgcatgt

SEQ ID NO: 4468 - DNA, 331 bp, Zea mays
  Clone ID: LIB143-001-Q1-E1-C9
agctagttctagatcgcgatctagaactaagcccacgcgtccgcccacgcgtccgaacttatgtgaccaataagatcaagctccagctcaaccgaaggtgtagctcgagccatggctaagatcaccacaatggccgcggcgacggcgatcgcgcttgttcttctacccgtcggccgcggcgaggagatgcccaccgcagcgcacccgcacgggctctcctccgagagcccgctcgctctgtcgccggctgcttacgacttcttccaccccagagcgcgcgcccgacgagctcacggcgtcgcgccggtgccggcgctcgcgtctcacggac

SEQ ID NO: 4469 - DNA, 405 bp, Zea mays
  Clone ID: LIB143-001-Q1-E1-D10
agctctcagaaggcactagcacgcaaaaaccccacgagagagacgaatcttccgaatctctcggtggcgatggcgctctccgaccgctcccgcgagtcgctcctcccgagcttcctctacgcctcctcggcgcgctctttcgctgccacaggagccgccgcgcgcctccctgtctcctccccagcgcctgccacggctggagcaggaggcggcgtgccgttctcgatccaggcgcccaaggagaagatcgagatgtactcgccggccttctatgccgcctgcactgccggaggaatcgccagctgcgggctcacccacatggccgtcacgcctctcgacctcgtcaagtgcaatatgcaaaatgacccaacgaaattccaggattatctcatcgggatttggtat

SEQ ID NO: 4470 - DNA, 414 bp, Zea mays
  Clone ID: LIB143-001-Q1-E1-D11
cgacgagggcggggaggaagacgacgaaggcgaggatgagcggatgacgggtacctcaagggcgtcgtcaccgacgtcatccacgaccccggccgtggcgcgccgctcgccaaggtcactttccgccacccattcaggtacaagcaccagaaggagctctttgtcgcagccgagggcatgtacacgggccagttcgtctactgcggtcgccgcgccaccctctccatcggcaacgtgctgcccctccgcgggatccctgagggtgccgtcgtctgcaacgtcgagcaccacgtcggtgaccgcggtgtcttcgccagggcctctggggactacgccattgtgattaagcaaaagccttggacacgggacatcgaggattaagctgccctctggcgccaagaagattgtccccag

SEQ ID NO: 4471 - DNA, 341 bp, Zea mays
  Clone ID: LIB143-001-Q1-E1-D12
cacagagcttgcgtgcaacgctggtgcaacgagaaaggagacactacttgtgaaatttgtcatgaggaatacaagccaggttacactgcgccacctcgtgttcagccagatgagacaaccatagacattgatggtgatttggttatggatttgcgagacccaaggattcttgctgtagcagctgcccaacatcgtcttcttgaggcagagtatgatggttacgctagtacagatgctagtggtgctgcattctgccgttcagctgcgcttattttaatggcactgttgcttctaaggcatgcattgtctatgtcagacaacgaaggaaacgatgatgacgc

SEQ ID NO: 4472 - DNA, 191 bp, Zea mays
  Clone ID: LIB143-001-Q1-E1-H3
tagggttccttacggttttgtggaggggcgatggcggcggctgatgtggagtagcgttgcttcgtcggcgggcttgcctgggccaccagcggggagtcgcgtgagaatgccttcgcctcctacggctagatcctcgactccaaggtcatcaccgatcgggacacggcgacgtctcgcggcttcggcttcgt

SEQ ID NO: 4473 - DNA, 303 bp, Zea mays
  Clone ID: LIB143-006-Q1-E1-A6
gggggttccaaaactttttaggtcggacggaacttaaccgggctggaacttcccaaaacacccaaaaatatgaaaaatcccgggaccaaaaaccccccccttcgggccccccaaaccccccctttattcaaagccaattaaccaaaaacccccaagcctaaacgcccaaaagcccccaccaccttcaacccagtccctttcagcagcaacgaccgacaccgacaaaccaaaacccaaaaaattcgggggaaataaccgccctctcccccgaggcctgtacccatcagccaacgctattcacaa

SEQ ID NO: 4474 - DNA, 337 bp, Zea mays
  Clone ID: LIB143-006-Q1-E1-A7
aacagcagaaattatcaatacattggactagagctcaatcgcttttagaaaacagtgtactaatcaggactgaaaacatggcataacgctctgaacttgagacgactaaccaaaaaaagtgtactcatcaggacacacatttcggtgcaagacaatccatgagaatgctctaagctacagggctcttcgccttgatactggtagctactcatggggaagtcaagctgttactcgcatgacccgtatcctcgacgtggtcgacaatgcatcaaacactgaacctgtgaggtgacagagccttgtgaagagtgccattgtgcaagttgagtcggcccca

SEQ ID NO: 4475 - DNA, 405 bp, Zea mays
  Clone ID: LIB143-011-Q1-E1-A1
tatagtgagtcgtattagatggcatcaagtactacagagacctcatcaacttgttgctagaaaacggcatagagccatatgtaacaattttccactgggatgtacctcaagcactagaagagaagtacggcggcttcctagataagagtcataagagcattgtcgaagattacacatactttgctaaggtgtgctttgataacttcggcgacaaggtgaagaattggttgacctttaatgagccccagacatttacttccttttcctacggaactggggtctttgcaccaggtcggtgctcatctggactagactgtgcctacccaactgggaattcactcgtcgagccttacactgctggccataacattctcctagcccacgctgaggctgttgatctttaca

SEQ ID NO: 4476 - DNA, 79 bp, Zea mays
  Clone ID: LIB143-011-Q1-E1-A12
gtcgcattaagcaggacgactcaatagtgggacgcgtcagaagtgggactaacctatagtgcgtcatatgagtggatag

SEQ ID NO: 4477 - DNA, 387 bp, Zea mays
  Clone ID: LIB143-011-Q1-E1-A2
cctatagtgagtcatattagtcttgtttgttgccggtggcgagacgtcggcgacggccatgcactgggcaatgacggagctgatacggaatcctcgggcgatgctgaaggcgcaggccgaggtccggtctgcgctcgcggggcatagcacggtgacggaggccggcctcaccgacctacactacctgcggctagtcatcaaggagacgctccggctgcacccgccggtgccggtgctgctccgggagtgccttatcgcacgcgaggtgctcggctaccacgtcccgcggggcgccatggtgctggtgaacgcgtgggcgatcggcagggacccggcgcactgggacgcgccggaggatttcgcgccggagaggttccaggagcttga

SEQ ID NO: 4478 - DNA, 408 bp, Zea mays
  unsure at all n locations
  Clone ID: LIB143-011-Q1-E1-A4
acaggcccctatagtgagtcatattaagcgcagnnnnaggaagcagcagctttgatcgggtggagtttcttgctcactgatcgtcgagtgaagcctttgtggtccgtgacgatgtcgaggagagccgcagcgttgttgctcgcgtgcctcgtcgccgtgacagcggcggcgctggcggacggcgcgctgctcccgtggttcggcgacggccggcgcgggctcgacgaggcagcggtgaccgacgtgggcctcctggcggccgacccgttccggatcctggagcacgtccccttcggcttcgaccgggacgacgtggccatggtctccatggcgcgcgtggactggcgcgagacccccgacgcgcacgagatcgtggtcgacgtgcccgggatgcgcaaggaggacctc

SEQ ID NO: 4479 - DNA, 383 bp, Zea mays
  Clone ID: LIB143-011-Q1-E1-A5
tgccaaggctatggagaaggttggcaaagagggtgtgatcactattgcggatggcaacaccctttataatgagcttgaagttgtggagggtatgaaacttgacagaggttacatctctccgtacttcattaccaactcaaaagcccagaaatgtgaactggaagacccattgatcttaattcatgacaagaaagtgacaaatatgcatgctgtggttaaggttttagaaatggctctaaagaaacaaaggcctctactgattgttgcagaagatgtggaaagtgaagcattaggtactctgattattaacaagcttcgtgcaggcatcaaggtctgtgctgtcaaagctcctggttttggggaaaacaggaaggcaaacttac

SEQ ID NO: 4480 - DNA, 375 bp, Zea mays
  Clone ID: LIB143-011-Q1-E1-A6
tcgagatcacttcgccgccgccgctttcgagatctccgggtggagcaagcgaggaaaggcagcagccatgtcgctccgcgtgctgaaccctaacgccgaggtgctcaacaagtcggcagcgctgcacatgaacatcaacgccgccaagggcctccaggacgtgctcaagaccaacctcggccccaagggcaccatcaagatgcttgtgggtggagctggtgacctgaagctgacgaaggatgggaacaccctcttgaaggaaatgcagattcagaacccaactgcaatcatgattgcgaggacggctgtggcacaggatgacacaagtggtgatggcacaacctccactgtgctatttatcggggagctaatgaa

SEQ ID NO: 4481 - DNA, 379 bp, Zea mays
  Clone ID: LIB143-011-Q1-E1-A8
aatctcagtcacctgcgccgccgcttcgttcgtgtggaggggagaagagaggaaatggcggcgaccgagggcgtgctcctggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaactcctggtgcaacaagttacatgggatgcattggaaaggacaagtttggtgacgaaatgaagaaaaacgctcaagctgcatgagttactgctc

SEQ ID NO: 4482 - DNA, 408 bp, Zea mays
  Clone ID: LIB143-011-Q1-E1-B1
cctatagtgagtcatattatacgacagtatgatctcttcgcacatcagacatggcttcgactctttcaccattcaagtcatttttaggagaatcgtgaacaaaatgaccagatgtttacgcctggttgggaggacatttttcgaatggttcacagtgagctcgacgctgagttttgactgggtctctcgagattcgactcttgatctaaggatgaaggcctatctgatccatagtctcatgaccagccgttggatagttgctcagcactactcaccacaatcaagcgtcgaaggacataatggatgtacacgatgacctggatgtgttccttcgtaccgagacccagggaaacacatatttggctgtgtgcatttcagcggaaactgcaagcttgttgctgcatgctg

SEQ ID NO: 4483 - DNA, 191 bp, Zea mays
  Clone ID: LIB143-011-Q1-E1-B10
tgagtcgtattaaacagtacgactcactatagggagtcgcattaagtagtacgactcactcgcgggtctcgtcaccagctgtctcactcgcacagtgagccggtctgagcggacttgatggcacaggcaccggggcaggggatctcccgcaggccgatttctgcgacccgcaacgaattcgtcagcgcccc

SEQ ID NO: 4484 - DNA, 390 bp, Zea mays
  Clone ID: LIB143-011-Q1-E1-B11
tcgtttgtcattacaactccctatagtgagtcgtttatggaacagccaacggttcgtcagctataattcaccggacatgtccggtgtgcaccggactgtccggtgtgactccagcgcaacggctatcccgcgccaacggctacctgcatacgcattaaatgcgccgcagcgcgcgcacatgtcaggtttgcccacactggcgcaccggacaatgaacaggagctgtccggtgcgccaccggacatcaagggtgggccacaagtcagaactccaacggtcagattccaacggcactgatgacatggcacgggcaccggacatgtccggtgtgcaccggactgtccggtgcaccatcgaacagactggctccccaactgccacatttggtgg

SEQ ID NO: 4485 - DNA, 372 bp, Zea mays
  Clone ID: LIB143-011-Q1-E1-B12
atggcgaccgcagaccgggtcgccgccaccttcctctcctctttccccactcaccatccccgccccttttcctccgtttccctcgtgacaaaccctgtcctacccgtctcccttcgggccgctgtcacaggtggcccacggctcgcctcccgtctccgggtccaccgcgtcggcgccgccgtcgcccagcttcccaccacgaatccggaggtagcttctggggagaagaagatcagatggtcatcaagggctgtgcggtcttttgcgatggcagagctggaggcccggaagatgaggtaccctaccacaggcaccgaggggctcctcatgggcattcctgttgaaggaactagtggcgcagcaaaacttttg

SEQ ID NO: 4486 - DNA, 406 bp, Zea mays
  Clone ID: LIB143-011-Q1-E1-B5
acaaaaccctatagtgagtcgtataaggtgtccaacctctgctccgaattcctcaccgcaggcaccgacacgacgtccaccgcgctgcagtggatcatggccgagctggtgaagaacccggacgcgcaggagaagctctacagcgagatcagggcaacgtgcggcgacgaccaagcggaggtcggcgaggaggacacgcacaggatgccgtacctcaaggccgtcgtgctcgagggactgcgccggcacccccctgcgcacttcgtgctgtcgcacaaggcggcggaggacacggaggtgggcgggtacctgatccccaagggcgcgacggtgaacttcacggtggcggagatgggctgggacgagcgggagtgggacaggcccatggagttcgtgccggagcgat

SEQ ID NO: 4487 - DNA, 409 bp, Zea mays
  Clone ID: LIB143-011-Q1-E1-B6
cacaaaaccctaaagtgagtcgtcttaatcccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagttgaagtcgtgatggccaatgattgcattggtgaagaagttgagaagttg

SEQ ID NO: 4488 - DNA, 377 bp, Zea mays
  Clone ID: LIB143-011-Q1-E1-B7
tcgatcggtgcttttaatctctgaccaagcgatcgtgctcaccatcaaccaccgcgctcatgagtatcagccggccggacccgagcacgaccaggcggtggcatggggaggccgccgtgctgcgacaaggtgggagtgacgaaagggccgtggacccccgaggaggacttcatgctcgtctcctatgtcgaggagcacggccccgggaactggcgcgccgtgccgacgaacaccgggctgatgcgctgcagcaagagctgcacgttgcggtggacaaactacctccggccgggaatcaagcgcggcaactttaccgaccaggaggagaagctcatcatccacctccaggctctccttggcaaccggtgggcggcgat

SEQ ID NO: 4489 - DNA, 381 bp, Zea mays
  Clone ID: LIB143-011-Q1-E1-B8
tttgaggtcctctgtgcacggcctgccttgaaccctactcttccaaaagaggaagttagcttggcggagtgggcgttgcactgccagaagaagggcgttcttgatcagattgttgacccctacctgaagggaaagatagctccacaatgcttcaagaagtttgctgagacagccgagaagtgtgtttctgatcagagtattgaccgcccttcgatgggcgatgtgctctggaacttggagtttgcccttcagatgcaggagagcgcggaagagagcggaagcctcggttgtgggatgtcggacgagggcactccccttgtgatggtcgggaagaaggatccaaatgacccgtcgatcgaatcgagcaccaccaccacaacc

SEQ ID NO: 4490 - DNA, 378 bp, Zea mays
  Clone ID: LIB143-011-Q1-E1-B9
ttacaacatcctatagtgagtcgtataaatcgcggcaacttcacagaggaggaggacgagctcatcgtcaagctgcatagcgtcatcggtaccacgttcggacgtcgcacgcctctcgctctctctcctaccactcgacattcgtttcgttacctaaactggccgggtacgttatctgcatgtggtcactgattgccggaaggctgcccggcatgacggataatgagattaataactactggaacatgcacatccggaggaaactgctgagcagggggatcgacccggtgacgcaacgtcaggtcatggatcaccactcgtccaagatcataatatcgttcgatactgaggtggtcgcagctgcccgtgagtataaga

SEQ ID NO: 4491 - DNA, 383 bp, Zea mays
  Clone ID: LIB143-011-Q1-E1-C1
tatagtgagtcatattaatcatggttgagcttgtccagaaaacatggataagtgaggtctcatgcagaaacggatcaaaatacaggatgtaaggcactaacaaagcattaagaaggacggccatactggaggttctagtcatagatatagttgtctccagtgaacaaggcacttctaagatcgtctgcttatttcacttcagtgagctccttatgcaatcttcatcacaggtgttacctcggtgttaccagactttgccttctggaaaagcatgctcctttctgtagtgggtatactgcgcgacgcgctagaatttttaccacgtctgatgtctttcccatcttcacggatcactggtccgcaccatgtacagcttcttcaac

SEQ ID NO: 4492 - DNA, 288 bp, Zea mays
  Clone ID: LIB143-011-Q1-E1-C11
atagtgagtcgtattaaatcggtttttttgatggtttgacagaagatagtgagcacacacggtggtttcataccatgagtgccatgcgacgagctgtgcgtgctcacgctctatccgtcagtcactcatcaagctcatctgtcttagcttgtttccggatttccgctgctaataaatattcaatcctcaagtttatttgacacagatatcgatcgctatcatgttcgatgcatttatatagaagtattacttacatgtgcggatctcgtgtagatcttcttcctaatt

SEQ ID NO: 4493 - DNA, 384 bp, Zea mays
  Clone ID: LIB143-011-Q1-E1-C2
gaacgaacggacaggttgttgcacagaagcgacatggctttcgcgcccaaaacgtcctcctcctcctcgctctcctcggcgttgcaggcagctcagtcgccgccgctgctcctgaggcggatgtcgtcgaccgcaacaccgagacggaggtacgacgcggccgtcgtcgtcactaccaccaccactgctagagctgctgcggctgctgtcacggttcccgccgccccgccgcaggcgccggcgccggcgccggtgccgccaaagcaagcggcggcacccgccgagaggaggagccgtccggtgtcggacaccatggcggcgctcatggccaagggcaagaacgcgttcatcccgtacataaccgccggcgaccccgacctagcg

SEQ ID NO: 4494 - DNA, 371 bp, Zea mays
  Clone ID: LIB143-011-Q1-E1-C3
atagtgagtcatattaggcgtcggcccacgcgtccggcttttgtggctggcgtcggtggcgggtgcgtcgcggtctggtgctgcgtggtgggggcgggggtggctggtgggggcgtggcggcggggggggggggggccggggcttggggggggctggggggcggctgggcgccgcggggcgggggcccttggggttcgggccgtcggtgcgcgtggtcggggggtggtgcggcttcgtggtggtcgcgctggtccgcttccggggccggcgttttgggcggtcttggcggggagacgcgggggggtggccggtttgcccgcctgggggcgcggccccctttggccgcggggggtgttggcgggggggcggc

SEQ ID NO: 4495 - DNA, 416 bp, Zea mays
  Clone ID: LIB143-011-Q1-E1-C4
acaggcccctatagtgagtcgaattacgcggtacagaggacaagaacgcgtggaggaccgacgaggagttcgcgcgggaggtgctcgccggcgtcaacccgatggtgatcacgcgcctcacggagttcccgcccaagagcacgctggaccccagcaagtacggcgaccacaccagcacgatcacggcggagcacatcgagaagaacctcgagggcctcacggtgcagcaggcgctggacggcaacaggctctacatcctggaccaccacgaccgcttcatgccgttcctcatcgacgtcaacaacctggagggcaacttcatctacgccaccaggacgctcttcttcctgcgcggcgacggcaggctcgcgcgcctcgccatcgagctcagcgagccgtacatcgacggggacctc

SEQ ID NO: 4496 - DNA, 379 bp, Zea mays
  Clone ID: LIB143-011-Q1-E1-C5
acggagaggggagacccggtcactaccaatgccaagaacaagaaaccagagaggacagtcgtcaatccaatccgagtctcctccaaaaacccatcaatctgcaggaacgagagcagcaggagagcatcctaggaaaaaagttaggaccaactgaccgagcaaaaaaggtagcatctctgtatcaccaaggcaccgccgatcacagaccaaatccctcccccctctggtccatcccacacgtagagcagccggtatttcttcaatccgtgcttgcgcttttttttttctttgtaaagatttcgtttccctcccttttaactgttgccgagaagtttcgacaagagtggtgtgagtgttgaagagctcctcaacatgatgg

SEQ ID NO: 4497 - DNA, 409 bp, Zea mays
  Clone ID: LIB143-011-Q1-E1-C7
cttacaacaccctatagtgagtcgtttaaccgcgatctgaccgtccgccactgcgcacctgccggcgtctggcgacgccccgccgccagcctgccaccaccacgacgcctgcaccagaatccgacactgtctcaaccactccgtcgtgcctatccgaagctcaacggcggagcccggtgggatagggcggagacgctgaggcctgagggggagactggacctgggctgcacgaggtaggctgtgcggtggcggaaggaatcaccgatgagcgatgcgcaggcgacaggggatggtccgcgctgcgttggctgcggcgggcgcgtgaagacgctcttcgtgcagtactccacgggcaacatccgcttgatgaaatgcgataagtgcaaggctgttgctgatccctacata

SEQ ID NO: 4498 - DNA, 203 bp, Zea mays
  unsure at all n locations
  Clone ID: LIB143-011-Q1-E1-C8
atagtgagtcgtattaaacgntgtgactcagtatgcggagtcgcaaccccgggtgtgaggcgatacagcgccgcgagcctgccaccagcaggacgcctgcacgagtttcgggcactggcgcaaccacgccggcggggcgagccggggctcagtcggagggcctggtgggatagggcggagacgctgaggcctgagggggagac

SEQ ID NO: 4499 - DNA, 388 bp, Zea mays
  Clone ID: LIB143-011-Q1-E1-C9
agtgagtcgtattatacagaacaatctggcacaatcttagctgacgaatgttgggattgcaacgagaaacatcctcgatgtacaagagaacgtcatcgagagattatgctccgatgatcgacgtcgaacagagctcaggtcttttagacaatgatgtggacaatgaaatggaaactacaaatccttcatggaagtgttctcttccgcatgttctagtggctacaatttcgtcgtttctatttggttaccatttaggagttgttaatgaacctcttgaaagcatttcgtctgatcttggttttagtggtgatacattagctgaaggtttggtggttagtgtatgtcctggtggtgcatttctcggatctttaatcagtgggggagttgc

SEQ ID NO: 4500 - DNA, 261 bp, Zea mays
  Clone ID: LIB143-011-Q1-E1-D10
gttacaacaccctatagtgagtcgtttaaaacggcgctcataggactcttccacggtcgcaacgtcggaaagcagctcgtccgcgtcgccgacgacgagtgagacgcgcctcacttcgattggaccagacgatccatgtgtcgctgttgctatgtttcgattccccattttcatgaataattaattgtgccaatggatgcttttgttcggaatatactccgtatgccgcattttactaattcgagggagataattgcaggg

SEQ ID NO: 4501 - DNA, 234 bp, Zea mays
  Clone ID: LIB143-011-Q1-E1-D11
atagccacgtgcaagtgatcgagctcccccctcctcatcagtcgctatgcacagcgcacttgcaggatggcgcaggtctctaagacgcttctccttgtggccctggtgttcgtgtcgtcggcggcggtggatctgtgccgcgcgatcgacttcggataacgggacctggcgtctgaccacgcgctgtgggacctgtacgaacagtggcagacgcaacatcgggtgcaccggcat

SEQ ID NO: 4502 - DNA, 412 bp, Zea mays
  Clone ID: LIB143-011-Q1-E1-D3
ttgctggtccctatagtgagtcatattatcgcgtccgcccacgcgtccgcggtcgcgtgggttggctgccacgggggcccattcctcgtcgtcgtcattggcgcctacgaggaagatactctcaggtgggcgagcgtctactcatcggagactggcgtatggactacgtcatcctccattcaaattgatgcctacgtcgagcaaaggcccagcctccttgccggtgacgcgctctactttagcgcacaggaaggcaaaataattgtcaaatacgacctcaatggacagagcctacatgtgatcaatgcgccggatatgtttgagccaacagagggcattgctgtgaccgtggaggacggtggtttgggactcgccggagtgaaggatggcaacctccacctgtggtcatggc

SEQ ID NO: 4503 - DNA, 351 bp, Zea mays
  Clone ID: LIB143-011-Q1-E1-D5
ttgtgtttcttctccgtccagccatatggtatggatcctagtgggcggcggtgcttcttcttctcttctgtcgtagccaaaactaatcatctgaggctagtgaggaagaagggtttcctcgcaggcaattgagttctgtcgtcgtgtacgtggagtctgattagcagcagtccagtatgcttggttggcgagtcaaactaactttttttaggggggagggcgcaaattatgtagtgacctgcctgtgggtggtcctggccgcggggtggtccgtccggtcaggctgtgtaccctttttccttcacatctctctttatttattaatacgatgagatggtgtggttatgttct

SEQ ID NO: 4504 - DNA, 226 bp, Zea mays
  unsure at all n locations
  Clone ID: LIB143-011-Q1-E1-D6
ctatagtgagtcgtattaaacnntgggagttacccgcttgacgggcgtaattgtacagagtttacagagcgacaaggaagtatttttacatgagcgtgtaagtaacgcgagtggtgcaggggagatgctgggattcggcagcgtgagtggtgcttcagtgttggatgatgggggtgagttggtgatagtgagtgaaccggacctagaggcggggacaatcactatt

SEQ ID NO: 4505 - DNA, 403 bp, Zea mays
  Clone ID: LIB143-011-Q1-E1-D7
caacaccctatagtgagtcgtatacctccgtcctccgcgtttccacgcaggaagactccgccgcctacgccctcgccatcatgaagcatccggatccgatcggcgaggggctggctatggaggcgttcgcggaggcagccgggccggagtgcatcgtgcccggacagcaagcgcctctaaggcttatggggctcaaggtctggcccgttgatatagatatgaagttcctagagccatttggacgggaactacattcaatgaaaaaattcatggacaaatcgtgcagtgttatggactcatctatggcaaacaagtaggcacatgacacatcagttccgtccaatacagctgttgttgtatccacctgcttcctgaagttacaagacccgagaaatagaagaga

SEQ ID NO: 4506 - DNA, 338 bp, Zea mays
  Clone ID: LIB143-011-Q1-E1-D9
agctcctttggtggagttcaaggaggccaaacaatgcaaccaaaggttggctacatagcactagatattctcacagatactgtagaagctgctgaacatcaatggaaatttcatctctggtgaagggatcgatgaggtggaggaaatcttgaaggctggtaagatacccctgaaagtgctgggcccactacatgagaatgagcctgatggatagcctgatgatgacgatgaacaagttgtggataatgaggactagctgaattcgaagctgcagagtgtgaaggttgagcatgatgattgaccgagttggtatccaaaaatcaacctgtcccaaggtc

SEQ ID NO: 4507 - DNA, 333 bp, Zea mays
  Clone ID: LIB143-011-Q1-E1-E12
accggaggagttgtcacagcaaaggtggcagatgagactactaaaccggcaatccaaggagacggcaccgagagcaaggccgggatgagtgatctgctgatgctgaccgacaagtcgcagctgcaggcgctggcgatgctgctgcggaacaacgaggagctcatgatgagccaggcgattaagtcggagacggaacgcattgagtacctcaagacggtgagcgactgctacacgcggacgatgaagctcctccacgattccatggcggccaggaccacgtacgatcgttcaggcagattgatgatccacgtcacccgggacatggacgactac

SEQ ID NO: 4508 - DNA, 416 bp, Zea mays
  Clone ID: LIB143-011-Q1-E1-E2
tacaggcccctatagtgagtcaaattaagttgctaggtcctttgaaccagcaactgaagcttcctcgtctcatcatcgagaccagtaagcaacatggcggctaatctcaagtgggctcctgttctagccctcctcgtcgtcgttgctgccatggttggcaccaccagcgccggcaacatcgcagtgtactggggccagaacggcaacgaaggcagcctggcggacgcctgcaactccgggctctacgcctacgtcaacatcgcgttcctcacaaccttcggcaacggacagaccccagttctcaacctcgccggacactgcgaccccggctccggcagctgcaccggccagagcagcgacatccagacctgccagtcgctgggcatcaaggtgctcctctccatcggcggcgccag

SEQ ID NO: 4509 - DNA, 407 bp, Zea mays
  Clone ID: LIB143-011-Q1-E1-E7
tacaaatctctacagtgagtcgtattagatcgagctcccccctcctcatcagtcgctaggcacagcgcacttgcaggatggcgcaggtctctaagacgcttctccttgtggccctggtgttcgtgtcgtcggcggcggtggagctgtgccgcgcgatcgacgtcgacgagcgggacctggcgtcggacgaggcgctgtgggacctgtacgagcggtggcagacgcaccaccgggtgcaccggcaccacggtgagaagggccggcggttcgggacgttcaaggagaacgtgcgcttcatccacgcgcacaacaagcgcggcgaccggccctaccgcctccgcctgaaccggttcggcgacatggggcgggaggagttccggtccacgttcggcgactcccgcatcaac

SEQ ID NO: 4510 - DNA, 385 bp, Zea mays
  Clone ID: LIB143-011-Q1-E1-E8
ttcaactgcggaaagattatgaagaagcgaaagcaaagggaacagagaattttgacagagaactcgaggatatgatagaaaggctcattgtggagtgcgacaggaaaattcagagggccctgaaacgacttgcggatgacgatgccaaggctgctattgcgatatccgtctcggaggttactctgacggatgacatactgcagctgtcaaaacagatcaaggaaaaaatggtagaagttgatgcctttgattttgaagggagaactgatgataaaataaaggcccaggaagtagtggaagaactcagaactaaaagagctgatatgcaggctaccctcttgcttgatgcttttaacaaggacagagcttcattaactcagcctgg

SEQ ID NO: 4511 - DNA, 382 bp, Zea mays
  Clone ID: LIB143-011-Q1-E1-F1
cgcatagatcgagctatagctagctctgcaaccagagacaatgaggacgaggactacccttcgtaggccggcctaaagacgagtacgtacagaacttgggacatggaaaccgtcgtgggcgacgtcatggataccgagctgaggcttggcctgcctgataccgtggatgactgcaaccaggcccatctggtgaaggccactccgccgtcgacgccaaggggcaagaggcgcgccaccgccgatgccgtacaagaagccgccggcgccgaggaggcaagcaagcgtgacgccgagacagcgccctcagcatccaaggcgcccgtggcccgttggccgctggtgaggtcgtaccggaagagctgcttccagcaggccagcaaca

SEQ ID NO: 4512 - DNA, 408 bp, Zea mays
  unsure at all n locations
  Clone ID: LIB143-011-Q1-E1-F2
cctatagtgagtcatattatcctcctcttcctcctcctancacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcgaggcggccaccgagggcggcggctgcgactgcaacacctgcaactgcggcaccagctgcggctgctcctgctgcagctgcaactgagccggcccgcccggcccggcgatggcgcacgagagtcgagaggacgacgacgacgaggcgtataaatataatagcagcgtctaaataagat

SEQ ID NO: 4513 - DNA, 413 bp, Zea mays
  Clone ID: LIB143-011-Q1-E1-F4
tacaggcccctatagtgagtcaaactactacgtcaaccgcggcttcgaggaggtcacgggctaccgcgccgaggaggtcctcggcaggaactgccgatttctgcagtgcagagggccattcgctcgaaggaggcaccccctagttgatgctgcactggtttcagagattcgaagatgcatagacaatggcattgagttccgtggtgatttactaaatttcagaaaagatggatctccagtgatgaacagattgcatctgacccctatttatggagatgatgaaaccataacccattatatgggcattcaattcttcactgatgctaatgttgatttgggaccattgccctgttcaatgacaaaggaaccagtgaggtcaacacggtttgctctagataacacatttcgaccca

SEQ ID NO: 4514 - DNA, 76 bp, Zea mays
  Clone ID: LIB143-011-Q1-E1-F6
cctatagtgagtcgtattaaacaaggcggggcaggaagggagaatagaaaaaagaaagggcggccgctcaagagga

SEQ ID NO: 4515 - DNA, 400 bp, Zea mays
  unsure at all n locations
  Clone ID: LIB143-011-Q1-E1-F7
tacaacaccctatagtgagtcgtttaaactgnatgagatattcacatggtggcaccggattccaaagcacatgaatttcctgaagcatttctgggagggtgatgaggacgaagtgaaggcgaagaagactcggctgttcggcgccaacccaccgatcctctacgttctccactacttggggcggaagccatggctgtgcttccgggactacgattgcaactggaacgtcgagatcttgcgggaattcgcgagtgacgttgcgcatgcccgctggtggaaggtgcacaacaagatgccgaagaagcttcagagctattgcctcctgaggtcaatgctgaaggctgggctggagtgggagcggcggcaggccgagaaggcgaacttcaccgacgggcattgg

SEQ ID NO: 4516 - DNA, 392 bp, Zea mays
  Clone ID: LIB143-011-Q1-E1-G10
gatacaaaactctacagtgagtcgtattacttcttcatcgacctcctcctcctagcacagctagcgccagctcaccttcggctgggatcacgtcgtgcagcagaggtaagtgcgactgtcgcaccagctgctcctgcggtagctcatgcatctgcatgtcccctaacgtggagaccgccgccgccagcagcatcaacatcaccgtcgtcgccgcgccgaccagcaagggtagcgccggcggcttcgaagccgccaccgacggcggcggctgcgactgcaacacctgcaactgcggcaccagctgcggctgctcctgctgcagctgcaactggaccggtcatgccatggcgcacgagagtctagaggacgaagatgagtcttacaaatataat

SEQ ID NO: 4517 - DNA, 380 bp, Zea mays
  Clone ID: LIB143-011-Q1-E1-G5
aaagcagaccaacctagccacccagggagaaagaggccaaaagggaggggagagtgtcgtcatggcttccattgtcgcttccaggagggccgttcctctagttcgcgctctggagaagctcatcgcagcgtcctccgctcccgggactggctccgccctcaggccggtggcagtcgccggcggcctccgcggctacaacaccggcgctccgctccgacgctacgagggggccgagtcggaagacgatagcgtccgcgagtacgatgggcggcacggcggccgggactacgctgtgcccagcctgttctcagatattttccgtgatccgcttagtgcgccgcacagcattggccgcctgctgaaccttgtggacgacttgg

SEQ ID NO: 4518 - DNA, 378 bp, Zea mays
  Clone ID: LIB143-011-Q1-E1-H1
ctccctcgcgtccgccgcggcaccggtactacgagtgcttcgctaccagccagccagcacactctatgagtcgccatcttccactccaccgaggcagctccaagccatggccatggagaaggccgcctccttcctctcctccctcttaagcggtggcggcggggagccggcggggactgtgaaatctatcttcatataccctatcaagtcctgcatgggtcttgccgtgtcacaggcgcccatcacctccactgggttccggtgggatcggcagtgggtggtggtgaacgccaaatggcgagcatacacccagagggtggagcccaagcttgctctggtccacgtggagttgccgccggaggccttcgctgagaactg

SEQ ID NO: 4519 - DNA, 68 bp, Zea mays
  Clone ID: LIB143-011-Q1-E1-H10
gtcgtatcatctcctccactggtttcgggtctctaaggatatgcggctgcgtaatgtgggcagctgac

SEQ ID NO: 4520 - DNA, 290 bp, Zea mays
  Clone ID: LIB143-011-Q1-E1-H11
aacataaggggtgcagatgacgacgatattggggatgatgaagatgatgtggttgatagtgctaacatggatggataaggtggtaagacagattacagcaaggaggaggaagcagctccggcagcggcaaaggaagttgtaccatgaacaagcatttccgtatgctcgatgccaaacgtgtcgacggcatctaggtaggctacacgtatccttggctttttggagttaaatctgtcagtcgaatcactcaatgcctacgtcaagtatacgatacaacaggagttgtgctg

SEQ ID NO: 4521 - DNA, 415 bp, Zea mays
  Clone ID: LIB143-011-Q1-E1-H5
cgtttgtcttacaacaccctatagtgagtcgtagtattcctcgaattcttgttccccggtccctcctcctgtccccgcgtagatccgtccgtccgaggagcacaccgtccccacccccatgtttacccaccagttcctctgacggccgccgtgctccgatgaagctgagcgtgctccgtatccgccgctcccactccttctccgtcgccttcctctactggttctacgtcttctcatgaacgcatcgcccctctccacctgctgatccttcgccgtctctctctctctctctctctctctctctcttagatagtcttttgaatccatctctagggctcttgtttctcgccatcctcaccgcaccccaccccgcaccaaacagattcaatccgacaagacaagcatcgatgtcgtc

SEQ ID NO: 4522 - DNA, 106 bp, Zea mays
  Clone ID: LIB143-011-Q1-E1-H6
ccctaaagtgagtcgtattattcgtcgtctcggtgtcgtgcgggcttggcccgggtcttcgtctcctggggttggctgggttgctttggccgtgcgtttgcggctg

SEQ ID NO: 4523 - DNA, 58 bp, Zea mays
  Clone ID: LIB143-011-Q1-E1-H7
cctatagtgagtcgtattaaacgtggggtcctcattgtgcgggcttgcggattgattg

SEQ ID NO: 4524 - DNA, 384 bp, Zea mays
  Clone ID: LIB143-011-Q1-E1-H8
agcgtccctcacgcgtccaggcggtgtccgccgacttgtggaaggtcctcgccgccgtcgtggccgcgtgccgcgtgcccgaggagcggtgctgcatgggctggatggtggacgctcggcggcgggtgaagtcgcccgagctgatccccgcgatgcgcaactacttcggcaacgtcacggcctacgcgctgggcggcgcggccgtggaggagatccggcggaagccgctggccgaggtggcggccatggtgcgggataccatcacgtccatagactacgacgagtacctgcaggagctggtggactgggtggaggtgcacaagacggagcacgtgatggagaagggcgtcctcgggctgggctcgccgacgttgaaccagaccg

SEQ ID NO: 4525 - DNA, 132 bp, Zea mays
  Clone ID: LIB143-013-Q1-E1-A12
tatagtgaatcgtattacaagttggctcgccggcgctgatccttgggcgtgactctggccgcgttacaggagcttcactcggtccctcactgccgcgccggtcgaggcagcgcgcgtcgagggcgcaggggg

SEQ ID NO: 4526 - DNA, 217 bp, Zea mays
  Clone ID: LIB143-013-Q1-E1-B12
agcgtgtgcgagacacaccgtcaaacggacccgagagagtcactgaccagaggctatggcatcgacgcgcggcacgcatggggctcccgccgaggcgggcgtggagcgcgccgtacgtgagctagctcgggggcgggacgggacgtggactaaggcggtgatgaacgcccggcacggccgcggaggagatcgcgcgctcgcacgccaaccgtgctgc

SEQ ID NO: 4527 - DNA, 316 bp, Zea mays
  Clone ID: LIB143-013-Q1-E1-C6
caattgttgagggtgtcggcgatgatgtggtcgctgaacatgcatagatcacatgtggcaagcaacgtcagcacatgcatgtagctgcagtgatttatgatgctgttctgacgctggcgggaccagtgtactacgacatagatgttgtcgctggtatcatacatcgcactgccacaaccgcaacatatattaagtctgcagatcctatgccatcatcggaaggttcgctggccgattcaggagacatggtcatcaccatggcatggggtaacgtcctcgcatctcatctcacgatcactgaatatgatgtagactt

SEQ ID NO: 4528 - DNA, 434 bp, Zea mays
  Clone ID: LIB143-013-Q1-E1-D11
tatagtgagtcgtattaacgcgtgggcggacgcgtgggccggcaccggccccccgcgacgctggtgccgcacatcgcgggcgacgcgttccagctgacggagtggtacacggtgcccaagggcgccatcgtgttcccgtccgtgtacgagtcgtcgttccaggggttcccggacgcggaggcgttcgacccggagcgcttcttctcggaggcgcggcgggaggacgtggcgtacaggcgcaacttcctggcattcggcgccgggccgcaccagtgcgtggggcagcggtacgcgctgaaccacctcgtcctgttcatggcgctgttcgtgtcggtggtggacttccggcgggagaggacgcccgggtgcgacgacccggtgtacatgcccaccatcgtgcccaaggacggctgctccgtgtacctcaagcagcg

SEQ ID NO: 4529 - DNA, 334 bp, Zea mays
  Clone ID: LIB143-013-Q1-E1-E3
actccctatagtaagtcgtattaacgcgtgcatggagaacggcgtgctcacagtcagcgtgcccaatgaggatgccaagaagccgcatgtcaaggctgtcgatatctctggttgatcgatccgttcactgcatgcattacgagtgcccgagctgtactacaggtagtataacttttcgagattccctggtacgacatctgccatgcatatacaacctgtctatctgtccatcgttcgtgtatggcagtgttgtgcttttggtgtcaagtacgtctggccaatgttttgtgtctatgtgatgtgtaatgcatctgtgcttttctttgtgccgttg

SEQ ID NO: 4530 - DNA, 377 bp, Zea mays
  Clone ID: LIB143-014-Q1-E1-C9
gagtcgtattagagcccaaccgcacaagcgcgcgaggcaggagagagagagaggcggggagcaaaacaatggaggggaaagaggaggacgtgcgcctgggcgccaacaagttcgcggagcgccagcccatcgggacggcggcgcagggcgccgctgacgacaaggactacaatgagcccccgccggcgccgctgttcgagcccggggagctcaagtcctggtccttctaccgcacgggcatcgccgagttcgtcgccaccttcctcttcctctacatcaccatcctcaccgtcatgggcgtctccaagtccacctccatgtgcgccatcgtcggcatccagggcatcgcctggtccttcggaggaatgatcttcgcg

SEQ ID NO: 4531 - DNA, 305 bp, Zea mays
  Clone ID: LIB143-014-Q1-E1-D10
atagtgagtcgtattatcctggaaaaggagaacttacgccgcagcccttcgccctccttccgtcggcttcgacgggcgccttaccacgcaagcgcgggaccataggagcttggccagcagaggattgggacatttgggaagggtgagcaaaggccctgttccattcgcgaacattgggaagagagcaactgatcgcgtgtacaaggactacaactttgatgaagacgttttggtggcgacatgttctaactctggcttgattctcacagccactgggcgtgaaggatcagttaagacttcattgg

SEQ ID NO: 4532 - DNA, 341 bp, Zea mays
  Clone ID: LIB143-014-Q1-E1-D2
gggccacgcacgcgtccgcaaacgagtccgcggacgcgtgggcggacgcgtgggtgaaaacccaggttgggttgaaagtattggtgtcaatctgtgagattatttatcacttcagattgaagacatgatttggtagtggtaaagaaggagggggaatgagacatggtgggggagttagataattgagtactactgaaaggatggggacgggtaatccgaaattaatagtagaaggggctagagttacagtgattaaacaaggaagggggcacaggagaagggggcgcagtccaaggcctcatgatgattatggtggtcgtggtaaggatctcccaaccagt

SEQ ID NO: 4533 - DNA, 138 bp, Zea mays
  Clone ID: LIB143-014-Q1-E1-D5
tatattgagtcgtattaactcttccttcctcggtccagctctctctctttccctctctctctcgcggccctctatctccttagctgctgggatcacgctgttcgatcgtctggtgctagcttggtagtctggaagcgt

SEQ ID NO: 4534 - DNA, 304 bp, Zea mays
  Clone ID: LIB143-014-Q1-E1-D8
gagtcgtattatgagtcaccatgagaaaagcaatgtttagtattcaaattcaacgcgcgctggcgcgcgccattgactagtatttatatagtgggctctccgtaagtttctgtgagccgggtagctacacagtacgcacacggagcccggctgcagcgcggttccagccactggtgccacgtggtttgtgctcttgtgggcacactggcctctacccatgctctctcacgtctccccatccgcagcagaggcacacagtacagattcggcccatcgttttagagccacaccatggctaggaagt

SEQ ID NO: 4535 - DNA, 191 bp, Zea mays
  Clone ID: LIB143-014-Q1-E1-D9
atggacgggacattctggagctcagcgccatcacgttccttatccaactcactggccttgtagctgagctcgagaatgccctgaaggagtggactggagggacgactgtcgcaaatctcttcagcaatgggaagcatagtggctgctgtgatgagactagggcgctgaagagtgatgggaagctggtgcct

SEQ ID NO: 4536 - DNA, 356 bp, Zea mays
  Clone ID: LIB143-016-Q1-E1-H12
agggcgataaacatcgattcattaaaaaaaccatttacatgagcagaagattacatgggaaattcacctccaatagcgggtgatttttgattgagatttcggcaactactaagatgtaggtacacaaaatatgctgtagggaatgctgatgtcttaacagattacataacacaatgggagagtaatccacaagcaggatgcaatggccaactagtccactaacttaaaaaaaaacagcatcaaactaccatgttccggaatcacagaaataccaagccgtggtggaaatccggcccgccttcgtcgtcacatcagccgccgccatgcttcgccaccaagaccctaaccctatgcac

SEQ ID NO: 4537 - DNA, 291 bp, Zea mays
  Clone ID: LIB143-018-Q1-E1-A12
aaccgaagcagggagttgatttatccgctgcagccatgagtaagttgcagtccgactctgtcaaggatgctatctcccatattgttggggatgccattgagaagatgatgaagttcactgagactgtggaacttcagattggtctgaacaattatgatccacagaaggacaagcgtgtcactggctctgttaagttgccccatatccctcgtcccagtatgaatgtgtgcatgcttggtgatgcccatcatgtttaggatgccgacaagatgggacttgactacatggatg

SEQ ID NO: 4538 - DNA, 145 bp, Zea mays
  Clone ID: LIB143-018-Q1-E1-A4
actctctatagtgagtcgtattactgtggccatcacagcataatcgatgccctcagatgctctttcgcttccattactgataatatctgtgcagatcttgtccctttcacccgagctgactacctctttcagagcactgattgtg

SEQ ID NO: 4539 - DNA, 442 bp, Zea mays
  Clone ID: LIB143-018-Q1-E1-A9
acgggccgacccacgcgtccagcgcccgtctcggactgcgcgtccgccatggcacatgccgcattcctcgtccgcgcgccgactcgcgcctcggctccgcgccgcctgcagacgccgaaccatcgcctccagcccaggcgcggctaccacgtcgagcttggggctcgcgaaaaagcgcttttggaggaggatgttgctttgaagaggttcaaatcatacaaaaacagtgtgaaacaggtctccaagatcgggaatgctctcactttagctgttgtacttgcttgcagctacgagcttgctgtgttggcgactagcacaaaatgaaggaaaactcagtcatgtggcggcacggttattccgggaagtgatccatcagcatgaactggcactctctctcttcgtgtttttttagccccgtttgttgatcactcgtaccgtgtaa

SEQ ID NO: 4540 - DNA, 249 bp, Zea mays
  Clone ID: LIB143-018-Q1-E1-B10
caactggaacctgacgcacgagatcagcgcgctgtctgcagtgaggtcaaggaacgggatgtatccggggatcgagctgcacatcctcgccggcgacggggatctcgacatcgccaatattgacgataaggtcatcgtgaatatcgggtcacggtacgacgtcgggaaccgtgatcacctcagacttcgacgccgttgcgcatggcaacaactactgcgtttgggagacgcatggtcggacagttcgag

SEQ ID NO: 4541 - DNA, 411 bp, Zea mays
  Clone ID: LIB143-018-Q1-E1-B4
agctaagcaagtgccaaccaacgagtagcaggaaacatgtctccgcccgtcaagatcctcggccactacgcgagcccgtactcgcaccgcgtcgaggccgctctgcggctcaagggcgtgccgtacgagctggtccaggaagacctgggcaacaagagcgagctgctgctcgccaagaaccctgtccacaagaaggtgcccgtgctcctccatggcgacagggccgtctgcgagtccctcctcatcgtcgagtacgtcgacgaggccttcgacgggccgtccatcctgccggccgacccccacgaccgtgccgtcgcccgtttctgggcgaacttcttggacaccaagttctcccagccgttctggctggcgtactgggcggagggcgaggcgcagaaggccgtggtgaag

SEQ ID NO: 4542 - DNA, 271 bp, Zea mays
  Clone ID: LIB143-018-Q1-E1-D11
gcaaccctctagagtgagtcgtattagaatgggatcggcaaaggtacatgctacgacagcacgcgcaccacacccatctctagcttacttataagaacattcatgtcgttggggataaactactcgttagtgtgatctacgtgatccattagcgtcagtgctatggatgcatgatcatgagttgatcttttagcatctacagtacaggaataatatgacaatgtggcacgtttcctggaagcatgtggactgttcgacgaagggctcgaga

SEQ ID NO: 4543 - DNA, 100 bp, Zea mays
  Clone ID: LIB143-018-Q1-E1-E9
ccacgcgtccacgttagccttgcttcttgccaaaaaaaaaaaaaaaaaaacaaaaaaaaaaaaaaaaaaaaaaaaaaaaaaaaaaaaaaaaaaaaaaaca

SEQ ID NO: 4544 - DNA, 422 bp, Zea mays
  Clone ID: LIB143-018-Q1-E1-G2
tcccaatagtgagtcgtattactggagctcgtccaccacgcaatagtgtatttgaagtgctcctgattaactgtttattaggttccgtgcttgggtcatgggtatggttcagagtctccgtagagttgcttcacgcaagcactacacagtcggaggttcttgttgcgtggtacactgtaaacttagtagtagtctttgtcgacaacaagctgcgagaaatgccggatcggacgagtggactacatttgcttccattaagctccaaagaaaaagagggcaggcagaaggaggagaaagacagtagactgaaggacgagttccacaagttactgaatgggaaccatgcggatcctactgatcggcgacagcgggcacagatgaacgggacgcacgacgaagacatcaatcacgcgctctccgag

SEQ ID NO: 4545 - DNA, 59 bp, Zea mays
  Clone ID: LIB143-018-Q1-E1-G8
agtgagtcgtattaaaaccccgagatgatcgtcgacgtcgagggcacgcgcgaggtcgg

SEQ ID NO: 4546 - DNA, 339 bp, Zea mays
  Clone ID: LIB143-019-Q1-E1-H7
agagttcaacagaagctcagtttattacatagaccaccctgtactatcataagcacgactaaaagtcccagagcagagaatatgcagtgcgctttacaaggctggttcatgtctatcatgtttgttggtcatccgtccttatttcgatggctgcattggacagcgatgtgttatttttgaaagctgactccactgccacaaaggcatgcatgtattcagagcttgcacggtgacgcacctggatggtgcgccacgatgaggttgtacgcgtccagcgtgaggaagtcgtccagctccggcgcggtgcactgccggctgaagatcctgcccgcctccgcg

SEQ ID NO: 4547 - DNA, 51 bp, Zea mays
  Clone ID: LIB143-021-Q1-E1-E8
cctggcgtaccagtccggacctccgggtcgacccacgcgtccgggaacgcc

SEQ ID NO: 4548 - DNA, 63 bp, Zea mays
  Clone ID: LIB143-028-Q1-E1-C7
ccacacgtccgtgactagtgtacacctcacacctgtggctatgcttgaattgttgatctaaaa

SEQ ID NO: 4549 - DNA, 280 bp, Zea mays
  Clone ID: LIB143-030-Q1-E1-A1
cacctgtgatcacaaaatggtccgcatattatgcaacgactgcagggcaggatcagatttgcatgtccatttagatgcggagcattaaggtccgctgacgtgccggcttacctgaagccgcgcttgacctgagacaacgtccagaagagcgcctaccatgccgtcgaccgctacatctagaagtacatcgacacgagctcgccggatcctctctatcaggtctgcatcgcgatggatgatcttctcctacttcgtcaatctgccctgggagcgcgctcac

SEQ ID NO: 4550 - DNA, 352 bp, Zea mays
  Clone ID: LIB143-030-Q1-E1-A12
tatctttggatgaaaagtaccccaccacacacgcacgaccccaatctaggcctcaagctcaacgtcgacaaggcgctcggcctccccgccgtctgccatgcgcccgccaatatctccgactgccccaggctgctggacctgccggccggctccaaggacgcacaggtgttcgagcagtacgcgaggcagcaggctgcggcggatgcgcatggcggcgcacccaccagtggacgcagcatgctcggcggcgagcacgaccgcgggcgcgcagaagagcggagcctcagccgccggtcggtggttgggagtggggatggtcggtggtgccggtggctgcgcacgctcggtggcg

SEQ ID NO: 4551 - DNA, 318 bp, Zea mays
  unsure at all n locations
  Clone ID: LIB143-030-Q1-E1-A4
tagtgagtcgtataatgcntacccccgaaaatttgccgtcttctcatctcgctcccctctttgcgccgcccccagatccggcaccgcccgctgctcgaacccgcaccccacgcccgcaggccgggaccggtgggcgcgcgccgggcagtacgagggagaggaagggcggcatggcggcgccgccggcgagggcccgggccgactacgactacctgatcaagcttcttcgcagtggggatagcggtgttggcaagagttgcctcctgttgcggttctctgatggttccttcacgagaagctttagtaccacaattggga

SEQ ID NO: 4552 - DNA, 291 bp, Zea mays
  Clone ID: LIB143-030-Q1-E1-B11
atgcgtccgcgccgcgcgcacacaagcacaagtggattgtggcttgtctagtgttcttccggtacagtcaaacagatatggacgctcctgcggcggaggcccaaggttgcggcggctcgcagatcgtgctcatccacggcgcgtgcctgggcagctggtcctggttcacggtggccccggcgctcagcgctgcggggtaccgcaaggacacgccggacctttcggcgtctggcgtggacccttcggtcactgccggaggtgccgacgttccgggaatacacggggccgctg

SEQ ID NO: 4553 - DNA, 380 bp, Zea mays
  Clone ID: LIB143-030-Q1-E1-B2
gcgtagtcgactacaacacccaaatagtgagtcgtattatgattacccacgataatctgcggtcttctcaactagcacgggtcttggcgccgcgcccagatccggcactgcccgcggctcgaacccgcaccccgcggcacgcaggccgggacccgtgggcgcgcgccgggcactaggaggtagaggaagggccgcatggcggcgccgccggtgacggcgttgagcgaatacaggaggggaggaggcttcgtgccagtggggatatcggtgttggcaagagttgcctcctgttgcggttctctgaggattccttcagtacaggctttagtaccagaattggcgacgaccttaggatagggacaatagaattggctggcaag

SEQ ID NO: 4554 - DNA, 130 bp, Zea mays
  Clone ID: LIB143-030-Q1-E1-B3
agcctgttcgggaggtcataggtggctgtgcaggctgttcactatggagcttcacggccatactatggcatccagactacacttaacgagcaggggtgcggcgtattaatcgtcaagttctcgggggatg

SEQ ID NO: 4555 - DNA, 169 bp, Zea mays
  Clone ID: LIB143-030-Q1-E1-B6
attactactcacagtagtgagtcgtattacttcgtcgtcctcctcctccgtagcacagctagcgcctgctcaccttcgcctgtgatcatgtcatgcagcaacggcaagtgcgactgtggcgccagctgctcctgcggcagctcatgcaagtgcatgtcacctaacgtgg

SEQ ID NO: 4556 - DNA, 415 bp, Zea mays
  unsure at all n locations
  Clone ID: LIB143-030-Q1-E1-C12
actcgtgggccgttacaagcctctataatgagtgcgtataacgccaagttctacgacgccttctccaagaacatcaagctgggcatccacgaggactcgcagaaccgcgccaagctcgccgacctcctgcgctaccactccaccaagagcggcgacgagacgacgagcctcaaggactacgtgacgcgcatgaaggaggggcagaaggacatctactacatcaccggcgagagcaggaaggccgtggagaactcgccgttcctggagcgtctcaagaagaagggctacgaggtgctgttcatggtggacgccatcgacgagtacgccgtggggcagctcaaggagtacgacggcaagaagctggtgtcggcaaccaaaggaaggcctaaaagctgggacgntacgaggacgacga

SEQ ID NO: 4557 - DNA, 236 bp, Zea mays
  Clone ID: LIB143-030-Q1-E1-C7
attactacacccactagtgagtcgtattaagagtgcgacgacacacgactcagacggccacccgctgggttcggccccaggtgtacccggtgttcgcggcatggggcgtggccgtcggcatgagcggatttcagctcgtccggaacatcagcggcaacccggaagctcagggtaaacaaggcagggagggcacctggtgtgcgtgagaaccatgatgaggggaggcgttacgccat

SEQ ID NO: 4558 - DNA, 194 bp, Zea mays
  Clone ID: LIB143-030-Q1-E1-D10
atccggtggcatggtattcctgcttgctataggtgcccaaacgggcggcccggcacggcccggcacgggcccgttaggcacggacagttagacgggccgtgcccggtcggcccacgtgccgcagatgcggcccaggcacggcacgccggcctggtagccgtgccgggccggcccgtttaacttgcgcacgttgt

SEQ ID NO: 4559 - DNA, 327 bp, Zea mays
  Clone ID: LIB143-030-Q1-E1-D11
aacagctacgctaagaacatgggattgtatggagagcgtgttggcgctttgagcattgtatgtaaaagtgccgatgtagctgttacggttgaaagtcaactcaaacttgtcatcaggcctatgtattcaaaccctcctcttcatggtgcctctatcgttgctaccatactcagggacagcgagatgttcaacgaatggactctggaactgaaggccatggctgataggatcattaacatgaggcaacaactatttaatgcgctgaaatccagaggaacccctggtgattggagccatatcattaagcaaattgggatgtttactttc

SEQ ID NO: 4560 - DNA, 321 bp, Zea mays
  Clone ID: LIB143-030-Q1-E1-D9
cagagctacgctaagaacatgggattgtatggagagcgtgttggcgctttgagcattgtatgtaaaagtgccgatgtagctgttagggttgaaagtcaactcaaacttgtcatcaggcctatgtattcaaaccctcctcttcatggtgcctctatcgttgctaccatactcagggacagcgagatgttcaacgaatggactctggaactgaaggccatggctgataggatcattaacatgaggcaacaactatttaatgcgctgaaatccagaggaacccctggtgattggagccatatcattaagcaaattgggatgttt

SEQ ID NO: 4561 - DNA, 406 bp, Zea mays
  Clone ID: LIB143-030-Q1-E1-G10
tacaattccctatattgagtcgtgattagctcgttgatccaaatccaagacctcacgtcaacgcactgtctcgcctgttaattagtcgtcgacgtcgtcgtctatgtccaggctgatggctgccatgctgctcggaggcgcgcgcgtcgccggcgccgcaaagctcaccggtaacggcaacgctgctggcatgcaggctcttcccatgccggcgtgcttccttccgccgcgcccgcaggcagcgacctggacccgcctctgcttgcaggctgcgccaagatcgtcccaggcatacgacaacgcgccggaagaccggagagaaataggggacaagtacaaggacgcggcggaggaggcgaaggacgccaaccggggaacgccaaggaagcaaagtccaagaggatgg

SEQ ID NO: 4562 - DNA, 345 bp, Zea mays
  Clone ID: LIB143-030-Q1-E1-G12
tacaactccctagagtgagtcgtattacggcgtgccgcgtgcgtgaggcgatcggagcatcccgtcccgaggaggaagacaaccggcgacgcggggggaacatggggaagacgccggtgcggatgaaggccgtcgtgtacgcgctgtcgcccttccagcagaaggtaatgcccgggctgtggaaggacatcaccaccaatatccaccacaaggtcaccgagaactggatctccgccacgctcctcctcacccccgtcgtcggcacctaccaatacgccatgtggtacaaggatcaggataagctttcccacagatactaaatgcgctgcccttcacatacagcac

SEQ ID NO: 4563 - DNA, 321 bp, Zea mays
  Clone ID: LIB143-030-Q1-E1-G5
cgttccagttctactcggagggcgtgttcacgggcgactgcggtacggacctggaccacggcgtggcggcggtcggctacggcgtcggcgacgacggcacgccctactggatcgtcaagaactcctggggcacctcctggggcgagggtggctacatccggatgcagcgcggcgccggcaacggcggcctctgcggcatcgccatggaggcgtccttccccatcaagacctcgcccaaccctgcagacccgccgcgcaagccccgccgcgcgctcatcgccagggacacctcttcttcccagtgacacacacgaccacaac

SEQ ID NO: 4564 - DNA, 345 bp, Zea mays
  Clone ID: LIB143-030-Q1-E1-G9
gcgtcgtctgtcaaaactccctacagtgagtcgtattataaacccgacctccgctcgccggcgcccggcaggatggcttcgtcggcggcgtaccctgatgcggacgagaacctggaggccatcatcacccgcatagagcagaagtcccgaaagatcgagacccttctcaagcagtcgaagccggtggaggccctaaagacggcgctcgaggggtcaccgctcaagacccgcgacgagcgatgcaagtcggcgaactggatcgtggtgcaccgcgcgttgatggcgattagggacgtagaccgcatgttcaactcgctggatcccgagtacgaagacatcctcatg

SEQ ID NO: 4565 - DNA, 381 bp, Zea mays
  Clone ID: LIB143-030-Q1-E1-H12
ctcgagtaaccacagcgagaaccaatcgccaagcaaaaagcccgagaaagaaagaacaaacaggagacacagatggcggctgcagcgaaggcgtcgtggatggtggcgatgagcgtcggggccgtggaggcgctcaaggaccaggcgggcctgtgccgctggaactacgcgctgcgctccgtccaccgcgccgccaaggccaacgctcccagcttcgcgcaggccaggaagctggcgccgcccgccgcggacaaggccgccgcggaggaggggatgaggaccgtcatgtacctcagctgctggggccctaactagctagggcctctgctagtttcgggctccctgcaaaccgtaccgagcctccgggccttcaaatctgat

SEQ ID NO: 4566 - DNA, 351 bp, Zea mays
  Clone ID: LIB143-030-Q1-E1-H2
tcccgcgtggagcgctacggctccaccgtggtgcgcatgaacgtgccgccgggccccttcatggcgcgcgacccgcgggtggtggcggtcgtggacgccaagagcttccccgtgctcttcgacatggacaaggtggagaagaaggacctgttcacgggcacctacatgccgtccacctccctcagcggcggctagcgcgtctgctcgtacctggacccctccgagcccacccacaccagggtgaagcagctgctcttctccctcctgctctcccgcaaggacgacgtgattcccaccttccgctccaagttctcctcgctcctcgccaccgtggaggcggagctggccaag

SEQ ID NO: 4567 - DNA, 322 bp, Zea mays
  Clone ID: LIB143-031-Q1-E1-A3
aacacactagagtgagtcgtattaatagccactctagacccccgcttccagaaccttctcgagactctgaggcgcggcctcagctgcaagccgtaggcgacggaaccgatgcgcgtgctcgtcactggcgccgcagggcaaattggatatgcgcctgttcccaagattgctaggggagttatgcctggtgcaggccagcctgttactctgcacatgcttgatactccgcgagcagctgaagcccctaatggcgttaagatggagttggttgatgctgcaattcctcgtctgaacggagtcgttgccacaactgaggttgtgg

SEQ ID NO: 4568 - DNA, 222 bp, Zea mays
  Clone ID: LIB143-031-Q1-E1-A7
atgcgcgggaggatggtacacctgtatggtcaccagtggagatagactacttcctgaatggtactcagataggggcattcaagtgatcttacctggtgatattgtcacagccgaccttgcttccgtacactggacagtgcatctgccgacagcttcacatatgagaccccactcggtgctacgggtgccacgctcatcgggcacgccgtcgtgggtgctgaa

SEQ ID NO: 4569 - DNA, 369 bp, Zea mays
  Clone ID: LIB143-031-Q1-E1-A8
tacaacaccctagattgagtcgtattacttttggcttactgcgcaagaagaagggtaacaagaggacggcggcgatggcgaagaggctgctcccatctctgaaccgggtgctggttgagaagctggtgcagcccaagaagaccgccggcggcatcctcctcccggaaacatccaagcagctgaatgctgctaaagtggtggctgttggccctggtgagcgcgacaaggcaggcaatctgatcccagttgctctgaaggaaggtgacactgttctcctgccagagtatggtggaactgaagttaagcttgcagctgataaagagtacctcctcttcacagagcacgacattttgggcacacttgttgact

SEQ ID NO: 4570 - DNA, 401 bp, Zea mays
  unsure at all n locations
  Clone ID: LIB143-031-Q1-E1-A9
tcatattacattacaacactctataatgagtcgtattatcaagattcttcaagcagatcngcgcccaccccgaccccgaaaaggccaaggactccttcggcatccgccccggcaagggttaaaatcccaaccgccgctacatcaaccgcaagggcccgctcatcgtctacggcaccgagggctcaaaggtcgtcaaaggccttccgcaaccttcccggtgtggatgttgccaacgtcgagcgcctcaacctactagaccttgcccccggtggccaccttgggcgctttgtgatctggacccagagcgcgttcaataagctcgaggaggtgtatgggagctatgacgccccgtcgcagaagaagaagggcttcgtgctgccgangcctaagatgtccaacgc

SEQ ID NO: 4571 - DNA, 387 bp, Zea mays
  Clone ID: LIB143-031-Q1-E1-B12
caccctaaagtgagtcgtattaaggtacggcggcggcgccaactcgctcgcctccggctactcccgcggcaccggcctcggcgccgagatcatcggaaccttcgtgctcgtctacaccgtcttctccgcgaccgaccccaagcgcaacgcccgcgactcccacgtcccggttctggctcgcctcaccatcggcttcgccgtgttcaaggtgcacctggccaccatccccgtcaccggcaccggcatcaacccggccaggagcctgagcgccgccgtcatctacaacaaggacaagccctgggacgaccactggatcttccgggtgggccctctcgtgggcgctgccatcgcggccttctaccaccagtacatcctccgggctggcgc

SEQ ID NO: 4572 - DNA, 371 bp, Zea mays
  Clone ID: LIB143-031-Q1-E1-B2
aacactctatactgagtcgtattagctgcaagactgccaggcttccacacgtgtgtgggcagcggtggagagagactacttcctgaatggtactctgagaaaggcattgaactgatcctgagtactgagattgtgaaggccgaccttgcttcaaagactctgaccagtgcagctgcggaaaccttcacatatgagaccttgctcattgctacgggctcctcggtcataaagctcactgattttggtgttcaaggagcagaatccaacaacatattgtatctaagggacattgcggatgccgacaagttggttgcagctatgcaggcaaagaagggtggaaaagctgtgaatgttggacgtggttacataag

SEQ ID NO: 4573 - DNA, 350 bp, Zea mays
  Clone ID: LIB143-031-Q1-E1-B6
acctcgagcacactgatgtggctatcctgctggacaacgaggccatctatgacatctgccgccgttcccttgacattgagcgcccaacctacaccaacctcaacaggcttgtgtcccaggtcatatcatccctgactgcctccttgaggttcgatggtgctcttaacgtggatgtgaatgagttccagaccaacttggtgccctacccgaggatccacttcatgctttcctcctatgctccagtcatctctgctgataacgcctaccacgagcagctgtctgtggccgagatcaccaacagcgccttcgagccatcctccatgatggtcaagtgcgatttcccccatggt

SEQ ID NO: 4574 - DNA, 118 bp, Zea mays
  unsure at all n locations
  Clone ID: LIB143-031-Q1-E1-D10
atagtgagtcgtattaggganggggagacgcacgcgagacgtcacgggagcagtgcatagcattgcctgagatctccattgctggccagacgccgatccgccgcgaggctcccgggaa

SEQ ID NO: 4575 - DNA, 335 bp, Zea mays
  unsure at all n locations
  Clone ID: LIB143-031-Q1-E1-D2
tataggtgagtcgtattaaatcntgtcaggttgctgaacgtgcgttgttcttgtggaacaatgatcatactgtaagcttgatagcacagagtcgtgttgtcagaggtcgaatgatatgggaagctcttgataggaatagacagacgccactggaatcctgcagttcatggtcgcacggccaatgtgcgcacgatgtttttggacatggacagtgaagtagttgaacagtgcgaccagcagtacatggagaaacaggcgacagccaaagagatacaggaacacgcgataagcagcatggagacacttggaagcagttgttgctgccacaggtggcg

SEQ ID NO: 4576 - DNA, 381 bp, Zea mays
  Clone ID: LIB143-031-Q1-E1-D9
tagagtgagtcgtattagagggacctgttctaaggtgggaatcacggattgtatttgttcatagtggagatgcatatcatcccacaaacagaaaagtcaagctcagtgtgactgtgaaggaattgggactttcacgacatgctttccgtcggttgcgtgaggttgttggaaagaggtataaatctgggaaagatgagctcacaataatcagtgaaaggtttgaacaccgggaagagaacagaaaagactgcttgaggacactgtatactctaataaaagacgcaatgaaagctgacaaacttgttgaggatgccaggaattcttatgttaaaggaagacttaaggctaatccacaatttatggagcgattgaagaggaaga

SEQ ID NO: 4577 - DNA, 393 bp, Zea mays
  Clone ID: LIB143-031-Q1-E1-E11
acaacaccctagactgagtcgtattattcttctagctctagctaggctcgtctgctgcaagaaggtaacagcgcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcggcatccagggcatcgcctggtccttcggcggcatgatcttcgccctcgtctac

SEQ ID NO: 4578 - DNA, 200 bp, Zea mays
  unsure at all n locations
  Clone ID: LIB143-031-Q1-E1-E6
naaaaaaaaaaaaaaaaaagaaagaagaaaaaaagagaagaaaaaaaagaaagataagaaagagaaagaaatgcgacggcagaagagacaatacggcgtaaatgtcacgtgggcagtgggttaacggggacgtgaatgagaaagccgaggcgagtgggaactgagtcgttctggagtacatcgttgtgacggtagatggc

SEQ ID NO: 4579 - DNA, 379 bp, Zea mays
  Clone ID: LIB143-031-Q1-E1-F9
aatactctaaagtgagtcgtattagtggttcttctatggctcttttcggccgcgttggtggtggtatttataccaaggctgctgatgttggtgctgaccttgtggggaaggtagaaagaaacattcctgaggacgatccaagaaacccagctgttattgctgacaatgttggtgataatgttggagatattgctggaatgggatcagatctctttggctcatatgctgaatcatcatgtgctgctcttgttgtggcctctatctcgtcttttggaatcaaccatgaatttactccgatggtgtaccctcttctcgtcagttctgttggtattatagcatgtctcataacaacgctgtttgcaactgatttcttcgagat

SEQ ID NO: 4580 - DNA, 142 bp, Zea mays
  Clone ID: LIB143-031-Q1-E1-G10
cctatagtgagtcgtattaatgcaggagggattggatcgagagtcacaggggttggcgtcatcggtcgcggtttcgtgagtgaggggcttgagatggcggcgtcggatgttgagtaccgctgcatcgtcggcggcctcgcct

SEQ ID NO: 4581 - DNA, 259 bp, Zea mays
  Clone ID: LIB143-031-Q1-E1-G11
tatagtgagtcgtattaaagtgcgcgggagcccaggcgtggcaacagagagtacactcctcggtcgacgcggaggccccgttcctgaaggtcccgtcagctgccggcccgtctgccgggctgcagataggagttggtcatggcgtcgaagcacacccgtgaacgagctgacggacgtgtagaaggacggctcgacatcagacactgtaggtcatgatggtgaggacatgtttaattggcacaccagacgtatgggagga

SEQ ID NO: 4582 - DNA, 382 bp, Zea mays
  Clone ID: LIB143-031-Q1-E1-G12
tatagtgagtcgtattacggcacgcgagggcgcagcgttgatggcggcggcaccggcggacgctaaggcggaggccgccaagatggacctcctcgaggacgatgacgagttcgaagagttcgagatcgaccaagaatgggatgaccaggaagaaggcaacgaagccgtccagcagtgggaggatgattgggatgacgatgacgtgaacgatgatttctcgctgcagcttaaggaagagctggacggaagcaaacggcagaagagctgaagtaatacttctccactttatataaatgaattttaaaatgcaaccacctttggaacccttgatgttccttggaagttaaagtttttggacatcagtcggcaatttgacagcact

SEQ ID NO: 4583 - DNA, 394 bp, Zea mays
  Clone ID: LIB143-031-Q1-E1-G5
gcgggccgacccacgcgtccatatgattcccgcttagggtgcgagaggtcgcgagttcgtttcacgcaacaccccacatcccagtccccagagaagtcgcccgcgcgccacaagttcgtcaatgactgcgaggccgccctcaacgagcagatgaacgtggagtacaacgcgtcgtatgcataccactcccgcttcgcctatttcgaccgcgacaacgtggctctcaaaggatttgccaagttcttcaaggaatccagcgacgaggagagggagcacgctgaaaagctcatggagtaccagaacaaacgtggaggcagggtgaggctccaatcgagtgtgacgcctttaaccgagtttgaccaccctgagaaaagagaagctctggaagccaagg

SEQ ID NO: 4584 - DNA, 206 bp, Zea mays
  Clone ID: LIB143-031-Q1-E1-G8
aattggcgctgctgcacgcgttgtagtcttcgagcatgacacttccaaggccttaaggtcatctccgtcaactgggccaccgatctctcagcagcactacgcagcagccggtgtatcgacagcatcgtcaagggcagcaccccgggctcgtgcctcgactgaggccggcacatgattggctgctacgactcgatgtcctcggactg

SEQ ID NO: 4585 - DNA, 263 bp, Zea mays
  Clone ID: LIB143-031-Q1-E1-H11
gagtcgtattaaacacgtgcggcgtctgtgcccgcgtctcgagcctcacggtccggatcgctctcccttccacaacattagggatcatgtcgggggccgacccctgcgagatccgatcggaggcagtcagctaaggtcaccctgatcatctatgaggctgggggtcacggggaggtccggattctcggctcgcgcatgacgcggaagcgtcggttgcttatggtcacggggccctctcgccggtggagctaggggcgccggga

SEQ ID NO: 4586 - DNA, 136 bp, Zea mays
  Clone ID: LIB143-031-Q1-E1-H6
aacacacggaagtaaaccgtagctacttcccaagttaggtataatagtctttctgatagatgtgtcgcgatcggcctagaatgatttgttccagaagacagaggattttgctctagcacgtgcggcgatgtatgag

SEQ ID NO: 4587 - DNA, 215 bp, Zea mays
  Clone ID: LIB143-031-Q1-E1-H7
tacaacaccctaaagtgagtcgtattaaattcactcaattcactgaaatctcctaatcagctctcatcttacagtacacgttaaagagcatacgacactccatcatgaacagttcactgatcagcctgcggaaccgtgttcgatacctacgccgtccatctctgtgacgccattgatggcatctccttcgggtcccataacatcatcagtctcat

SEQ ID NO: 4588 - DNA, 356 bp, Zea mays
  Clone ID: LIB143-032-Q1-E1-A11
tcctcgtcttcctcatcctatcacagctagcgcctgcgccccttcatctgggatcatgtcctgcaacagcggaaatgtgcaactgcggctccaactgctcctgtccgcggcacatgcatacgcatgtcgcctgacgctgcacacggtcgccgctagcatcatcaatagcatgggccgcgctgcgccgactacgaacggcaactcctgccgcttccaggcggacatcgacggctgtggctgcgactgcaacaccgtgcaactgcggatccacctgcggctgctcgtgctgcatctgacaactgacacggctcgccctgcccggcgatggcacgcgaaactctaaaggaccaccacga

SEQ ID NO: 4589 - DNA, 434 bp, Zea mays
  Clone ID: LIB143-032-Q1-E1-A12
ctaggacgcgtagtacgatacaacaccctatactgagtcgtagtatgctccccaaccctgaacttgcattggacgcgctgtctgtatgcatgactgttaacgggtgggtgttcatgatcgcagtagggttcaacgccgctgccagcgtgagagtgagcaatgagctcggcgccggccaccccaagtccgcgtatttctcggtgtgggtagtgaccgcgctgtcgacgctcatatctatcatgctcggcgttctggtcctctgcctgcgcaactacatcagctacttgttcacggagggcgaggtggtgtccaacgcggtggcggatctctgcccgctgcttgccgtcacgctcgttctcaacggcatccagcctgtgctgtcaggtgtcgccgttgggtgcgggtggcagcagttcgtggcctacgtgaacatt

SEQ ID NO: 4590 - DNA, 408 bp, Zea mays
  Clone ID: LIB143-032-Q1-E1-A8
agtaggacagccatggcgacggcggcggcgcagtcccatccggcatcgatggacgcgcgccggtgggacgagtcatcgtaccgccgcggcatcctccgtgcccgcgacctctcgtcccgcaccctcttccgtgccgtcttctttgaccacagcgacgacccggataccgacatcctactcgccgccgcctccagcgacggctccctcgcttccttctccctttcatcctgcatctccgcatgttccgctacctcccaggtggagaccgccgccactctggtagatcctgtctgcatcgtgcaggcgcacaacggacctgccctacgacgtcaggttttagcccgatgaacagcagccgctgctcttcagctgcggggacaatggccgcatcaagggttggaggtggca

SEQ ID NO: 4591 - DNA, 53 bp, Zea mays
  Clone ID: LIB143-032-Q1-E1-B11
cgtagtccgatacaaccctctagattgagtcgtattacggccgctctagagga

SEQ ID NO: 4592 - DNA, 394 bp, Zea mays
  Clone ID: LIB143-032-Q1-E1-C1
cctaaagtgagtcgtattatagccgctcagcgaccgggattcaaggtacgtcctgctcaccttcgggaaccctcttcctcgtttgcccccttctcttctctcatgtggaccaggaataagacgcaagcttgtcccccaccatggtcccccagacccccaccatggttcatcgttgccctgagtatatcgtgccgtctatttccgatctgtggacgaggcagagaaggcttttcacggatcatccagcttgcaaactgaagcagaaatgcagggattgttcttggcgtttccatggacggcgacaagtccaagcatcttcgctgtccgtgacatgcgattatgttaagtaaatcgccttccctgtttagctagtacaaaaccttggtttgtgttt

SEQ ID NO: 4593 - DNA, 70 bp, Zea mays
  Clone ID: LIB143-032-Q1-E1-C10
aggggacctcgtcactgtcgagcgcaagagaggcgaggtcgaacgcgggtcgatggggtagtgcgaggag

SEQ ID NO: 4594 - DNA, 376 bp, Zea mays
  Clone ID: LIB143-032-Q1-E1-C12
atagtgagtcgtattaaaagatctgaaacctcgtgtgttgtgcctttggtagttcggtgtagcattgagctagcagaggtgctgttctagttccaggatgagcaaggaggatgtcctcaaggtgcagacattgatgctgagagtgaacatacactgtgacgggtgcgagaagaaggtcaagaagaccctccacaagatcgacggtgtctaccacagcagcatcgacgcggaacagggcaaggtgacggtgtctggtttgctggatccggataccatcgtccggaagctcaacgggggcgggaggccgggagcagctgtggggttccaagcccggcatcactcagggggcgtagcatgggggcgggaaggccgattt

SEQ ID NO: 4595 - DNA, 102 bp, Zea mays
  Clone ID: LIB143-032-Q1-E1-D5
acgcgtgggtgtttttgtgcgccaggacgtatatttttactgagatgatactccgaagagcacgtatggtgtcttaaaaaacgaacgagggaagagagggaa

SEQ ID NO: 4596 - DNA, 432 bp, Zea mays
  Clone ID: LIB143-032-Q1-E1-D9
ctcgtgggccgatacaaccctctatagtgagtcctattagatgactgggtcctgtgccgcatctacaacaagaagggcggcgggctggacaaggcggcggcgccggcggccggcggcgaccacaagcctgtgttcgccacggcggcggtgagctccccgccggagcagaagccgttcgtagcgggcgcgggcgggctgcccccggcgttcccggagctggcggcgtactacgaccggccgtcggactcgatgccgcagctgcacgcagactactccagctgctcggagcaggtgctgtccccggagcagctggcgtgcgaccgggaggtgcacaaccagcccaagatcatcgactgggagcggaccttcgcctcagaccccgtgaacccctcgggctccatgctccagcccgtcgtcggccacacgggcggg

SEQ ID NO: 4597 - DNA, 363 bp, Zea mays
  Clone ID: LIB143-032-Q1-E1-F11
tagtgagtcgtattatgacatcagatgaggactctaacgctgtcatgttacacatctgcaacaacagttcagcaccttgtgaatccccgccctctaacggtacatctggcagcaaacagtctggcaaaattgcaaatgaaaaggagagtcctaaagttgatcctaaaagtatattccatggccatgacagtactgttgaacatgttcagttctgcccggtcggagtgcccaggagttttgtagtgtgggtgatgatgcttgtcttattctgtggtatgctcgagctggcactgacccatctgttaacgttgataaagctcacagtggagatgtacattgtgtggattgcaatccccttgatgt

SEQ ID NO: 4598 - DNA, 416 bp, Zea mays
  Clone ID: LIB143-032-Q1-E1-F2
cacgtcggatcgaacagctagggtttccaagatgttcgggcgcgcgccgaagaagagcgacaacacacggtactacgagatcctcggggtctccaaggacgcgtcgcaggatgacctcaagaaggcctaccgcaaggccgccatcaagaaccaccccgacaagggcggcgatcccgagaagttcaaggagctagctcaggcctatgaggtcgtcagtgatcctgaaaagcgagagatttatgatcaatatggtgaggatgccctcaaggacggaatgggaggtggtggagggatgcacgatccctttggcatattccagtcattctttggtggtggaagcccttttggaggtggtggcagcagtaggggcagaatggcaccaaggggacaagatgtggttccacccctgaacggtt

SEQ ID NO: 4599 - DNA, 151 bp, Zea mays
  Clone ID: LIB143-032-Q1-E1-F3
ttacaactcctaaagtgagtcgtattaaaggcggctgggcatggatgacgctccctgcagttatcgccatgggagttgatttcacgggacctgtaggtgcggaaggattgggagagtttggcgcgtacgtgcagtcaggtccagccgcttc

SEQ ID NO: 4600 - DNA, 441 bp, Zea mays
  Clone ID: LIB143-032-Q1-E1-G6
acaacaccctatactgagtcgtatcatatcaagtcctcctcgggttagggttccttagggttttgtggaggggcgatggcggcggctgatgtggagtaccgttgcttcgtcggcggacttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggcggcggcggcggcggcggcggtggctactgcagcggtcgcggcggcggccgctatggttgctggcgccgtgacggcggttatggcggcggttgcggctac

SEQ ID NO: 4601 - DNA, 363 bp, Zea mays
  Clone ID: LIB143-032-Q1-E1-G7
acaccgtcttctccgccaccgaccccaagcgcaacgcccgcgactcccacgtcccggttctggctcccctccccatcggcttcgccgtgttcatggtgcacctggccaccatccccgtcaccggcaccggcatcagcccggccaggagcctgggcgccgccgtcatctacaacacggacaagccctgggaagaccactggattctcggggtgggccctcccgtgggcgctgccatcgcggccttctaccagcagtacatcctccgggctggcgccatcaaggccctcggctccttcaggagcaacgcgtgatgagcggggcttggctgttgagcaactgcgggcgacctaccggcgggggaag

SEQ ID NO: 4602 - DNA, 384 bp, Zea mays
  Clone ID: LIB143-032-Q1-E1-H1
tgccttgattttgtggaacgaagcgatggctcgcagcggcgccatggtttcctgcatgctgctcctggtggtggcgcaactgctcatggtgatggccacgcagacagcggcggcggcgggcgaccaacgcggagctggacgccggctgctgtggcaggtgacctgccactacagcgcctgtaactgccgcacttgcccgacatatggctgggcgtgctgcagcacttgctgctaactaactagctagtgtgagttcttccgcgcgcgcgcagccttttgcacacccctcttgcttagctcatgcatgtccattagtagccggttgctgcactcgtcgtcggcggcggctgttgcggcgtcatctctggcgtggttacattctca

SEQ ID NO: 4603 - DNA, 164 bp, Zea mays
  Clone ID: LIB143-032-Q1-E1-H12
aacacgtgggcaattctcaggtctctcggcgacttactcgtcgatcacatcgtgcgcagtgcaacaatgaggacagggtcaactcagcgataagggtatgtttcacaggcttagtcgcattgttttagcggactaatgtggtgtgtcgaagtgcgggcaatagg

SEQ ID NO: 4604 - DNA, 341 bp, Zea mays
  Clone ID: LIB143-033-Q1-E1-A11
ttcttcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactgagccggtcaggcgatggcgcacgagagtcgagaggacgac

SEQ ID NO: 4605 - DNA, 352 bp, Zea mays
  Clone ID: LIB143-033-Q1-E1-A12
cgtccgtccgtccgttggcgtcgtcaccgtccaaatcaaacaaaaagaacttggcgataatgtgtcgctttcgtaatgaacgcggggataagcgtggcccatggttttgggccgctgaattttttttacgtgggccatgctaggtggggtggggggctgcaccgtgcccaatgattcgaccgcgtcgcagtcctccgcgcgcaagtattcgatgcccatgggtcatagcgaacagatcattttcgcccgtcgcgccctgcgacggcgacggcgacggagagccagtggggtctcactgggattagacatcgaaatgacgctttgtgattctttagctcatccatttctcgtc

SEQ ID NO: 4606 - DNA, 377 bp, Zea mays
  Clone ID: LIB143-033-Q1-E1-A8
tacaactccctatagtgacgtcgtattaagcgtccggtgatattggatctgtgctacctgaagaagcttcacttgttgcatatcttattgatgcagtcactggacgcatacttcatcgtgtaactcatcatggtgcacaaggccctgtacatgcagtcttgagcgagaactgggttgtttatcattattttaatctgcgagctcacagatttgaaatggcggtgattgagatatatgatcaatctagggcggacaataaagatgtcatgaagctcatacttgggaagcataatctttcagcaccaattacatcatacgcccgccctgaggtggcagtaaaatcccagtcatactttttcacccattcagttaaagca

SEQ ID NO: 4607 - DNA, 149 bp, Zea mays
  Clone ID: LIB143-033-Q1-E1-B2
ctacaccctatagagagtcgtattaaagagtttgaggcaggccgcgtgcgctttcagtgggtgagctgaagcagtcagctggagaggaggaatccgcaggacttcaataagggaagtcgggaggtctgggtgaggtggccgtttcgtca

SEQ ID NO: 4608 - DNA, 144 bp, Zea mays
  Clone ID: LIB143-033-Q1-E1-B9
cgactacagcatcagccatcgccatcgcgtctcctcgctttccctcgcttcctcggggccggttccgcgtcgtcgtcctcgagtgttctccgtctcgttcgggcgtgcgcgctcgcgcgggctggcgggtgccagatggggtct

SEQ ID NO: 4609 - DNA, 345 bp, Zea mays
  Clone ID: LIB143-033-Q1-E1-C12
atagtgagtcgtacttaaaacccaaccgcacaagcgcgcgaggcaggagagagagagaggcggggagcaaaacaatggaggggaaagaggaggacgtgcgcctgggcgccaacaagttctcggagcgccagcccatcgggacggcggcgcagggcgccgctgacgacaaggactacaatgagcccccgccggcgccgctgttcgagcccggggagctcaactcctggtccttctaccgcgcgggcatcgccgagttcgtcgccaccttcctcttcctctacatcaccatcctcaccgtcatgggcgtctccaagtccacctccaagtgcgccaccgtccgcatcc

SEQ ID NO: 4610 - DNA, 158 bp, Zea mays
  Clone ID: LIB143-033-Q1-E1-D5
acaactacctacagtgagtcgtattaaggcatggcagcgtttgtgatcgaattcctgcttgctatctgtgctgaaacgggcgccaccgcatcgcgcgccacggggtcgtaaggcacgaagtttaagccggcgctccggaggcggctgtggtcgagcag

SEQ ID NO: 4611 - DNA, 356 bp, Zea mays
  Clone ID: LIB143-033-Q1-E1-E11
taatcccacaagccttcagctgggaacggagaagacatttttacgcgcaatggcagatggaatttcaataataagaagctcattagagctagcagtgtcgagaaatgggcagtagtaaacttttctgcacgatgcaatgtccgggatcttgtccgtgatctcatcaagtgtggaggcatgaagggcattatggttgatgcaccatttgctgtatttgatgagaatccttcaatgagacggtcacctgctgtaagaagggttgaagacatgtttgaacaagtgaaaactaagcttcctggagcacccaagtttcttttgtgtgttctagcggaaagaaagaattccgatatttatgg

SEQ ID NO: 4612 - DNA, 393 bp, Zea mays
  Clone ID: LIB143-033-Q1-E1-E12
acgcgcggtccgatacaacaccctagagtgagtcgtattactcccccctcctcatcagtcgctaggcacagcgcacttgcaggatggcgcaggtctctaagacgcttctccttgtggccctggtgttcgtgtcgtcggcggcggtggagctgtgccgcgcgatcgacttcgacgagcgggacctggcgtcggacgaggcgctgtgggacctgtacgagcggtggcagacgcaccaccgggtgcaccggcaccacggcgagaagggccggcggttcgggacgttcaaggagaacgtgcgcttcatccacgcgcacaacaagcgcggcgaccggccctaccgcctccgcctgaaccggttcggcgacatggggcgggaggagttccggtccacgt

SEQ ID NO: 4613 - DNA, 382 bp, Zea mays
  Clone ID: LIB143-033-Q1-E1-F11
acgcgcaggccgttacaagactctatactgagtcgtattaaacagcacatcgctctctcgatctcagccatggcggaggtggagcagccccaggacgcggtgaagctcttcaaccgctggaccttcgacgatgtccaggtgaacgatatctcgctgaacgactacctggctgtgactgcggcgaagcacgcgacattcctgccgcactccgcggggcgctactccaagaagcggttccgcaaggcgcagtgcgccatcgtcgagcgcctcaccaactcgctcatgatgcacgggcgcaacaacggcaagaaggtcatggccgtccgcatcatgaagcacaccctggagatcatccacctgctcactgacgccaatcccatcc

SEQ ID NO: 4614 - DNA, 310 bp, Zea mays
  Clone ID: LIB143-033-Q1-E1-F12
acgcccagtccgttacaacaccctatagtgagtcgtatgtaacaggcagtgatcggcaaccaaatccggacagtcttgagctctctcagtctcagcatttcagttcccagattcacatagccccagccccacaagtagcgaaatggcagctgctccgttcgcgattgccggccggctctcccccgttgcgcgcctcccggtccgcgcctggaggccggcgcacgggtttgcgtcgtccgggagagcccgctcgctcgccgtggcgtccgcggcgcaggagaacagggacaacagtgtcgacgtacaggtt

SEQ ID NO: 4615 - DNA, 345 bp, Zea mays
  Clone ID: LIB143-033-Q1-E1-G11
cccagtccatctcccagtggagcgacttcgcggccaaggtcgccgagctgtaccctgagtacaaggtgcccaagttccccaaggatacccagcctgggctggtgcgacagggagccgaggaggggtccaagaagctcgtcgcgttggggttgcacttcagccctctggacaagatcatcacggacgctgtggaagccctcaagagcagaggctacagttcgtagctagccgaccgacggcagctatagtggagtagtatgcctgtcgaatttcgattcccaattggcaaattctgcaaaacgagttctccaatatgaacaatagataaagaacgctgtgataaaa

SEQ ID NO: 4616 - DNA, 115 bp, Zea mays
  Clone ID: LIB143-033-Q1-E1-G2
tactccctatagagagtcgtattaattacgtgacccgacacaaggggggaaacttctcctcgtgcagtcctacatccagtgaggtcagtaccaccgccggccggccgcggcgcca

SEQ ID NO: 4617 - DNA, 343 bp, Zea mays
  Clone ID: LIB143-033-Q1-E1-G7
acactacatatgtatatggaatctatatctatgtgtaatgtgtgtccattgcagcagtaccatgtacttcagcggttcagccagctatgcttgtttgtatttgtccactaatataaatccatcaatctcctaataaccgtaacatatcattattagtcgacacgtaatgtccctacggtcggccacgtgtcgggccggccaggcgcggcaacggcgacggccttgtccgcgcgctgctgctgctgcggcttcttgtacccgcggctgctgggagacacgcgcttggactcgccccacttgtggaagtcgtcgcgttccgaaccgtcggcgtcgcactcgggga

SEQ ID NO: 4618 - DNA, 369 bp, Zea mays
  Clone ID: LIB143-034-Q1-E1-A11
caccctatagtgagtacgaacaggaaaggcgtgctgcaggtgcaggacggctctgagatccgggctctcgtggagaacaaggcggagttcgctaggttcgtcgacgacaggttccggaagctcgacgccgatggcgacgggaggctgtcggtgaaagagctccagccggccgtcgctgacatcggtgccgccatcgggctgccggccagagggtcgtcgccgcaggcggaccacatctacgcggaggtcctaaacgagttcactcgcgggaagcaagagtcggtgggcaaggccgagttccagcgcgtgctgtccgacatcctcctcgggatggcggccgggctgaagagggacccgatcgtcatcctc

SEQ ID NO: 4619 - DNA, 59 bp, Zea mays
  Clone ID: LIB143-034-Q1-E1-A2
ggtcgagaattagcgggtcgacccacgcgtccggactgaataactacgtatagtactgt

SEQ ID NO: 4620 - DNA, 338 bp, Zea mays
  Clone ID: LIB143-034-Q1-E1-F12
caacttaccttgagaaaattgcggggaaccccaattaacttaggcggtaagggtattttcaaggttggtacaatggttgttcagctgaagctttgcacactagttgactaaattgcacacgcggtcctattcgagacccgattcagtggcttaatagaagattgttctcttcgactccgtcctagggaaaacatctcggccctgcccaatttccgttgacaaattttacatactttatcgttgatgtatgtgacacattgacagcaagccagagtgacatttgagtgatttcagttgtgactttctaaaaaaaaaaataaaaaacaacaaaagacaat

SEQ ID NO: 4621 - DNA, 141 bp, Zea mays
  Clone ID: LIB143-034-Q1-E1-H6
gagtcgtattagagatgctacgacctctatactcgtgagataatcagttctctccagagtttcctgttcctttattgcaaacattgacacagctcttctaacgaacttggttctgaaccgggatgatagatgtctaatctt

SEQ ID NO: 4622 - DNA, 284 bp, Zea mays
  Clone ID: LIB143-035-Q1-E1-A11
aaccgttcatccttcgttcacccgtccactcccatcttccttcacccgcttgtttatcagccgagtcagcacgtacgtcggcagtggttaggagagccctggcgcagtgcttcacgtcatgctctctgtcatcgaccgcgacctgcaggtctctgagatctcgtgcctgaagcagcctggtgccaacagggtcttcggcgcaagcgggccacgtctacgcgggagtcgtacacgaattcactcgccggaagcaagagtctgtgggcaaagcccaattccaacgc

SEQ ID NO: 4623 - DNA, 326 bp, Zea mays
  Clone ID: LIB143-035-Q1-E1-B9
acatggcgccgccgcagccaaagtcgggcctcttcgttggcatcaacacgggtcatgtcgtcaccaagcgcgagctgcctccccgcccgtgccaccgcaaggggaaatcaactaagagggtgtctatggtcaggggcctgatcagagaggttgctgggtttgctccttatgagaagcgtatcactgagcttctgaaggttggcaaggacaaacgtgccctgaagcttgctaagagaaagcttggaactcacaagagggcaaagaacaagacagaggacatggctggcgtcctcacgaacaataggtctgctggtacgcacactgac

SEQ ID NO: 4624 - DNA, 381 bp, Zea mays
  Clone ID: LIB143-035-Q1-E1-D12
ctacgcaagcaggcttcgagaacaagggggagggggaggaccaagcgaaagggggaactagagcaagatgggcggcgaactgctgcttgcgcgcctcctcgtctctgctgctgccgcccctcaggtacttggagttggcaatggagacaatcacatgagaatcatccaggaggacatcattgagacagtcaacaaccatcccagtgctgggtggacagcctcacgtaatccttacttttcaaactataccattgcgcaatttaagcacatacttggagtgaaaccagcaccacagaatgcactaagcaatgttcctgtcaaaacttattcaagatcactggaacttccaaaagagtttgacgctagatctgcatggtcccg

SEQ ID NO: 4625 - DNA, 410 bp, Zea mays
  Clone ID: LIB143-035-Q1-E1-D8
acaacaccctaaagtgagtcgtatcatgaaaccaccgagagcccaaccgcacaggcaggagagagagcagggagccagggacagtagcgtggggccggggagcaacgatggaggggaaggaggaggacgtgcgcctgggcgccaacaagttctcggagcgtcagcccatcggcacggcggcgcagggcgccggcgccggggacgacgacaaggactacaaggagcccccgccggcgccgctgttcgagcccggggagctcaagtcctggtccttctaccgcgcgggcatcgccgagttcgtcgccaccttcctcttcctctacatcaccgtcctcaccgtcatgggcgtctccaagtccacctccaagtgcgccaccgtcggcatccagggcatcgcctggtccttcgga

SEQ ID NO: 4626 - DNA, 337 bp, Zea mays
  Clone ID: LIB143-035-Q1-E1-D9
tgtttgcgggaatgccatctggtatcgacattgagtggtaccctgtgaagtgcttgacacacaaggtgctaggagagaatccacggtcgggttgaaagaacactaaacctatcacaagaactgaagattgtgaaagcttcttcaacttcttcagtccacctcaagtccctgatgatgatgaggaaattgatgaggatatagctcaccagttgcagaacgaaatggaacaagattatgatattggatctaccatcagtcacaagattatcccacatgctgtctcgtggttcactggacaggctgctcaagatgaggagtttgaacttatggatggtga

SEQ ID NO: 4627 - DNA, 185 bp, Zea mays
  Clone ID: LIB143-035-Q1-E1-E12
atagtgagtcgtattaaggtgtcagccagcgacagatccaggagggattgaactaagctcgtttcctccgtccacatgcatcgctgcacatcgacaatgacatgatcggaggcacgactggtgacacacactgcggataataggaccgtccttaggtcggttctcaaggagcagacacaggtcag

SEQ ID NO: 4628 - DNA, 59 bp, Zea mays
  Clone ID: LIB143-035-Q1-E1-E2
gtcaccgcccgtccgaaaaaaaaacaaacccggcacgaacagaagcgaacaaaacaaac

SEQ ID NO: 4629 - DNA, 59 bp, Zea mays
  Clone ID: LIB143-035-Q1-E1-E6
ctactagcgtaccacctttttttaatcgagagtactgtacacgtcgccatatcgactag

SEQ ID NO: 4630 - DNA, 171 bp, Zea mays
  Clone ID: LIB143-035-Q1-E1-E8
agtaccgtcttacgcaatcaacagaaatacgcggagtgacaaactgtacgaaaggcacactacactgtgtgtcttgctaaatcaggagcgtgcgacatataccagacccgtatccaaatctagagcgcgcgagtgcgagctctccagacgctacgagcttatctaccccta

SEQ ID NO: 4631 - DNA, 319 bp, Zea mays
  Clone ID: LIB143-035-Q1-E1-F11
catagcagcgagaggaaacaaggcggcgaccgacgagccaagcaagcagcagagcatggacgcgggcgaggtgcggcactggaacgcggacgtcaacggcgtctccatccacgtcgccgagcggggccccgaggatgggcccgcggtgctcctaatccacggcttcccggaactctggctctcgtggcgccaccagatggccgcgctcgccgcccgcgggttccgcgcgctggctcccgatctccgcggctacggcgactcctccgtgccgtccgaccccgccgcctacaccatcttccacatcgttggcgacatcgtc

SEQ ID NO: 4632 - DNA, 252 bp, Zea mays
  Clone ID: LIB143-035-Q1-E1-F7
tacaagactctaaagtgagtcgtattagcgctcgcggacaggacaaaggcgctcgatagccgcatgatcatcatcgcccgcgccaagcattacaccgaggaatactacgcgcagcaaaaggaggttgtgcagctcaagcgtgacgcccggttgaagggtgcgctcgatgtgagcctgcaggtcaagcttctgtatgtggatcagatccatggtagcaatggcatgcacctcaagagcctcaagatcttgcag

SEQ ID NO: 4633 - DNA, 393 bp, Zea mays
  Clone ID: LIB143-035-Q1-E1-G11
tacaacaccctatactgagtcgtactaaatggctcatccttgcttaattaccaaggtacctttgcaggtaggtaggtagctagccgccatagcaagctaggccgaagcagaggagtgatggccaatgtccatcccaacgccgcggagtccgtccaggcagaggccgagggagagctgcccacggtgctgacggtgtggcgcaagtcgctgctcttcaactgcgacggcttcaccgtctacgacgcccgcggcgacctggccttccgcgtggactgctacgccggctcgttccgccgccggcgccgcgccgacgtcgtgctcatggatgccacggggaatccgctgctcatcgtgcgccgcaagacgcggttcggcttagcggagcgctgggtc

SEQ ID NO: 4634 - DNA, 379 bp, Zea mays
  Clone ID: LIB143-035-Q1-E1-G12
gcgtagtccattacaacagcctatagtgagtcgtattaaacggcttattactattgtaccttcgcaggttcgcacgcacctggacggaagcgtatgcgacgacgagtcagaagagtcatcggcgtcgaggaccgcagggtggcggactacatcccttcaccgtggcacgcagtgcagctgctcgtcctcagcggggccggatctgtcaacatctacgacgccaacgcgggcgtgctccgcacgctggctgggacacgctgggccgtctccatcatggtgccagaccaaatcacaccggacctcgccgcctactctgccgcagcggaccggtgggtcgccgacaacctggtcccctactacccggggacacgggtcaagt

SEQ ID NO: 4635 - DNA, 185 bp, Zea mays
  Clone ID: LIB143-036-Q1-E1-G11
tacgggtgattgcctaaatctccgctggctctcacagatttgaattcacctctctgtcgtgtcatgctgtccagttgggtttgctaagtggagcttcatcttactcacggttgacttctgtattcattaggcagctattcgagttttcacacttgacggcgtcgtaatcaagaacacacattcag

SEQ ID NO: 4636 - DNA, 373 bp, Zea mays
  Clone ID: LIB143-037-Q1-E1-A1
tgcaactctctagagtgagtcgtattacctcctcttcctcctcctagcacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcgacgcggccaccgagggcagcggctgcgactgcaacacctgcaactgcggcaccagctgcggctgctcctgctgcagctgcaactgagccggtccgcccggaccggcgatggcgcacgagagtcgagaggacgatt

SEQ ID NO: 4637 - DNA, 420 bp, Zea mays
  Clone ID: LIB143-037-Q1-E1-D12
gcaagtctctatagtgagtcgtattagactgccaaggtcacatatgttagaggagttgctgtgccactggggaaaacaaagtctcttgttgagagatgggaaaaaagagagacttctagcactgattattcaccacaaactggttcttgtggtgatcgggcatcgagaaatgacaaccatccattccatctggcggaaccaagtacaacatttgaaaaggacctgtcaactgtagatgaagcgatggctcctgtcaatttagtgcggaaccatgatgaattcctaaatgctgtaaaacttcggctgacaaaactagagatgatgcggcatgtctttgaacatagtggtattaaaggagcaattgctgcagtggcaaagctacctgacaatgcggttaatgcagatgttgttagtggtctc

SEQ ID NO: 4638 - DNA, 404 bp, Zea mays
  Clone ID: LIB143-038-Q1-E1-A12
tcgatacaacaccctaaagtgagtcgtttactctcttacctttcagttcggatcagtatgggagtcgctttatacagcagtaactagaaactgcttctactgaacagaagaatatgatttttcctgagatccttccccatgcacgtacattgatgactgatgtttttggaaactatgttatacagaagttctttgaatacggaactgaaacgcaaacgaagcaactggcaaccctgcttaagggttttgtgttacagctgagtcgtcaaatgtatggctgccgggtgattcagaaggctttggaagttgttgaagtggaacaacatacacaaatggctttggagcttgatggatctatcatgagatgtgttcgtgattagaatggcaaacatgtcaaccaaaaa

SEQ ID NO: 4639 - DNA, 357 bp, Zea mays
  Clone ID: LIB143-038-Q1-E1-A4
cctatagtgaatcgtattactcacacggcactccagccgctaggcctcactcaaccagacaaccagtacaccagcgccaccaagcccgggacgaagaactctgccgggcaaccgccgcccttcgccggcaaagaacgcccaccagatgcaccccggcctgctatggagtccgcggtgaacccgagagcgtacccgctgggtgatgcgcagctgacgatgggtatcctcgatatcatccagcaggccgccaactagacgcagctcacgaagggagcgagcgaggcgactaaaaccctgaatagggggatatcggagttcgttgtgatggcggcggacaccgggcctctcgagatcctg

SEQ ID NO: 4640 - DNA, 213 bp, Zea mays
  Clone ID: LIB143-038-Q1-E1-D3
tacaacatcctatagtgagtcgtattaaactcgcaccagatgtcatcaggcaattgggtaaagaactgaagaatcttaatgagtcacctgcagaaggaattaatgtgactgtcaatgctgatggcgtcactactatttttgccgatagtgaaggccctgctggaactccatgtgacaatgtggtgttcaggatgaagctattagtgtcgcatg

SEQ ID NO: 4641 - DNA, 418 bp, Zea mays
  Clone ID: LIB143-038-Q1-E1-F4
tagtgagtcgtattaaagctcttccccgcctcgtgaatctgttgacgcagaaccacaagaaaagcattaataaagaggcatgctggactatttcaaatattactgctggaaacaaagatcagatacaggctgtcataagtgccggtatcatcgctcctttgttgcaactgcttcaaacagcagagtttgatatcaagaaggaggctgcttgggccatctcaaatgctacctctggtggttctcatgagcaaatcaagtacttggtgtctgagggctgcatcaagccattgtgtgaccttcttgtctgccctgatccgagaattgtaacagtttgtctggaaggtcttgagaataatcctaaacgtaagggcagcattggcaagaacatggggtgcaacaggtgacactaacggtctta

SEQ ID NO: 4642 - DNA, 368 bp, Zea mays
  Clone ID: LIB143-038-Q1-E1-G10
acaccctatagtgacgtcgtaatagcgcatcgaagcctggagcgacggccgggagctccctgcaggacgcgccgctaatcgaggaggtggtgcaaggaggaagcggaggccacgacggcgacggcgacggcgacggcggcgcgcaggcgcaggagcagcccccggccccggggacctgcgacctgtacaagggccgctgggtgtacgacgagtcccgcgcgccgctgtacaaggagtccgactgcagcttcctcacggagcaggtcacctgtatgcgcaacggccgacgcgacgacgactatcagaagtggcgctggcagcccgacggctgcgatctccccagatttgaagctaagttgcttctggag

SEQ ID NO: 4643 - DNA, 381 bp, Zea mays
  Clone ID: LIB143-038-Q1-E1-G12
acaagactctatagtgagtcgtattacgtgtcatcatcaaaaaagcctcagtcatctcgtgatgacagttggtctgcactggttgagcggcaccggttcctcctgacaacacttcttgtgcttgccttcctatgcagtatctatctgtactttgcagtgaccttgggggcatcagatgcatgcagtggtttgacaggaggggcacagaagatcgagtgccaggcaagatcagtgctgcaacatggaaagttgaaattccgctgacttcggagtctcattgatgaagaccaaattattgagtttatttgcactctggtcacaggtcttattcttcataccatgaatctgtatattattggtggtggctggtttgtattcatg

SEQ ID NO: 4644 - DNA, 113 bp, Zea mays
  Clone ID: LIB143-038-Q1-E1-G8
ggtcaggacttcccgggtcgacccacgcgtcagaaaaaaaaaaaaaaaaaaaaaaaaaaaaaaaaaaaaaaaaaaaaaaaaaaaaaaaagggcagacgctcaaaaggttcaca

SEQ ID NO: 4645 - DNA, 371 bp, Zea mays
  Clone ID: LIB143-038-Q1-E1-H11
gttacaacaccctagagtgagtcgtatctaaggcgggggcgccttctccggcaaggacccgaccaaggtggaccgcagcggggcctacgtcgcgaggcaggctgccaagagcatcgtcgccgccggcctcgcccgccgtgccatcgtccaggtctcctacgccatcggcgtgcccgagcccctgtcggtgttcgtggacacgtacggcaccggcgcgatccccgacaaggagatcctgaagatcgtgaaggagaacttcgacttcaggcccggcatgatcatcatcaacctcgacctcaagaaaggcggcaacgggcgctacctcaagacggcggcctacgggcactttgggagggacgaccccgacttca

SEQ ID NO: 4646 - DNA, 398 bp, Zea mays
  Clone ID: LIB143-039-Q1-E1-A10
attacaacagcctatagtgagtcgtattacgatcccctctcgttcctccctcgtcgcctcatcaattcaagatccaatctttgctgctgccactcggcgatccgatcgttctcgagcaaggtcggtggccatggcacgctgccgccatcacctcctcctcctttccgtcttacttgccttggctgctgctgctgcgcggcaggcgcagagtcatggaaaagcctccgccgtcttcatcgatgcctcgtcgcaccgctaccttcgggaccagcaagccgaccaccaggacgcttcaatgtcgttaaatgaagtttctgcggttgtttctgtcatgcttggtttcgcaccgtcaacatccctaccagctatttcttcttcgaagttgaacaaagttcttc

SEQ ID NO: 4647 - DNA, 348 bp, Zea mays
  Clone ID: LIB143-039-Q1-E1-B12
atagtgagtcgtattaatccggctggccgcgactgtggatcttccacggtcgcagagatgggtctacgtatccaaggtcccgtatgctaggatctgtgcatccacttgcactgccactcatcgtgcggctgacctgtcaaggctaccagtcgtgatgcatacagcacatcgaattacggccagtttgcgctcgcgggacacgctggatgtcaaggacgagctctggcgagcatcatgtatgaatctgaagctttttactgtgaatggacgatctagaatcaagatgctgctcagtgggtgcaacgttaggtatgcccgtgcggcgtcctcacttgaggtcaatttagg

SEQ ID NO: 4648 - DNA, 213 bp, Zea mays
  Clone ID: LIB143-039-Q1-E1-C4
tcggctcccgttcggaatgcgcagccctgcctccggcgaactggtccccaagcgatgtggcatggcgccggtgccgggtacgatcacgacggctaaagtgacgaaacctctattcttgaagaggccgatgcagttcggcatcagcggccctttgccgcccagtatagacctgcaccggttcgtcaagttgcccattgtcctgcgttgccagcg

SEQ ID NO: 4649 - DNA, 378 bp, Zea mays
  Clone ID: LIB143-039-Q1-E1-C6
acgcgttggtcgttgcaacaccctaaagtgagtcgtattagaagatgaagaccgccatgaagttcgtggtgaagaagctcagctccatcgaccgcctctccatcgtcaccttcctggacaccgccaacaggatctgcccgctgcggcaggtgaccgaggactcccagccgcagctgctgaagctcatcgacgccctccagcccggcggcaacaccaacatcagcgacggcctccagacggggctcaaggtcctcgccgaccgcaagctcagctccggtcgcgtcgttggcgtcatgctcatgtccgacggccagcagaaccggtgcgagccatccgccagcgtcaagatccgcaacgtgccggtgtacaccttcgggt

SEQ ID NO: 4650 - DNA, 234 bp, Zea mays
  Clone ID: LIB143-039-Q1-E1-C9
tatagtgagtcgtattaacagctcccatctaacactacctgtcaagctacccagcccatcgatcacaccgcgcactgcaatggcgcttggcgacagtccagtcacagcctcagcagcgggagtatcctgtcgtgccgcaaccgagtcgcattgcacggcaacgtccgttcagcagccgatgcacaccatcacaggcatccacgcagccgacttgtcaatggttaacgggcccga

SEQ ID NO: 4651 - DNA, 339 bp, Zea mays
  unsure at all n locations
  Clone ID: LIB143-039-Q1-E1-D12
atagtgagtcgtattaaacagtgggtgcggntgggcgagcaggcggccgggccccttgcccgagtgccaggccaggggaggcgcgccaagtggtcgccacttagcaggacgaacctagtgtttattccaggtcatagttttgtgctgctgatgatggtgttaagtgccggtgggctgaaccttcttagaaatctaagtggctcccttatacttcttactgaggatggtcacttgagctagcagatatttcaaacttatacttttgtaatcactcggatgaagatagggtaaaatttttgtaacttgtaaaatttgggagtaagaatttccgctgcagaa

SEQ ID NO: 4652 - DNA, 167 bp, Zea mays
  Clone ID: LIB143-039-Q1-E1-D6
gtgagtcgtattaaaggacgacctcgtcgtgcggtgcttcaagcggtacccggacctggcgtagccgggcgggaagccgatgtcggtggacgccacgctgtgggacggcaactactgggccacgcagacaggggaaggcggacgtggactgctcggccgcgcccttc

SEQ ID NO: 4653 - DNA, 192 bp, Zea mays
  Clone ID: LIB143-039-Q1-E1-E1
cattacaacagcgtatagtgagtcgtattaacacacctccacgagcgagcccggcccggacctcgccgactacccctacgacaccgtgcccaacagggtggagcacctcctcgtcgcgcagatctaccaggagcgcacgcagcgggaggcgcgcatgtcgcggcgccgcgcgcgtcccgcgcgggcgccggt

SEQ ID NO: 4654 - DNA, 365 bp, Zea mays
  Clone ID: LIB143-039-Q1-E1-E10
tattttcggcacagagccgtgttttttcctcatttcgagcactaggactcgcctgtcggctaactgaaccgcttaaccaagtgtgagttgcctcgtgcgaaggtgacgagtgaggtatccgtatcccggaggcgtaggagtccctcggctcggtcggccttgctgcccgaggcttctcttgcttagttaaaggaaccctcggccgctcttcgatgagccgaagccggaggcagcggtgtcagtgtggacagaggctgagttggctcgaaaagaagacttcgtcggccggagcctggccgggccgtccactagtgggaccggcgccgaagttgagttgccgaggccatgagccgggctgatgtcct

SEQ ID NO: 4655 - DNA, 82 bp, Zea mays
  Clone ID: LIB143-039-Q1-E1-E4
gtgagtcgtattaaaacgcagcggacgactaatgcgatcgaacgatcaacacagcagaggggctgtggaggatgaggactgc

SEQ ID NO: 4656 - DNA, 64 bp, Zea mays
  Clone ID: LIB143-039-Q1-E1-E5
agtgagtcgtattaaacactgcggaacgacggacgaccgaagctgcagcggccgaagccaccgt

SEQ ID NO: 4657 - DNA, 337 bp, Zea mays
  Clone ID: LIB143-039-Q1-E1-E6
agcaacgcaatccggcaaaaaggcgcttctttcttgccctgttcgggacaggacacagacacagagccaggagaaggaaccgccggaggctaagcttcttcttcgtctttcctgggcgcgctcaagtggcgatggcatttgcggtctccgacgagctgctgggcaccttcgtgccgattgcggtgtactggctctactcggggctctacgtcgtcctggacgggctcgggatggacgactacaggctccatcccaagggggaggaggaggccaagaacatcgtttccaggtggacggtcgtcagaggcgtccttgttcagcaggcttttcaaatcgc

SEQ ID NO: 4658 - DNA, 83 bp, Zea mays
  Clone ID: LIB143-039-Q1-E1-E8
agtgagtcgtattaaacagctcgcgatggcaccgacaccgaggaagaggagatgaatggagtcggagcagggagtccggatcg

SEQ ID NO: 4659 - DNA, 78 bp, Zea mays
  unsure at all n locations
  Clone ID: LIB143-039-Q1-E1-E9
acaactcctatagtgagtcgtattaaacantgcngcncgcggcgcaccggcgcggggcggccgcccggcggcggctcg

SEQ ID NO: 4660 - DNA, 377 bp, Zea mays
  unsure at all n locations
  Clone ID: LIB143-039-Q1-E1-F11
tatagtgagtcgtattaaacggngcngncgacgacactgaggctcgagcggcagagcttgagaggactaagacagaaagagccgaggagaagcttagacaggagcggcaacaagcagaagaggaggccaagatgaaggaggctgaactgatgcggggaaacccgttgattaatatcaacaatgctggctccttcagtgttaagagaaggtgggacgacgacgtggtattcacgaatcaagcacgaggagagaccaagacaccgaaacggttcatcaacgacaccatcaggagtgatttccaccgtaaatttcttcagaggtacatgaagtgacgcttccgtcggtcacaattcagcctgaagcccctcatcgttatc

SEQ ID NO: 4661 - DNA, 437 bp, Zea mays
  unsure at all n locations
  Clone ID: LIB143-039-Q1-E1-F12
tcgtagttcgttacaaccccctagagtgagtcgtattagctgaaaccccgccgcctttttttccttttcttttctggacctgattgaagaaccgtagcagattaggggagggaggagcggcggcggccggtcggtcagtatgattcacctgctgttcctcgtgctgttcgcggagggcgcggtagcgctgctcctcatggtgaaggtcgggccgctgcgggagctggcgatgcgcgtcgtggaccaggtgaagacgggcaagggcccggcaaccgtcaagacgctggcatgcacgctctcggtcatcctcatgtccaacgtcgccagcatcctcaagatccagaatcgtgggctcaagctcggcaccgtcagccccatggaccaggtgctctggagaacgcacctcctccgaggatcnctcatcggatacacgctat

SEQ ID NO: 4662 - DNA, 83 bp, Zea mays
  Clone ID: LIB143-039-Q1-E1-F6
atagtgagtcgtattaaagagggcgacggcgaggggcggacggggtgccggcggggctccaggtaggaggcggcggtggacaa

SEQ ID NO: 4663 - DNA, 281 bp, Zea mays
  Clone ID: LIB143-039-Q1-E1-F9
acagctcccgaaggcccggctgagtgacccacccgaagatgataaccgccgcgtacaaccatcgtgaagaggatgcgcaccctgcagcagtaggatgcaacacttgccatgcgtcacaggtgctctcgaaggaggatcaatgacaggctggactggtctggccaacgtagccccgttttgggtagccgtggtggctgcagcgcaagcatgcaatggcatcatgtctctgctgagcatcggatggagaatgatcagatgaccaatactgttgccacgaatga

SEQ ID NO: 4664 - DNA, 309 bp, Zea mays
  Clone ID: LIB143-039-Q1-E1-G10
aatagaataccctggacgtcccaacacgcagcatcagaccaaatggactgggatgttacgcctgagtaccccgatgggatcaacaacagtgaggtaactagccgtcgggtcaaagggacgagactgggaaaagccagcagtaacacagcttacgcacctggcaacacaacggccatccgcgaggcagtgtagtagccagaacgcgcgcgtcgatggcacatcacaacagtcgcgaacctcgaaaggggaatgggaagtcccaaggcacaccacattaagcacggtgtttgtaggagtgacatccacctt

SEQ ID NO: 4665 - DNA, 232 bp, Zea mays
  Clone ID: LIB143-039-Q1-E1-G4
tacaactccctaaagtgagtcgtattacctcctcctatcacagctagcgcctgctccccttcgtctgtgatcatgtcttgcagcatcggcaagtgcaactgcggctccagctgctcctgcggcagctcatgcaactgcatgtcacctgacgtggagaccgccgccgccagcagcatcaagaccatggtcctcgctgcgccgaccaccaaggccagcgcctgcggcttcgacg

SEQ ID NO: 4666 - DNA, 293 bp, Zea mays
  Clone ID: LIB143-039-Q1-E1-G7
agtgagtcgtattaaactggattcccccgattccctcacccatcaaccccacagcggacaaaaggcaatatgttcggcttcgggcatcacggtcaccacggttagaacccgccggtgcatggcggcctgcaccagcccatcttcaatatcgtctgcaacgccgacgaggggtactgcttcaacgtccgcgacggcaacgtggtgctggcccccgccgacccgcgcgactaacaccagccttgggacaacgccatgcgcttcagcacgcatgtcatggtccaggagggcaggcc

SEQ ID NO: 4667 - DNA, 203 bp, Zea mays
  Clone ID: LIB143-039-Q1-E1-H3
gggaaaaaaacccccgaaaatgggaaaaccccccaaaaaaaaagggggggggggggggggggggggggggggaaaagagggggcccgcgaaggagatgttgtggccaaagggggggggggaaaggcggcggggaggggacaggggcgggcagcgcgggggggagaggcggggggggggggggcgaggaaagaggggggggggg

SEQ ID NO: 4668 - DNA, 262 bp, Zea mays
  Clone ID: LIB143-039-Q1-E1-H8
gttttacattgctacaccctatagtgagtcgtattcaaaaacgcggtcagggagcgggcgcaggaggggatgaggggaggacagccgaaggcgcgggtccacgggttggccggggatgggaaagtgaaaacgttccctgtgatcgcagtgcccaaggagaaacttgttgacaccaacggggcaagtgatgctttcgttgggggcttcctctcacagttgggtctatgcaagggcaatgaagactgcgtgagggcaggttgct

SEQ ID NO: 4669 - DNA, 211 bp, Zea mays
  Clone ID: LIB143-040-Q1-E1-B11
atcgtactatcgccctcatgctgttcgtcggttgcgcgttagtggatgtagctagctcgttctcgacggtacagtcgggaacgtactcgcatgggagcgttgccgggctggcgggcggctacgtggcggataacatgctcggcctggctggatgccaagtcctctcctcgagatcatggccttcaagctcccgtccatctgcccttaatcg

SEQ ID NO: 4670 - DNA, 146 bp, Zea mays
  Clone ID: LIB143-040-Q1-E1-B4
tagtgagtcgtattaaaattgcgcggcgacttctgtgcatgttgttcagagtgcggtcctggcagtgattcttgcataaggatgcgtccagatacgacgggagagtcgaggtccactaggagtgaagttatcgcgggagccggggg

SEQ ID NO: 4671 - DNA, 99 bp, Zea mays
  Clone ID: LIB143-040-Q1-E1-C3
actccctatagagagtcgtattataggagggcgcggatgcgtcgtgaagccgttttaaggtcgctagaccgcttgctgtgccacttatgtttcggatgt

SEQ ID NO: 4672 - DNA, 188 bp, Zea mays
  Clone ID: LIB143-040-Q1-E1-D10
tagtgagtcgtattaatcgtattaacggcgggttccacgacgccatctccaggaacatcaggctggggatccgcaaggactcgcagcgagggggccaagctcgacgagcgtcaggggctatagtccaccaggagcgggggggagaggacgagccacatcgactgggtggcgcggaggggagaagggca

SEQ ID NO: 4673 - DNA, 403 bp, Zea mays
  Clone ID: LIB143-040-Q1-E1-D11
acaaccctcaaaagttagtcatattatcatggctcagagctacgctaagaacatgggattgtatggagagcgtgttggcgctttgagcattgtatgtaaaagtgccgatgtagctgttagggttgaaagtcaactcaaacttgtcatcaggcctatgtattcaaaccctcctcttcatggtgcctctatcgttgctaccatactcagggacagcgagatgttcaacgaatggactctggaactgaaggccatggctgataggatcattaacatgaggcaacaactatttaatgcgctgaaatccagaggaacccctggtgattggagccatatcattaagcaaattgggatgtttactttcacttgggctgaatagcgaacaaagtcgcccattcatgaggca

SEQ ID NO: 4674 - DNA, 310 bp, Zea mays
  Clone ID: LIB143-040-Q1-E1-D3
acaattcctccttcggatctcgcattcaacgcatcgcacgtgtgaaggaacggggacgccgatgaagatggggctcgcgttcgggaagctcgtcagccggctcttcgccaagaacgacatgcggatcctcatggtcggcctcgacgccgccggtaaaaccacgatcctctacaagctcaagctcggcgagatcgtcagcagcatctccatcagtcggtttcaaggttgaaactgttgagtacaagaacattagcttcactgtctgggatcttcggggtcaggagaggatcagacctctttgggaggcatt

SEQ ID NO: 4675 - DNA, 263 bp, Zea mays
  Clone ID: LIB143-040-Q1-E1-E10
acgggtcagccgccgctccgcctcagcgcgtcgcccgccgccagatcctgacagcgacctcatcgatcaccttcaactttcaatcatggcggacgtcgatgtcgaaccggaggttgccgccggcgctcccgaagaagaggacgtgccgcaagtacagctaccgcggcgtcgacctagatgcgcttctcgacatgtccacggaccacgtcgtcgagctcttccgcgcgcgcgccacgagaaggttccagaggggtctgaagagg

SEQ ID NO: 4676 - DNA, 62 bp, Zea mays
  Clone ID: LIB143-040-Q1-E1-E8
atagtgagtcgtattaaaggcggcagagaacatacccgtgggaagctacgacgtgggcgttg

SEQ ID NO: 4677 - DNA, 211 bp, Zea mays
  Clone ID: LIB143-040-Q1-E1-G10
ttacaacatcctaatagtgagtcgtattaaactattagcgcgtcgatccacctctccgaggtcccctgctgcgccctgtcccgcctgtggcttattcgtcgacgtgggggactatgtccagggtgatggctgccatgctgctcggattgcggggcgtcgccagcgctgcaagcctcaccggtaagggcaacgccgtcggcatgccggctct

SEQ ID NO: 4678 - DNA, 344 bp, Zea mays
  Clone ID: LIB143-040-Q1-E1-G12
atacaaccctcaatacatagtcgtggtaaggctcggcgattacctgatcgagcagggcttctaaaagttcgtcatgttctgttttggtcatttgggcaccaaagtttgcgcctcatttggttctgtaatccgtgagctcgtgcatgtacttggcgtattgcatgcagtgaataatttagcttgggtttgtttgttgggggcagtgttggggacggatttggattggggtttatgcttggcatcgcgtcgtatcgaaactcagctgctgtttcgctgagtaatgtacatttccctggtaatggtacttgtggactctgatgcttttatgggaacgagtgcatttt

SEQ ID NO: 4679 - DNA, 53 bp, Zea mays
  Clone ID: LIB143-040-Q1-E1-G5
gacccacgcatccagagggcatcaccggctacctctggcaccatctgagcact

SEQ ID NO: 4680 - DNA, 132 bp, Zea mays
  Clone ID: LIB143-040-Q1-E1-H7
tactacacccaatagtgagtcgtattaccgagcgatcgagctctccggtcgctagcacagccggcgactgcacacaacggtgctgctaggttgcaagcacttgcatgattgcgcaggtcgcgaagacgcttc

SEQ ID NO: 4681 - DNA, 186 bp, Zea mays
  Clone ID: LIB143-041-Q1-E1-A10
gtgagtcgtattaagtacggcgtggcggtcgtctgctacggcatcaggaagacgggcgcgcacgagtgcatgctgcagacatcgcggggccggtcgcggggagagggcgcgggtcgcccggatgcagaccgccggcggcatccgcggccccggccgattccccctgcaggctgctgctcacgtggt

SEQ ID NO: 4682 - DNA, 341 bp, Zea mays
  Clone ID: LIB143-041-Q1-E1-A4
agcaatggctaccattatcaagctcgtggcccttggcttggccgtcctcgtgagcgttgggttctccgatgcagcgagggtagttaggcttgggagctatgcgtctgccggacgaggcggcggcggtggacgcggcggctccggatcgaccggggctgctgggtacggcggtgggtctggcggtggcggtggctacggcataggcaagggtggcggggactggtggaacaatttcgtctccagcgtagcgggcggtggtggtgggggacatggcggagggggtggcaccaatagtggatccgggtccggctgtgggtcgggctatggttctggcaccagtt

SEQ ID NO: 4683 - DNA, 393 bp, Zea mays
  Clone ID: LIB143-041-Q1-E1-A9
gtcattacaacaccctagagtgagtcgtattaaccacggcgtggcggcggtcggctacggcgtcagcgacgacggcacgccctactggatggtcaagaactcgtggggcccttcctggggagagggcggctacatccggatgcagcgcggcaccggcaacggcggcctctgcggcatcgccatggaggcgtcctttcccatcaagaccgcgcgcaatccgtcgcgcaagccccgccgcgcgctcatcaccatggacgcctcttcccagtgacaggctgatccatctcggcgtcgaactcgtactactggcacgtaagtaggagtacgttgacacgatgacatcctgctgctgctgtttgcctgtactattttcgaatgtgtatgtacgtttga

SEQ ID NO: 4684 - DNA, 379 bp, Zea mays
  Clone ID: LIB143-041-Q1-E1-B10
gttggtcaatacaacactctagagtgagtcgtattatataacaatgtaaggagccagcttactgcattcaacagaaagcaaagtgggagcttatcagttcgtgacctttccaatctggtagaagcaaaggatatggtctgctcatagcatctagtaacacttcttgctattgttccgaagtactcacaaaaggactggttgtcaagctatgaatcactcgacacatttgtggtacccaggtcatctacacagctctatgaacacaatgagtatgcacgctatatcataacactttttgctaacgttgttgacaactttaatgtcagtgctcgcgagaagggtttccagattcgtgattttgactatagtcatgaagcac

SEQ ID NO: 4685 - DNA, 399 bp, Zea mays
  Clone ID: LIB143-041-Q1-E1-B5
gccgacccacgcgtccacctaaaaccatctgcttcagccttcagctagccccaagtttagtcggccgatcgatcactgaagtagtaatggcctccgccaacagctggaccctcgagatcgcgtcgccggtggccccgcagcgcctgttccgcgccgccgtgatggactggcacaccctggcgcccaaggtcgcctcccacgtcgtcgccagcgcgcagcccgtggagggcgacggcggcgttggcagcgtcaggcagttcaacttcacctcagtcatgccgttcagcttcatgaaggagcgtctcgagttcctcgacgcggacaagtgcgagtgcaagaacacgctcatcgagggcggcggcatcggcgtcgccatcgaaacggcgacgtcgcacatca

SEQ ID NO: 4686 - DNA, 94 bp, Zea mays
  Clone ID: LIB143-041-Q1-E1-B8
atagtgagtcgtattaaacgtgacacatccagtcacaagttttgacgcgacggtcaatgcttcagataatggctgagctcgtgtaaagtgttcc

SEQ ID NO: 4687 - DNA, 201 bp, Zea mays
  unsure at all n locations
  Clone ID: LIB143-041-Q1-E1-C10
tagtgagtcgtattaaacacnacatcgcnctcnacaactaaccccacgcgtccgcggacgcgtgggtttggatatgtctaatcagtggccatgtcggctgtggaaggtacaagggtggacatgctaatgaccactggaaggaaactcaacattggtattcacttgagtgagagacacggagagtgtgggagctattctggg

SEQ ID NO: 4688 - DNA, 362 bp, Zea mays
  Clone ID: LIB143-041-Q1-E1-C11
tcccacaaaccgttgagctcaggagggtccgccgtgagtacaaggcaaaaaagatctctgaggaggaatacgtcactgccatcaaggaggaaatcaacaaggtcgttaagctccaagaagagcttgacattgatgtgcttgtgcatggcgagcctgagagaaacgatatggttgagtacttcggtgagcagctctccggttttgcgttcactgccaatggctgggtgcagtcttatgggtcaaggtgcgtcaagcctccgatcatctacggtgacgtgagccgccccaaccccatgaccgttttctggtcgaagacggcgcagagcatgacgtctcgcccaatgaaggggatgctgactggc

SEQ ID NO: 4689 - DNA, 161 bp, Zea mays
  Clone ID: LIB143-041-Q1-E1-C12
ctatagtgagtcgtattaaacagagcggcgtggggctcaggagggtccgccgtgagtacaaggcaaaaaagatgtcggaggaggactacgtcagtgccatcatggaggcggtcaacagggtcgtgaagctccaacaagagcgtgggattgaagtgcttgtc

SEQ ID NO: 4690 - DNA, 382 bp, Zea mays
  unsure at all n locations
  Clone ID: LIB143-041-Q1-E1-C5
atagtgagtcgtattataagnncacgcgtccgcccatgcgtccgcaggtgaggctccgcgcctgcgcgggccctagccgtcgtctgcgggacttcatcttcgcggtgggggaatacttcttcaggcactggcagaggtgaggggtccaggatattggggtccatcagcttgatgtcatcatgtgcggggaggtatctggcatctcgattgggggcctttgcgcagaaatgtgttgcgatttttgttgtatgcgaatcgtaggtgcgccgatgtgcgcttgtccgggtcggcgaggagtgactttaggggaaattccaggggaagtctctgatctgattggattgtctgtgtcgcaggtggttgctatcgggtggcctttttg

SEQ ID NO: 4691 - DNA, 379 bp, Zea mays
  Clone ID: LIB143-041-Q1-E1-C9
cctatagtgagtcgtattaaattctagatcgcgatctagaactagtcccacgcgtccgcggacgcgtgggtttggatatgtctaatctgtggccatgttggctgtggaaggtacaagggtggacatgctattgaacactggaaggaaactcaacattgttattcacttgagttagagacacaaaaagtgtgggactatgctggggacaactatgtacatcggcttattcagtcaaaaacagatggaaagctagttgagtacaatttccatggtgatcacacagcagacagcacgtgttcactatgcagtggtgatgccgcactggatgaagctctactgaacagtaaatttgaagctattgttgacgagttcaatgatc

SEQ ID NO: 4692 - DNA, 418 bp, Zea mays
  Clone ID: LIB143-041-Q1-E1-D3
gcgggccgacccacgcgtccacagagactcgggtcagtacccatcctgcacacgaagcctagaatagccctcccctgctccgccacctcctcggatcccgaccaccccacccccaccccagacaacaggttgatggaggctaagatgggacgcttcttcgagtccgtgagcaatttcttcaccggaggcgaccacatcccctggtgcgaccgcgacctcatcgccggctgtgaaggagagcttgtcaatgctgcaaatgaggaacagaggaatgaaagccttatgaggttgtcatgggcccttgtgcactccaggcagacagacgatgtaaaccgtggaatcagcatgcttcaagcttctttggataattctgccagtcctctgcagactagggaaaagctgtacttgttggctgttg

SEQ ID NO: 4693 - DNA, 360 bp, Zea mays
  Clone ID: LIB143-041-Q1-E1-D4
gagtcgtattattagccgccatacccactgagttcacaatcggaatctcacattacaacctgcgttgtttgtacctaagagctcaatacttgaggatccggttgaatcaaaatgttctgggtttacgaatctgcaagatgatcatgaggctctacatggctagtcaggcccggtgtcaccatgtgctggttcctccatatctgcgaagaatgaaaacaatgattccattggaatgacagctgaatatctttctcagacagtaggaacatgagttggtgctgtacgtgtacaagctgttggcataaatgttaatggtgcagcaccacaattcactattccccactggtggagtcaactgaa

SEQ ID NO: 4694 - DNA, 387 bp, Zea mays
  Clone ID: LIB143-041-Q1-E1-D6
gcaactcactatagtgagtcgtattattcacccctccaccacctccatggggtcgtcggaggccgacgaggaccagctcctcaagagcttcctcgcggaggtcagcgaggccgagcgggacaacgaagtgctcaggatacttggttgcttcaagttaaaccccttcgagcatcttaagttgtcttttgattcatcaccagatgaggtgaaaaagcaatataggaagttgtcattgctggtccatcctgataaatgcaagcatcctcaggcacaagaagcttttgcagctctggcgaaagcacaacagctcctgcttgatccacaggaaagaggctacattcttgaccaagttactgctgcaaaagaagaattgagggcaaagcggaa

SEQ ID NO: 4695 - DNA, 261 bp, Zea mays
  Clone ID: LIB143-041-Q1-E1-D8
tcacgcctccaccacctccatggggtcgtcggaggccgacgaggaccagctcctcaagagcttcctctcggacgtcagctaggccgagcgggacaacgaagtgctcacgatacttggttgcgtcaagttaaaccccttcgagcatcgtaagttgtcgtttgattcagcaccagatgaggtgaaaaagcaatatacgaagttgtcagtgctggtccatcatgagaaacgcatgcatcctcaggcagaggacgcctttgcagc

SEQ ID NO: 4696 - DNA, 351 bp, Zea mays
  Clone ID: LIB143-041-Q1-E1-D9
acggcaggctgtgccacatgagacctatgtttacttcatggaccttctcgccaagacagttagagatgagatcgctgggtgcagcgaaaaggggtatgattccctatctgtaagtgatgcaaaacaaatgcttatgttcagttctgaccaagatctgcacgagtacatcacagaggagcacccggaatgggagtttaagaatggcgccgtcttcttccagaaggcaaaggaatcacagccctacaaggagatcccatccttgcagctcatcaaccagacgctcagctatgcgacggagctggagcgtattgtatgatttaatttcacagtaatccctggtggatgtttatt

SEQ ID NO: 4697 - DNA, 162 bp, Zea mays
  Clone ID: LIB143-041-Q1-E1-E12
tatagtgagtcgtattaagacctcacacacacaacatcacatacctggattccaaggcgaaatgtgtgtaccaataaccaagctcgcctcgcgggagcacgtacccatgatgcggctcgagcgggcaccaccgcttcttcaaccgcgagtagatggaccagg

SEQ ID NO: 4698 - DNA, 209 bp, Zea mays
  Clone ID: LIB143-041-Q1-E1-E9
agtgagtcgtattaaacggtcatcgcagcaccgttatggaagcagccacgccggcggcgccatggggacgggggcactgttagctggacgtgccgcgggcggcgcagctggttacggcgcagacaggcttgctcagggggagagcggacgtggtagatatggggactttggacgccgaggccgtcgccgccgtgcatatgggcgtggtc

SEQ ID NO: 4699 - DNA, 214 bp, Zea mays
  unsure at all n locations
  Clone ID: LIB143-041-Q1-E1-F9
gtgagtcgtattataaangacgcgaaacaaacatcaacaagaaaaaaacatgcaaaaaaacaaaagaaattcagtggaggaccacaccaacggctaaaaaactgtggtacgcgagtcggcgcagcaataactcgtccaaacggtcctccatctacatctcgcaggccgtcgatatgtagcgctccaactgggagtccgcggccttttcccacgg

SEQ ID NO: 4700 - DNA, 365 bp, Zea mays
  Clone ID: LIB143-041-Q1-E1-G11
tcacaacaagcaaagcagcgatccgacatccgagagatggacgcggtgatgttcgggctggagactcccctgatggccgcgctgcagcacctgctggacgtgcccgacggcgacgccggcgcgggcggcgacaacaagacgggcagcggcggcagcgccacgcgcacctacgtccgcgacgcgcgcgccatggcggccaccccggccgacgtgaaggagctgcccggcgcgtacgcgttcgtggtggacatgccggggctgggcacgggcgacatccgggtgcaggtggaggacgagcgggtgctggtggtcagcggcgagcggcgccgggaggagcgcgaggacgacgccaagtacctgcgcat

SEQ ID NO: 4701 - DNA, 287 bp, Zea mays
  Clone ID: LIB143-041-Q1-E1-G12
agtgagtcgtattatacaatacgacaccccaagccgcacagcacagacccgggcttcgccggcgcggtagccagagcaagacatggacgggaggacgtacggccacgagaccaccctgatggtggctgctgcagcaccttctggaagtgcccagactgcgacgccggctcgcgcggcgatctcgcacgtcctgccgctgcgggcggcgggcatacgcgcgggttgcttcgcgaagcggccccgtcggcgcgcatccggccggcgttaccgtggccgtagcgcgctgt

SEQ ID NO: 4702 - DNA, 357 bp, Zea mays
  Clone ID: LIB143-041-Q1-E1-G5
atagtgagtcgtattattcagaaagggtgtcgagggtgcaaccaagtttctccttaacaagctgaatgacctccaattttttgttggtgagtccatgaaggatgatgcgtctgtggtattcgcctattacaaggatggtgccactaatccgacattcctctatttctctcatggtcttaaggagatcaagtgctaggcgtgcggcgaaattagttacccatgttgggtactatctatgtactattagtatatccacaactatagttgtcctggctgaattgaactcaaaagggtttgtttgagaaaagattgtcccaagattggatttgcttgttaaaagcctcaatattgttattg

SEQ ID NO: 4703 - DNA, 372 bp, Zea mays
  Clone ID: LIB143-041-Q1-E1-G6
ttactactcccaatagtgagtcgtattaaaatggcctctgtcgtctaacgcggcacggacggcggcggcagctaccgccacttcgccatgggctggagcaccccctggggcgcctccacgagcagggcccactgccagatctgcaacggggggtccttccagtcgcagtgggacaatctcgacgaaaaactcaacaaggccggatacactaccaacgcaagtggtaccagctcgtctatttccgccgcaactgcgaagggcagctcccccgacttcaaagcatatgtggagatcccttacagcgcatgatgtcaaatcggatccgtcatccacatcgtatcgcgtcgttctgcttgtacactgcttcttcgg

SEQ ID NO: 4704 - DNA, 350 bp, Zea mays
  Clone ID: LIB143-041-Q1-E1-H1
cctatagtgagtcgtattaaaggtcgtttgccgagaagcactacgccgatctcgcctccaagcccttcttccagggcctcgttgactacatcatctctggccctgtggtggccatggtctgggagggcaagagcgtcgtcacaactggccgcaagatcattggcgccactaaccccctggcttctgagcccggcaccatccgtggcgactttgctgtcgacattggcaggaatgtcattcatggaagtgacagcattgagagtgccaataaggagattgccctgtggttccccgagggccctgctgattggcagagcagccagcacccctggatctacgagaagtaaaca

SEQ ID NO: 4705 - DNA, 395 bp, Zea mays
  Clone ID: LIB143-041-Q1-E1-H5
tacaactcactatagtgagtcgtatgtaatttgacaaaggaaaccctgcatttatatcttcaaacatcacacttgttgagagatatattgtggtgcatggacagataatactccagcagtttgcagattttccagatgagactatccgtcggagtgcatttgtcagtggtcttttattgaagatggaacagaggaggcatacaaagttagttatgaagaaaaaaactcaagtgatgaggggagagaatctgaatccaagtgcagcaatgggtccagcatcgaggaaaaaagcaatgcatgcaacaacaaccaggctcatcaacagaatctggagtgattactatgcacatcatttccctgaagattccaaggagggagatggaaattgaaataaa

SEQ ID NO: 4706 - DNA, 384 bp, Zea mays
  Clone ID: LIB143-041-Q1-E1-H8
ctatagtgagtcgtattaaatcgctagcagcagctgcatgctggcaatgtgcagtggtcaacctaagatgtcacagagcgttctaatcgccttcaggaatgtaggagacgacgctacgggagccgcattggccatcgacgcgttctttccctttgcctgtactgatgccatctaggaggcgtgctacaacagtatcggtatcatcgcccagccagtacgcagtaacaacgacgaagacgccgtcgcgtgctgcatcaagtatggtgtgtctctcgtcctcaccgatgtcaggcacttcaagctttacccgtcatgctccatggcaggtcatcttagcgtacggagttacggactttacaccaaccttcgacagctgctccttgt

SEQ ID NO: 4707 - DNA, 404 bp, Zea mays
  Clone ID: LIB143-042-Q1-E1-A11
cgcgtaggacattgcaacaccctaaagtgagtcgtattaccctaggattgccatggcggaccagctcaccgacgaccagatcgccgagttcaaggaagcattcagcctcttcgacaaggacggcgacggctgcatcaccaccaaggaacttggaactgtgatgcgctcgttggggcagaaccctactgaggctgagcttcaggacatgatcaacgaggttgatgctgatggcaatggaaccatcgacttccctgagtttctcaacctgatggcacgcaagatgaaggacaccgactctgaggaggagctcaaggaggccttccgcgtgttcgacaaggaccagaacggcttcatctctgctgctgagcttcgacatgtcatgaccaacctaggtgagaagctga

SEQ ID NO: 4708 - DNA, 122 bp, Zea mays
  Clone ID: LIB143-042-Q1-E1-B1
tatagtgagtcgtattaaaccgctcctggggttcacgttcatctgtaacgtgctcgcggtcatgtccgtctcgtgccggatttaatatttagatgcatgtccttgtgttttttctgcgttaa

SEQ ID NO: 4709 - DNA, 425 bp, Zea mays
  Clone ID: LIB143-042-Q1-E1-B6
ttgcaacaccctagagtgagtcgtattagtcgccttcccctctctagtgctcaccggctccttccgtcgccatggacgtcctcttctgctgctgcctgctgcttctcctggcctccgccgcgtccgccggcagcgagcggtgcgtgcggcaggggaaggcggcctactctccctcgctctccccggcccctcacggtagcagcggagcgtgcgggtacggcgccatggccgccgagatcaatgggggcttcctcgccgccggcgggcccaggcagcaccgcgggggcctcggctgtggccgctgtttccagatgagatgccgagacgcaaggctgtgcagcgccgggggagtgcgggtggtgctgaccgacttccacaggagcaaccgtaccgacttcctgctcgccggggtcggcgtccgcggg

SEQ ID NO: 4710 - DNA, 323 bp, Zea mays
  Clone ID: LIB143-042-Q1-E1-C8
ttacaacacctatagtgagtcgtattaaatcgcctccaagcgggcgccgcgggattactacaatggcaagaactgcaagcccaccgggttccacacccgcaaaggtggatatgtgattgttgatgaaaagttgccaagatgtgtggtccctgacttgactgatttcaagctgaaggcatacgtgtcacaatgcggccagggaccgcacagcgtcgacagcatcctcgacttcagcagaaagtactgaaagcatgagctgatctgatctttgcttgcggggaggcagcgcaagtctgaagttatgtttccctagactgcccatg

SEQ ID NO: 4711 - DNA, 340 bp, Zea mays
  Clone ID: LIB143-042-Q1-E1-E5
tacaacacctatagtgagtcgtattaagtggatcggagacacacgattcgcggaaggacgaggaagtccgatctgccctcgtgtcgcagagctcgacgaacaatgtcgcggagacgccgtggatgcgcatacgagtccttcacacgggagctccgggacaccttccagggctttcacttcggatctggaggcaggagtagcagcagccagtgctgctcgttcggtggcagcaccagctatgagacagcggtcttctctgggattcgtgtagaagggaacgagacgactgaagcgcgaggttgcaagagtgacgtgccggggctgaagtagggagatgtgg

SEQ ID NO: 4712 - DNA, 419 bp, Zea mays
  Clone ID: LIB143-042-Q1-E1-G11
tacaaccccctaaactgagtcgtattatggcggcaacagcgtctggacccgcccggcctcccgcaagggcaagaagaaggcgaggcagccgggcggcctcggccacggctccggcggccccgccggggccgccagaggctccaaccctaggcccaacgccggcggcgaggaggagttcctcctcgtccccgcgacccgcctcgccgccgagcgctccgacgacgcgcccggccagcctgtgctcctctcccgcgtcttcaagtccgagcggatcgagctctcagaggaccgcctcaccgcggccagcaccaagggattccgcatggtgcgcgcgacccgcggcgttgcggcaggggcgtggtacttcgaggtcaaggtcgtgcacctcggccccaccggccacacccgcctttggatgg

SEQ ID NO: 4713 - DNA, 349 bp, Zea mays
  Clone ID: LIB143-042-Q1-E1-G12
gtgagtcgtattaagccgcacggcttccggaaggtcgatccggaccggtgggagttcgcgcacgtgtccttccttcgcggccagacgcatctcctgggccagatcgtccgccggagcagcggcggcaagcgcaaagacgacggcaacggcgccggcgccggctccgccgacgacgaggacgcggtggccatggaggtggtccggctgaggcgggagcagcgggccatcgaggagcaggtggccgcgatgtggcgccgcgtgcaagagacggagcgccggcccaagcagatgctcgcgttcctcgtcaaggtcgcgggcgacccgcaggtgctgcgccgcctcgtctcca

SEQ ID NO: 4714 - DNA, 396 bp, Zea mays
  Clone ID: LIB143-042-Q1-E1-G3
aacaccctagactgagtcgtattaatctctctctctctctctcgccgagtgagggaaggtggcacggaagtggggagagcggttaggacatggcggcgaacgcgagcagcgcagcctcctccggcgcggcctacgaagagcagcgcatgaagcgggtcctcgagaacctcaagcatctggaggatttgggtatagcggagatgtctaagagcctgctccaggcggcgcgcctgcagaaactgagcaaggccggcgtgcgcgcgggccccaaggagaggaagaagttcgacgccaccgacgtgcagcgttcttcgagggcgaagaccacagtttcctacaaggacgattttggtgaactacatacttttctgcgtggcacaaggcgcactggtggta

SEQ ID NO: 4715 - DNA, 404 bp, Zea mays
  Clone ID: LIB143-042-Q1-E1-G6
ctcctcctcatccgcatcgcatcgagagcggggctgtgccgtgcgagactctagtgctcgatcgccatggccgccgcgctcaggtgcccggcatccgtcagggtctcgggccccgccgccgcggggctcgccaaggtgcgccatgcgtccagagtcttaacggtgagcggggcccggcacatccgctgaggcggcgtcgccgtgcgggcctcgctgttctcgcacaagcccgcggcggccaaggactcgcgtgccgaccaaggtgcacgagctgtacatgtacgagatcatcgaccgggaccgcgagagccccgcatagctgcgcctcagcccttagcagacggacaacgcgctgggcgacctcgtctccttcaccaacaaggtgtacaacggcagcctggacg

SEQ ID NO: 4716 - DNA, 388 bp, Zea mays
  Clone ID: LIB143-043-Q1-E1-A5
tacaactacctatactgagtcgtattaacgtcgaggagcttccggggggcagagcagggcaggggagggggaggggagagaagaaggctcctgcttgcgtaagcgaccaagtcgttcttccaaggaaacgaaggggaagggaagggcagggagggcgacagaggctgatcggagctcatcatcgttcgatggcggtgaccgcgacgacggtcgcggcggcgaccacgatgctggcggccgtggcggcggtcttcctgaccctggtgctctgcttctacgtcttcctctgcgccaagcggtaccgcggcgaggcgccgccgcacgcggtggccgccggcggcggctgcggcgtcagggcgtggctgcgcgtcgtgttcggcgtcggggg

SEQ ID NO: 4717 - DNA, 389 bp, Zea mays
  Clone ID: LIB143-043-Q1-E1-A7
agtgagtcgtattaacgcgtgggcactcatcagccgccgtagggagcatgagtgacggagcgcgatggcggataagaatcagcgcccaggagggtccaggaatgacgaggtggttacccgcgagtacaccatcaaccgtggacaagcgcctccacggatgcaccttcaataagaaagcccccaatgctatcaaggaaatcaggaagtttgcacacaaggcaatgggcaccactgacatcaggattgatgtgaaactcaataagcacatctggagcattggtatccggagtgtgccgaggcgtgtccgtgtcaggatcgcacgcaagaggaacgatgaggaagactccaatgaagagctttactctcttgttaccgttgctgagatttcc

SEQ ID NO: 4718 - DNA, 86 bp, Zea mays
  unsure at all n locations
  Clone ID: LIB143-043-Q1-E1-B12
agtgagtcgtattaaacggnggaggacgaggaggggccgcacctgagggcggacatgccgggccggcggaaggagcacgtcagcgt

SEQ ID NO: 4719 - DNA, 270 bp, Zea mays
  Clone ID: LIB143-043-Q1-E1-C2
agcgagggaggcagccttctattttctgtcaaaacaagggcgatactcctcctactccagcgcacacgcagatcagcgtcgaaatccgtcgcatcgtgcccgcctcgctgtctccgctgggcgcgggtggtcatggcccgcatggcgctggagctcgcggcggttctgctcgcgctggcggcgctggcggccgtggcggccggaggggacatcgtgcaccaggacgacgaggcgcccaagatacccgggtgctccaacgacttcgtgctg

SEQ ID NO: 4720 - DNA, 387 bp, Zea mays
  Clone ID: LIB143-043-Q1-E1-D12
tacaagactctatagtgagtcgtaatattgtgaagcctgattctttcaaggcgatcaacgacgaaggcatgcccatgtaccagaggccgttcatgaagggcaagctgtacatccacttctcggtggagttcccagactcgctaagcccggagcagtgcaaggccctggaggctgtgctcccgcccaagccggtgtcgcagtacaccgacatggagctggacgagtgcgaggagacgatgccctatgacgtgaacatcgaagcggagatgcggaggcggcagcagcagcaccaggaggcctacgacgaggatgaggacatgccgggcggcgcgcagagggtgcagtgcgcccagcagtaggcagcagcttggtagcagtgataaaata

SEQ ID NO: 4721 - DNA, 411 bp, Zea mays
  Clone ID: LIB143-043-Q1-E1-D8
acaactccctatactgagtcgtattatcttaccaagtcctcctcgggttagggttccttagggttttgtggaggggcaatggcggcggctgatgtggagtaccgttgcttcgtcagcgggcttgcctgggccaccagcaacgattcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgactgccgtaacatcaccgttaaccaggcccagtcccgtggcggtggccgtggcggcggtggctacggccgctgtcgcagccgccgctgctatggtggcgggcgccgtgac

SEQ ID NO: 4722 - DNA, 200 bp, Zea mays
  Clone ID: LIB143-043-Q1-E1-E10
agtgagtcgtattaaacagtgcacagactgcttgaccgcgcgataacggccacgcgggacgcgagagtggagtcaatggatggattgcacggtccattaggggagtgcagcaaggtcgtgctcgggatcgactaagggggacgtctccatgaagctcggaatggtcaccgtccagaagcaggtgccagtcgcctgtggac

SEQ ID NO: 4723 - DNA, 124 bp, Zea mays
  unsure at all n locations
  Clone ID: LIB143-043-Q1-E1-E8
aaactggntagaagccagaggatggcaccaagcagctgacaaaacggacaagcaataatcgtagagtcgagcctctttcattcgtcattatgggtgatgtgtgcatagaggtcaatacatgggg

SEQ ID NO: 4724 - DNA, 152 bp, Zea mays
  Clone ID: LIB143-043-Q1-E1-F12
aaccagggtttccgctggtgtctgtcacagcgcacacggtagtggtcgtcagcatggggcggcatcagaccccgtaggcgggcttcatgcgcgggaacgacgaccatggtcccagccaacgcgatatccctctgggccgggcacatcactca

SEQ ID NO: 4725 - DNA, 248 bp, Zea mays
  Clone ID: LIB143-043-Q1-E1-F6
tagtgagtcgtattaagggagggagggaaatgggccacgaggctgcggcgccggggtcgtcggtgctcggccgcgcggtggaggaggtgcgctcggccctcaacgagcacgccgacgtggttgccgacctcttcggtggcgtctcctccaaagtgcgcaccggcttcacacccgccgtcaactccttcgttggcttcttccacaccgtcaactggaacgagccttggctgatcagcatagtatctttc

SEQ ID NO: 4726 - DNA, 64 bp, Zea mays
  Clone ID: LIB143-043-Q1-E1-G11
aaatgggcgggttgttggtcagaacgcgactggcgttctagcagaagggttcatcctcggcatc

SEQ ID NO: 4727 - DNA, 298 bp, Zea mays
  Clone ID: LIB143-043-Q1-E1-G4
cttcccaataatgagtcgtattaattccccggcgtcgcgcccaatgacttctacatgaaagatccacttcctgtgagagtctccaagctgatctcactcattatacatcttccctagtcctactattctctctcattctgcaagcggcggaacatctttgacagtgcacatcatctcggtgaatttcttccttgacatcgcattcacaattctccctatacgtttgtaatgatggagcctcacatttgtccagtcgtctgcagcatatctgttggggagatactacagatcttctcac

SEQ ID NO: 4728 - DNA, 371 bp, Zea mays
  Clone ID: LIB143-043-Q1-E1-H10
ccctatagtgaggtcgtattatacatagcagacgagcataacatggtcagcgagaacggccacacgggaagggacaatgtcatcgtggtttccattgacactctcagcatggacgttcctctacttctcgtcctcggacaatattatctgaacgtctgcgacgtcgcggactagatcatccctgacgacagtcgcattctcctgaaggcctggtcgctccgccaccagagctgctactgggagctccaaaacgagttcgtcccggagaggttcctcagcgggaatatagccggcggcatcgagctcaagactaagcagttccaattcctgtctttcagatcttccctgatgatcttcctcggcgtcaaatc

SEQ ID NO: 4729 - DNA, 409 bp, Zea mays
  Clone ID: LIB143-044-Q1-E1-A12
gtgagtcgtattacacgccgcctagaggcctcgccctcccccctccggcgaaaaccgattctctccggcgtttcctggtcccttagtgcaagcaaggacaccgctcctctagcgagctccgttctgaagcggcaagaaagatgattaatcttttcaaaataaagggtcaaaagaaagaggaggcagcaagtgctgctggaaaggcccctgttaagaaacagtctgctggggagctccgtcttcataaagatattagtgagctcaacctgccgaagaccacgtcaatttcgtttcccaatggcaaggatgatctgatgaattttgagaccaccatccgacctgatgaaggatattacatgggaggcactttcgttttcacctttcaagtgtccccatcttatcctcatga

SEQ ID NO: 4730 - DNA, 379 bp, Zea mays
  Clone ID: LIB143-044-Q1-E1-A4
accctatagagagtcgtataaggaaactgatgcaaaggttgagccatcgacgacgaaaattaagaaaacttctgttccgatccatgagttggtctacggcgcattgtctgccagtgacctgcataaagctgtagataaacagtatgagatggctctgcaggatagagtaatggaagagaccaaggaaaagaagaatgctgtggaatcttatgtctatgacatgcgtaacaagctgtacgacaagtataacgattttgtcacacccgaggagaaggaagggttgactgcgaagcttcaagaggttaaacattggctgtatgaagatggtgaggatgacacaaagggagtatatagttctaaactggaagagcttagaaag

SEQ ID NO: 4731 - DNA, 384 bp, Zea mays
  Clone ID: LIB143-044-Q1-E1-B12
cgtcaggattcaaatctgccggaaacctgtatcttcatccagtatcaaggggaagttctgttgttgtgtgttcggtgatggatacatccaacagcaagcaaggaccataacatctccttgttcttgtccatggtatcatggctaaccccaaagactggacatatggggaagcagtgctgaagatgcggttgggtgatgattttttcatatatggtaaagcatgctagcatttgaactcttcattcactatgttcaatactagtcattatctaaccatttgttctagcttccacagtgccggtttatgaactaaatggattttaaaataagtgtatgcaatcatcgttgtccacagctagttcaacgaacagctacaccaaaacc

SEQ ID NO: 4732 - DNA, 356 bp, Zea mays
  Clone ID: LIB143-044-Q1-E1-B7
acaacacccaatagtgagtcgtattaaaagacggagctgagcttcaagcaacgtagagtgtatccgccatgagtcctttcggggcggtgatcacgccagaaagcctcaagtacatgtcgaagtaccagggacgtgagatcacgcaggtggactgcgcacgggaggcgatgaggctgatccacgcggaagacaagaacctcaaggcagaggactcagcgtgggagctgaagaataagttcggcaacggcgtgagcagcagggtcctcgtctacaacgccacgggggccagcctgaacctggtggacgacgggataagaggggatgggcgccgtctacaacgcgccgaattccggaca

SEQ ID NO: 4733 - DNA, 381 bp, Zea mays
  Clone ID: LIB143-044-Q1-E1-B9
attaaaacaccctaaagtgagtcgtattaacgggggctcgccctgttccttacggtgggggtgcgagcttggctggtacagcgcgctatgcaagttgcaacacccaccttggaatagaacaaagccgcagagatgatttggtatctctacgctatgtgcttttgtattttctccgaggaagccttccttggcagggacgaaaagccgcaacaaaggcacagaagtatgacaagatatgtgagaaaaagatatcgactcctatcgaggtcttatgcaaatcctgtccggtccagttttcatcttacttccattattgccagtcaatggcatttgatgagcgacctgacgatgcatttgtgaaacgacgtttccgtgacctgt

SEQ ID NO: 4734 - DNA, 148 bp, Zea mays
  unsure at all n locations
  Clone ID: LIB143-044-Q1-E1-D11
agtgnctncnncggcatgcttcctgtctcactcttgcctgccactgcgttctgtttgttgcgctccgtggggctggggtcggctgggtggctcgggcggcgcggcggggtgttcgggggcttggcggtggtgctctgggaggcctgcg

SEQ ID NO: 4735 - DNA, 108 bp, Zea mays
  Clone ID: LIB143-044-Q1-E1-D12
tacggggcgcgtcggggtcggggggctcgccgcggggcggggggggcggggccatggttgccagccccgtgcgtgtggggcatccggggttttttggtgtcgtcctca

SEQ ID NO: 4736 - DNA, 383 bp, Zea mays
  Clone ID: LIB143-044-Q1-E1-D8
atagtgagtcgtattataacatcatacacaccacagaccaaaacgaccgccgcaccttcaacagcaaagcgtccaagcggcggcatggcagcgagcaaggcgtgtgtggcgctgttcctggcggcgctcgcggtggcgagcgtgctggcgctggccccggccgaagccgcgacgacgtgcgcgccgacgcagctgaccccgtgcgcgcccgccatcgtcgggaacgcggcgcccaccgcggcgtgctgcgccaggctcaaggcgcatccggcgagatgcatctgccagtacaagatgaatcccagcatggaccgttacgttagacctcccaacggcacaagggtcttcgtcgcatggaaggtgtccctgctcaggtgctgatg

SEQ ID NO: 4737 - DNA, 407 bp, Zea mays
  Clone ID: LIB143-044-Q1-E1-D9
tcgtaggtcgatacaacactctaaagtgagtcgtattattcttcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactgagccggtcaggcgatggcgcacgagagtcgagaggacgacgacgagtcgtataaatataatagcggcg

SEQ ID NO: 4738 - DNA, 393 bp, Zea mays
  Clone ID: LIB143-044-Q1-E1-G12
tatagtgagtcgtattagtcgtattagaacagatcccaagtgctgccggcgagccagccggcctccagcttgtagcgaccgttcgtgacgtcgatgggtgacttcgtgggccacgtgctgccgggcacgctgctgctggcggtgggcctgtggcgggtgtgggcgtcagtggcgcgcttcgcggccgacccggcggcgttccgcgtccgcgcctggaaccccgtcccggcggcggggccgcggctgctggagctgcacgtggtggccggcggcgcgttcctggacatgtgcgtggagctctactacgccaacccgctccgcgtcctcaccggcggcggggtcgacccgggccacctcggggtggctcgagcaagccgagcatgctcctcatgt

SEQ ID NO: 4739 - DNA, 156 bp, Zea mays
  Clone ID: LIB143-044-Q1-E1-G3
ttactacaccctatagtaagtcgtattaaaagagcccagctttgctcgggtggcctttcgggctcactgatggtcgagttcctgtccgatggagagttccacgagggcaaggtggcagggaggccggtggcggtccgtgcccaggtcgaggagagc

SEQ ID NO: 4740 - DNA, 346 bp, Zea mays
  Clone ID: LIB143-044-Q1-E1-H10
cctgcgtcctgcctcggtgcctaccagagtcccagacccaggcggccaggctcccagcctcccaggtccccggtggcggcagcaggctcccagtcccagatggccaccagttctaaaccctagccgccaaaccaacacgagcagctgtcgccctccaggccggtcgagcggggcgccgggcaccgtcgcgccgagctgagcggagagtggagcacctgcaccgagcggccagcggtgcgccgtgcgccgagcacctgagtggccagcggggcgccgagcactcgtctagtcgtcttctctgatcctgggcgtgcctgccaatgaacaagaagaggaagcatctgga

SEQ ID NO: 4741 - DNA, 393 bp, Zea mays
  Clone ID: LIB143-044-Q1-E1-H12
agtgctactccgccgcgccgcggcgctcctcgtcgtcgctgctgtctgcgcggacggcgcctccacgttctactcctccgaccccaacctcggatccgcgcgcgtcgtcttccagacgaattttggtgatattgagtttggtttctttcctcatgttgcacctaagactgtcgagcacattttcaaacttgtgcggcttggatgctacaacacaaatcacttcttccgggttgacaagggtttcgttgcacaagttgctgatgttatgtcaggtcgaaccgcccctatgaatgaggagcagaaaaaagaagcggagaaaacaattgttggtgaatttagtagtgtcaagcatgtcaggggaatcctctccatgggaagggactctgattcaga

SEQ ID NO: 4742 - DNA, 407 bp, Zea mays
  Clone ID: LIB143-044-Q1-E1-H6
tacaacaccctagagtgagtcgtattattcagcaccaccgccgcctttcattttttccttcgcatcttgagagagagagagagagagagcggaggaggagagcaaggagatgggcggcttcgaccagcaggtgaaggagcggaccaaggagctgaagcacctcaagaccgcggcgatgaagggcatcaaggcggccggcgagtcgtgcaagaaggcgtggagcaaggtcaggagcagcatcaagcgctaaaaggccctaggcgttgttgctctgctgctgcgtggttttctgagttgtggactgtggtagatttgcgcttgtggtttctgtttgttggatctacttagttattttggagatacatcatgtgtgaagatctgcatgtgtgtgttccaagtgttttttg

SEQ ID NO: 4743 - DNA, 116 bp, Zea mays
  Clone ID: LIB143-045-Q1-E1-A10
acgcgtgggcgcaaagcaggccgacctgtacacgatgctgaacaagcagagctccagagggcagaatggcagtggcattacagatggcaaatcgcacggacgagccaaagtacggg

SEQ ID NO: 4744 - DNA, 73 bp, Zea mays
  Clone ID: LIB143-045-Q1-E1-A4
ccacgcgtccacagaaactcggagtaaaaaaacaaaagataaaaaaacaagaaagggcggccgctctagagga

SEQ ID NO: 4745 - DNA, 134 bp, Zea mays
  Clone ID: LIB143-045-Q1-E1-A7
tagtgagtcgtattaaacggcggcggcggcgaccatggggctggggggcggcggccgggtccgcgggcggcgcagggggagcaagggcggggatgccttggcgtgggccgtgaagccgccggccagcgcgcggt

SEQ ID NO: 4746 - DNA, 350 bp, Zea mays
  Clone ID: LIB143-045-Q1-E1-A9
gtgagtcgtcatattttgtatgtcaaactggagttttggttcgcgctggccatcaggccttttctgctagccatataggggctctggattctggatactggtgcgtttgcaccgaggtcacactctgatgtttgtctaatcaattgactaggtgatttaccaccttttgccggtttcatgatgtcattttccttcagccataaaaaaaaaaaaaaaaaaaaaaaaaaaaaaaaaaaaaaaaaaagaaaaaagaacaaaaaaatagaaaaaaaaaaagaaaatgaataaaaagaaaaaaaacactaaagagtgatacagaaaataaaaaaagggggggcccctttaaaggt

SEQ ID NO: 4747 - DNA, 373 bp, Zea mays
  Clone ID: LIB143-045-Q1-E1-B11
ccctaaagtaagtcgtattatcatcgcacagcaatcgaagaaacagcatcagcacaagaagcagcaacagcatacgcagcagcatcagaatcaacagcacttgcagaaacagccagaagattatactcaagctctgattgcactggaaacagaacttaataataaattgtctatacatggtcagaggccatcttcatctttggcataggtatgaaagcaattgaaggataaatcattaaagcaagcacggctgactgaagaacaattgcaagatcatattgagcacacaaatgtcgcacggaagaataagcagtttgagatatctgatggaatcatgaagaaccttgctagcaaaggcatcaccctgatggac

SEQ ID NO: 4748 - DNA, 257 bp, Zea mays
  Clone ID: LIB143-045-Q1-E1-B7
atcgtcagtcggtggcagtttacaagaataatactcaaggaacagtcgcttctgaggttgggacgttgacgagatcgaagaaggtgcgagttgtggaggaacaagatttcggggagggggaggcatgcccgtggatagttggagcgcttgtactcgtgcagctcagtggaattcatgtgactgggcccatcgtgagggagctcggtggaagagctagtctcacagttggtgctgtttcggctagtgatgtgaccggg

SEQ ID NO: 4749 - DNA, 330 bp, Zea mays
  Clone ID: LIB143-045-Q1-E1-B8
tggtccgtgagctgagggaaaatacacaggagcttaagctatttgtggagttgtacaagcatgagtccactgattccagacagctgatggaatcgagagatagggaactcgctgaatgggctcgagttcacattctcaaatattctcttagtgaaagtaaattagagcaacgtgtaatttcagccaatgaagctgaagcagtctctcagcagaggttggcaactgctgaagctgagattgctgaattatggcagaagctagaaacttctaggagagatctagtgaaacaatctgatatactgaagtctaaacatgaaggaatgttaagcg

SEQ ID NO: 4750 - DNA, 287 bp, Zea mays
  Clone ID: LIB143-045-Q1-E1-C11
tatagtgagtcgtattatacgatgcggcggtgcgggaggggattccacgatgccgggggccaacagcgtgggggaggctcctgatccagtccctcggtaatgcgtacgctgctggcaggaggcgagcgcgggattattgagctctaggtgggttttgcggttgccactggccttacgcatgttgcttagatgggattggctgggtcgtttcgcttcaactccttcctctcaggagttctttcaggcagaggaactgcagttcttgcggtttgcctcggcattcgagt

SEQ ID NO: 4751 - DNA, 285 bp, Zea mays
  unsure at all n locations
  Clone ID: LIB143-045-Q1-E1-C8
cctatagtgagtcgtattaantgtgctccttagggcgtctcgcggaccgggccggtggcgtgcgcgggcacgagattcaccgttcgcgcttttaagctatccctcggtcctgcagcggtagcataggactttgggggtggggaagccgatcagtgatctatttagcactagcaggtatggctgaatgtttgctgccatctacacatttgcatggaacacgaacaggtactagaaggcttggctacacagatcctggcagggttgcaggcctagctggagcagggt

SEQ ID NO: 4752 - DNA, 91 bp, Zea mays
  Clone ID: LIB143-045-Q1-E1-D6
tagtgagtcgtattatccggtcgggagcttcgagagatttccatcaggtttagcgtcacgcgggtatagtgatgcgggtggggtctgtgta

SEQ ID NO: 4753 - DNA, 413 bp, Zea mays
  Clone ID: LIB143-045-Q1-E1-D7
acaacaccctatactgagtcgtattaaagtacctataatggatccctcaaaagcatcaaaaaggcctgttggaattctacttgtgaaggttgtgagagcccaaaatctgcggaagaaggatctgctgggtaaatctgacccatacgtgaaacttaagatgtcagatgataaacttccatccaagaagacaactgtaaagcgcagcaatctcaatccagagtggggtgaagacttcaagtttgttgtgacagatccagaaaaccaggctcttgaagttaatgtcttcgactgggaacaggttgggaaacatgaaaagatgggaatgaacatgatcccacttagagaactcctaccagaagggaacaaagtttacaaccttcaacttgcttaagaccatggacccaaacgatgta

SEQ ID NO: 4754 - DNA, 335 bp, Zea mays
  Clone ID: LIB143-045-Q1-E1-E2
gggccgacccacgcgtccactcaaatggaaggccaagtacgggatcgaagagatgtgcatagatctgtggaactgggcgagcaagaacccgtacgggtacgctgggtcacgcgacaacagcaaatgaaccacccatccatgcatcccatcctgcagtaggagcaagcagcagccttatagcctatgctaccataattagtaactcatcaatcatgcatacataatcagccagtcatctgattatgggtactgcgatgggcctcgcttcttcagtgtatagagggaggaggaggggggtcatcatgatattcatttttttatcattcccgaatgat

SEQ ID NO: 4755 - DNA, 211 bp, Zea mays
  Clone ID: LIB143-045-Q1-E1-E6
tagtgagtcgtattaagcgatcgacgagatgtgcagcgatctgtggaactgggcgagcaagaacccgtacgggtacgctgggtcacgcgacaacaccaaatgaaccacccatccatgcatcgcatcctgcagtaggggcaagcatcagccttataccctatgctactatgtttattctctcatcattcaggcagatatcctcatctaatca

SEQ ID NO: 4756 - DNA, 422 bp, Zea mays
  Clone ID: LIB143-045-Q1-E1-F3
gggccgacccacgcgtccacagcaatggagtccaccaagctctccgcgctgctggtgctcgccatgctcgcgctctcctcgtccccgctcgctctcgcgtgggagaaggcggaaccggagtgccactcgtgcgagtccggctcgccaccctcgaccggcggcgtccccctgcctcccgtcagcataccgtcagtcccgctgccccctgtcagcataccgtcggtccccctgccccctgtcagcataccgtcagtgcccctgccgccggtgaccctccctcccattccgatcgttgggggaagcccgagcccgacgaagaagggacaccggaaggcgtgcccaccgcctccgtctcccccgacgccgacaaccaagcccaaagcggtcttcggacaagtgccccatcgacgcgctcaagctcg

SEQ ID NO: 4757 - DNA, 200 bp, Zea mays
  Clone ID: LIB143-045-Q1-E1-F5
agtgagtcgtattaccggtcgtctctgccgcggcggccctttctccgcctccccctccgctggcgccgccgccgggcagccgttctcgccgctcaccgcctcttcgtcatctctttcatcctccccttcttatgggggctccacctccgtcagcatcgacggtgacctgctcccaccatctcatgatatccggctactcc

SEQ ID NO: 4758 - DNA, 298 bp, Zea mays
  Clone ID: LIB143-045-Q1-E1-F8
aactgcacttggatctcagatcggtgatcacagatacaatggtaaacgctgttgctgtgcttggtagcagcgatggtgtcaagggcagcagcgtcttcagccaagagggatatggccctgcgactgtcaccggaagtgtctctggcctcaagcctggcctccatgggttccatgtgcatgcacttggtgacaccaccaatggctgcatgtcaactggaccacactacaatcctgcgagcacggaacatggagcaccagaagatgagaaccgccatgccggtgatcttgggaatgtgag

SEQ ID NO: 4759 - DNA, 257 bp, Zea mays
  Clone ID: LIB143-045-Q1-E1-G3
tccctatagagagtcgtattaactgcgcaggattgagcatcgtgcatgtgtaaggaactctggggagctttcgactcattacctacttcatcacacgggttgaagattcgagatcagctgcttatgtccagcgaatattgcttgaggatgggaatcatacagcagcgttaagggaaagatcggactgccgactaagtagtactgtcagtggagaagttttgttggttcccggacaggaacgagctcctcctggaaca

SEQ ID NO: 4760 - DNA, 304 bp, Zea mays
  unsure at all n locations
  Clone ID: LIB143-045-Q1-E1-G6
attgcagttggntctcagatcggtgatcacataaacaatggtgaaggctgttgctgtgcttggtagcagcgatggtgtcaagggcaccatcttcttcacccaagagggatatggccctaggactgtcaccggaagtgtctctggcctcaagcctggcctccatgggttccatgtgcatgcacttggtgacaccaccaatggctgcatgtcaactggaccacactacaatcctgcgagcaaggaacatggagcaccagaagatgagaaccgccatgccggtgatcttggaaatgtgacagctgga

SEQ ID NO: 4761 - DNA, 339 bp, Zea mays
  Clone ID: LIB143-045-Q1-E1-H1
acaccctatagagagtcgtattacatctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcacaaaccgtccctgcaaggttgtggaggtttctacctccaggactggcaaccatggccacgccaaatgccactttgtcgccatagacatattcaatgggaaaacgcttgacgatattgttccttcatcacacagctgtgacattccgccagtgaa

SEQ ID NO: 4762 - DNA, 352 bp, Zea mays
  Clone ID: LIB143-045-Q1-E1-H10
acaccctatagtgagtcgtcataccggctgagcaggacatggtcaccgaggacagcctccccggaaggaacaatctcatcgtggttttcattgacactctcagcatggacgttcctctaccttctcctcctcggacaatattatctgaacgtctgcgacgtcccggactagatcatccctgacgacagtcgcattctcctgaaggcctggtcgctacgccaccagagctgctactggaagctcaaaaacgagttcgtcccggagaggttcctcaccgggagatatagccggcggcatcgagctcaagactaagcagttccaattccggtctttcatatcttccctgatgatc

SEQ ID NO: 4763 - DNA, 397 bp, Zea mays
  Clone ID: LIB143-045-Q1-E1-H11
caactccctaaagtgagtcgtattaaacccaaacggagagagacaatcgagagagatggcaaactgttttggtgacgtcgtggacaattacaagctagacacaatgccaagatatatcggcaaaaagaagactcgagaagaccgggcacgagaggcctcctatctcagtaatgagaatgagaagtacaagaaagctaaagactatgtgaacatgctgaaggactggtacggcaatggagcgtcgacgctgtgcgtgatctacaaccagacgggcggaaccctgcggtacgtcgacgacaaggactggctgggctacccggggccgacgccctacccgacggagatcggcaacgggcagtgggcgtccttcctccacgtccacaagaccggcgcctcg

SEQ ID NO: 4764 - DNA, 368 bp, Zea mays
  Clone ID: LIB143-045-Q1-E1-H12
cagaaagaatgccaaaaccaccagttactgagcttttcactgatgtttacgacaagatcccttccaacctgcatgaacaagagcaattgctgcgggatacaatcatgaggcaccctgcagactacccaactgatgtacctgttggggtcgtgcttcggtatgccgaaggtctcacacgaagaagcagcttcggccaaagtcgtttctaagagatggccgaaggtcccttttcatggagcttcggcgttttaaaccgacatagaggcagaatgacctttttatacatgtatgtccgagtcaatgttgtaaacttccgcaaggggcataattgtaatttgtcacaggctgcgacctgtgtccataaatag

SEQ ID NO: 4765 - DNA, 347 bp, Zea mays
  Clone ID: LIB143-045-Q1-E1-H3
attacaacaccctatactgagtcgtattaaaaagtccattttcagactgagctagttcagctgtcattttttttttcagccaaaggtcgcgttcttttggacctgctcttgattcgttcgttcgttcgtttggattgattgattgattgattcctttcgacttcccttcaccacccccctgctccgtcaagcgtgcctctgttcttctgccattgctggatcgcgtttgtctgtttgttgggttgctggcgctgcggccatggatcccttccacggcattgtgaaggaggagttcgacttggacttcgacttcacctgcgcgtctgcggcggcggcggcggcggcct

SEQ ID NO: 4766 - DNA, 293 bp, Zea mays
  Clone ID: LIB143-045-Q1-E1-H4
actctctcgacctcatcggcgttggcggagcgcgtgttgaccggagatggcgccgagcgggtggaggaggagcgcggcggcgcgggtcgcctggcgcccggccacggtttgcctgtggctcgcgctcgccgccgccgcactgacgctcgcccaggctaagaaggacctgacggaggttacccacaaggtctacttcgacatcgagatcgacggcaagcccgcaggccggattgtcatggggctttttgggaagactgttcctaagacggcagagaacttccgagctctttgca

SEQ ID NO: 4767 - DNA, 325 bp, Zea mays
  Clone ID: LIB143-045-Q1-E1-H5
cgccgctcgtccctcgccccatcgcgatggcccggatcaaggagcacgagctgcgggggaagagcaaggcggatctgcaagcgcagcttaaggagtttaagtcggagctctccctgctacgcgtagccaaggtcaccggcggggctcccaacaagctctccaagatcaaggttgtgcgcacctccatcgcgcgcgtgctgaccgtcatctcgcagaagcagaagtcggcgctgcgtgaggcgtacaagaacaagaagctgctcccgctcgacctccgccccaagaagacccgcgccatccgcaagcgcctcaacaagcaccagct

SEQ ID NO: 4768 - DNA, 419 bp, Zea mays
  Clone ID: LIB143-045-Q1-E1-H8
tacaacaccctagactgagtcgtattacgtgtccgcgtccagtgtgtccgctactccgctccccctcagtcctcagttcctcacctagcggtagcgtgcgcgcgggagacgtagatggcggcttcggaggcggcagcggcggcggcaacaccggtgacgccgacagaggggacggtgatcgcgatccacagcctggaggagtggagcatccagatcgaggaggccaacagcgccaagaagctggtggtgattgacttcactgcaacatggtgtcctccgtgccgcgccatggctccaatttttgctgatatggccaagaagtccccaaatgttgttttcctgaaagttgatgtgggtgaaatggaagcccattcgggagcaattcagcctaaaggccatgccaacattcgtgttcatga

SEQ ID NO: 4769 - DNA, 366 bp, Zea mays
  Clone ID: LIB143-045-Q1-E1-H9
cctcggcgtcgctgcgctgtccgtgttctcctggatgtacaagtacctgacgggcaagcacccgccgggcgccgaccagctggaccacgccaaggcgaggctggcgtccaaggcccgcgacatcaaggatgcagcacagcaccgcatcgaccaggcgcaggggtcttgagagaagaaccacactcgagcggaccgcgcgcgcgacctccttgaaccactgccggcgcggcggcatatggcccttaaaggcggtggctgctgctacgtacgctgccgtagagtctcggtcgccgcgatagctctagctagtcgtttatgtgttgtgctttgtgtgtgcatgcttgtgtctgggggcatgcactgcag

SEQ ID NO: 4770 - DNA, 359 bp, Zea mays
  Clone ID: LIB143-046-Q1-E1-A12
acacctatagtgagtcgtattaaactacggcctgcaatggtgttcttcgcgttgaaatgaacagtggtgcctatggatgttaggtcactgcgggatcgacagccacggctcatagacctacatccacgaagttcaaagatggcatcacgatctcaactggacagcgattgtatcagtacatccactcagccgtgtgacaagtcctcatcagacagggtgttctggggaccaaggtcaagatcatgcttgactgagacccgaagcggcacgttgcgcctatcaaccctcatcccgacctggtgaccatccataatccgagacgatgatgacaagcatctctctccgtgtcttggcaactg

SEQ ID NO: 4771 - DNA, 438 bp, Zea mays
  Clone ID: LIB143-046-Q1-E1-A2
acaacaccctacagtgagtcgtattaacccggccgtgaccttcggcgccttcgtgggcggcaacatcaccctgttccgagggctcctgtactgggtggcgcagctgctggggtccaccgtggcgtgcttcctgctccgcttctcgacgggcgggcaggccacgggcaccttcgggctgacgggcgtgtcggtgtgggaggcgctggtgctggagatcgtgatgaccttcgggctggtgtacacggtgtacgcgacggcggtggacccgaagaagggcagcctgggcaccatcgcccccattgccatcggcttcatcgtgggggccaacatcctggtgggcggcgccttcgacggcgcgtccatgaaccccgccgtgtccttcggccccgccctcgtcagctgggagtggggctaacattggggtgtacgggtcggccc

SEQ ID NO: 4772 - DNA, 408 bp, Zea mays
  Clone ID: LIB143-046-Q1-E1-B11
caacaccctatagtgagtcgtatacgactcgtcagacgtcagccagcagttcgaaaccaaggattgatccaggagcttccggaaggcgaggcgcgcgcgcagcgtcgaggtgctggtgccggtgccgcccatggatcgggctcgcggatccgcgttcctgctcggcgtcctgctcgcaggatccttgttcgcgttttcagttgccaaagaggagaccaagaagctcgggaccgtgatcggtatcgatctcggtaccacctactcctgtgtcggtgtgtacaagaacggtcatgtcgagatcatcgccaatgaccagggtaaccgtatcacaccctcatgggttgccttcaccgatagcgagaggctcatcggtgaggctgccaagaaccaggcaaccgtcaaaccctg

SEQ ID NO: 4773 - DNA, 405 bp, Zea mays
  Clone ID: LIB143-046-Q1-E1-B6
ctcgtaggacgatacaagcctctacagtgagtcgtattaccctttcagttcgccatcggcagccgagcatcatgagctccacaggcggcgacgatggcgccaagaagtcttggccggaagtggtctggctcagcctggaagaaaccaagatggtgatcctgtgcgacaagcccgactccgacatcgtcgtgctgcccgtcggcatgccggtgaccatggatttccgccccaaccgcgttcgcatcttcgtcgacaccgtcgcggaggcaccccatatcggctgagaatcaaatctataaaatgaataactcggacatgtcatgcgtgcatgtccgtctccgaataatggatgtgtgtgcttcgttccaataaattgctagtaaaaataatggcatcgtcggtatg

SEQ ID NO: 4774 - DNA, 225 bp, Zea mays
  Clone ID: LIB143-046-Q1-E1-B7
tactcgcactacacgcccgacacgagacaatcaggaccacccctcggcgcaacaacggcacaagaagatcatacgccgcaggcgactggcacatcctgaagaagaccccggtggctaatctcgtgcagctgcacaagtcccagcacctggtcctactgatacggatgccggtgagtatggatttccggttgatgatcgtacgcagtgtccttcatgcgttgcgga

SEQ ID NO: 4775 - DNA, 406 bp, Zea mays
  Clone ID: LIB143-046-Q1-E1-C11
aacatcctatagtgagtcgtattaaacccatcgattcaaacatccattctataataaccaatgggctccaaaggtccggtcctcctccgcatcccggcggtaaccaacttcggccgcgttgctcaccgccgcggcggagcaaacccatgagaacaacaagaaaatggtggcgaggagcaaggacgccgcggccggcgtgataaaccagcaggaacggcgcggcggcggatcagacgagtactgccacgcctgcgagtacggctgctgccaccacgtattccatggaggatgccagaagtgctgcacgccgctaaccggcgctgcatgtggccgaccgcaggaggttaagaactagtatacgtctacacccgccggacggccgctgccatgcatgcatgacgccggg

SEQ ID NO: 4776 - DNA, 186 bp, Zea mays
  Clone ID: LIB143-046-Q1-E1-C7
tacgcgcgcgatacgcccgaggcgaagcagtcagcctgagccttccgctgatgagcatcggaacaagacagcacgcctccggcgagtaaccagttttgactgacgatgccggtacgttaactccggcggctcagtaggtgcctgcaacaggtcgtagctgacagctgatccgcatcggtgtgccca

SEQ ID NO: 4777 - DNA, 114 bp, Zea mays
  Clone ID: LIB143-046-Q1-E1-C8
aacttcgcgaagcagtcatacacgagactgactgctgtttgttgagacgcatagagctagctggaaacgtccagactgtcgctcgtgaggctcagtggcgtgtgcgaccccttc

SEQ ID NO: 4778 - DNA, 318 bp, Zea mays
  Clone ID: LIB143-046-Q1-E1-D6
gtcgttacaagcctctatagtgagtcgtactaccgctgctcatctcacatccctcgagaagacgcctgctcctcgccgatcgatacgatggccgtcttctccgacctccacaccgccgacaggctcaagtccctcgaggctcacctcgccggcaaaacctatgtgtccggtgactccattactaaggatgacattaacgtcttcgacgcggtgccgtcgaagcctggcgctgagtttcctaatgccgcccgctggtacgaaaacgtctcaggggctgttgcctcaagattccctggtaaggctcttggtgtaaatctc

SEQ ID NO: 4779 - DNA, 376 bp, Zea mays
  Clone ID: LIB143-046-Q1-E1-E11
gtgagtcgtattaaaagatagatgcccacagtgcaacggtgataaagttgtgcacgagaagaaggttcttgaagtgtttgtggagaaaggcatgcacaatgggcagaagatcacattccctggtgaagctgatgaagcgcctgacactgtcactggagatatcatttttgttctccagcagaaggagcatcccaagttcaagagaaagggcgatgacctcttctacgagcacaccctgaccttgactgaatctctgtgtggcttccagtttgttgtgactcacttggataacacgcagctgctgatcaaatcaaatccgggccaagttgtgaagcctgattctttcaaggcgatcaacgaccaaagcatgcccatg

SEQ ID NO: 4780 - DNA, 210 bp, Zea mays
  Clone ID: LIB143-046-Q1-E1-E5
caacgagccaccgtttaattcctagggttcttggagtgtttttttttttctctctcgtcgtcgagtcaaaaaaagaaaaaagaaaagaaatggtcaaaacgcgcggacagtgagtttggacgtctgtgtatttcggtgacctgtgttttttttttttctctggagggcttttggtccgcatgtaatttagccgggtttgtgacttgtgac

SEQ ID NO: 4781 - DNA, 375 bp, Zea mays
  Clone ID: LIB143-046-Q1-E1-G11
agtgagtcgtattaaaaagtgcggcagcctggaggtccttccctctcgcgcgatgggccaggctgttgttgctcaaggttggcatgtcctgttagggctgtgttggacgctgtcaaacgggtcctgtgcaagatggaacgcgtccagtcctaggacgtagacatcatgggacagaaggtcaccgtgaaaggcaatgtgacacctgacgccgtcctgcaaactgtttccaagactggcacgaaaacttcggtctgggaggctgaggccgtgacaaatgaatcccgccacacctgccggcgccatcgcctgacacgttctaatatctggaagtgcccagcaaaaaaatgttaatgtggttagcctgggatctgttaa

SEQ ID NO: 4782 - DNA, 328 bp, Zea mays
  Clone ID: LIB143-046-Q1-E1-G7
cctatagtgagtcgtattcaagtgttgtcgcgattggcaagctcggcggctcgtggcagcgggaacgtacgaggcgaaggagagcgagggcgaccgcgcggatcgcatcgcagctctgggcggagatgctggcggtgttcgatcgggcggtggcgccgagcccggaggggctgcggcagccgggcgccgctgggggcggcagcgcggcgggcctcgcggaccggttcagagaggcgcggcccgacgcggtcaccgtcaaccttggcgggtccggcgccctggcgttctcctcgagcaaccagaaccccctcctccccaggttgtttgg

SEQ ID NO: 4783 - DNA, 304 bp, Zea mays
  Clone ID: LIB143-046-Q1-E1-G8
actcactaggaggacgcgtatgaccttactacaccctaaagtgagtcgtattaatggctgctgctcacgtcacgcaggggacacctcgatgccgcgccatggatgacgccgacctcacgcggggccgacatgccatggtctcctcccacgactgtagtgcaagggcccacgaggccggtcgctggacaggtctccggtatccgcgcctgcgacatggccccgcaccggagcgcttgccgtagtcgactggacgaccgggaatcggcacgaggtcaaggtctccgatgacgggaccgtgcgcacc

SEQ ID NO: 4784 - DNA, 413 bp, Zea mays
  Clone ID: LIB143-046-Q1-E1-H11
agcgtgcctgcctctgcgcctgcccctcccaaacacaagacatgccggaagtgcaaggcgagctatgacccctcggccaacacgcgcctctcctgcaggttccacccttccttcttcgtctgccgccgccacgacgaccagaagaggtactacgagctccgcgacggcgatcctccctacgccgccaagttctacgactgctgcggcgccgaggaccccgacgctccgggctgcaccactgacttgcaccgttcctacgacgacgcccaagactagcaaacctttgctgcttccacaggcctcatcttaatctcaagtctcatctaccgtttcgcttttgcatcccctccttatcctctccagtcagctatcaaatttaaccaacctatgttacactttaattaaattttgct

SEQ ID NO: 4785 - DNA, 170 bp, Zea mays
  Clone ID: LIB143-046-Q1-E1-H4
atactgagtcgtattatgactcgtactaatcaggatctaatgtgcacagtttgtaacatgccatatgtgttctgttgaatcctgatgaccaccgactggtcgcttctcaggtagacggatcggcccggagatgtgctgagatcggggttgctgaggttcttggcaatgca

SEQ ID NO: 4786 - DNA, 379 bp, Zea mays
  Clone ID: LIB143-046-Q1-E1-H5
tacaatactctaaagtgagtcgtattatacgtgagctcgtgcgtgagtgccctggtcgacgaccgctcgcgcgccatggactcaacgacgacggcgccgctgctgcagccgtccgccgcctcgagcaaggaggggccggggccggcgccggctcagcacggtgagggcagccgggagctggaggcgatcctggccgacgcgtccaagccgtgggcttggcgggcctgggaaggcgcccgcctggagctgccgctgctgctgcgggtggcgctgccggcggtggccgtctacatgatcaacttcgtcatgtccatgtccacgcagatcttctgcggccagctcggcaacctcgagctcgccgcctcctcgctcggcaaca

SEQ ID NO: 4787 - DNA, 348 bp, Zea mays
  Clone ID: LIB143-046-Q1-E1-H6
atggctgctgctcccttctcccaccgaccaactcgatcccgcgccatggatcgcgccgaccccgcgcggggccgccttgccgtgctctcctcccacctccgtggtgcaggggccgaggaggcggcggggctggagaggtcgccggtatccgcgccggcgcccgggccccgcgccggcgcgcttgccgtggtggacgggaggaccgggaagcggcacgaggtcaaggtctccgaagacggcaccgtgcgcgccaccgacttcaagaagattaccactggaaaggacgacaagggtcttaagatttatgatcctggttaccttaacactgccccggttcgctcgtccatc

SEQ ID NO: 4788 - DNA, 253 bp, Zea mays
  Clone ID: LIB143-047-Q1-E1-A1
acaacacctatagtgagtcgtattatcagcgacgaccggaactgtgtgaaggagtccagaggtacggcaagagtgacaacagtcgctgtcgcagatctgaaaggcagcatgggtgatgcagtagtttgtgtgcaacgtgatcctgaccagaggcttgctcgacgacctgttttaggcagcactccagaccaagtaattgcacccaaaggtgtgaagccaacattatcagcagatctcaatacacttgccttag

SEQ ID NO: 4789 - DNA, 391 bp, Zea mays
  Clone ID: LIB143-047-Q1-E1-A12
acaagtctctatactgagtcgtattaagcgtccgcttcccgccgccgccacgcacatcaccgatcggcaccaccacctccaatagtttctcctcgccaacggcatctccgcggagagggtgcttgagctccagtatgtgagagcagtggcgccaacgaagcatgatgaaccttgcccccatgaagactgggttagtgctgtggatggatcaaacacatgttttatattatctggatgctatgatggtcttgcaagattatggaaagatgcatcagtatgcacacaaattttggacggacacaatgatgcaattacttctaccagattcatcaataagggatctgaaaccgagggcagtctgcatgtagtgactggctcataggatatgtca

SEQ ID NO: 4790 - DNA, 264 bp, Zea mays
  Clone ID: LIB143-047-Q1-E1-A5
tcatagtacattacgtcactctaaagtgagtcgtattatgcctgaccagagctagctgagtggactacggcatcagcaggtggtctgactgacatcccgaacgacatcaatgcatagggacccgtcgcgggcgaattcgcctaacggagactacaacggccgaccaacgggcctgcaactctgggccgaataacgcacacattaatcgccatatcgaacgaaaaatgcggacttcacaccatcgctacgcgtcctctacaccgc

SEQ ID NO: 4791 - DNA, 364 bp, Zea mays
  unsure at all n locations
  Clone ID: LIB143-047-Q1-E1-A6
ctcgtggtccgttacaaccctctacagtgagtcgtattacgatcggcgtgccgcgtgcgtgaggcgatcggagcatcccgtcccgaggaggaagacaaccggcgacgcggggggaacatggggaagacgccggtgcggataaaggcggtcgtgtacgcgctgtcgcccttccatcaaaacgtaatgccggggctgtggaacgacatcaccaccaagatccaccacatcgtcaccgacaactggatctccgccacgctcctcctcnaccccgtcgtcggcacctaccaatacgccatgtggtacaaggagcacgacaagctttcccacagatattagatgctctgcccttcagagaaaagcactt

SEQ ID NO: 4792 - DNA, 427 bp, Zea mays
  Clone ID: LIB143-047-Q1-E1-B12
cgtgggccgtcccaactctctatattgagtcgtattactcggcaaagaaaagaggcaacgacgatggctgctgcggcggcgatgatggtctccggaggacgggcggcgctggtggtggcgggcgtgctctgcgcggtggcggccatggcggcggcgcagcaggcgtcgaacgtgcgggcgacgtaccacctgtacaacccggcgcagaacgggtgggacctgaatcgcgtgagcgcgtactgcgccacgtgggacgccgacaagccgctgtcgtggcggcagaagcacggctggacggccttctgcgggcccgccgggcagaagggccaggccgcctgcggcaagtgcataagggtgaagaaccgtgcgacgggcgcgtccatcgtggcgaggattcgtggacagtgcagcaaccgcggcctggacc

SEQ ID NO: 4793 - DNA, 53 bp, Zea mays
  Clone ID: LIB143-047-Q1-E1-B6
tacaatacccagtagtgagtcgtattatccgtactctgctgcaaagcttccgg

SEQ ID NO: 4794 - DNA, 295 bp, Zea mays
  Clone ID: LIB143-047-Q1-E1-B7
tacaacacccagtagtgagtcgtattatcagtactcatctgcttcacctccgggctccggctacggcggcactcttctctggcaaccggaccacagaaacctctaggcgacgaatcgagcaggtagaggagtaatcaggcatccatggctgagcatcttgcgtccatctttggcactgacaaggaccgcgtgaactgccccttctacttcaagatcggcgcatgccgccacggcgaccggtgctcccgcctgcacaacaagccttccatctccccgacgctgctgctctgcaaca

SEQ ID NO: 4795 - DNA, 59 bp, Zea mays
  Clone ID: LIB143-047-Q1-E1-C3
agtgagtcgtaataaatggggggtggcgctccgtatgcagatctctaccattatgaact

SEQ ID NO: 4796 - DNA, 171 bp, Zea mays
  Clone ID: LIB143-047-Q1-E1-D12
ctgaggtcaacgattcagcgtaattaacacgctgctggagaatccctgttgttgtatgcactgtaattaacatggtatccgtgcggtgttctgtcttgtactgcgattgttgccaatggaataaggcatggtttcatgagaactctagattactacaagaagtcctgattc

SEQ ID NO: 4797 - DNA, 256 bp, Zea mays
  Clone ID: LIB143-047-Q1-E1-D8
tacaacaccctatactgagtcgtattactgaggtcaaggattcggcgtaattaacaggctgctggagaatccctgttgttgtatgcactgtaattaacatggtatccgtgcggtgttctgtcttgtactgcgactgttgccagtggaataaggcatggtttcatgagaactctagattaataaaagaagtcctgattctagaaaacacagtcaacgtcaaagacatcgaggaaacaataaacgttcatcctgaaca

SEQ ID NO: 4798 - DNA, 433 bp, Zea mays
  Clone ID: LIB143-047-Q1-E1-E10
aggtctaggaatcgcgggccgacccacgcgtccacgacaagtccgattaacagaactcttctgccttgcttttggatagtacaaccggcagtaatcctgtttgagtacggcatggtgagaacaaacgacgagacgagtccagtcaaaagtcagctttgtctcgcctgctccatcttttcgccgccggttacgtgcagtttcaagcacgttgatttgctgaccgggacctggaaaagataaatggaagaaacgaaaaaaagaaaatcttttgtatagtgaagtcagatttttgttgcagactgctgcagtagacctggaatgatgagatttgtcaattctgacggcaggtgttgcggcgagcgtggcggcggccaccggcgcgcttctgctgtgctggctgcagtgccggcggcgcaaggccgggcgctcggcg

SEQ ID NO: 4799 - DNA, 375 bp, Zea mays
  Clone ID: LIB143-047-Q1-E1-E11
caacacccaatagtgagtcgtattaatagagctcttctgccttgcttgtggacagtacaaccggcaataatcctgtatgagtacggcatggtgagaacaaacgacgagacgagtccagtgggaagtcagctttgtcgcgcctgctcgagcttttcgccggcggttacgtgcagtttcaagcacgtggatttgctgaccgggacctgtaaaagataaatggaagaagcgaaccacagaaaatcttttgtggagtgaactcagatttgtgttgcaaactgctggcagtacacctgcaatgaagagatttgtcaagtctgacggcaggtagttcggcgagcgtggcggccgcgagcggggcgcgtgctgcggtgcggg

SEQ ID NO: 4800 - DNA, 382 bp, Zea mays
  Clone ID: LIB143-047-Q1-E1-E12
atgacgccgacaggcaggagctggtcaactgggcgcaggcggtgggcggccccgccgcggcgttcgacttcaccaccaagggcgtgctgcaggcggccgtccagggcgagctgtggcgcatgaaggacggcaacggcaaggcgcccgggatgatcggctggctgccggagaaggccgtcacgttcgtcgacaaccacgacaccggctccacgcagaactcgtggccattcccctccgacaaggtcatgcagggctacgcctatatcctcacgcacccaggaactccatgcatcttctacgaccacgttttcgactggaacctgaagcaggagatcagcgcgctgtctgcggtgaaggcaagaaacggggatcacccggggga

SEQ ID NO: 4801 - DNA, 76 bp, Zea mays
  Clone ID: LIB143-047-Q1-E1-F12
tagtgagtcgtattaaacccggtgcgggtccgggttggtgccgttcgccggggttgcagcttcgtgggtgagcgga

SEQ ID NO: 4802 - DNA, 322 bp, Zea mays
  Clone ID: LIB143-047-Q1-E1-F7
acaacactctatagtgagtcgtattaccctaactccaaaaaccctcgctctcctctcatggccgccgccgcagctgacgacgcagccgaggtggagcggctttacgagctcggcgagcgcctctcctccgccaatgacaagtccgagcatgcggcggactacgaggcgattattgcagcggtgaagggacagagtgccaatgcgaagcagctcgcagcgcagcttatccccaggttcttccggagcttccctgcactcggcacgcgcgccatgtcagccatgttcgatctcgtcgatatggaggagctcgcgatcagaatac

SEQ ID NO: 4803 - DNA, 70 bp, Zea mays
  unsure at all n locations
  Clone ID: LIB143-047-Q1-E1-F8
agtgagtcgtattaaacnaagtccagcaaaactcgccctcctcacatggccgccgccgcggctgcagacg

SEQ ID NO: 4804 - DNA, 419 bp, Zea mays
  Clone ID: LIB143-047-Q1-E1-G11
ccaacactctatagtgagtcatattattttggagggcggcctttttgtcatcaatttagtctcgcggtcagcctcagtgagggaaacggttgtttcaagactgaaagcggtcttcgaacacctgtactcactgcaacttgaagaagacataaatgaggttctgtttgcatcaccgagcggaagattcctagaaatcaatgacattactgcaggagcctccaaactgcaggacttgctcaaaattccggttgatgtagaatcagatatacagaagttgcagaaactccagtaacaatctcacctgacgcggagcaccatccatttgcatccacttgatttaggtgctgttcagttctcaccccagcagggcacaccaaaatgtcctttggttttgctcttggaagccaaattgggaccag

SEQ ID NO: 4805 - DNA, 348 bp, Zea mays
  Clone ID: LIB143-047-Q1-E1-G12
atagagagtcgtattaatctggagggcggcctttttgtcatcaatttagtctcgcggtcagcctcattgagggaaacggttgtttcaagactgaaagcggtcttcgaagagctgtactcactgcaacttgaagaagagataggatgaggttctgtttgcatcaccgagcggaagattcctagaaatcaatgacattactgcaggagcctccaaactgcaggacttgctcaaaattccggttgatgtagaatcagatatacagaagttgcagaaactcgagtaacaatctcacctgactctgatcaccatccatttgcatccacttgatttaggtgctgttcagttctc

SEQ ID NO: 4806 - DNA, 86 bp, Zea mays
  Clone ID: LIB143-047-Q1-E1-G6
taagcatatagacagatgcgacctaatcttgccgtgggtgcaatgcatgcaaagatgacgaagctcggagccatcgttgttgctgc

SEQ ID NO: 4807 - DNA, 152 bp, Zea mays
  unsure at all n locations
  Clone ID: LIB143-047-Q1-E1-H10
caccctatagaaagtcgtattaaacngtngagagacgaactagatagatcgcaaactgttttggtaacgtcgtggacaattacaagctagccacaatgccacgatatatcggggggggggaagactcgacaagaccggggacgagggggggg

SEQ ID NO: 4808 - DNA, 260 bp, Zea mays
  Clone ID: LIB143-047-Q1-E1-H11
cctatagtgagtcgtattatagtgtctaccagaccatgcgtcctgaaagactcctgccggcgacagacttcggtgtgtggagacgcgaggatcttgagtcgaggaaggtcgcacgggaggcgcagtaacatgttcgagcccggcacgatggacctctgggacgcctgtcgacagcatgttgcgctccaacatcacgtcggcgacctcgatgaagtccgctactggcgccttcgggagacgccggcagctgctggaaggaa

SEQ ID NO: 4809 - DNA, 399 bp, Zea mays
  Clone ID: LIB143-047-Q1-E1-H12
tctgctagtatagcgggtgatatggttcttgcttctgcctactctcatgagttgccacgatatggtcttgaagttggtctgaccaactatgcagctgcctactgcactggacttctgttggctcgccgtgtgctaaagatccgtggtttggataaggagtatgagggcaatgttgaggccactggtgaggacttctctgttgagccagctgatgagaggaggccattccgtgctctcttggatgttggccttatcaggactacaacagggaaccgtgtctttggtgccctcaagggagctttggatgggggcctggatattcctcacagcgagaagaggtttgctggattcaagaaggatgacaagcagttggatgctgatacccaccgcaggtacatc

SEQ ID NO: 4810 - DNA, 416 bp, Zea mays
  Clone ID: LIB143-048-Q1-E1-A11
tgcaaccccctagagtgagtcgtattagcgcgactgacatgtcgatgctcaccagcatactgggccgcaagcatcagcagccgccgccgccgccgcagcagcagcagcagcagcagaagggcggcggcgcgcgcactggcaccggcgccggcgccggcacggaggcggcggcagtggagccggtgagcatcgacatcgcggagcaggggccgctagtggacgccatcacgctggcggcgttcgcggcgccggcgctaggcctgccgccgttcgcgacggccagcatggactggaaggagacgccgacggcgcacgtgttcatggccgacctccccgggctgcgccgcgacgaggtgaaggtggaggtggaggaggagaggctgctccggattagcgggcagccgcagcgcgccgcc

SEQ ID NO: 4811 - DNA, 63 bp, Zea mays
  Clone ID: LIB143-048-Q1-E1-B8
aatgcacgcgacatcacagatcttctacatagttgggcaagttgaactcactgggccgtcgtt

SEQ ID NO: 4812 - DNA, 366 bp, Zea mays
  Clone ID: LIB143-048-Q1-E1-D8
tacaacacccaatagtgagtcgtattacggactcctgtaaatccaattgaagaagtggaaggagctactaaagcgggaagggagatcaggttttataattcagagatgcatatggcagcgtttgttcttccgacatttgccacgacggagctagaagcatactgtgcttccacggaaacggagcatgcggatgaagtaccggccacggcaccacaaatgctaactgcggcgcccacgcgtggaattaccaccgcatcctagctgttggatacacacatagccatgtactattagtatcacgcacgtaatctatgcatcgaactcgagtgcgtgcgtgttcggtgggggtacgcgcatcgcggtttg

SEQ ID NO: 4813 - DNA, 369 bp, Zea mays
  Clone ID: LIB143-048-Q1-E1-E12
caggataataatctcttcgatatgaatgactggagagcaatttggaggcataatgcttaagccgttcgagagaagatttgatgcctttaaatgaaaggtttgctggtacatcaaaagacgtattttatgctctttctaatctttctccagtagacctatgcgcttaattttagagatgataacggtggtgcgggccgaagatctgtcatactcctaggggccaattatagcttacacttatgttgttattagttttaaatgctgaaaatacatggagatgcgtagctcagctcagcttggatataacttggtttctatccaaactagtactttgctccgtagggaatgcatctggcaacggaaattgtt

SEQ ID NO: 4814 - DNA, 302 bp, Zea mays
  Clone ID: LIB143-048-Q1-E1-E5
cagagtagtaggcatttggcacgtgctgtaaatagtcattacgttcgagcaagctgttgctcgaagcttcctcatctcgggttgccgtcacccgggtggaatctatagacagtgaacgcaggttgtgcaggtcattcacgtgtttgaggccagcattggacacccgtgagtttgacacgttcaagttgatcagagcagtcaggccagagatcagctccaaggttttgtctgtcagattagcattttgagaaagattcagcaacgtcagggccttcagatccttgatgttcttcactccagca

SEQ ID NO: 4815 - DNA, 191 bp, Zea mays
  Clone ID: LIB143-048-Q1-E1-E6
ctgcggatgcgatggctgggaagggagggaaatgcttgctcgccgcgatgactactgcggtcaagtccgccgagaatgacaatgggaagaaggccccaatctcacgctcgtcacgcgctgggctccagttccttgttggaggtatccaccggtcagctgatgcagaggactcaggcaaatggtcttgttgg

SEQ ID NO: 4816 - DNA, 354 bp, Zea mays
  Clone ID: LIB143-048-Q1-E1-E9
ttcagcaacgtctcccctgagctgttcctgcagatcttcaagttcctctcctcggaggacctcatctcctgcgctctagtctgccgcttcatgaatgctgccgcgtccgacgagaccctctggcgccgcctgtactgcatgaggtggggactggcctccaatgccaaattcagggagtgcgcttggaagaacctctacatacagagagatagagacgatatggttgaatttgtgaggaatactcctacagagttcaaggagtactatattcagatgcatgctgcaaaaaggagtcaagctccccgtccgtcagaagttattactaaattcaaactcctgtttaatccctgtcac

SEQ ID NO: 4817 - DNA, 126 bp, Zea mays
  Clone ID: LIB143-048-Q1-E1-F11
tagtgagtcgtattaaatacggttgcccactgatcatgggttctaaatgcagttcgatacgtgtgttctttaggtcgctcggagtgcatgtttggggtccgtggtcggctcagcatgaacagttgg

SEQ ID NO: 4818 - DNA, 345 bp, Zea mays
  Clone ID: LIB143-048-Q1-E1-F5
cccaatagtgagtcgtattaagtggatacataggatatctcgatcagtagcatctagccatcctctaatcagcgtgaattctcgggatcttgtggcattcaggtcgtccatgttcatattgagctaggtcacgtgtcattttggttttcagccgacaggtctcgttcctttggacttgctcctgatgctttcgttggttcttttgggttgatctgttgagtgatactttctccaattgccttcgatagccctgtgctcagtcaagcgtgcctctgttcttctgctagtgctggattgcgtgtgtctgtttgttgggttgccggcgctgtcggatatggatcgctt

SEQ ID NO: 4819 - DNA, 224 bp, Zea mays
  Clone ID: LIB143-048-Q1-E1-F9
ataggtcgcgggaaacaagagaatgtctccaatgatgcacatgacgctggccgtgcttgcctgttggatgtacatgacgaggtctgcaggaaaggatgccttccaccttcaggggctagttcagtccttacgattccatcgattacaaggccatgctttagtgtgctggggtcgattagctccagtcgggaatgatgggtgcctttggaaaacctcagggtatc

SEQ ID NO: 4820 - DNA, 211 bp, Zea mays
  Clone ID: LIB143-048-Q1-E1-G7
atagtgagtcgtattatattgttgccctctctggtggacacaccttgaggaaggtgccacaaagagcggtctggtttcaaaggggccggcactatagaggcctttagcctttgtcaactcttacgtcagggcacttctcggtggtgatgtcgacggccttcgtcacctcggacgtgattttgccctgctgagcgaggcagtttcctgccgt

SEQ ID NO: 4821 - DNA, 53 bp, Zea mays
  Clone ID: LIB143-049-Q1-E1-B9
ccatcctcgacgagctctaccagttttagctggggctattagagtagtagtag

SEQ ID NO: 4822 - DNA, 412 bp, Zea mays
  Clone ID: LIB143-049-Q1-E1-C12
cgtggttcgttacaaccccctagagtgagtcgtatcaccccgccccaacttgtcaggactcaagaggctcccctcctccctcgccgcggaacacgcgcgccgtcgtcgccagcccgggttcagttctccgttccttggtgcggtggtagccgagcgctccggccatggcgttctatcggggcctcaccgcagtctcgagactgcgatcacgcatggcgcaggaggccaccacgctggggggtgtgaggtggctgcagatgcagagcgcgtccgatctcgatcttaagtcccagttgcaggaattgattccggaacaacaggatcgcttaaagaagctcaagtcagagcatggaaagacccagcttggaaacataactgtggatatggtccttggtggaatgagagggatgac

SEQ ID NO: 4823 - DNA, 147 bp, Zea mays
  Clone ID: LIB143-049-Q1-E1-C7
gatacaagcctctaaagtgagtcgtattaaaaaaaaaaaaaaaaaaaaaaaaaaaaaaaaaaggaggaagcccaaaaggaattatagcttaagtaaaagtaaaagaaacgtcaatagctcttctaaaaatgtcaccaaaggggcggc

SEQ ID NO: 4824 - DNA, 405 bp, Zea mays
  Clone ID: LIB143-049-Q1-E1-D10
ctcgcgggccgacccacgcgtccaggaagatcatcgacaccatccactccggcgagcttctcaccgccaactaccagaagaccgaggtctttggcctggagatcccgactgagatcaagggcgtgccgtcggaaatcctcgacccaatcaacacctggacggacaaggccgcgtacaaggagacgctcctgaggcttgccgggctcttcaagaagaacttcgaggtgttcgccagctacaagatcggggacgacagcaacctgaccgacgagatcctcgccgcaggccccaacttctgaactaaagcagtgggtccgtccggatgaataaaacggtggtatgcgtgtgaagaagaagatgatgacgacgaaaaaagtgtgttggatcgatgggccagcacagtgt

SEQ ID NO: 4825 - DNA, 177 bp, Zea mays
  Clone ID: LIB143-049-Q1-E1-D4
acaagtccctatagtgagtcatattagcgtcatggctacaatgtcatgatgtcgagattgccgaggttcttccatacgataacagaggatctttgtgttcagtactgtcaagccgtgtcttcatacgaggggggaaagtggatgctccactgaatggttgggcaagaagtggtgtta

SEQ ID NO: 4826 - DNA, 139 bp, Zea mays
  Clone ID: LIB143-049-Q1-E1-D7
atttgtccttgtaatgctgacacagaaccatatctcgctcgtcgtcgttggtgctgcgtcgatcatgtggtcccacggagtcgtcaaggaccagggtatggctgctgaatagcgggaggctgatgagaatatcgttgtg

SEQ ID NO: 4827 - DNA, 108 bp, Zea mays
  Clone ID: LIB143-049-Q1-E1-D8
aacagtctttggcatcatgaaggccagggaaatgtcgttcggcgccgctgatgctgcgtatgtcgtggcgtccagcggtctctagactgactgggataaggatgctgc

SEQ ID NO: 4828 - DNA, 415 bp, Zea mays
  Clone ID: LIB143-049-Q1-E1-E12
cgtagtccgttacaacaccctatagtgacgtcgtagtattctcgcgctcgcctcccggctctacgggaggcctcaggcgacgcagccgtggcggcgacccccgccccggtttctctcctcagctgcgtccggcaccctcgatcacctgaagtcgccgcctttcgcgcgtccggctgcccggaaccccgcctcctatccatgggatcgattcggaggagggcagaagaggaccatgttcatccagacacagtcgaccccgaacccgcagtcactcatgttctatcctggaaagccagttatggagattgggagctctgatttccctaatgctcggactgcgatgacatcccctttggctaagtcgctttttgctattgatggagtaaccagggtaatctttggatctgagtttgta

SEQ ID NO: 4829 - DNA, 279 bp, Zea mays
  Clone ID: LIB143-049-Q1-E1-E8
gactcgtgggtcgatacaagactctatactgagtcgtattaccacctcgccgtccctcacgttcctttcacggactcgccagcgcctctccgcgccgtgatctagatgcaggttgttcagcatgggtctggtgaaggaaggcgtcgacatggaggagggaaccctagagatcaggatggagtagaggactgtaactggtgtggccgggcctctggttaacctggggaaagtaataggcccacagtaccaataatctgtgaacatccgacctggagatgg

SEQ ID NO: 4830 - DNA, 74 bp, Zea mays
  Clone ID: LIB143-049-Q1-E1-E9
ttcttcaatatatctaattttttcacaagtaagttaaattgagttagtaccagtatgtttgtgactaagtagtt

SEQ ID NO: 4831 - DNA, 371 bp, Zea mays
  Clone ID: LIB143-049-Q1-E1-F11
accccctagagtgagtcgtattaaaaggaggaggagaagtcggtggagcatgaatatggcgaaggcgatgagaaggcgatcaacaagaaggataaaaaggagaaagacaagaaaaagaaggaagatgatggagattcagggaaggcagagaaagataagaaggataagaaggctaaagagaacgacggatcagagttgaagggttcaagtggtgagaaacaagagaaaatcaaagataagaaagagacaggagatggcaaagatgtgggggaggaagataaacgcaagaagataggaaacaaggacaaagataagaaggataaaaaggccaaagaaaaggatggatcggaaccaaagggtgacaaggatga

SEQ ID NO: 4832 - DNA, 86 bp, Zea mays
  Clone ID: LIB143-049-Q1-E1-F6
atcggcacatgatgccatcagaagagtcacagatcaagcactgacgcggaaatggagacacacattggtgccatgtgaaagttgag

SEQ ID NO: 4833 - DNA, 201 bp, Zea mays
  Clone ID: LIB143-049-Q1-E1-F8
aatccgattagtggcgacggtgaggggaacgggcagggaaacgtcggcgctgctatcgacgttatgccaaatgcaactggctgcaggctcgatcggctcttcaacatgaccagggatcacgcccagcaccatctggtgccagggcaccctgatttcgtactccacacgtgctccgttttcggcaatatgtactccctacgg

SEQ ID NO: 4834 - DNA, 128 bp, Zea mays
  Clone ID: LIB143-049-Q1-E1-F9
aggcggatataggatttttgagtcagactacagaagaattttaattggtgatggttaattcgtagtgtgcaagaaaattttattggtaagaaagaagcgattagtttttgtaccttgatgtgtaggga

SEQ ID NO: 4835 - DNA, 55 bp, Zea mays
  Clone ID: LIB143-049-Q1-E1-G11
tagtgagtcgtattaaaaggcgccactgacctcacgccgtcgcgctcttgagatc

SEQ ID NO: 4836 - DNA, 233 bp, Zea mays
  Clone ID: LIB143-049-Q1-E1-G4
atagtgagtcgtattaagatattgccgtctcccgtttgcgtgaggcgaagacgagagcgagaagcagtcgccatgtctggcagcatccacaagatcgacgagaagctccagatggggggcgagcacaacaagaaggaggacgagcaccacatgaagggcgaggagcaccagagggaacgacgagggggagcaccaaaagaaggacggcggggagcacagtgaaggcatcgtgg

SEQ ID NO: 4837 - DNA, 346 bp, Zea mays
  Clone ID: LIB143-049-Q1-E1-G5
attacaacatcctatagtgagtcgtattacagagctgctccgcgcccccgacgccggtcattaagagcaggaataatacgggttcggaatggccaagtctaagaatgatacggcgcataaccactcgtccaaggcgcacaagaacggcatcaagaagcccaagcaccaccgccagacctccaccaaggggatggaccccaagtatctgacgaactttaagtactcaatgaagggcagtagcagcagttgtgacggcgagtcagaagaatgagaagatgcccgattttatggcgacaaatccatcgcctgtgcccttaaggtccgaatcgtgaaattaattttcaga

SEQ ID NO: 4838 - DNA, 189 bp, Zea mays
  Clone ID: LIB143-049-Q1-E1-H8
tagtgagtcgtattaaaagatcaaccgcagtcgcggggatcacaccaggggtcgccctcatacctcctcgtcactgccttcggttcgggttctaggagtcaggatgaggggtggctgtagcgggggtggtggtcacaggtgtctgggtgatgtcgttggaagcagggagcgctgcagtacagaatgtgg

SEQ ID NO: 4839 - DNA, 216 bp, Zea mays
  Clone ID: LIB143-050-Q1-E1-A3
agtgagtcgtattaaacggggcggcgcaggcgcgggaggagctgtgccgcgccacagtgggtctcgcacgcgactcgatgtcgaagcgccgtgccacgcgtggcgagcagagggcctggcggaagagggggatgtggggcttggtcgctagagggctagcaccaggttgtcattcaggacgacagtggcgagggtccgtgttcgtggacgtgacgt

SEQ ID NO: 4840 - DNA, 396 bp, Zea mays
  Clone ID: LIB143-050-Q1-E1-A4
acaacaccctatactgagtcgtactatcctctcccgacgacagctacacctcacaaccgtgagctcgcgaaggaacgctgttcgcaattccggcgccggcaccatgagtaagctgcagagtgattctctgagggacgcgattgcctcaattaccaatgattcccgtgagaagcagcgcaaatttgttgaaaccattgagctacaaattggactgaagaactatgaccctcaaaaggacaagcgcttcagcggttctgttaagctgcctcacatccctcgccctaagatgaaggtttgcatgcttggtgatgctcagcatgttgaggaggcagagagaatgggtatagacaatatggatgtggaagccctcaagaagatgaacaaaaacaagaagct

SEQ ID NO: 4841 - DNA, 139 bp, Zea mays
  Clone ID: LIB143-050-Q1-E1-A6
atagtgagtcgtattaaatatcctctcgcgacgacggctaggcggcacaggcgctgagctcgcgagggaacgccgtgcgcatctccggtgctggcaccaggcagtcggctgcaaagtgattgcctggaggacgcgattg

SEQ ID NO: 4842 - DNA, 314 bp, Zea mays
  Clone ID: LIB143-050-Q1-E1-A8
taataatgagattgaggttgacattgatagtatggatgctgagacactttgggagcttgaccggtttgtggccaactacaataagaacctgagtaagcaaaacaggaaggccgagcgagcgatgcgtgccagacaagatgcatagttgcgtgcgcagcgccgtatacagcaaccgcaaacaaccccagtcgcccaagaacctgttggtgaaagatctctacagcaacttgccaaaggtgagcacctaccaacatctgcatcagataaaagctaccagaatagacagaaccgtgagtggttcacgcaagtcaagc

SEQ ID NO: 4843 - DNA, 417 bp, Zea mays
  Clone ID: LIB143-050-Q1-E1-B10
gtgggtcgatccaagactctatagtgagtcgtaatatttctcaaagcctgctagttttgaggggatggagaagtttgatactgatttaattacacttcatccaattttaaccgaatgtcgtgtgattaaatctgatctggagcttgctctcatccggtatgctaatgatgtcagttctgaagctcacattgaggttatgagacgagcaaggccaggcatgaaggaatatcaattagaaagtatcttccttcaccatgtttatatgtatggaggttgccgacattgctcttatacatgtatatgtgctactggagataatagtgctgttctacattatggacatgcggcagctccaaatgaccggactttgaatgatggagacatggcactaatggatatgggagctgaataccattt

SEQ ID NO: 4844 - DNA, 224 bp, Zea mays
  Clone ID: LIB143-050-Q1-E1-B3
tatgacattacaacagcctatagtgagtcgtattaacactctccgtaggagacgagcctgggtcacctgcgccgccgcactgagcccacgtctctatcagtcgcatagtcaggtcatgtgaagaccgagcggaggaagcgagcaacttttgtaagcggattccgcgacgtcgacggcgtgcgactaggaggaatggatgtggtgggcgtggagagtgagtcagg

SEQ ID NO: 4845 - DNA, 367 bp, Zea mays
  Clone ID: LIB143-050-Q1-E1-C3
acaacaccctaaactgagtcgtattaacgatctcatttgagatcaacccatcctcgtttcctccgtctagcagcctctcaccctcatggccaagatcaagatcgggatcaatgggtttggcacgatcggaaggctggtggccagcgtggccctgcatagcgacgacgtcgagctcggcaccgtgaacgaccccttcagcagcagcgattacatgacctacatgttcaagtatgacactgtgcacggacagtggaagcaccatcaagtcaaggtcaatgaccccaacacccttctctttggtgagaaggacgttgctgtatgtggctgcaggaatccgcaggagatcccatggggttcggttggcgct

SEQ ID NO: 4846 - DNA, 284 bp, Zea mays
  Clone ID: LIB143-050-Q1-E1-C6
aaaatcgctcgcacgtggagtcaacccagccacgattcatccgtccagcatcctcgcatcctcagggtctacatcaacatccggatcaactgggtttggcacgatcggaaagctggccaccacggtggccctgcagaacgacgacgtcgagctcgtcgccgtgaacgatgccctcagcagcaccgattacatgacctacatgttcaagtaggacactgtgcgacggcagtggaagcaccacgaggtcaaggtgaaggactccaagacccttccccttggtgaga

SEQ ID NO: 4847 - DNA, 200 bp, Zea mays
  Clone ID: LIB143-050-Q1-E1-C8
agtcacgtagcttcacacggtagggttctgcttctaggtcgtagtatcggttgtttggtatatagtagctgctctgtctgcgcaagggatgtagcggcgagcggttgcgattgttgctgctgcagcgatgatggtctccggatgacgggcggcgctggtgttggtaggcgttctctgcgcggtggccggccatggcggcg

SEQ ID NO: 4848 - DNA, 98 bp, Zea mays
  Clone ID: LIB143-050-Q1-E1-D8
tggtgtgacgcaagtgagaatatcatgtgctgttcagctgttgaactctattgcgtagccaagaaatggaggacagcggatgaggagccacagtgagt

SEQ ID NO: 4849 - DNA, 381 bp, Zea mays
  Clone ID: LIB143-050-Q1-E1-E11
gtcgttacaacactctaaagtgagtcgtattaaatgtctggaatcccagctatcttctcccactttgtcaccaatctgcctgcgtttcaccaggtactggtattcctatgtgtcaaatcagttcctgtgccacatgtgcaaccggaggaacgatttctggtgggtcgcattggtccaaaagagtataggctatacagggtcattgtcagatatggttatcgcgatgtgcagaaggatgacctggagttcgagaaggagctagtcagcaacattgcagagttcatccgcagcagtggggaatatgacaagaatggcttcgtcgaggacgcagataagctcttcgagaagctgtccaccatcagtactggaatcagtatgttg

SEQ ID NO: 4850 - DNA, 232 bp, Zea mays
  Clone ID: LIB143-050-Q1-E1-E2
tactccctatagtgagtcatattaactatgttcagccactcccaggctgtggttgtgtgcccaggctgtcatactgttctgtgccaatctagcggtgggattgccaggctcatcgacgtgtgctccttcggtctcacgggcgattaagtccggcgtctcgtaacgtgagaagacatgaatttgctgttttgcagctttctcaggatatgtattgtagtccgtgaggatcttg

SEQ ID NO: 4851 - DNA, 270 bp, Zea mays
  Clone ID: LIB143-050-Q1-E1-E9
taacagtgcatgcattccaaaccaggtcctttgagcaatctgagtaactgtagttacagagtacaatacatccaaagcacactatccttgaattacagagctcaaaccacctgaacttgttattgtggacttttttcatctcatcgctggttctccctcctgcgtgcgtagcgggtcctgtcattgtacctaggcctgtcggcagccctctgtggcacgggctcaacccttctctgcctctcatgaggcctctgaggaatctcaccgttg

SEQ ID NO: 4852 - DNA, 195 bp, Zea mays
  Clone ID: LIB143-050-Q1-E1-F12
atagtgagtcgtattaagcaatgccaatgccaatgccatctggttttcgtgcaaaagaaaaaaaagcaaagggaaagagagaacaagggagacaagagagaaagggggggcgggcgagaggatccaggcttatcgtgggggtgcacacgacgtcgtactccttccatagggtcagcgtaagttcaaatgactggg

SEQ ID NO: 4853 - DNA, 76 bp, Zea mays
  Clone ID: LIB143-050-Q1-E1-F8
tattgagaccacagtcgcggtatggacacgggatgtgtctgtggtcagaggagatcgctcaccacaatcggtatca

SEQ ID NO: 4854 - DNA, 404 bp, Zea mays
  Clone ID: LIB143-050-Q1-E1-G11
cctatagtgagtcgtattaagcagtagctcaagtacgagagtggtcttttggtaatattccaaagaaggatgcttctcgttttgtacgagcggtaatatacacgtctatctatctatgttaaaaaatttgggaatgcaacccagattgacttaattgtggatgatgttggtggtgtactagagaaggcaccacatgaagcacaaatagagctatttgatttgttgattgatggttgtcagaaagctgttaaagagaatacagatatcaagggcacagttttggattttttcggtgtacctgtgatggcctatgaattgctagctcgtgttgaagagcttcagttgttgtcaaagcgcattgcacgatacaaacgatccaatcaagcaatagcccatccaactac

SEQ ID NO: 4855 - DNA, 140 bp, Zea mays
  Clone ID: LIB143-050-Q1-E1-G4
ttacaatacactaaagtgagtcgtattagacttccaagatatacatgtcttcgggcgcgagctcgccgaaatggccgcctgagggttccacgactacgaggtggtgggtcgcacgctggggacggcgaacgaggagcacg

SEQ ID NO: 4856 - DNA, 317 bp, Zea mays
  Clone ID: LIB143-050-Q1-E1-G7
aatactctatagtgagtcgtactattcagccgccagtccgccggcgcaactccagccgccgcgtgcccctcctctccccacccgatgctggccctcgcgcgcgccgcgtcgctgctccgccgcgcctcggggtccgcgcctagtactgcgtctctgtacgatccgccgcggtacgtatgcccttgcctcgtggagaatctgccaagtttctttgtcaatgggtaatcgacacttttggctcgaccatttgacgtgttgtttccatcagtactcccttctagcaggactgtgtggacaccatatcgggagcctgggca

SEQ ID NO: 4857 - DNA, 367 bp, Zea mays
  Clone ID: LIB143-050-Q1-E1-H1
acaacaccctagcgtgagtcgtattaagcacaggcagtgatcggcaaccaaatccggacagtcttgagctctctcagtctcagcatttcagttcccagattcacatagccccagccccacaagtagcgaaatggcagctgctccgttcgcgattgccggccggctctcccccgttgcgcgcctcccggtccgcgcctggaggccggcgcacgggtttgcgtcgtccgggagagcccgctcgctcgccgtggcgtccgcggcgcaggagaacagggacaacagtgtcgacgtacaggttagccagaacggcggcaacaggcagcagggcaacgccgtgcagctccgcgcgcgcggcgcgacagcgctc

SEQ ID NO: 4858 - DNA, 358 bp, Zea mays
  Clone ID: LIB143-050-Q1-E1-H12
cgagtgcatggtgctcgacaacgaggcgctgtacgacatctgcttccgcacgctcaagcttaccacgcccagcttcggcgacctcaaccacctcatctccgccaccatgagcggcgtcacctgctgcctccgcttcccggggcagctcaactcggacctccgcaagctggccgtcaacctgatcccgttcccgcgcctgcacttcttcatggtggggttcgcgccgctcacctccaggggctcccagcagtaccgcgccctgacggtgccggagcttacccagcagatgtgggacgccaagaacatgatgtgcgccgcggacccgcgccacggccggtacctgacggcgtccgccatg

SEQ ID NO: 4859 - DNA, 174 bp, Zea mays
  Clone ID: LIB143-050-Q1-E1-H2
ctctacactaaagtgagtcgtattaatgcgtcgcggtaatcaggagctgtatcgctggcggttgcgcggtactctggtatcaacatggctgtgaacaaggagtccaagctctagacacgcgcggacgtatggtgcggggacgagctgcggtacagcggtatcgcctgcgccggt

SEQ ID NO: 4860 - DNA, 282 bp, Zea mays
  Clone ID: LIB143-050-Q1-E1-H5
caacaggcagcagcacaagcaagaagcagacctcctcccttcgcctgtgatcatgtcgtcttgctgcggcggcaagtgcgggtgcggctccaactgctcctgcggcagcggatgcaacggctgctgtatgtacgctgacgtggatagcgccgccaccagcagcgtcgataccacggtcctcgccgcgcctaccactaaggccatcaccggcggcgtcgaggcggcgaccgattggcggcggctgcgactgtaacagctgcaaggtgcggcaccaactgcggg

SEQ ID NO: 4861 - DNA, 420 bp, Zea mays
  Clone ID: LIB143-051-Q1-E1-A11
tacaattctctatactgagtcgtattacgagaagagagtccatctgctcgttgccttgattttgtggaacgaagcgatggctcgcagcggcgccatggtttcgtgcatgctgctcctggtggtggcggcgcaactgctcatggtggtgatggccacgcagacagcggctgcggcggcgggcgatcaacgcggagcagcatgccggctgctgtggcaggtgacctgccagtacagcgcctgtaactgccgcacttgcacgacatatggctgggcgtgctgcagcacttgctgctagctagctagctagctagctactgtgagttcttccgcgcgcgcgcgcgcgcagcctttgcatacccctcttgcttagctcatgtccagtactatccggttgctgccctcgtcatcagctgcgtcatc

SEQ ID NO: 4862 - DNA, 418 bp, Zea mays
  Clone ID: LIB143-051-Q1-E1-A12
gttgcaacaccctagattgagtcgtattagaccagcgacacgcactctgcacccagcgcgagaaaaaactacatcgatcatcaccagcgagccagccggccgagcgagcagcaccgatggcggcgtacatgcgcgtgacgcaccgcgacgaggaaggcaagaaggtgacggagaagatgccggtcccggagacgcggcgcccggacacggccaagcacttcgagcgcaagctggaggagcagggcctccaccgcttcgagcggcacccggcgaacgcgccccggggcgtgggcatcggcgccccgccgcccaagtccgggcgcggcggcaagtacacctgggagggccccggcggcctcgtcgaggaccagctcgacccggcgccgctcggcatcgaccccaacgaccccaactacga

SEQ ID NO: 4863 - DNA, 417 bp, Zea mays
  Clone ID: LIB143-051-Q1-E1-A2
acaacatcctatagtgagtcgtattatctactgacctgtgacctccgcatttccaaacagcccgagcgagctagagctagcagagcggcaggcacctccctcctcaaggaacatggcccgcacgcagcagttggcagtagtggcgaccgccgtggtggccttggtgctgctggcggcggcggcgacctcggaggcggccatcagctgcgggcaggtggcgtcggccatcgcgccctgcatctcctacacgcgcggccagggctcggggccctccgccggctgctgcagcggcgtcaggagcctcaacaacgccgcccgcaccaccgccgaccgccgcgccgcctgcaactgcctcaagaacgccgccgccggcgtcagcgggctcaacgccggcaacgccgccagcatccccttcaa

SEQ ID NO: 4864 - DNA, 402 bp, Zea mays
  Clone ID: LIB143-051-Q1-E1-A3
tatagtgagtcgtattatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgagtccaaggtgaacgagactaaggcaaccgtcaagttccagctcaagaaggtcctttgcatgggtgtcgccgtccgcaacttggcgaaggaggaaaagccaatccagcataacatccagatg

SEQ ID NO: 4865 - DNA, 411 bp, Zea mays
  Clone ID: LIB143-051-Q1-E1-A9
tacaacaccctagagtgagtcgtattaattgctgatcgttattcttggaatcactcagtatcagaataccatgtatacgagttctttaagatatggaactgttctcgagaaagagctaattttcttgtccacgagttcttcacaacccattacttccaagatggcattcatcctattccgggggctcgagatgctctccaaactctttcttctttctgtagcttgtctgtagtaacatctcggcaggatgtaattaagaatcacacattggaatggattgagaagtattatccaggcttatttgagcagatccatttcgggaatcattttgctttggaaggtcaatcaaggccaaaatcagagatttgcaggtctttcggcgctcaggttctaattgatgacaagcccaga

SEQ ID NO: 4866 - DNA, 312 bp, Zea mays
  Clone ID: LIB143-051-Q1-E1-B11
tagtgagtcgtattaaagttgattgggacaaatggcaggacgaggatgatgaagacgctggatttaatgactttggtggtatggacttctcgaaactggacataggaggtgctgatgaccactatattggggatgatgaagatgatgtggttgaaagtgctaagaaggatgaagaacgacgtaagacagaacagagcaaggatgaggaagcagctccagctgctgcaaaggaagtgaagccatgaagaatcagttgactttgctcggcgccatgggtgtccacggtatctagctaggcgagacgttcccttg

SEQ ID NO: 4867 - DNA, 77 bp, Zea mays
  Clone ID: LIB143-051-Q1-E1-B4
tccgcggggctggctccgcactggactccgtgtctgcggccttcgtagtagagttggttacggggtgcgggtggcgg

SEQ ID NO: 4868 - DNA, 191 bp, Zea mays
  Clone ID: LIB143-051-Q1-E1-C11
agtgagtcgtattaaacaggtcgcagggctgccagcttcaccatgagtcgtagcagcaccgcgtgctgcctacgctgtcggtagggttcgtcctgacttgagcggcaagcgcactggcatgtccgtccgggttcccaccgtggatgtgtcagttgttgactgtcactgtgagagtcgagaggggggcctgc

SEQ ID NO: 4869 - DNA, 363 bp, Zea mays
  Clone ID: LIB143-051-Q1-E1-C12
gtgagtcgtaatatgtgtgatcttcttaaatctaaggttggatcgctcgagttccttcaaaagctcaatggtattcagaagtcagtaagtcaaaatggtgcagttgaacctgatacatcatgggatataataacgtcagtggatttatgggaagatggtggctcagatgatggatatgtactggttaagcaggaggatgtggttgatgggatgacttcctttatggctgcatgcttggtgtcaattaaaaagaccaaggacctgccccctgatcaacttcaaaaagtgcttaggaagacgttttcagctgaaaagaagaaaagtaaaatccgaaaggcatgggatggaactaaagtcctttat

SEQ ID NO: 4870 - DNA, 70 bp, Zea mays
  Clone ID: LIB143-051-Q1-E1-C4
gccacaccctaaagtgagtcgtattaggatatagcggttatagataggtcgtttgggtttgagcctgcgg

SEQ ID NO: 4871 - DNA, 188 bp, Zea mays
  Clone ID: LIB143-051-Q1-E1-E11
agtgagtcgtattaaggcgtcgccgccgccgcgtcgtccgccgcgtccgctcttcccagcgacatgtgcaagcccggcgcgtactcgctcggctcgcgcgtcgccaggatcatgtccaacggcgcgaccttctcggtggtcggattcgcggtcgggctcaccggagccgcgatctcgatgcgggctga

SEQ ID NO: 4872 - DNA, 326 bp, Zea mays
  Clone ID: LIB143-051-Q1-E1-H3
gtgagtcgtattaagcagatatttttctcatctcgcctgtgcggccactggcacccgccccgttcgttattagatatagaacagcaggctgccagtcgcactcgttgacatcggttcagcgtcggcccaggtaccttccgtacgtggaggaggcggtcgcgatgctctagcttgcattgcaccagcgcgcagagctgcaggaggtgggaagcgcgcaggaggatctcgacacagagagataggctggtcgggacacagcgagttcagtccatttggatatggacgcacgcagcgccggccacgagagcggttttgatctggaggag

SEQ ID NO: 4873 - DNA, 68 bp, Zea mays
  Clone ID: LIB143-052-Q1-E1-B3
ttacaacaccctatagtgagtcgtacaagcaacttcaaacccctccaaaagtggtccacctaaaatca

SEQ ID NO: 4874 - DNA, 111 bp, Zea mays
  Clone ID: LIB143-052-Q1-E1-B5
atagtgagtcgtattatacggctcacgggccggcgggcggggcgccgctgcccggtgcagcgcccgtcggccggatccgtcgggcgcgcggacggcggtgggcgtgggggg

SEQ ID NO: 4875 - DNA, 58 bp, Zea mays
  Clone ID: LIB143-052-Q1-E1-B8
aatggcgttgtcagcggcagccaaggccgtcgtgcggatttctcatcgggtggtgtct

SEQ ID NO: 4876 - DNA, 387 bp, Zea mays
  Clone ID: LIB143-052-Q1-E1-B9
tatagtgagtcgtattacaagcggcgacactgtagcccagctccagcagcactacagcagtagcgccaccgaacctgaaaactcctagccccacgaaatcgctgaacctacccatgagccgagcgatgattagccgactcgccgcggcgaggcgacagctactgcaatcgacggacgtcgcgtaacgctcctcctcggcagcggctacagcgtcagctgtccaagatagagcagggcccgcgtcgggcactgtgctcacggacagcttcgatcggggctccgacgcgtaccagcgcaaaactgacgccgtctgcgggttgctctccaaactgcactccggcgtcacacaagtgctgagcttcggacgcgccaacgcagtaacgccga

SEQ ID NO: 4877 - DNA, 140 bp, Zea mays
  Clone ID: LIB143-052-Q1-E1-C12
acaagactctaaacagactcgaaccatgcgcccggtgctgtgctagggcgcagagaccatctgatggtggaaacaccggaaataagagcgtgccgctgtgtgtttcctttgaaggaatgaaaatggtgtttgtgttgtgc

SEQ ID NO: 4878 - DNA, 443 bp, Zea mays
  Clone ID: LIB143-052-Q1-E1-D3
gtaggacgttccaacatctctatagtgagtcgtattacaagcagcagccatgtccaaggtcttcaccctcgacgcggtcgccaagcacaactccaaggaggattgctggctcatcatcggcggcaaggtgtatgatgtgacgaagtttttggtagaccacccaggaggtgatgatgttctgttgtcctcaactggcaaggatgcgactgatgatttcgaggatgtcggtcacagcaacactgcccgcgcgatgatggatgagtacttggtgggtgaaatcgacgcgtcgacgatcccttccaggacgaagtatgtccccccgaaacaaccgcactacaaccaggacaagactcccgagtttgtcatcaagatcctccagtttttggttcccctggcaatcctggggcttggctgttgccgttacgatgtacaacaagtcggag

SEQ ID NO: 4879 - DNA, 395 bp, Zea mays
  Clone ID: LIB143-052-Q1-E1-F12
ccctagagtgagtcgtattaggatttgttgctttcaaatctgctgaagatgctaaccgagctcttacggagatgaatggcaaaatggttggaagcaagcccctttatgtagctcttgcgcagcgtaaagaagacagaaaggcaaagctacaggcacagttttcacaaatgcgtcctgttgcaatggcgccttcagtaggtcctcgcatgcccatgtttccacctggtgtccctggagttggtcagcagctgttctatggtcagccaccaccagccttcatcaaccctcaggctggatttgctttccagcaacctctgatgcctggtatgaggcctggtggtccaatgccgaactttatgatgcctatggttcagcaaggacagcaaccacagcgt

SEQ ID NO: 4880 - DNA, 61 bp, Zea mays
  Clone ID: LIB143-052-Q1-E1-G8
atagtgagtcgtattagacgtcgcggcgcgtttgggtctcggccgtagtgtcgcgcgtccc

SEQ ID NO: 4881 - DNA, 429 bp, Zea mays
  Clone ID: LIB143-053-Q1-E1-A1
tcgttacaacactctagagtgagtcgtattatggactgccacacctcgcacattgctgtcaagtttgcggagctcattaccaagattgataggcggtctggcaaagagcttgagaaggagcccaaattcctcaagaatggtgatgctggtatggtgaagatggttcccactaagcccatggtagtggagaccttttctgaatatcctcctcttggtcgctttgctgtccgtgacatgaggcaaacggtggctgtcggagtcatcaagagtgtggagaagaaggatccaactggagccaaggtgaccaaggctgccgcaaagaagaaatgatgtgtctggctggttctgtgtttgcttgagggatacctagtggaaacgtaaaatatctcgtcctgttcacgtcattgtctgaactatgctcgcaacgtt

SEQ ID NO: 4882 - DNA, 423 bp, Zea mays
  Clone ID: LIB143-053-Q1-E1-A12
acaacaccctagagtgagtcgtattaatctgccagtccctggcggggtccaagaacagctcgtccagcgacgagtcggccgcgtccctgccggactcccccaagtgctcagcgtcgacggagggggatgaggactcggcctccgccggctcccctccttccccgacgcaggcgccgcccgtgccggagatggcgaagctggacttcaccgaggcgccgtgggacgaaacggaggccttccacctgcgcaagtacccgtcctgggagatcgactgggattccatcctctcatgaacgatcaactacaactagtattttagtagtagtagcagcagcagcagcaaggttcagtcagtgatagctctgtgtaattttcgatttggggtttgcatctgcggtggatcgatggcattttagacatccg

SEQ ID NO: 4883 - DNA, 149 bp, Zea mays
  Clone ID: LIB143-053-Q1-E1-A6
agtgagtcgtattaaaacctccgccggccccacactcgtgcacggccagctctcaatcagtctaagactcctcatagctcaacgctcgatctctcggagcgtcaccttcatggactgcgaagcggctcacatcgccgtccatggtcagt

SEQ ID NO: 4884 - DNA, 54 bp, Zea mays
  Clone ID: LIB143-053-Q1-E1-A8
atagtgagtcgtattagagcggtcgcccgctcgaatggcggcgccggccagctc

SEQ ID NO: 4885 - DNA, 444 bp, Zea mays
  unsure at all n locations
  Clone ID: LIB143-053-Q1-E1-B11
tcgtaggacgttacaacactctaaagtgagtcgtattatgatgatgatgacttctggtgaggctgtcaagtacaagagctcattggacgcattccagcagatccttaagaaggaaggccccaagtccctgttcaagggtgctggtgctaacattcttcgtgccattgctggcgctggtgtgctttctggctacgaccagctccagatcctcttcttcggaaagaagtacggctccggcggtgcttaaatggagaaaaatgatgacgaacaagagcagttcgctcccggtccagcccagtcaggatctggtcaagtttttgcctttcatatcgaagaaattaataatttatgtaggagaatttttccaacattcgttttgggcggagacattgatctcaaaacactcgtaactgtcctactangtggtggcatgggtccccaaaa

SEQ ID NO: 4886 - DNA, 406 bp, Zea mays
  Clone ID: LIB143-053-Q1-E1-B12
agcaagcctccgctgtacaggagcgtcacgttcccggacttcatcgccaagttcaacagcatcggactggacggtcgcgtgctcgaccacttccggttggaggacgacggccctactcctcttgctgctgctgcacaccacgtctagtcttgttttcgttcgatcgaacaaacagttctcgtcgtcgtctcttttatttttcctgcaatctgaatttcgagttctccaaataaataagggtatccattcccttcatccgcagagcgcgcggatgccttcactagcagctctagttttgctatgtatatagctgtgtgtgtggtacctttgtgactcatatattatgcaataaagtatgctttctcctcgtacctttgtgcctcactttttttattaaaggtatgtt

SEQ ID NO: 4887 - DNA, 444 bp, Zea mays
  Clone ID: LIB143-053-Q1-E1-B2
tgggtcgatgcaagactctacagtgagtcgtattacttctccctccgccgccactcccctcccattcaccgccaccgccaattccataccgtcctccgccacctctgctgagagcgagaagagatggcaggcaagggtgatgggccggcaatcggcatcgatctcggcacgacgtactcttgcgtcggcgtctggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattccagggcccggtgagaagccaatgata

SEQ ID NO: 4888 - DNA, 157 bp, Zea mays
  Clone ID: LIB143-053-Q1-E1-B6
agatgcgccagaaccgccccatcccctactggatccgcatgcgcaccgacaataccatcaggtacaacgccaagcgcatgcactggcgacgcacgaagctcggcttctgagcggtggaagagatgatggccagcgaatcttgtggaggatagagctc

SEQ ID NO: 4889 - DNA, 177 bp, Zea mays
  Clone ID: LIB143-053-Q1-E1-B7
cgaatctgtgagccatgtcgaccaacaagggcagcgcggccaatggcggcggagggaagaagaaggaggtgaagaaggagacgaagctcgggatggcctatacgaacgacgacaacttcgggcagtggtactccgaggttcttgtcaacagtgaaacgattgagtccgatgaccttt

SEQ ID NO: 4890 - DNA, 203 bp, Zea mays
  Clone ID: LIB143-053-Q1-E1-B9
taaaaaagaaaaaaaaaaaaaaaaaaaaagaaaaaaaaaaaaaaaaagaaagataaaaaaaaagaagggatgaggaagaaaatggggcgggatagagaaacgcgataaagggaagatgagtcgcgggggggtaggtcagctcagatgggagggagggtggtcggagttgcagattcgaggagcaagagagtgtcgtaggagat

SEQ ID NO: 4891 - DNA, 246 bp, Zea mays
  unsure at all n locations
  Clone ID: LIB143-053-Q1-E1-C9
atagtgagtcgtattaaacaggncaccgcgtagctcgccacggcagccacgatgacagcagcaccagttctgccgcttgagaagctcttcgggcaccatcatgtcttcgcacaacttgaccagccagacctaactcgatgggcggccagacgtgatcacggtcagtcgccatcggccttgcactcgctgcctagatcatgtacatcagcgcgcgtagagtgtagaacgtgtcccacggggttagga

SEQ ID NO: 4892 - DNA, 104 bp, Zea mays
  Clone ID: LIB143-053-Q1-E1-D1
agtgagtcgtattatacgtcacgagcagcgaaacgccatcgattcctgactctgctgcacctgcagctctgggctgccgcctatatgggcgccaatggcgggct

SEQ ID NO: 4893 - DNA, 391 bp, Zea mays
  Clone ID: LIB143-053-Q1-E1-D11
atagtgagtcgtattacactgcgctattgctgcaggagctcttttatttgttttggcaagtgatgtccaggaggataattcgctggattcagaaacttgtgtcgagatcgttcttaggttaatagaccctccagtgaatgttgttaatgccaaagcggcatgaataggttctaaacttcttggaatcactaaatttcagatgcttagcagttccaataacgatgcagattctaattcagaggacatacttttaaaagttgaagaaatcctcttaagctgcatagagatcaagcgactatacagttatgataacaagacaacaaggccagaactatgttcaaagtggcttgctttgttgacaatggaaaaggcatgcttgtctgctgttgca

SEQ ID NO: 4894 - DNA, 445 bp, Zea mays
  Clone ID: LIB143-053-Q1-E1-D12
gtcgcgtgggtcgttacaacaccctatagtgagtcgtatcacgcggcaagagcttcccggcccgaaaccgaaagcaccaccaccaccaccaccaccaatctctgcgttttccgtctgcggcggcggcggcagcagcggaggaggtggacgagatgctgtccgccgacatccccccaaaccagaccatctacctcaacaacctcaacgagaaggtcaagaaagaagagttgaagagatcgctttatgccctgtgctcgcagtatggaaggatactggatgtggtggccctgaaaacacagaaactgagagggcaagcatgggtggtgtttagcgagattacagctgctaccaatgctttccgtggattgcaagactttgatttctacggcaaaaaaatgcgagtacaatatgcaaaaacaaaatcagattgtattgcaaaagaaga

SEQ ID NO: 4895 - DNA, 72 bp, Zea mays
  Clone ID: LIB143-053-Q1-E1-D5
attacaacagcgtatagtgagtcgtattagtcccagcagcaggggtggtgccacggccgtcagtcaggttcg

SEQ ID NO: 4896 - DNA, 83 bp, Zea mays
  Clone ID: LIB143-053-Q1-E1-D7
tatagtgagtcgtattaaacagcggcggagctcaacgggacgggctagaagacggacgcgtagaggcgctgcagcaaggcgca

SEQ ID NO: 4897 - DNA, 172 bp, Zea mays
  Clone ID: LIB143-053-Q1-E1-D8
atagtgagtcgtattacatccttgccaccatcaccattactggcactggcatccacgcagctaggagccgtggcgcggcgagcagcgacaacagggatcacgcatggaccgaggactggatcttctgggtccgccccttcagtggcgctgccctgggtgccagctaccaccg

SEQ ID NO: 4898 - DNA, 57 bp, Zea mays
  unsure at all n locations
  Clone ID: LIB143-053-Q1-E1-D9
atagtgagtcgtattaaacactncgncgcggacgcgacgaggacgctccagacttag

SEQ ID NO: 4899 - DNA, 93 bp, Zea mays
  unsure at all n locations
  Clone ID: LIB143-053-Q1-E1-E6
agtgagtcgtattatacgggtcgngatggcttgagtgtgtgacgctgtgcacggcgtgagggtcgtggttttcttattggtgcggaataggtc

SEQ ID NO: 4900 - DNA, 445 bp, Zea mays
  Clone ID: LIB143-053-Q1-E1-E8
gttgttcgttacaacaccctatagtgagtcgtagtagccaaagaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgccaagaagccatcctgatatcccttttgggcttctca

SEQ ID NO: 4901 - DNA, 329 bp, Zea mays
  Clone ID: LIB143-053-Q1-E1-F12
agtgagtcgtattaaacaatgtggaacctcaaagccctggtcacctcactactctgcatctcggcgttgtcgtcgtcgccatggccatgcacggcagccggtcagctgggcggcaagcccctggtcaccgccgtcaccaaggacgcgtccacctccctctacacggcgccgctcaaggacggtcacccgctcgtcctcgagctcagtagctcggtcatctcgctggccatgtgcgccatctcctccaacaacagcaacggcacgctcagcgccactccatccgccagtgccacgtactgttataactcactgttcacggtctccttccc

SEQ ID NO: 4902 - DNA, 125 bp, Zea mays
  Clone ID: LIB143-053-Q1-E1-F6
agtgagtcgtattagacgcatgagaagtgtagaattcggagccatagagactgatgctagcgagtagtggatcggtgcaccagatacagacctagctttgtgggggtgggcctattaccagggag

SEQ ID NO: 4903 - DNA, 436 bp, Zea mays
  Clone ID: LIB143-053-Q1-E1-F8
gacgcgtaggtcgatacaacaccctagactgagtcgtattatacgacggagctgagcttctagcaacgtacagtgtatccgccatgagtcctttcggggcggtgatcacgccagaaaccctcaagtacatgtccaagtaccagggacgtgagatcacgcaggtggactgcgcacgggaggcgatgaggctgatccacgcggaagacaagaacctcaaggccgaggactcagcgtgggagctgaagaagaagttcggcaacggcgtgagcaccatggtcctcgtctacaacgccaccggggccagcctgagcctggtggacgacgggaaagactggatgggctccgtctacagctcgccgatcccggacaccttccacaacgggcagtggatcgccttcctccacgtcaagcccggctcgctggcgcagggcagcca

SEQ ID NO: 4904 - DNA, 400 bp, Zea mays
  Clone ID: LIB143-053-Q1-E1-G10
cctatagtgagtcgtattaaacactggtcaaatccttgcgagcctcgtcatgaatccaccaaaggttggggacgaatcatatgcttcctacaaggcatagaaagatggaatccttcagtctttagctcgccgtgcaaaggcactggaagatgcattcaacacgcttgagggattttcatgtaacaaggctgaaggagcaatgtaccttttccctcagatccatctgccacataaggcaattgaggctgctaaagctgccaagaaagcacctgatgcattctatgcgctccgtctccttgaatcaactggaattgttgtggttcctggatctggatttggccaagttcctggaacatggcacgtcagatgcacgatcctgccgcacgaagataaaatcccc

SEQ ID NO: 4905 - DNA, 430 bp, Zea mays
  Clone ID: LIB143-053-Q1-E1-G11
tacaacactctaaagtgagtcgtattatagtgtataaatttgttctagttttttttattttgaaatatttgtttgcgtgttcgtgagattcctggccgttcttagtagtatgcatggtgtggagcactactgtacttccgctcctggatctttactactactccactgtgcttttttgtttgtttgtttgcttgcttccttgctgcgaaatcgaggagcagcgcaagattggtgtaatgatggcctgccttttgacccctcctttctctgtgcatctggcatgcagcaggtgatgagagttcccatcattacctcttgattgggagaatcttcgctttctctctctctctctcggcttcttcttcttcgtgttcatttctcttcctcctctccgtcgtctctctttgtttatttgcagcatatgtctttg

SEQ ID NO: 4906 - DNA, 386 bp, Zea mays
  Clone ID: LIB143-053-Q1-E1-G12
tacaacaccctatactgagtcgtattattctccaccggcaccagtccaccacctcctgccaccgcgcggccccaaccaaccacaccgcagcgcagcaatggcgggcaacggcgccatcgtggagagcgacccgctgaactggggcgcggcggcggcggagctggccgggagccacctggacgaggtgaagcgcatggtggcgcaggcccggcagcccgtggtgaagatcgagggctccaccctccgcgtcggccaggtggccgccgtcgcctccgccaaggacgcgtccggcgtcgccgtcgagctcgacgaggaggcccgcccccgcgtcaaggccagcagcgagtggatcctcgactgcatcgcccacggcggcgacatctacg

SEQ ID NO: 4907 - DNA, 290 bp, Zea mays
  unsure at all n locations
  Clone ID: LIB143-053-Q1-E1-G5
atagtgagtcgtattaaacgatngcgagagattgagccttcgatggctaccattgtgttgtaggggtcagcatgatgtgatgcccacaagcttgtccttggacaatgctgcagcctgcagcttcgaccctgtatagccaggatagtgaggtttcagcggacctacgcactcttgtttccaggaaggggactgaactctgagtgaccgctggaagagtccaagtcgtacttcagctgatgaatcgataagtggtttagtctctcggcctttttcgtaggatcgagagcagc

SEQ ID NO: 4908 - DNA, 438 bp, Zea mays
  Clone ID: LIB143-053-Q1-E1-G6
tcgttggtcattacaacaccctatagtgagtcatgttagtgttcgtcctcatggcgccgccgcagccgaagtcgggcctcttcgtgggcatcaacaagggccatgtcgtcaccaagcgcgagctgcctctgcgcccgtcccaccgcaaggggaaagcaacgaagagggtgtccatggtcaggggcctgatcagagaggttgctggctttgctccttatgagaagcgtatcaccgagcttctgaaggttggcaaggacaagcgcgctctgaagcttgccaagagaaagcttggaactcacaagagggcaaagaagaagagagaggagatgatgggcgtcctcaggaagatgagatcggctggtacgcacactgacaagaagaaataaagcatttcaagttcatgaatgtggcaaccagagattatcaactgtgtttttt

SEQ ID NO: 4909 - DNA, 101 bp, Zea mays
  Clone ID: LIB143-053-Q1-E1-G7
tagtgagtcgtattaaacacggtggtgagcaagatgatgaaggctgggtccgaccgcgtggaggccgtcatggacgtgcatcggcgtcgctaagccccagc

SEQ ID NO: 4910 - DNA, 391 bp, Zea mays
  Clone ID: LIB143-053-Q1-E1-H12
gttgtgcgatgctttgaggatggtgatatagttcatgtcaatggcaaggtccatcccagatcacacattgatgtcattaacctagagctgatattttcggatcttgaacaaatagagaagaggttagataagcttagcatgagcaaaactaaagatacacacgtacgagtgaaggaacaagcagagaaatcacgattggaaaaaattcagcaggcacttatggaaggaaaaacctgcaagatcgatctagttggctgagcatgagaaacaagctataaaacatctttatctgctaactatgacacctgtcatttatgttgctaaggttacagaatcttatcttgctgaacctgatatcaatcctcatgttaaagaggtgtctaaaccaaca

SEQ ID NO: 4911 - DNA, 246 bp, Zea mays
  Clone ID: LIB143-053-Q1-E1-H5
tagtgagtcgtattatcacccttcagctagccccaagttgagtcggccgatcgatcactgacgtagggatggcctcagccagcaggtggacccccgacatcgcgtcgctggtggccccgcaccgccggatccgcgccgccgtgacggactgccacaaccggttcagcaccgtcgcctcgcacatgcgcgcgagcgcgccggccacgttcggagacggcagcgcttgcatgggctggccgtgcaggt

SEQ ID NO: 4912 - DNA, 126 bp, Zea mays
  unsure at all n locations
  Clone ID: LIB143-053-Q1-E1-H6
agtgagtcgtattaacacacacccgccttgccactaacgagcaccccgcctcaatccacggcncacggatcagccgcagcatgccctacatccgccgtcgctgaggccggctgcgccatttgccat

SEQ ID NO: 4913 - DNA, 134 bp, Zea mays
  Clone ID: LIB143-053-Q1-E1-H7
atagtgagtcgtattaaaccagttcgcctccgcctccgctccgctcctccccctctcgtcccgccatggccaccgcagcacgcgccctcgtcgccgcacgcccggcactgcggttgcggccgccttagcgcctg

SEQ ID NO: 4914 - DNA, 317 bp, Zea mays
  Clone ID: LIB143-053-Q1-E1-H8
gtgagtcgtattaatgcgtccgcccacgcgtccgagcaactctctcgagtcgattcctaagcagctagccagtgactcgatcttagcgtgctacaatggcggcagctgctagtgccctgctcctcctgctctgctcagccttctgctcccttgcccaccgggcggccggcgtcgactacggctcgtggcagagcgcccacgccacgttctacggcggcggcgacgcgtctggcacgatgggcggcgcgtgcggctacgggaacatgtacagcacggggtaccgcaccaacacggtggcgctgagcacggtgctgttc

SEQ ID NO: 4915 - DNA, 408 bp, Zea mays
  Clone ID: LIB143-053-Q1-E1-H9
atagtgagtcgtattaccgaccccgagctccgaaggccgcagcatcaggcgcgccccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcatagggacctg

SEQ ID NO: 4916 - DNA, 412 bp, Zea mays
  Clone ID: LIB143-054-Q1-E1-F12
cgggccgacccacgcgtcagggtcttcttgttcaatccccatctcgatcggggaggccaccaaccaccatatggcgggagggaaggtttactcgttcgaggaggtgaggaagcacagcgaccgcaaggactgctggctcatcatcgccggcaaggtgtacgacgtcacgccgttcatggaggagcaccccggcggcgacgaggtcctgctggcgtccgtcggcaaggacgccaccgcggacttcgaggacatcggccacagcgcctccgccaaggagctcatgccccagtactgcatcggcaaggtcgacgcggctaccttcccggccaagcccgcctacgtcgtcaccaaggacgacgccaggtcgtccgagaaggccgcgacgagcgccggcgcttgggccacgctcctg

SEQ ID NO: 4917 - DNA, 443 bp, Zea mays
  Clone ID: LIB143-054-Q1-E1-F6
cgggccgacccacgcgtcagcacacaacagcagctcaaaaacctaacacacctcaacaagcagagcaaagacccgggattcgccggcgcggtagcgagagcgagagatggacgggaggatgttcggtctcgagacccccctgatggtggcgctgcagcaccttctggacgtgcccgacggcgacgccggcgcgggcggcgacaaggcgagtggtgccgcggcgggcggcgggcccacgcgcacctacgtccgcgacgcgcgcgccatggcggccaccccggccgacgtcaaggagctcccgggcgcgtacgcgttcgtggtggacatgccggggctgggcacgggcgacatcaaggtgcaggtggaggacgagcgggtgctggtgatcagcggcgagccgcgcccggaaggagcgcgaggacgccaagtacctgcgcatggag

SEQ ID NO: 4918 - DNA, 276 bp, Zea mays
  Clone ID: LIB143-055-Q1-E1-A11
tatcggagggtggtaagtccgcatcggcgttagggttccttagggttttgtgggcgggcgacatcctgcggttgcttatgctgatgttgcgtggtgtgcgggcttcggcattgcctcaggggggcggtggtctgcggatgccgcggcctcatggtggtacatcacgtcatcctcgatgtcgacggggaattgttctcggacgtggtcggcttcggctgcgtgcccttggcgtccaaggacgccatggccgcacttaatgaggtgatcgccggggag

SEQ ID NO: 4919 - DNA, 389 bp, Zea mays
  Clone ID: LIB143-055-Q1-E1-A12
atagtgagtcgtataagacactaggtgacacagcgcgacggtcatgggtgacagccaatactccatcgctctcagcactttcagcccgtcgggaaagcttgtgcagatagagcacgcgctcacggctgtcggatcagggcagacctccctacggatcaaagctgccaacggtgtactgattgccaccgagaagaaactgccttctattttagtggatgaaacatctgtgcaaaagattcaggcactaacaccaaatattggagttgtccacagtgggatgggtccagattttcgtgttctggtgagaaaaagtcgagagcaggcacagcagtattaccggttgtacaaggagcatatacctgtaacacagcttgtgcgggagactgctg

SEQ ID NO: 4920 - DNA, 369 bp, Zea mays
  Clone ID: LIB143-055-Q1-E1-A6
tgctgggaagcagcttgaggacgggcgcacgcttgccgactacaacatccagaaggagagcaccctccacttggtgctgcgcctcaggggaggcatgcagatcttcgtgaagaccctgaccggcaagactatcacccttgaggtggagtcttcagacaccatcgacaacgtcaaggccaagatccaggacaaggagggcatcccaccggaccagcagcgtttgatcttcgctggcaagcagctggaggatggccgcacccttgcggattacaacatccagaacgagagcaccctccacctggtgctccgtctcaggggtggcatgcagatctttgtgaagacactcactggcaagacaatcacccttga

SEQ ID NO: 4921 - DNA, 351 bp, Zea mays
  Clone ID: LIB143-055-Q1-E1-A7
acaacaccctagagtgagtcgtattaggtggagcctagcatgtctggcccaaagaggcctcatgatcgtgtccctttgaaggaaatgaaatcagattggcatgcttgcctggacaacaaagttgggttcaagggttttgcagtgccaaaggagcagcaggataaggttgtcaaatttgactttcatgggcagccagcagaaatgaagcatggtagtgttgttatagcagcaataactagctgcacaaacacctcaaatcctaatgttatgcttggtgctggtcttgtagctaagaaagcttgccagttgggtcttgaggttaaaccatggggtgaagacaagcccttgccc

SEQ ID NO: 4922 - DNA, 383 bp, Zea mays
  Clone ID: LIB143-055-Q1-E1-A9
tatagtgagtcgtattaaaccggtccgagcggaccgctgaaaccagcacaacacgcaaagcagcgatccgacatccgagagatggacgcggtgatgttcgggctggagactcacctgatggccgcgctgcagcacctgctggacgtgccctacggcgacgccggcgcgggcggcgacaacaagacgggcagcggcggcagcgccacgcgcacctacgtccgcgacgcgcgcgccatggcggccaccccggccgacgtgaaggagctgcccggcgcgtacgcgttcgtggtggacatgccggggctgggcacgggcgacatccgggtgcaagtggaggacgagcgggtgctggtggtcagcggctagccgcgccgggaggagcg

SEQ ID NO: 4923 - DNA, 410 bp, Zea mays
  Clone ID: LIB143-055-Q1-E1-B12
tacaacactctagagtgagtcgtattaaaagatgacgcaaatcatgtttgaaaccttcagtgttcctgctatgtatgttgctattcaagctgtcctttccctatatgctagtggccgtaccactggtatcgtcctggattctggagatggtgtcagtcacactgtcccaatctatgaaggctacgccctcccacatgccattcttcgtctcgatcttgctggcagggacctcactgattccctcatgaagatcctcaccgagaggggctactctttcacaaccactgccgagcgggaaattgtacgtgacatcaaggaaaagcttgcatatgtcgcgctagactatgaacaagaactcgagaccgccaagagcagctcatcagttgagaagagctacgagctgcctgatg

SEQ ID NO: 4924 - DNA, 344 bp, Zea mays
  Clone ID: LIB143-055-Q1-E1-B3
tctatagtgagtcgtattactacatgttcaagtacgacaccgtgcacggccaatggaagcacagcgacatcaccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggacaaggctgctgcacatctgaagggtggtgccaagaacgttgttatctctgccccaagcaaagatgcacccatgtttgttgttggtgtcaatgaggacaagtacacctccgatgttaacattgtttccaatgct

SEQ ID NO: 4925 - DNA, 319 bp, Zea mays
  Clone ID: LIB143-055-Q1-E1-B6
actctgtgaatagtagtctagaatacagtagtgttttgagtaaactatggataaactgctggacaaggtctaagacaagtgctgcgtggtggcaacaaacgacacttagtcttgtttggtggcaatgacattggaggggctaaagttttttcgctcctaaacaagctcctaagaatcttacgtgttatgttgcattatggaatatctatgtatctgcaaactctctgtagtatgtatgtacctcggatgtgctctatgtggctttgtaattttgaacggacgaagtaataataagataaatgaatggcgtaacaggata

SEQ ID NO: 4926 - DNA, 347 bp, Zea mays
  Clone ID: LIB143-055-Q1-E1-C12
atagtgagtcgtattataaaatacgacacacaaggaaggagtaaaaaaaaaaagaacaaaaaaaaaaaagagaaaaaaaaaaaaaaaggggggaagacaaaaaaggttggggggggagataaacgtagaacggacgattaaaatcacatcaaagggggggccgaccctcaggtacgggccccttcgtttcggagcggagtaatgggaatctctctggcggttccaagaaatatcgccggggggggggtttttatatcccgcgcagggggggaaaactggggtggcacgccacattgacccccccaaatattcccccttttggaggggttggggaaattctcaggggg

SEQ ID NO: 4927 - DNA, 272 bp, Zea mays
  Clone ID: LIB143-055-Q1-E1-C8
gggaaggcatgagacaccaaccaactctagttaccgtctacgacgaggaacgataacaggctgattcgatcgagcatacagcggcgcggcgggcacggccgtgtacccgactaacggcaaagcaccttcagctccccgtcgccgcagtggatcccatagccgcgtaccgtcacgagaaatcaggagccattgctggaaccacctcagcaaccctatgcgtgtagccaacccagcggccgccaccggtactagaaaccgccgccgccaccgcc

SEQ ID NO: 4928 - DNA, 352 bp, Zea mays
  Clone ID: LIB143-055-Q1-E1-E12
ctctgcataatagttaagtaaaattagcatgcatccaagtacaaactgcgcttacattacatgcatgaggagacaagggtctccctctcttgaagacaaagtgctactagcggggcaatcatatacagggaaggtgtgtgtggaagtggaaggagatataaacaaggtggtgaagcagagattcatgtatctgtgtcagcatccagtaatcccacccccctgaaccaaacaaaagctcaatcattgctccggcggctcgcacctcccaccaaacatgctcttctctctctgtctactctttctcagcatgtatacaacggatccatggcacacacaggcagcatcatttgtg

SEQ ID NO: 4929 - DNA, 55 bp, Zea mays
  Clone ID: LIB143-055-Q1-E1-E3
gggtcgacccacgcgtccatgtcgatttaacgtttatgcatgtctggatataatc

SEQ ID NO: 4930 - DNA, 118 bp, Zea mays
  Clone ID: LIB143-055-Q1-E1-G4
ctcctcgctctgcaaagcgaagccaagcctgaaggtagtcgcggtggctcgaaaacacgatgggcagggacgacctgattgagagcggggcggggggcggcgagttcactgccacggg

SEQ ID NO: 4931 - DNA, 66 bp, Zea mays
  Clone ID: LIB143-055-Q1-E1-H10
aacgttgctgcgccataaggcagtgtccatgatccagtctagagtgggaacgcggtttatggattg

SEQ ID NO: 4932 - DNA, 372 bp, Zea mays
  Clone ID: LIB143-055-Q1-E1-H11
acaccctatagtaagtcgtattatgagcggcggcgagggatcggatcgtcggcggcgatggaggacgaggtgcagacggcagcggtgagcagttggaacgagcttgactatgaggcggaagcgcgtttggtggcggaggcgagggcgtcgtgggataggaaggcaaggggggaggaggaggatgaagaagaacatgatcctgagatgaccttggactactacgcctaccaggctaaaaagtttcgcaacacctggaacatcctctatttcggccacttcggtcgcttcgaggacaccacagggatccctcctatgcgctttacagagaagccgcctgactccccggcgtaaccgcgcactacactgcaggtc

SEQ ID NO: 4933 - DNA, 422 bp, Zea mays
  Clone ID: LIB143-055-Q1-E1-H2
atagtgagtcgtattacgccgcgcgcgcattcacaagcttctagacgttccgaggaggaggggaggtacccgccgccgcagccatggcgtcgactaaggtccagcgtatcatgacccagcccatcaacctcatcttccggttcctacagagcaaagcgcgcatccatatctggctcttcgagcagaaggacctccggattgacggtcgcattatcggattcgatgagtacatgaacttggtcatcgaatacgctgacgaaatcaacgtcaataaatacactatgaaatcactgggccggatactcctcaaaggtgacaatatcactttgatgatgaacagtggcaagtgaagattcctatggcaggaacgatgtctggtgctcgctttcattatctgtgacacaatgtactccatccatccg

SEQ ID NO: 4934 - DNA, 218 bp, Zea mays
  Clone ID: LIB143-055-Q1-E1-H3
tacgatgcgactcacctcagaggcagcatcaagctctagtccgagctcgtcggctgcaacaaggtaacagtgccagcaggcatggacgggaagggggaggacgtccgcctgggcgccaacaagttgtcggagcgccagcccatcggcacggcggcgcagggcacggacgacaacgacgacaaggagcccccgccggcgccgctcttcgaacccgggga

SEQ ID NO: 4935 - DNA, 313 bp, Zea mays
  Clone ID: LIB143-055-Q1-E1-H7
cagattacgctggacgagaacaccgccaacaatgaggctgctggggctgcagcggcgccggtgtttgttgttggtgaggctgtcaatgacagcttgccagtggttgcttctgagtctgatttcagccgtggtaagtaccttagttacattggtggtggcgagaggtgcaggagcatgaaccatttcatttgggggttcttgtgtacccttggcgaggcacagttcttgaagcggacgcgtgtcatggacttcaatgtctgcctcaatgcacggtagacgtcgagtggcaaggatgaaggagaggatttcacgg

SEQ ID NO: 4936 - DNA, 221 bp, Zea mays
  Clone ID: LIB143-055-Q1-E1-H8
agtcagttgcctcactctggttggtgatctttatatatggtctcaaatgtaggtcaggttgcaatgtttgtagctgctcttggtgtttgttcatgcaactcatggttgtaaaagctgtggaaagacttgtgcagtcaaggatacagattccgatggttaactttgggttagaacatatacagctgtaaaattggaagtcgaggtggttaaaactctgaaaa

SEQ ID NO: 4937 - DNA, 389 bp, Zea mays
  Clone ID: LIB143-056-Q1-E1-A12
cctatagtgagtcgtattacactgctcaacgcacaagtgcacgctcacctcacacactcagataagtagctaactccgtaggcgagaacaagaaaaagctcgacatggccgaggagaagaagcagggcctgcatctgctggacttctgggtgagcccattcgggcagcgctgccgcatcgcgctggactagaagggcctggcctacgagtacctggagcacgacctgaggaacaagagcgagctgctcctccgcgccaacccggtgcacaagaagatccccgtgctgctgcacgacggccgccccgtctgcgagtccctcgtcatccttcagtacctcgacgaggcgttcccggatgccgcgcccgagctgctccccgccgaaccctac

SEQ ID NO: 4938 - DNA, 156 bp, Zea mays
  Clone ID: LIB143-056-Q1-E1-A7
cctatagtgagtcgtattacaggacggagccgagcgtcgagcggcgtgcgctgtatcggctatcactccttccggggcggtgatgacgcgacggacgcgcaaggagatgtcggagtatcagcggaggtgagatgaggcgagtggacggcgcacggg

SEQ ID NO: 4939 - DNA, 99 bp, Zea mays
  Clone ID: LIB143-056-Q1-E1-A8
taaagtgagtcgtattagcgccgaggttccttcgttgggggttcttggtccggattgagagatttggttcgcggggggttgttgtgtgggtgtgagttg

SEQ ID NO: 4940 - DNA, 337 bp, Zea mays
  Clone ID: LIB143-056-Q1-E1-B1
ccaccacgtgccaagcggcacgatgctgctcaccaacgcatacgccatccacagagaccctgcggcgtggacggaaccggacgccttcaggcctgaacgattcgaggatggcagcgccgaagggaagctcctgataccgttcgggatggggcggcgcaagtgtcccggagagaccatggcgctgcggactctagggctggtgctggggactctgatccagtgcttcgactgggccactgttggaggcgtccccaaagttgacatgaccgaagcgtccgggctcactctcccgagggccgttcccctcgaggccatgtgcaaaccgcgccaagccatg

SEQ ID NO: 4941 - DNA, 411 bp, Zea mays
  Clone ID: LIB143-056-Q1-E1-B11
tacaacacccaatagtgagtcgtattatgcagagcaagccagtgaggtctctcagagcgtagccagccagctacaatggcggggaacgcgctagccaactatgtccaggtctacgtcatgctcccgctggatgtcatcactgtcgacaacacgttcgagaaggaggacgagacgagggcgcagctgaagaagctgacggaggcgggcgccgacggggtcatgatcgacgtctggtgggggctggtggaagggaaggagccgggagtctacgactggagcgcctacaggcaggtgttcaagctggtgcacgaggccgggctgaagctgcaggccatcatgtcgtgccaccagtgcggcggcaacgtcggcgacgtcgtcaacatcccgattcccgcagtgggttcgggacgt

SEQ ID NO: 4942 - DNA, 374 bp, Zea mays
  Clone ID: LIB143-056-Q1-E1-B12
acaacactctatagtgagtcgtattaagaagggatgcagcagccgatgcacatgcagccgcaggcgccggcgataaccccagctgccggaatcaccacggagcagatccaaaagtatctggatgagaataagcagcttattttggctattttggaaaatcagaacctaggaaaattggcagaatgtgctcagtatcaatcacaacttcagaagaacctcttgtatctcgctgcaatcgcagatgcccaaccgcagactgctgtaagccgccctcagatggcgccgcctggtggatcgcctgaagtacggcagtacatgtcacaggtgcctatggtcccaccgacgacaactctaacaccccagcagatgcagga

SEQ ID NO: 4943 - DNA, 257 bp, Zea mays
  Clone ID: LIB143-056-Q1-E1-D12
tacaaaaccctatactgagtcgtattatgcagacacgtcctgctgcccagacaaatactgcctacaacaagggcatagcccatgcacattatcctatctgcaaagatgatggtgtcagtggactgtaccacggtcctggagatacctcattgggaatcggccccaacattgcagtagccctcaccgtttacgaatcttaacactcgcactgccagatagacaagccatgtgctccccctgttcggataagtttggct

SEQ ID NO: 4944 - DNA, 414 bp, Zea mays
  Clone ID: LIB143-056-Q1-E1-E12
cgtggtctgatacaacaccctctagtgagtcgtattactgaacaccaacgtcaccctccagcagtttcgctttcttgcttcaccctgcgatcgagatcgagctcaacaaccatggaggatttagtgagtagcccatctttcaggagcgtcctcagcagcagtagcgatgggcaggctcagtcaggagagagttcttggacggattacttcgtggatttcatgttatccgaggaggagaggaagagacaggcagatgctagctcatactcatactgcgctaccgaggacgaaggcggcagcatatacggtggcgatggatgcagccgcgatgaggatgaggaggaagaggaggagtccatggtctccgatgccgcctctcatgcccctacgactgcaagcgccaacgcactgata

SEQ ID NO: 4945 - DNA, 298 bp, Zea mays
  Clone ID: LIB143-056-Q1-E1-F10
aagagtcctctcgtataacataatacatcgaaggtaactcacatgggaacttccatgggttgtctcgtcatgctctgccttgtttcgtctctccttcccagtgccgtccttgtccacccatggggtggcttgttcccacagttctatgaccattcgtgccccaaggccaaggagattgtgcagtccattgtggcataggctgtggtcaatgagaccaggatggcggcatctttggtcagactgcatttccatgactgctttgtcaacggctgcgatacttctgtgctgttggacaaca

SEQ ID NO: 4946 - DNA, 228 bp, Zea mays
  Clone ID: LIB143-056-Q1-E1-F12
aaccgtgcgaccggcaacgcccatcaactactcgttcatggaacagagggccatagacacagcacgctacagcgatggaggatcgagggagtccccaagcgtgcaagagcgacgcccgcagcgagggcaaggggcaagctcaggggggagagattccggggcgtggtgacgtcctgcgagccgcggcagcacacgaagagaggagaaaacacgctcatgcgagggcag

SEQ ID NO: 4947 - DNA, 353 bp, Zea mays
  Clone ID: LIB143-056-Q1-E1-G12
caaggcgaccgcgccgcggaggctgctccccgcgctcctcaaggccctagctccagccggcgcgcgcggcctctccaccgagaaggctgtcggcgccgccgccgtcgctgtcgtgggcagccacaccgctaagtggatgcaggacacgagcaagaagtcaccgatggaactgatcaacaaggtacctccgatcaaggttgatggccgcatcgccgtttgtgaaggggctgctgaaggtgttgggcttggccacccaatcgagtatatctgccttgatctggaggcacccaacgtgtgcaaatactgtggcctccgttatgttcaaattcaacatcactaaatagggaagatac

SEQ ID NO: 4948 - DNA, 164 bp, Zea mays
  Clone ID: LIB143-056-Q1-E1-H1
tctatagtaagtcgtattagggaaggggagaagcaagcgagacgtcacgggagcagagcatagccttgcctggaacctccattgccggccatcgcctagccgccgcccggcttccgggaagaaaaatcagtcagccccgattcccaatccgtccgcccccaaaa

SEQ ID NO: 4949 - DNA, 98 bp, Zea mays
  Clone ID: LIB143-056-Q1-E1-H12
tagtgagtcgtattagagaggaatcacgtcacgtgggtcaaattgagcattgatcaagctggattttatagagtgaagtatgatgatgaacttgcagc

SEQ ID NO: 4950 - DNA, 400 bp, Zea mays
  Clone ID: LIB143-056-Q1-E1-H2
acactctatagtgagtcgtagtaacaaaggcgctggaagctaaacgtgccaaagtcatgggacaagcattagctggtgtacccttgtggcagcttggtcctgagagtagatttcctggggtcccttacattgtttttcctggtaatgttggtgataacagtgctcttgctaaagtggtgaaaagttgggcttccccatctagaagttctacaaaagaaattcttcttaatgcggagaagggcggttatgctgttggtgctttcaatgtgtataaccttgagggaattgaagctgttgttgcagcagcagaggctgaaaagagtcctgctattcttcagattcatccgagtgctctaaagcaaggtggagtcccactggtagcatgttgcattgctgctgc

SEQ ID NO: 4951 - DNA, 78 bp, Zea mays
  Clone ID: LIB143-057-Q1-E1-A11
tgctacgacgcctatgtctcgttcaaaagttctctgtcgtcgtcatcaacaggacgctccatgtagcaaaccacgttg

SEQ ID NO: 4952 - DNA, 356 bp, Zea mays
  unsure at all n locations
  Clone ID: LIB143-057-Q1-E1-A2
tagtgagtcgtattaggcangccaacaccctgcccgcagccgcaagcaagcagccaagcagtgtgaactgaccgtctgttccgtccagcccagcatggatgcgccgccggtaccggagctcatggatctggacgcgccccctcgcgccggttccccccgccgtcagcgacatgaagaacgaatgggaagggggagacattgttacgggtcacatcatctccaccaccagcggtgggaagaacggcgagccgaagcggaccatcagttacatggcagaacgtgtcgtgtgtacgggctcatttgggatcgtcttccacgcctaagtgttgtggagacgggcggagaccttcgcccat

SEQ ID NO: 4953 - DNA, 174 bp, Zea mays
  Clone ID: LIB143-057-Q1-E1-A3
cctaaaatgagtcgtattaagcgggatggttggcatgctgtttactcagttgcttttcttacaggacctgaacgaataaatcatataaatctaattacatcggtcatctggatcgagagatttaaatttgggcgtcgattaatgaggaagggcgggtgtttgaggttggttccg

SEQ ID NO: 4954 - DNA, 371 bp, Zea mays
  Clone ID: LIB143-057-Q1-E1-A9
agcggctctttggaatacttagtcaatgactggagacagggtcgagactcgccgccgagatctggactcagaatgtatagctccgtaactcaggtgtccatgtgggcagatttacatcgtattccactggcaagggtagatgccgaatcgtagactgacgagtccttggacagtttgtcaacgtaatgaacctttcaagtgggagcaccagaatggatgagaaccaatgcacataaatgatcgcggtcgctgcctacggcgagatgggttcaccgcctaccatcccgcccaatgccacactccagttccatgttgagctcctttcttgggccagcgtcaaagacatatgcaaagacggtgcgacttttaag

SEQ ID NO: 4955 - DNA, 178 bp, Zea mays
  Clone ID: LIB143-057-Q1-E1-C8
cggatcccgagctccgacggccgcagcatcatgcgcggccccccatcgcgtgtcaccgagatggggctgcgtaatcaggggacggttggctagcccaggttcatgctcgtcatcgtcagggatggtggaattggcaggacggcatttgtgatcatggatctcactgtagagtttgaga

SEQ ID NO: 4956 - DNA, 383 bp, Zea mays
  Clone ID: LIB143-057-Q1-E1-D8
cagacagcagcgaggagcagtacctgttggctggattctctgcagtctagcagctagtcgagttaagtttcagatacacatggtgagcattggcaaaggcacagccacctggaccaccgtgccgcagtcggcgccgtcgacaaggaagctcatcacgatcctgaacatctatggcggcggcatcagcggccttatcccggagaccatcattgcgtacctcgacgccaacctccagtagctgtacggctcggacgctcggatcgccgactactacgatgtgattgcccggaccagcacggtcgtcctgatcgcgtcgatgcaggcggtgccggacgagaacaatcaggcgctgttcaccgccatgggactcatcacgttctacc

SEQ ID NO: 4957 - DNA, 57 bp, Zea mays
  Clone ID: LIB143-057-Q1-E1-E7
attcccgggccgacccacgcgtccaaaaaaaatcaaaaaaaaaaaaaaaaaaagaaa

SEQ ID NO: 4958 - DNA, 78 bp, Zea mays
  Clone ID: LIB143-057-Q1-E1-F8
tcacgcccacatgacgacacacgcttggggtgacggcctgcgactcgtacctccagatgtggatcacgcacaagggcg

SEQ ID NO: 4959 - DNA, 255 bp, Zea mays
  Clone ID: LIB143-057-Q1-E1-G1
tcgtgtttcgatacaaccctctatagtgagtcgtattagactgtccacgccgattccacgatacgttcgcgagttcaggccaacatcgtcagctcctggcactcgttgcgatactgtaggtcgtcacccgtaaggtctgactgataggattccagatggatgggtccagtaggcagcctcaatgccggtgcactcgacagccgtcaagagtgctccatctacaggatcggccgtggtaactgcatcgaaaggagc

SEQ ID NO: 4960 - DNA, 418 bp, Zea mays
  unsure at all n locations
  Clone ID: LIB143-057-Q1-E1-G11
cgggccgacccacgcgtccacaatttcatctgtgggaccaaatgcagcagttattcactataaacctgaagcaagcacatgttcggaaatggatgctgataaaatatatctttgtgactctggggcacagtacctggatggtacaacagacattacaagaactgtacattttggtaaaccctcagcacatgagaagtcatgctacacagcagttttgaaaggccacattgcactagacattgctgtgtttcctaatgggacgacaggacatgctcttgatattctttcacgagcaccactctggagagagggtcttgactatcggcatggtacaggccatggaattggatcntatttgaatgtccatgaaggtcctcatctaattagcttcagaccttctgctcgaaatgtaccgctg

SEQ ID NO: 4961 - DNA, 159 bp, Zea mays
  Clone ID: LIB143-057-Q1-E1-G7
tacaacaccctagagtgagtcgtattaccccggcgaggtacttgcgcgcaaatgcgccgacatgccgcggaaccacggtccacgtgaagccaagcaacgacaggccgcagtccacggtcgatcagccgcagcatgccagcccgacgctcgagaacgccg

SEQ ID NO: 4962 - DNA, 138 bp, Zea mays
  Clone ID: LIB143-057-Q1-E1-H10
agtgagtcgtattaaggagcaggaacctaaccacgaacgcatccgcagcgactgggtaacgatctctgatcccggagcaatgaacagccaaacgaatcgcaaaccgtgaggatcagacgatgttttatctcaagcgcc

SEQ ID NO: 4963 - DNA, 91 bp, Zea mays
  Clone ID: LIB143-057-Q1-E1-H8
acacgtcaagctcacgtcgggcgccttcgtcaccgccgtgctcttcagcgtccacgggctgctcaactcactcttcgaggggcgcaccgtc

SEQ ID NO: 4964 - DNA, 61 bp, Zea mays
  Clone ID: LIB143-058-Q1-E1-A5
atagtgagtcgtattatacagtacgactcactgggtggattcgtattaagttgtacgacgc

SEQ ID NO: 4965 - DNA, 428 bp, Zea mays
  Clone ID: LIB143-058-Q1-E1-A6
gcgcgggccgatacaacaccctagactgagtcgtattatcagagagcggggatcgaagaaaaagcgatcgatggcgtccaactacgtggacaccatcggcgaggagggacggttccacggcactcacatcgacaacagcagcacgacccggaagggcggcgcaggtgccgcggctgcatctcctggcagattcgggcgaagcttctaagccgggtactttgaagatcacagcttctgctgatgcagccatcgagaaagggaagctggttatcgacgtcaagtatttcttcttctacgtgcactcggagacccgcgacatctgcggagagacttcctgcccagcgaccggcgacttcgtgctgtcccaccagcagacgctgccaggcttcactccgccgggctcctacacgatctacatgaagattgtc

SEQ ID NO: 4966 - DNA, 251 bp, Zea mays
  Clone ID: LIB143-058-Q1-E1-A9
tagtgagtcgtattaaacattgccactcactatacggtgttatatttcttatgtctactcactggctgaacttgagagatcgaattacatcgtgtcctgtgtggcgggaggtgattatttgtgcatctatgagggtggatggtcatgttgtcgcgaagtgattctcagacttgcgcgtgtactcagaggtttgatcttgtgagctccctgaaaggtagagctcccgaggcatttttcaaccgttttgtggt

SEQ ID NO: 4967 - DNA, 407 bp, Zea mays
  Clone ID: LIB143-058-Q1-E1-B10
gcgttgtccattacaacaccctatagtgagtcgtatgtattcaagaaaccaccagagagcccaaccgcacaggcaggagagagagcagggagccagggacagtaccgtggggccggggagcaacgatggaggggaaggaggaggacgtgcgcctgggcgccaacaagttctcggagcgtcagcccatcggcacggcggcgcagggcgccggcgccggggacgacgacaaggactacaaggagcccccgccggcgccgctgttcgagcccggggagctcaagtcctggtccttctaccgcgcgggcatcgccgagttcgtcgccaccttcctcttcctctacatcaccgtcctcaccgtcatgggcgtctccaagtccacctccaagtgcgccaccgttcgcatccaa

SEQ ID NO: 4968 - DNA, 126 bp, Zea mays
  Clone ID: LIB143-058-Q1-E1-B7
tatagtgagtcgtattaaactgccgtgggtaaagccgccgccgccgcaaatgccgcgccagcatcatgcacgcctggtgccggttcttcatccgggggtgcatggcgtagcgccggactcagcgtc

SEQ ID NO: 4969 - DNA, 406 bp, Zea mays
  Clone ID: LIB143-058-Q1-E1-B9
acaacaccctatactgagtcgtattaagaaacagggaggaggcggaggaaaccagaaggtcctcctctggaggctgccggtggtcacctctaaggagctcggcaagataggccccgccctcggaatcggcatcggctgcggcgccggcgcaggcatcggattcttcggtggtgcagggttaggctatggatttcctggactcacattaggctttggagttggagctggatgtggtgtgggaattggctttggttatggcttgggcaaaggaattgcatatgatgaaaagaaaaaatactccaatgttggcaagatgttccaggaagctccacattttcctatggacactgtcggtgctttatttgacgagctggttataaacaccaagaagcttgtgacatcaaca

SEQ ID NO: 4970 - DNA, 371 bp, Zea mays
  Clone ID: LIB143-058-Q1-E1-C10
tagtgagtcgtattaaagtagcaccggcgcaggtagaacgctgcacaatccccttcgccgccgccaagatggtgaacgttcctaagaccaagaagacgtactgcaagagcaaagagtgcaagaagcacacactccacaaggtgactcagtataagaagggcaaggatagcctgtctgcccagggaaagcgccgttatgaccgcaagcagtcaggatatggtggtcagaccaagcctgtcttccacaagaaggccaagaccaccaagaagattgttctgaagctgcagtgccagagctgcaatcactactcacagcacgccatcaagagatgcaaggcattttgagattggtggagacatgaagggaagggc

SEQ ID NO: 4971 - DNA, 382 bp, Zea mays
  unsure at all n locations
  Clone ID: LIB143-058-Q1-E1-C5
atagtgagtcgtattaaacngccagacgctggnccncgttcagggaacgctagcaagtctgctgataagcagcctgcacctaaagagccagcagacgactacggccatgttacggctataagaggtcaagcagcggacagccatagcctcgcagaaagagcacgacgagagacgataagtgaacggatgaaagttcttcaagatattgtccctggatgcaacaaggttatcgggaaagcatcagtccttgatgagataatacattacatccagtctttacagcgtcaagtatagtttttgtccatgaaacttgaagcgattaatgctcatgtgagcaatgcaactgtagcttttccaaccaaggattttggagttgcgccat

SEQ ID NO: 4972 - DNA, 425 bp, Zea mays
  Clone ID: LIB143-058-Q1-E1-C6
gcgcgggccaatacaacaccctacattgagtcgtattaaccaaaattatctaactaaagagacttctgaccttttgctaagcttgttgaagccgatccttgtgctctcaggccatgatcatgaccaatgcacagttgtccactccactccttttgggccagttacagagcataccctggggacaataagttggcagcaaggaaatctctatccatcttttatgctgctatctgctggacccaagttatcacaaaattcaactgatctggaacatgaggttgcaatgaacctttgctttttgcctaaacaaacccatatttatatctggtaatggttacaagcaccttctgcctgttttatttatttagtgacaaagagttacagttgaactatgcatcattgttgtttcaactgtttgtacaggt

SEQ ID NO: 4973 - DNA, 383 bp, Zea mays
  Clone ID: LIB143-058-Q1-E1-C7
tcccatcccacactgctcagcagtcattcaacactcggcaaccacatgcctccgctcagcccactggtctaatgcaactctcagatctccaggaaacttctgcagacgacccggttagggccgctcacatggccgacgctgaggacatgcgctaggtcgaaagggcgtcccgatacatccgtgacgtcatcaccagcatgggatacgttacgatcatgctcagctgcatatggaatagaacgttgcacttatgaccttgactttatgccctggtggagcaataggtacaactagatatggttacaagtacactcagcgtgcataagctagttaatggcttgcaatcaatgtccatgaacccatcattgatgttaccctgtatg

SEQ ID NO: 4974 - DNA, 404 bp, Zea mays
  Clone ID: LIB143-058-Q1-E1-C9
gcgggtcgatacaagaccctagagtgagtcgtgagtaaggtagcaccggagcaggtagaacgctgcacaatccccttcgccgccgccaagatggtgaacgttcctaagaccaagaagacgtactgcaagaacaaagagtgcaagaagcacacactccacaaggtgactcagtataagaagggcaaggatagcctgtctgcccagggaaagcgccgttatgaccgcaagcagtcaggatatggtggtcagaccaagcctgtcttccacaagaaggccaagaccaccaagaagattgttctgaagctgcagtgccagagctgcaagcactactcacagcacgccatcaagagatgcaagcattttgagattggtggagacaagaagggcaagggcacatctctttt

SEQ ID NO: 4975 - DNA, 341 bp, Zea mays
  Clone ID: LIB143-058-Q1-E1-D10
aagactctatagtgagtcgtattataaaaaaaaaaaaaaaaaaaaaaaaaaaaaaaaaaaaaaaaaatcaaaaaatgaaaaaaataaaaaaggcgggagcgcaaattggtgggacgctgttcctaggtgtcaatggattggtttctcctcttcttaagtttttcctggtttaattgggttagcagtctttttttaacggcgttccggtttgaaccgtatggtaggttaactaattggcgttccataattaagccgtttcgctatctagcgttttttcaattttgccggcttcaattatcagcccaaactctttgtatctcggcatcattcttggatcgttt

SEQ ID NO: 4976 - DNA, 62 bp, Zea mays
  Clone ID: LIB143-058-Q1-E1-D5
attactacagcctatagtgagtcgtattaatagccctcctctcgaaccacggctctgctccc

SEQ ID NO: 4977 - DNA, 262 bp, Zea mays
  Clone ID: LIB143-058-Q1-E1-D7
tacaccaacaacggcggagctgccacatatagcaaaccagaggagagaagagaggaggggttggctggctggccctggccgtcgtccgccggtagctcgtggtcgcgcgctcgctccatcagtcctccctctccgccgtcgtgcccgcccgcacatatgacggggtcagaaggcgagacggatgctgcgcgcgcggccatgctaacaccgtcgctgtcgctcgggggcggcggtctcgagggggatctccgctcggccaacc

SEQ ID NO: 4978 - DNA, 59 bp, Zea mays
  Clone ID: LIB143-058-Q1-E1-D9
tttctattactacatcatatagtgagtcgtattaaacgatgcgactcagtggacggact

SEQ ID NO: 4979 - DNA, 157 bp, Zea mays
  unsure at all n locations
  Clone ID: LIB143-058-Q1-E1-E12
agtgagtcgtattaaacnngnnctgntcanagcaggtacctgccagcgggacacactgaagtgtagcccgtgcgcatctgccacaagataccctgaaccagggtgcggtagaagaagcaggtgacttgttctgccagcggggggtggcccatcaccc

SEQ ID NO: 4980 - DNA, 161 bp, Zea mays
  Clone ID: LIB143-058-Q1-E1-E3
caagcctctaaagtgagtcgtattataaaaaaaaaaaaaaaataaaaaaagataaatcaaaaatggcggtttgcgcatgaaaggtatatggactttctatccttccaatcgagtcctaattggcggggaatctgttacctgcttttccgtaaatggccctt

SEQ ID NO: 4981 - DNA, 181 bp, Zea mays
  Clone ID: LIB143-058-Q1-E1-E9
tagtgagtcgtattaaaaagtacgactcattagagggagtcgtgttaagtggtaccacccagtagcgggacaccgacagaggtgtcggaggctctagaggcggggtgggacttgcctacgacctgcggctagagctgggggcatgtcgccaggtagaagacgcgcagtcggcgcgcggagg

SEQ ID NO: 4982 - DNA, 311 bp, Zea mays
  unsure at all n locations
  Clone ID: LIB143-058-Q1-E1-F10
tagtgagtcgtattaaacancgcgacacaagatgtaggacatttggatgttagcctgcacgtcttctggcgaccagacaaggttttccccctgggggcttgtggtggagcttgttaggctcaccttaccttgggtagtggacgtgagccaggaggtatacgatttggaagaggagagaggataattttaattttcatcgcgcttggagtattattgagttatgtttgtgggtacgaaacttgaatttgtttcagcagatcgagttcacaaaaagacggccattactgggtgatggttctgaactgcaggtg

SEQ ID NO: 4983 - DNA, 202 bp, Zea mays
  Clone ID: LIB143-058-Q1-E1-F2
ccaattctctatagtgagtcgtattacctgagcctccagcgaccggctccaccaccatctgcgcgcttcgcgcgcgcgcaagggaccggtgtggcatctgaggctccattgacctcttagcgggtgtattagcaatagtgacagccctggtgcctgtgtgcgccgatgcccatggccattgtctctatacatcctctagctc

SEQ ID NO: 4984 - DNA, 424 bp, Zea mays
  unsure at all n locations
  Clone ID: LIB143-058-Q1-E1-F3
gggccgacccacgcgtccagcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtgaagatgcccttaaggaangaatgggcggtggaggatcccatgttgatccatttgacatcttctcatcattttttggaccctcttttggaggangaggtggaagcagcaggggaagaaggcaaangangggagaagatgtagttcacccacttaaagtttctctggaagatctttaca

SEQ ID NO: 4985 - DNA, 220 bp, Zea mays
  Clone ID: LIB143-058-Q1-E1-F5
tcactctcagctggtcgctcactcttgcagctccacccttcactcagtcttaggctcttagctctaggctctagctagccgcgccactccggcgtgtagccatcagccttctcatcgccatcaatggccactgccgaggtccagaccccgaccgtcgtggcggctgaagaagcgcacgtggtggtgagaccgctgcaggatgtcgtgcccgatgagtttg

SEQ ID NO: 4986 - DNA, 285 bp, Zea mays
  Clone ID: LIB143-058-Q1-E1-G7
tttctattactacatcctatagtgagtcgtattaacaggagtaacaggccatcgccttaccagttctggtcccagatcacttaaggagtacgtgccgcgtgctcatcactcagccccaggggaggggagttcaagaacggccgcgtttctgcaacgaacatctattccctgtgcatggcgacgccccgctccgacccgcttaaatgggggaaggctggcgccgatctgatgggcatccaactgtacgaagtcaagcggatcgtggcgtagtatcggcatcccttg

SEQ ID NO: 4987 - DNA, 366 bp, Zea mays
  Clone ID: LIB143-058-Q1-E1-H11
cggcggtctcaaccccaggcgagctcggctccggtcacccgtcgatccacgcaaccatgtcgaggaggaagaccagggagcccaaggaggagaacgttacccttggacccactgtccgtgaaggagagtttgtctttggtgttgctcacatctttgcatccttcaatgacaccttcattcatgtcactgatttgtctgggagggaaactttggttcggatcactggtggcatgaaggttaaggctgatcgtgatgagtcgtctccttatgctgctatgcttgctgctcaagatgttgcacagcgttgcaaggagctcggtatcaccgcgctgcacattaagcttcgtgcaactggagggaacaaga

SEQ ID NO: 4988 - DNA, 74 bp, Zea mays
  Clone ID: LIB143-058-Q1-E1-H4
ccacgcgtccactgatgctgttgctattgtctaccgcagtaggaaccaaagggcagccgctctacaggatccat

SEQ ID NO: 4989 - DNA, 366 bp, Zea mays
  Clone ID: LIB143-059-Q1-E1-C5
tgcaacaccctatagtgagtcgtactaccccgccattaacgtcaacgattccgtcaccaacagcaattttgataacctgtatggttgccgccactcactccctgatggtctgatgagggccaccgacgttatgatccccggtaaggttgccgtggactgcggatacggtgatgttggcaagggttgtgccgctgcactcatgcaggctggtgcccgtgtcagtgtgacggagatcgaccccatctgcgccctccaggctctgatggaaggtcttcaggtccttcccttggaggacgttgtctcggaagctgacatcttcgtgaccaccactggcaacaaggatatcatcatggttgaccacatgag

SEQ ID NO: 4990 - DNA, 269 bp, Zea mays
  Clone ID: LIB143-059-Q1-E1-C6
tgagtcgtattactcgaccgagaagttttacttccaagctgaggtttccagactcatgggcatcatcatcaattcactctatagcaagagtgatatcgtcctgagggagctcatatgtaatgcctctgatgctggataagattaggttcctttcccttactgataacgaagttctgggtgaaagggacactgcagagcttgagattcagattaagttggacatatagaagaaaatcctctccattcgggatacgggtattggtatgacc

SEQ ID NO: 4991 - DNA, 60 bp, Zea mays
  Clone ID: LIB143-059-Q1-E1-C9
cgaccgccggatcatatcacccgttgggctagcctgcgaccattcgcgcgtggcgttcgt

SEQ ID NO: 4992 - DNA, 170 bp, Zea mays
  Clone ID: LIB143-059-Q1-E1-D10
acacgactctatagtgactcgtattaatgtgacatacatactgtgctagcgccggaagccggaagcatcggtgacgaagccttccgtgtcatcactcagtcaggatctcatggggatgggtcggttcgcgggctttgggaatcagccgatgtgacgaagatgctcatcga

SEQ ID NO: 4993 - DNA, 86 bp, Zea mays
  Clone ID: LIB143-059-Q1-E1-H10
gtgagtcgtattaacctgttcgccggggcgaccctagtagtcgccaccaccgcgcacgagcacctatactatggctcccacctcca

SEQ ID NO: 4994 - DNA, 92 bp, Zea mays
  Clone ID: LIB143-060-Q1-E1-E4
ggtgtgggttttttttttttttttttttttttttgggttcttttttgtcttttatgttttcgcgttggtttctttgcttgtagtgttgtttg

SEQ ID NO: 4995 - DNA, 62 bp, Zea mays
  unsure at all n locations
  Clone ID: LIB143-060-Q1-E1-G3
gacccacgcngtccgagaaaaaaaaaaaaaaacaaaaaggcggccgctctacaagaataaat

SEQ ID NO: 4996 - DNA, 294 bp, Zea mays
  Clone ID: LIB143-060-Q1-E1-H11
tgtgctgtgtcatcaatgtggttctggctgacacagttgagaacgtcgtggtgtctgatctcgttgtggactcaccgtgctgtcttctcacgggtcactacggctagaccgctcccatggataggatcatcaacgcacaggccttcacggactcgggtatagaggtctagatgtcttcacactaggcaatggccatcaacccatagaatcctatcgtcactgagctgccgaagcttgcccacgctgacatcagtgacaagcctgtctgggatcacgtgatgctgctgttccata

SEQ ID NO: 4997 - DNA, 374 bp, Zea mays
  unsure at all n locations
  Clone ID: LIB143-062-Q1-E1-E1
tatactgagtcgtattagcaggctagcagcacagcagcagccagagccatcccctctcctcgctacgcttcgcttcctcggcgccgattcctcctcctcctcctccaccctcgtccgtcncgttccggcgcgcgagctcgcccgagatggcgaacgcgagatcgggtgtcgctgtgaacgatgagtgcatgctgaagtttggcgagctgcagtcgaagaggctgcaccgcttcataactttcaagatggacgacaagttcaaggagatagttgtggaccaggtcggggatcgcgctaccagctacgatgacttcacaaacagcctccctgagaatgactgccgatacgcgatctatgatttcgactttgttact

SEQ ID NO: 4998 - DNA, 361 bp, Zea mays
  Clone ID: LIB143-062-Q1-E1-F6
atagtgagtcgtattatggcagaccacagcaagaagcgtagtcgtcgccggaaggaaaggcgcggagcaagatgtcgtgggaggcgtacgtcgatgagcacctgaggtgcgagatcgaaggacaacatctcagcgccgccgccatcgtcggtcacgacggcagcgcgtgggcgcagtcagagagcttccccgagttaaagcctgatgaggttgctggtatcatacaggactttgatgaacctgatgcgcctgcaccaactggtcttttcgtaggaagtactcagtacatggggatccacggtgaaactgcagttgtcatccgaggaaagaagggcactgggggcattactatcagcagaac

SEQ ID NO: 4999 - DNA, 368 bp, Zea mays
  Clone ID: LIB143-062-Q1-E1-F7
atagtgagtcgtattaaacgcggcgacctcaggaaccggatcgggctcggaaggatcggcgcggagcaggatctcgtgtcaggcgttcgtcaaggaggacctgaggtgcgagatcgacggacaccatcgcagcgccgccgccagcatcggtcacgacggcagcgcttgggcgcagtccgagagctgcgccgacttcgagcctgaggaggttgctggtatcatagaggactttgatgaacctggtagtcttgcaccagctggtcttttcgttggaggtacagagtacatggagatccaaggtgaacctggagttgtcagccgaggaaagagaggcactgggggcattacgatcaggagaggcggcaggt

SEQ ID NO: 5000 - DNA, 360 bp, Zea mays
  Clone ID: LIB143-062-Q1-E1-F8
agtgagtcgtattaacgacgccaacgacagagaagagagtccatctgctcgttgccttgattttgtggaacgaagcgatggctcgcagcggcgccatggtttcctgcatgctgctcctggtggtggcgcaactgctcatggtgatggccacgcagacagcggcggcggcgggcgaccaacgcggagctggacgccggctgctgtggcaggtgacctgccactacagcgcctgtaactgccgcacttgcccgacatatggctgggcgtgctgcagcacttgctgctagctagctagctagtgtgagttcttccgcgcgcgcgcagccttttgcacacgcctcatgcttagctcatgcatgt

SEQ ID NO: 5001 - DNA, 348 bp, Zea mays
  Clone ID: LIB143-062-Q1-E1-G1
acaccctatagagagtcgtattaatcgcgagcggcgcccttttttttttttttttttttttttttttttttttttttttttttttttttttttttttttgggccatccaacaaccagggccacgctaaactttttgtacacaagcaggatcattttaaatcttgagaagatataggtcaaaaacagccgctacatgacgacagccaccaccatgagcaaccggtgctccggatcagtaccaaaaccatgacaaccacagtctagaactagagttcttcaatgtttcgacaggtctggcgaaccacagacacagcgatgttttttcatgggtccttattgtgccctttc

SEQ ID NO: 5002 - DNA, 411 bp, Zea mays
  Clone ID: LIB143-062-Q1-E1-G6
atagtgagtcgtattactcgcggcgccctcttattatgtcttccttcgggttatggttcctttatggttttgttggatgggtatttgtgttggtccagtgaagtaccgttgccacgccagaggatttgcatgcgcgaagggtaactagtcaccggagaaagacatcggtcaatacagccagatacactactccagcgacaaccatgagcagacagatgctcaggttcacggcaatcacattcgtaagactcacgagaacgaaagttctgcactagtccaacaagaccggcaaacgaaaggcacacggatgttttatcatggttgcttaatgggccctttcgggcacgatcagcatcctcctgcacgacgccgctgtccaactctgctccaaaagccggcgggacttggggg

SEQ ID NO: 5003 - DNA, 353 bp, Zea mays
  Clone ID: LIB143-062-Q1-E1-H2
acacacaatagtgagtcgtatgagcgcatctaggctcaagcgcctcaggcgtcagctcaccaccacgagacagacgacagaaagatggacgagatgggagctctcagtggtgggggaacccgccgggcctgaaccccgtctggggggaaggcaaggtcgttcaaagcttcggggggctcaaggcctacctttccgggcccgaggactccaaggccgccgtcgtcctcgtcgccgaactcgtccgattcgaagcgccgattatgaagaacatagccgataaggttgcttcgtcagggtacgttgttggggtagcagatttgtttcatggggatccttatgcacctgagaatgtt

SEQ ID NO: 5004 - DNA, 337 bp, Zea mays
  unsure at all n locations
  Clone ID: LIB143-062-Q1-E1-H4
accatatttccgaagaaaccctggaaaccaacgaatttcggttggttgaaaccaataaacctaccggcaacctccaacattgtcccccttaaggccaacaaactttttcaaccccttctcgatggacctctgggaccccttcgacaccatgttccgctccatcgtcccgtcggcgacctccaccaactctgagactgccgccttcgccagcgcccgcatcgactggaaggagacgcccgangcgcatgtgttcaaggccgacctccccggcgtcaagaaggangaggtcaaggtcgaggtcgaagacggcaacgtgctggtcatcagcggccagcgc

SEQ ID NO: 5005 - DNA, 372 bp, Zea mays
  Clone ID: LIB143-062-Q1-E1-H6
caacacccaatagtgagtcgtattaaacgtcagacgtcagccagcagttcgaaaccaaggattgatccaggagcttccggaaggcgaggcgcgcgcgcagcgtcgaggtgctggtgcgggtgccgcccatggatcgggctcgcggatccgcgttcctgctcggcgtcctgctcgcaggatccttgttcgcgttttcagttgccaaagaggagaccaagaagctcgggaccgtgatcggtatcgatctcggtaccatctactcctgtgtcggtgtgtacaagaacggtcatgtcgagatcatcgccaatgaccagggtaaccgtatcacaccctcatgggttgccttcaccgataccgagaggctcatcggtg

SEQ ID NO: 5006 - DNA, 333 bp, Zea mays
  Clone ID: LIB143-063-Q1-E1-A1
tagtgagtcgtattagcctcctacatgacggtgagtgctttgactctcgtcctcgtcatcctttggggtacaagagacgaggggaagaacccttgaagagatacagtggcccttccagtgagctccggcattcatatgtacatgcaaatagcgtggcaaatcctccaggatcccaataaaagatatagtgaaatatagcacaagctatttcatttagcattttttatagtttaaatggaatttcgctgccgattctgcatgagaacatgtaaataaggagatttcacgaacatgaacactcaaatacatgtacaggcctgtaaaagaagatgt

SEQ ID NO: 5007 - DNA, 400 bp, Zea mays
  Clone ID: LIB143-063-Q1-E1-A9
gggacgatgcaaccccctaaagtgagtcgtattaggagcaggtagctcggcatcagggatggcctccacgtcctccatcctacttgcaacggatatgctggttgcgctgtttgcggttggtttgtgcaccaccccgctcaccttccacgttggcaagggatccaagcctggccacctgatcctcacccccaatgttgcaaccatatctgacgtggagatcacagagcacggaggcgatgacttctcctttacgctcaaggagggcccgaccggcacctggacgctcgacaccatggccccgctcaagtaccccctttgcatccgctttgctgtcaattccggtggctaccgcatctccgacgacgtcatccccgccgatttcaaagccggcaccacctat

SEQ ID NO: 5008 - DNA, 193 bp, Zea mays
  Clone ID: LIB143-063-Q1-E1-B1
cctatagtgagtctataacgctatcagaacatattgccaatcactcttgcttcagtgagttctgtttgttggacgctagagctatctgctatcgtctacggggtggtcgtgaggcgcagggtgtgttcgatcccttctcgatggatctctgggacgctgtcgagactatgttccactccatcgtcgcgtgggt

SEQ ID NO: 5009 - DNA, 95 bp, Zea mays
  Clone ID: LIB143-063-Q1-E1-D5
tacaatactctatagtgagtcgtattacgccgcccaacccaagaccgatggcgcccaatgccgacaagaatcccccggtgaatattccttccgct

SEQ ID NO: 5010 - DNA, 337 bp, Zea mays
  Clone ID: LIB143-063-Q1-E1-D8
tacacgactctatagtgagtcgcaataccggccaacagctcgtgatctgagattgctcttacagacgtgagtcgtgtccatggagttgtattgattgtattggcgttggctatcaaatcggtcaatatgtctgctaatcactagtcagtggagcttgaccagacctatatctgacagtagatctacgtggctgtaatcgtcaaggcacaaggtaaacggctgccgcatctatacgatacattcatacgtacgcttgcaccagacatcaccactcttccatcatgtcacgcatctttaattcactggctgtcattgcactaagtcgtgacttcgagaa

SEQ ID NO: 5011 - DNA, 193 bp, Zea mays
  Clone ID: LIB143-063-Q1-E1-G5
agagagacttgccgtacaagaggattaacacgacttcgtagatatacactggcaccatgccacctgctgtggagcatcgtgccaggaggtgctcccgagatccagttgttgtgacagatggtacagctgggaacgccactgatctcatcacccagaatgtcataatggtcgaacgagtcagacaaagatgcca

SEQ ID NO: 5012 - DNA, 202 bp, Zea mays
  Clone ID: LIB143-063-Q1-E1-G6
agtgagtcgtattaagtgacgctagccgttctaaactcgcatctcaggatcataattagatgcaagttctcctccatcaagtctctaggacagcttcacgagggcggggccagcctcaccggagtcatcaccatcgctggctcctgcgcatccgtctccggttcgccgaagagctactacatgtcgttgtcggagtcgcaca

SEQ ID NO: 5013 - DNA, 372 bp, Zea mays
  Clone ID: LIB143-064-Q1-E1-A2
tatagtgagtcgtattagatccgtccaggcaaccaacaagcaagttgccccgccgcgcagaggaagaagagagcagaggacgatggctcgtacgaagcagaccgcccgcaagtccacgggaggcaaggccccccgcaagcagctcgccaccaaggcggcgaggaagtcggcgccgacgaccggcggcgtgaagaagccccacaggtacaggcccggaaccgtggcactgcgcgagatccgcaagtaccagaagagcacggagctgctgatccgcaagctgcccttccagcgcctggtgcgcgagatcgcgcaggacttcaagacagacctccggttccagagccacgccgtgctggcgctccaggagggcgc

SEQ ID NO: 5014 - DNA, 386 bp, Zea mays
  Clone ID: LIB143-064-Q1-E1-B8
cgctctctctctcctagtccccttctatcgtggcatcgacgagcgacagtcgctgccgccctacggcaggtgcccaggtcttcttcggtcccttcgccgtcgacgagcactaccaggaacttgatcttataatacatacttcaatatgttctctgctccaggcaacagttctatggctcttgtagccccacggccagggatggagctggctaatattcaacatcatccaaatcaggctcctgggcctggaggaaaacaacgcagatctagcctggaggcaccaataatgctacttacaggtcaccagagtgctatctactgcatgaaattcaatcctgcgggaactgtgatagcatcaggttcccatgacaaggatatcttcctat

SEQ ID NO: 5015 - DNA, 156 bp, Zea mays
  unsure at all n locations
  Clone ID: LIB143-064-Q1-E1-C12
tagtgagtcgtattaaccgtncggttctgcntctaaacccagccaacggtagtttggcaggttctaaggggcctatctgcaccaggcaaggaaaatgaggaactacgaggggggcagccgcagcgaacacggactccggaagacgggcggcgctgg

SEQ ID NO: 5016 - DNA, 450 bp, Zea mays
  Clone ID: LIB143-064-Q1-E1-C8
tcgtaggacgttacaagcctctacagtgagtcgtattatatccgacgccacacgaaacgaaacacaagagaagagaatagagagaaggtcggagggctagacccggtcccccaattccaattcgcccctctcgcggccggcctcgcgagacgccgattcggatcccatctcctgctcagagcctcgattcgaccggcgggggcgactattcgaccgggtcggtacccaggcagaggcagcggaaggagaggatgagcttccatgacctggaggcggggcacgtccggggggcgccgctcggcggcggccggaggaacggcacgggccccgcgggggcggggggcgcctgcgccggcgcgtctcaggccgtggcgtcgggcatcgtccaaatcaacaccccggttgccacgtcccagcgcctcgtcaacacgctcggcacgcccaaggata

SEQ ID NO: 5017 - DNA, 360 bp, Zea mays
  Clone ID: LIB143-064-Q1-E1-F10
atcccttcagctccagcttcagatggctggtcatgggggaaaggaaatgtcacgagtggatcctcgtgagctgcagaattcatcattacatgacggctgacactgcccagttgcctccgttgcgcgcctccggccagcagcaccggcaatttcagataactcaagccaatctccagagacaatctaacgtcgagtcggatttcttgagccagatgcagaacttgcactcttctgagccgcctcagaactttctcaggccaccgaaattgcaactttatacaccggattagacgggtggcctatgcagcacgagccacaacactggatggatttctgggagttcctcgtataacttcatgg

SEQ ID NO: 5018 - DNA, 350 bp, Zea mays
  Clone ID: LIB143-064-Q1-E1-F7
attcgatcgttccggctcatcatcctagtctgggagttcgctgatgtcgccgacaccgagcctgacactgtgcaggtaatagatgcccctccgctccgtatcgtgctgaaaggtggcgccaccgccacgaggatcactgtgtcgatcgttgcatggacaacacgtgttacggacacgtacaactggtgtgtacctttgcactaccttctcatggatcacgatacacactgggcgggacggagctttacgctgacctgatgcgcgaggcgtacccccagctttaaccttctccaggcatggcacgtgtatagcactaggacatgcgttgtctcccgcaatctcaatgcagc

SEQ ID NO: 5019 - DNA, 107 bp, Zea mays
  Clone ID: LIB143-064-Q1-E1-G7
tattacattacaacagcctatagtgagtcgtattaaactcgcaccgttctttgcattccttcgtccccaccttggctcatcacaacggatcagctccacggtgccgg

SEQ ID NO: 5020 - DNA, 233 bp, Zea mays
  Clone ID: LIB143-064-Q1-E1-G8
ttctgcctccgttctttgcttccttcgtccccccttggctcatcgcgcggctgctgctccccggtgcctgtgctgtccgccggctcgcgttggcggtgtctgccggatcaacgtcccggggcacgggggtcttacctccggtgtgcgcgtcctccctggttggcgcgccgctctctgtcgcccccctcccgcggtcgcgcttggcggcctgctgtacggcgtcgcctcttgcc

SEQ ID NO: 5021 - DNA, 406 bp, Zea mays
  unsure at all n locations
  Clone ID: LIB143-064-Q1-E1-H2
attccagaggccctatagtgagtcaaattatgttgttataactgacaattgtttccaagtggttctaacatcggtgctgtccatggatgcggtgaagttggctgcacaaagtcctgctctgagaaagacttaatctacatgactttactgttcccgagttgcggtatcaggacacataccattcgtttaaggaccagcctaacacctccacatcattctggacggacgttcaactctaggaacttacgacttgttctgcgcttacactttatcatacacttactatgcagacaatttgcgtgagatcactacanactgtagagtgtactttaggcaaactcctgtcacttgaatagttgggagagtatccagctctctctgtatgactgcacatctcagtgcattt

SEQ ID NO: 5022 - DNA, 391 bp, Zea mays
  Clone ID: LIB143-065-Q1-E1-A11
acacctatagtgagtcgtattaaactccgggtctcggcagggcccgctccagttctccagggcaggtatggccgtcggtggcggcgacgacagcagcagcagcgacgacgaggaggacgacgacaagtcggaggatggctacagcctgaaatgcgtgtgaggctgaggcaggctgcgtttgcggaagatcggatgagagtgtagagagatagcgttgtcgcggcttgagcatgcatcggtggattcttgagtctgtccgagagagtggttgtagtgcatgcaggcatgtatacagggagattaggcccgcgcggcccgtgtgcgcccaagagatgaactgatcatgcggcgtttggaaaggcgataggccttttgtttgagtccttgctga

SEQ ID NO: 5023 - DNA, 310 bp, Zea mays
  Clone ID: LIB143-065-Q1-E1-A12
atagtgagtcgtatgtattggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcacaggtcccgcggcttctgcttcgtcatcgtctccacggaggaggccatgcgcaacgccatcgagggcatgatcggc

SEQ ID NO: 5024 - DNA, 66 bp, Zea mays
  Clone ID: LIB143-065-Q1-E1-A5
tttgtttttttttttaaggttgagctcatcgcgttcaatttcgagtgcgctaggccacagttcgac

SEQ ID NO: 5025 - DNA, 233 bp, Zea mays
  unsure at all n locations
  Clone ID: LIB143-065-Q1-E1-A7
atcnccgccgccgcaggcggtcacccatcgccaccaagatgcagatctttgtgaagactctgacggggaagacgatcactttggaggtggggtcgtcggacaccattgagaatgtgaaggcgaagatccacgacaaggagggcatccccgcggaccagcagcggctcatcttcgccggcaagcagctcgacgacggtcggaccctcgcgggcgacaccattcacaaggagtcg

SEQ ID NO: 5026 - DNA, 355 bp, Zea mays
  Clone ID: LIB143-065-Q1-E1-B5
tcgcagcagcgaagtgtcgaagcggcggcatggcggagagcaaggcgcgtgtcgcgctgttcctggcggcgctcgcggcggcgagcctgctggcgctggccccggccggcgccgcgacgacgtgcgcgccgacgcagctgaccccgtgcgcgcccgccatcgtcgggaacgcggcgcccaccgcggcgtgctgcgccaggctcatcgcgcactcggcgacctgcttctgccagtacatgaggaaccccagcatgcagcgctacgtcaactcccccaacggcaagatggtcttcgccgcctgtaaggtgtccctgcccaggtgctgatgctgagtgagtcgtctgccggcccatca

SEQ ID NO: 5027 - DNA, 256 bp, Zea mays
  Clone ID: LIB143-065-Q1-E1-C3
cggcgcccaagacgtctagcatcgggtcgtcgcgaatgtcctagagttgcattactgcttggctgcgtgcgatgtccccattcgcgcgaaggcgagggttgttgacgtggccaccgacggtacacgttgtgatcgggttggaggtgtgccggcacggtggcctgcagcgaggtcagcgtcgttcttgacagccagggacgagtctaggggcgcggcggcagtggggaaaccagaagcctgaggctttcggaatgtc

SEQ ID NO: 5028 - DNA, 264 bp, Zea mays
  Clone ID: LIB143-065-Q1-E1-D10
ctacaacggacctcttctttctggagttcccatggagaaaatccgtgccatcactccgagtgttgttgcaaaaatttcttctacaaggagggaattgattctggtaggagccaagactcttgtggttccaggaaacctcgcaattggatgcatcccagactatctgatgagattcaagagcagtaaggaagaagattatgatgcacagacaggttgtcgtaggtggatgaaggagttcgcacagtagcacaacaacgttcttgt

SEQ ID NO: 5029 - DNA, 387 bp, Zea mays
  Clone ID: LIB143-065-Q1-E1-F12
atactctagagtgagtcgtattagagcccgagacgccgccggagtctgcaaccttcagtgtgcactctttgatctccacatatggagttcatctcgcttcaatgcggccactggatgagggtgccgcactgatggcgacatgtcggacgctgaggctaaatccgattcagtatggcttatcgaagtcaccatcggagagcactatgatgttttctggacgattctctcagggctgatacgtgtacattctaagggatttcgtgtatgtagtcgggtactacattacagacgcgtaaggtcaagttcgtttatgtcgagtacctgttgcagaggatcaatatgtacatgaccacctagcacgatatgcagctggctcttgatagctcg

SEQ ID NO: 5030 - DNA, 390 bp, Zea mays
  Clone ID: LIB143-065-Q1-E1-H11
aagtgagtcgtattaaccaggatcggccgctgtcgagtggggggcctcaccgccacccgttcttggcaaacagcacgcgatttagttgaaagtaatgggagatacgtggggcgttgggattctccaactccaaccaagacgaacgatttcatcccactaatcctttttcttttcgtttcgtctttacttttaatttcttgggtcggttcttgatcacctgttcttccttatgaccttatccatgaaattatattatcaggtgcttctatttgtttgtgcatctcttgtttgcgcctgcgatctggaccttttttggctcctcagcataagagaagatgagcctttcttgttggtagttaccacccgtggcgtctcttgttgtgcaggtgc

SEQ ID NO: 5031 - DNA, 119 bp, Zea mays
  Clone ID: LIB143-065-Q1-E1-H5
gtgagtcgtataaattcttcttttttttgtttcacgtcgcgggtcgttcgcgttagatcactacgtcgacaggcaccttggtggactccgtgcgcagatgcggggggggtatcggggtg

SEQ ID NO: 5032 - DNA, 59 bp, Zea mays
  Clone ID: LIB143-066-Q1-E1-B4
cgctgccagtgccggtccagaattagcgggtcgacgcacgcgtccgagctctacaagga

SEQ ID NO: 5033 - DNA, 181 bp, Zea mays
  Clone ID: LIB143-066-Q1-E1-B9
ggatacggagctcgctccgttcttttttgtaatcgccgagatggaaattgtatgacaacccttcttgttccacgcatagcatcctgagaggtgactgtgtcacttttcctgtccggtaaagtggcagttatgatggcgcaatatgaagaaaaaaggagggtgctctagacgatggaagctt

SEQ ID NO: 5034 - DNA, 415 bp, Zea mays
  Clone ID: LIB143-066-Q1-E1-E2
caaaaagcgccaggagcttaagaacatggcgaacaggggcttgcatctggctctgttcctcgtccttctcgggctgtcgtccaatttggcagccgggcagatcctgttccagggcttcaactgggagtcgtggaagcagaacgggggatggtacaacttcctgatgggcaaggtggacgacatcgccgaggccggcatcacgcacgtctggctccctccggcgtcacactctctcgccgagcaaggctacctgccggggcgcctgtacgaccttgacgcgtccaagtacggcaacgaggcgcagctcaagtccctgatcgaggcgttccacagcaagggcgtgaaggtcatcgccgacatcgtcatcaaccaccgcacggcggagcaccaggacgggcgcggcatctactgcatc

SEQ ID NO: 5035 - DNA, 211 bp, Zea mays
  Clone ID: LIB143-066-Q1-E1-F11
aacaccctagagtgagtcgtattataccacttccacatcctgatagtggtggcctacagcgacggcattcgtctctgatcaagccgcaatgcaaagatgcgtatgtcgtcggcggcacccgttccggcggcaactcaacacaccatgtatcatgttgcgtggcgaccgttgtccggagatttggctgagctagcgaccttgccacacctga

SEQ ID NO: 5036 - DNA, 182 bp, Zea mays
  Clone ID: LIB143-067-Q1-E1-C9
ctccctaaagtgagtcgtattacgacgacgggcgaggagggacggttccacgggcctcacaatcagagcaccaacacgaccccgacgggcggccctgtcgctgcagcagcatcgccgcgcagggtccggcgcagcttctcctccgcgtcctccgcgggccacaggcacggcggcggcggcgg

SEQ ID NO: 5037 - DNA, 131 bp, Zea mays
  Clone ID: LIB143-067-Q1-E1-G5
ctcgtcaagttcgtcgagaggcggctcaaggacaacggccacatggtcatcatggtcgccgacggtgctgggcacgacctcatcgcgagatgtatggatttcgaggacgaccaaaacggttctggaaacaa

SEQ ID NO: 5038 - DNA, 399 bp, Zea mays
  unsure at all n locations
  Clone ID: LIB143-067-Q1-E1-H10
taaagtgagtcgtattaangngttgattggttggaagataaatcgggtggtgatgtcggcaagaacaaatcagattaaaactaaggccgaagtantggtaatagaccttggtgccagtgcgtttgctcctgctaaggctgcccctataggtgtacatttgtgctgtgcctaatagaccggcccaaagcacacaatttctggcacggcccatatctggcacggcccaacctaattgtgggcctgggccggcacggcccatattgtgggccgtgcctgggcctcaagtcaagcccacgggccggcctggcacggcccatttaactaaggcccatcgaggcccactaaatatagactcagtatttaactaaggtccgtcaaagcccacatgactaacataac

SEQ ID NO: 5039 - DNA, 277 bp, Zea mays
  unsure at all n locations
  Clone ID: LIB143-067-Q1-E1-H9
acgcgtccgcccacgcgtccggcgcggctttccctctcgtcgctgacatgccgaagcggcaccgcgacagtgagggccggcagcggtcgtcgtcgtcgcggcggcggcgcagcccgtcnccgtccgactcggacgccgcctcctccgattacagcggctccccccgacggagccgtggacgccaccgccatangagccgccgccggagggacactccgtccacctccagcgacgcgagcggcagcgggagcgaggattcgaggtcggactccggacg

SEQ ID NO: 5040 - DNA, 131 bp, Zea mays
  Clone ID: LIB143-068-Q1-E1-D10
tcacatagtctctccactcgagctagctactgtgcgactaccatagttgtaacatcagtttacagctcaagctgcaacatttgggacaatcttgcaccttacggttctcatgcacgctgcgtttggggcct

SEQ ID NO: 5041 - DNA, 96 bp, Zea mays
  Clone ID: LIB143-068-Q1-E1-E2
tcgtattatgggcgctgagcaagtccagtggagagagggagagcggcgagaggatggctgggatggcgtcgctgcatggcgccatggggtcgctct

SEQ ID NO: 5042 - DNA, 291 bp, Zea mays
  Clone ID: LIB143-068-Q1-E1-E7
attccgatacaacatcctatagtgagtcgtattaatagagatcactctccttctccgcgtgaggtagtgacgcccatccatggcaacaatggcactgcgcgccgtggcaacggcgctgctggtggtggcagcctccgtgtgcggcgcgtcggcgtcgactctggtgctgtataatcagtgcggggagacggtgtggtcgggcatcaagccaagcgccggaaatgaggtgctggctcacggcgggctgcagttggcgccggagctgtcgtcagtcagtgcgggtcgcctcgg

SEQ ID NO: 5043 - DNA, 384 bp, Zea mays
  Clone ID: LIB143-068-Q1-E1-E9
caggtcacgaaagcagggaggagctggcgcgcacggccgaggaggggcagaccgtcgtccccggcggcaccggtcgcaagaccctcgaggcgcaggagcacctcgccgaatggcgcagtcacggcgggcagacccggagtgagcagctgggccatgaggggtacagcgagatgggcagcatgggcgggcagacccgcaaatagcagctgggccacgacaggtacagcgagatggggaggaagggcggcctgagcaccatgcaggagtccggcggcgagcgcaccgcccgggagggcatcgagatcgacgagtccaagttcaggaccatgtcccagatctgatgcgtgccgccgcttagcatgtaatacgtagctgccggaaatg

SEQ ID NO: 5044 - DNA, 198 bp, Zea mays
  Clone ID: LIB143-068-Q1-E1-F8
tagtgagtcgtattaaagcttgcgttcgtgtggtacaggtccgcagcaagcggtagagcgagaggtcgagaagattaagagcagcactctgttggcgatgggagttctccaggcccttctggtctctacgggcgtgggcagaggacctggcagggcctagtaagcagtgctggtgcggtgaggtgagcagctggtcgg

SEQ ID NO: 5045 - DNA, 294 bp, Zea mays
  Clone ID: LIB143-068-Q1-E1-G10
tagtgagtcgtattacggggcatctcgtccgcaagggcaccggagggaggtcttctgtgagtggaattgtagccacggtgtttggagctactgggtttcttgggcgctatcttgtgcaacaacttgccaagatggggtctcaagtgcttgtcccattcagaggttgtgaggattctcctcgccacctgaagattatgggtgacttgggtcagattgtgcccatgaaataccatccgagagatgttgattcaattaaggctgttatgggcaagtcaaatgtgggttattaacctc

SEQ ID NO: 5046 - DNA, 244 bp, Zea mays
  Clone ID: LIB143-068-Q1-E1-G12
cgtcgtcctgctccggcgacggccaggcagccgagcagataagagagagccgaggcatcaccagcagcacgtgcctctcttctcagcttgcgtgcctcactgcacccggccacaagggcaggatgcccgcctctgtcgctgtctacccggccaagatggcatgctgtctgcagctccagcatcttcgccgggcgtcgcctgctccactccctgctcgggtcctcttcctcctctcgagcccgcg

SEQ ID NO: 5047 - DNA, 59 bp, Zea mays
  unsure at all n locations
  Clone ID: LIB143-068-Q1-E1-H1
actactcccaatagtaagtcgtattaaccgctnacacagcacatctctctctcgatctc

SEQ ID NO: 5048 - DNA, 94 bp, Zea mays
  Clone ID: LIB143-069-P1-K6-A12
ggtccggacttcccgggtcgacccacgccgtccgaaaaaaaaaaaaaaaaaaaaaataaaaaaaaaaaaaaaagggacggacgatctaaaagga

SEQ ID NO: 5049 - DNA, 504 bp, Zea mays
  unsure at all n locations
  Clone ID: LIB143-069-P1-K6-F3
cgggccgacttccgggtcgcccacgcgtccgccacgcgtccgggacgcgtggtctagatcggcgggcggccgctcgcgactagaactagtgtcnatctcgagccgagctaggacagttcagagagaagaaagagaccgagatctcgccgatagctagcatcatggcgtccaaggcgctcctcgtgctaacgctcctgcgtgggggcaccttcctcgccgcctncgctaacgagcaagccaaggcggccaaagaggagaagaagggggaggtccaagactggcacggcggcggcggctacccgggtcacggcggcggcggcggcggcngctacccgcactgccnggggggctgctgcaaccgcgggtaccatggcggctgccggtgctgctcgcaccctgatcagataccagagcccatggaccgtcctgagctcgtcgaggtccacactaaatagtatacgggtacgtatgccccgatgggaatgaatggggaagcaagagcac

SEQ ID NO: 5050 - DNA, 309 bp, Zea mays
  unsure at all n locations
  Clone ID: LIB143-069-P1-K6-H12
cccgnnacccgggagacggggngaccaccggcganccggcgcgggagggcaccanganncagncagcaccgcngangcngcnggcngacccnganngaggcgngnccgnacaacnggcggaancaaggccccncggggccanggggncncngnggaggaggccgangggaaagangaacnganggcccgccnccgcncgccgggggaacaacngaaccgngangncagccngacggggacgaaagaagaacnggcgcnccgngnggcagagcngaaagaggagcnngangacacgaggccnaagcnngg

SEQ ID NO: 5051 - DNA, 390 bp, Zea mays
  unsure at all n locations
  Clone ID: LIB143-070-P1-K6-B10
gaagagccgcgagcagcgcgcccaggccgcggagcagaaggcggccgaccagcngcacgcgncaaggcaggacagagcccccgaggaggcgcccgacggcgggggcaggaacnagcagcanccggggcagcccgcaggaggggaaggccaacgccacgggcgaggcggacgccgccangggcaaggccagcgagacgaaggacgcggcggcggacaaggcgggcggcgacagggacagcggcggcggacaggacgggaaanaanaaggcggcggccgccgagncaaacgaggacgggaagccaagggagaaggcggcggaccagangacggggcaggcgnncaacgacgaccgaacgaggggggaggagggcaccggcgcaccgcggaga

SEQ ID NO: 5052 - DNA, 308 bp, Zea mays
  unsure at all n locations
  Clone ID: LIB143-070-P1-K6-B9
cccgaacccgaaaaacggggggaccaccggcganccggcgcgggagggcaccanganncagccagcaccgcggacgccgccggcagacccngangagcccgngnccgcacaaccggcgnaancagggccncccggggccacggccncncggaggaggagggcgggacgaaagangaacnganngcccgccnccgcncgccgggagaacaacngaaccgngacgncagccngacggggacgaaagaagaaccggcgcgccgngnggcagagcngaaagaggagccngacgacacgaggccnaagccngg

SEQ ID NO: 5053 - DNA, 169 bp, Zea mays
  unsure at all n locations
  Clone ID: LIB143-070-P1-K6-C12
acaccacaggggcacccgggacaacacgcaccacacgcgaggaagacacaaggnccgccagccacccaacgcagccgggaaccggaaggccacaccagccgcagacaggngncccacccaagcagcnggcngacccaacgcagaccggggggcaagcagcacnggcaaa

SEQ ID NO: 5054 - DNA, 323 bp, Zea mays
  unsure at all n locations
  Clone ID: LIB143-070-P1-K6-C7
ccacgcgacgcncaaactgccgggcccgccacccgaaacacggggagaccaccggcgacccggttcgtgagggcaccatgattcagccagcaccgccgaggcggcaggctgaccaagaggagttcgtgcaccaacaaccgccggaaacagggcccttcggggccaggcgagctctgcggaggaggggggggcgaaagaccaaccgagtgcccgcctccggtcgatgggtgaacaacggaaccgagctgccagcccgacggggacgaaagaagaacaggcgcaccgcgcggcagagctgaaggaggagctagaggacgcgaggc

SEQ ID NO: 5055 - DNA, 471 bp, Zea mays
  unsure at all n locations
  Clone ID: LIB143-070-P1-K6-D11
gcacaacgcgaacgcatgatcgccacagcccgacacccggaagacagggagacgcaccggcgaaccggcgcgggagcgcaccaggaaacagccagcaccgcagaagctgcaggctgaccccgaagagaacacgcccgaacaacgggcgcaagcagggccctacggggccaagganactcagaggaggagggggggacgaaagangaacagcangcccgccgacgggcgcggggagaacaacngaaccgngagggcagcccgacggggaccaaagaagaaccggcgcnccggggggcacagcggaaagaggagcnagacgacacgaggcccaagccnggcacaggccggcgncngacaacggcgngaccgggaaaacccngacgagacccaacccaagcgccgggcaacacacccccgccncgacagcgggcggaacagcgaagaggcccgcaccggacggcccccccaaca

SEQ ID NO: 5056 - DNA, 636 bp, Zea mays
  unsure at all n locations
  Clone ID: LIB143-070-P1-K6-E8
gggccggacttcccgggatagttcgtcatctccaagtgcgtgcgccggccgccccctatcccgccggccctgtgtgtgttccccgctaccagccatggcgtcgccgttctccgtgccttcgctgatcatggaggaggaagggcggttcgaggcggaggtggcggaggtggagtcgtggtggggcacggagcggttccggctcaccaagcgcccctacaccgcccgcgacgtggtcctcctccggggcacgctccggcagagctacgcgtcgggggagatggccaagaagctgtggcgcacgctcaaggcgcaccaggccggcggcaccgcctcccgcaccttcggcgcgctcgaccccgtccaggtcaccatgatggccaagcacctggacaccatctacgtctccgggtggcagtgctcgtccacgcacacctncaccaacgagcccggcccggacctcgccgactacccctacgacaccgtgcccaacaaggtggagcacctcttcttcgcgcagatctaccacgaccgcaagcagcgggaggcgcgcatgtcgctgccccgcgccgagcgcgcgcgggcgccgtacgtcgacttcctcaagcccatcatcgccgacggcgacacgggcttcgg

SEQ ID NO: 5057 - DNA, 71 bp, Zea mays
  Clone ID: LIB143-070-P1-K6-F5
cccgggtcgacccacgcgtccgaaaaaattaaaaacataatacactagcaacagggaaagcataaacaaag

SEQ ID NO: 5058 - DNA, 461 bp, Zea mays
  unsure at all n locations
  Clone ID: LIB143-070-P1-K6-G10
gcacaacgcgaaggcaggaactccngagccgcgcacccgaaaaacagggngaccaccggcganccggcgcgggaggggagccacgagcagccagcaccggggaagcagcnggcagacccngangagaacagagaccgaacaacaggcgaaaacaaggcccancggggccagggggccncngcggaggaggcgggggggaaagangaaccgancgcccgccnccgcncgcngggggaacaacagaaccgagangacaggccgacggggaccaaagaagaaccggcgcaacccggggcagagccgaaagaggagcccgangacaccaggccnaagcngggcaccggccgnagannaacaaacgccngaccgggaaaacccnggcgcaacccaacnnaagcgacgggcaacacagcccccccgcggcagggggcaaaaaagccaagaggcccgcaccgaacgcc

SEQ ID NO: 5059 - DNA, 651 bp, Zea mays
  unsure at all n locations
  Clone ID: LIB143-069-P1-K6-A11
gcgaaccggccagaaaaaaacacaaagtagtcctccatttcgaatcgcgctcatagtcacagggctttagcagagatggcgggcaacaagggagagggcccggcgatcggcatcgacctcggcacgacctactcctgcgtcggggtctggcagcatgaccgggtggagattatcgccaacgaccagggcaaccgcaccacgccgtcgtacgtggcgttcaccgacaccgagaggctcatcggcgacgccgccaagaaccaggtcgccatgaatcccaccaacaccgtcttcgatgccaagcgactcatcggccggcgcttctcggacccgtctgtgcaggcggacatgaagatgtggccattcaaggtcgtcccaggccccgccgacaagccaatgatcgtggtgacttacaagggcgaggagaagaagttctcggccgaggagatctcctccatggtgctcaccaagatgaaggagatcgccgaggcctacctcagcaccaccatcaagaacgccgtcattaccgtgccggcctacttcaatgactcgcagcgccaggccaccaaggacgccggcgtcattgccggcctcaacgtcacgcgcatcatcaacgagcccacggccgccgncatcgcctacggactcgacaag

SEQ ID NO: 5060 - DNA, 624 bp, Zea mays
  Clone ID: LIB143-069-P1-K6-A2
ctggacgctgtgggccctgtcacacacactacactcgcaattcatccgcagtcacaagctcggctgctgctcccgctaacggttgaggcgttgctggtgcacacaggaagggaagggaagggagagctgcacacagctttgctctggctcttggctcccctgtccagctgtcctgtgcggcatcatggaggaaacgcccagcccgcagctctagccgccgtcaatctcgtctcgtatcggagtcgaaggaagtaagaggcgggatggcatgaagcgacctaccaagaatgagaggctgggcaacccccggcacaagtaggaggaagaacccgagcaaccgagccacagggaggaggaggagatgggcaactgcggcacacgggaggagaatgccgtcgtcgctgcgcacgcgcaagttcagcaactccacttgttacaacagccttccaagaacgccaatgcagataggaagcacacctgcatgtcatcagatataagtgacccttccacacctaggaaagttgaagatgccaagaacatttccatatacaacgatgtgattgccttcacattgtttgagctagagacaatcacaagagcttccgtgttgattatgttcttggc

SEQ ID NO: 5061 - DNA, 446 bp, Zea mays
  unsure at all n locations
  Clone ID: LIB143-069-P1-K6-A4
cggacgctgtggcggacgcgtgggcggacgcgtggggactagttctagatcgcgggcggccgccctttttttttttttttttgctgctggaatggaagcattctttttggttcgttttccattgcattattacacacagctggatacatgggcttgatgaagcccggccggccgtgaggtgttttagcccgcccacagatgcaactagataccgaaataaaaagggtaaacaacatgatcgatcgatttattatgacacaaacacgtacaaacatgcatttatgatcgactctcgatccatgatcattacgggaagacctcgatgatggacgggatgcctcgggtgtgcgtgatcttgtagtcacggaacccagccgccaggaagatccttctccactcgtgctcctcccgctccgccccgttcacaaagctcantatgtggagat

SEQ ID NO: 5062 - DNA, 630 bp, Zea mays
  Clone ID: LIB143-069-P1-K6-A5
gttctttaaagaacacccctccagtcaggccgtcccgcgccgacgtcaacggagacgtgtcaacggcggcggtgagaagacccataaccttctagatttttttccgctgcctcaatggatctctgggagagggcccgggccttcgccggcgaggcggcgaagcggtcgcaggaactgtgggcggaggcggccaagcgctcgtcggcgctggtctcggagacggcgaagaagtccaaggagatcttctccgaaaccgcctccaagtcgcgggagatcgccgctgaggccaccaagcaggccgacctcctcgccggccagatcaagcacctcgcctccgacctccctgtgccttcgatcccgcccatccccgcgatcccgcctatccccgccgctgcctcgtcggtgcccgacgcggccgagcttgagtgctacggcatcaccgacgacctccgcgagttcgtcaagggcatgaccataaacaccttccgcgacttcccactgcaagatgagcctgaggtgtctgatgtgccaactgtgtcgaatgtgcgtcaggatctgaacgagtggcaggccagacacggcacacttgtcctttcggcagtcaaggaatatcaaagttcagatatgagc

SEQ ID NO: 5063 - DNA, 648 bp, Zea mays
  unsure at all n locations
  Clone ID: LIB143-069-P1-K6-A7
gcgttcttcggcttcattgtcacaaggttcgagttcgtcaccgtctagtacgactgtgcgagggaggaagaggcgaggagaagatgcagatcttcgtgaagaccctgacggggaagaccatcaccctcgaggtggagagcagcgacaccgtcgacaacgtcaaggccaaaatccaggacaaggaagggattcccccagatcaacagcgactgatattcgctggcaagcagctggaggatggacgcacgctggctgactacaacatccaaaaggagtcaactcttcatttggtcctcaggcttaggggtggaaccatgatcaaggtcaaaactctcactgggaaagagatcgagatcgacattgaacccactgactcgattgacaggatcaaggagcgtgttgaagagaaagaaggcattcctcccgtgcagcaaaggctcatctatgctggtaagcagcttgctgatgacaagaccgcaaaggactacaacatcgagggtggatctgtcctccatcttgtccttgctctgaggggtggttactagtctaaacctgatgaactagcagtcagataaactgntgtgttggctgcgaaatgtgcaggcctgatgttgaacttgcaaggagataatnacaaattatcagctt

SEQ ID NO: 5064 - DNA, 630 bp, Zea mays
  unsure at all n locations
  Clone ID: LIB143-069-P1-K6-A8
ctactactcaagtatccatccttattgagtacagtgttgatccatggactcggaaggagttgtagcagcaaaggtggcagatgagactactaaaccggcaatccaagaagacggcgccgagagcaaggccgggatgactgatctgctgatgctgaccgacaagtcgcagctgcaggcgctggcgatgctgctgcggaacaacgaggagctcatgatgagccaggcgatcaagtcggagacggagcgcattgagtacctcaagacggtgagcgactgctacacgcggacgatgaagctcctcgacgattccatggcggccaggaccacgtacgagcgttcgggcggaatgaggagcctcgtcgcccgggacatggacgactacgtcgtctacggcctcaacgcgtgcttgcagaacgtccgcaactgctgcgtgcgcctggacgccatcgacaagctgcgggcgcactacgacgccctcgccgacgccgtcgccgacccggccgccaacgtcgagggcctcgccgcggaggcgtccgagtacaaggccgncatgtggcagtactgctacaaccagcggagcgcctncgcgcgggcgcactcccgngcctactcccaggcgctcaagctgga

SEQ ID NO: 5065 - DNA, 636 bp, Zea mays
  Clone ID: LIB143-069-P1-K6-A9
taccattctctctcttctacctaattcaaagaaggaaattatttctgatgctgtatggtgcaaatggctcgaggattgtgctagtgggcgaattccctgcaatgatataaaactaaaaagttactgcaggttaacattattgaatatattatgttctgagagtccaaatacaagaaaagcctctgatgaatatcctgactcagaaagtgagtataaaagaaactgtccccagtttggagatgcactattcttgctaaatccagagttacctcttgaagttcatgtggacaacagtggttttgggattttaagagtttcaagagataattgtaaggaagatggaggtattggaggctctggctctgaaactgtgaactctgtagatgatgctgaagctgcatccaaaagtgtccctttgatggatgttgtgtttgttcatggccttcgtggcggcccattcaactcatggcgaattgctgatgacaaatcatcaactaccaaagctggtttagtggaaagcattgacgaggatgctgggaaagagggtacatgctggccaagagaatggcttgcggcagattttcctcaagcacggttttttacggtcaaatacaagacaaatttgacccaatggac

SEQ ID NO: 5066 - DNA, 658 bp, Zea mays
  unsure at all n locations
  Clone ID: LIB143-069-P1-K6-B1
agagaatattaactttggaccttcagtgagagctacaacgagtaattctgcccgtggatcatcatctcaacctgttttggagaaccctgatgaactatcagatgaccaaaggatgagccagtcatcctctagtcttccaccttctacagctgatatgcaagaaaccatgaggaattctatgaaagaccctgcaatgcggcagatgcttacatccatgatgaagaacatgagccccgagatgatggcaaatatgagcgagcagtttggaatgaaactgtcaaaggaggatgccgcaaaagctcaacaagccatgtcgtcattatctccagaggatttggatagaatgatgagatggatggagcgagcacagaaaggggtagaagtcgcgaagaagacaaagaactggctcttgggccggcaaggcttgatccttgctattgtcatgctgatcctagctttcatccttcatcagtttgggtttatcggcagatgatgggggtgacttgngtggctgcatcagcatggaaatagattattcgatggcgatgcagagttccctcttgctaacaactgcttaaaagcgctttggnggaaggccggattacgagaattctttgtatccgtatcttatgaaagtgtaactctgtccataaagcta

SEQ ID NO: 5067 - DNA, 588 bp, Zea mays
  unsure at all n locations
  Clone ID: LIB143-069-P1-K6-B10
cggacgcgtggcggacgcgtgggcggacgcgtggggactagttctagatcgcgggcggccgccctttttttttttttttttgctgctggaatggaagcattctttttggttcgttttccattgcattattacacacagctggatacatgggcttgatgaagcccggccggccgtgatttattttagcccgcccacagatgcaactagataccgaaataaaaagggtaaacaacatgatcgatcgatttattatgacacaaacacgtacaaacatgcatatatgatcgactctcgatccatgatcatcacgggaagacctcgatgatggacgggatgcctcgggtgtgcgtgatcttgtagtcacggaacccagccgccaggaagatcctcctccactcgtgctcctcccgctccgccccgttcacgaagctcagtatgtnggagatccaacacatacgtctccctgcacgtcttgtcgtcgtcgtcgtcgtctgcccgagatccgagcaccgtgtctattattatcaccttcccccctgcttccttgccaccgatcgcttccttgcagcgctccattatcttgatgca

SEQ ID NO: 5068 - DNA, 514 bp, Zea mays
  Clone ID: LIB143-069-P1-K6-B11
gatgcacgcagactagcatgccgtatcgtctctgcctgttgaggttccttctgttgccgcagcccgggttgccgaccagcttccaccgttccacagtcgccaagcgaatcccgagtatggtttgcgcgatggcggaggagcagtccaacctgcagcacctgctagcggaggatagggaggttctggcggagcagaaccacccgaggagggcccctaagctgaggtacctggacttcgtccaggtggcagctgcccaggccgcggtgtgcctcgctcgggctctacggcctacccatggaccacgccggcccgttccgactcatcgttgactccgtcaagtctgtcgtgatgggcgtctgtagccacgattacgaccggtttgtcggcctgacgttcgacgttctcatctttgtcgacctgaaggtggacgacacggtgctcgaggtggtcaagcacctcatgtgcgcgctgaaagcggcgctatcgcatgtctacacggtgcatcagggcgtgc

SEQ ID NO: 5069 - DNA, 572 bp, Zea mays
  unsure at all n locations
  Clone ID: LIB143-069-P1-K6-B12
ccacgatcgataaagctaattaagctgctactgctacgctagcctcgatcgatcaagcaagcagctcacagacccaccggcccacccacccacccacatggcggcgtcccgttccgctctgatcacgctgctcgtccttgtgagctccgtcgcggcggcctcggcgaccacgttcaccgtcggcgacagtagcggctggagtcgtagcgtcaactacgacaactgggccagtggcaagaccttcacggatggagatcagctagtgttcaacttcgccaccgggaaccacgacgtggtggaggtggacaagagcggatacgacggctgctccaccaccaacgccgccaacacaatccaaaacggcccggccaccgtcaacctcacctccggcacccactactacatctgcggcttcaccggccactgcagcgccgggatgaagctcgctgtcaccgtcggctccggctccggctccgggtcccccacccccggcggcggctcgcccagcacacccacaccaaccaccccgagcgcccccacccccgacactccggccagcgcgtncgtgcgcc

SEQ ID NO: 5070 - DNA, 603 bp, Zea mays
  Clone ID: LIB143-069-P1-K6-B2
gttcataaattatcttggaacatcaattgatgcaagtggaagaatcaacagtgaaaatcttacaatcctgaactgccttcgcatgaacgaatgcaacataaacaatttaactaatcgtgcaacttccttcgctataaactgtggtggcaagcaagtggagtattcagatctaatgccaattatgttctctgaagactccactgatcttggaggatcaggctttcatgttaatgctactagtcattgggtagttagtcatgtgggttctgatccatttaacgaatccaccggtattgtaaatacaagtgatatttttgaaaccaacatgcaagagctctaccaaacagcaagaacttcaacaagttcgttgtggtactatgtggtaggtttagctaacgggaactacacagtccaactcttctttgcagagatagtcataactcatggacctggaaagcgcttatttgacattgatattcaggaccagaatatcaggaaggactttgacattactaaggaagcaaggggttccagaaaagccactaacataacctacgaagtgactgttgataactccatatgggcatacatctgtattggagt

SEQ ID NO: 5071 - DNA, 532 bp, Zea mays
  unsure at all n locations
  Clone ID: LIB143-069-P1-K6-B3
gattatttactgtatatgtttgtgtgtttgtggtggaggtaaatcctaggaaatttagatgagaagaaagctatagcgaggcgcttgccaagtgcttggtgaatcgcctcaaccggatgtggttgtcgatctcgcggagtcgagtcgagtttagtcgtggttgaagatacaaactcatgcgaagtgatcgtgtgtatggttataaagtataccaatctactgttgggaccatgcttcgtcgccgaaggtcctgcaggaagaaacagcttcggctgaagctgtctgcacgtgatgaccgaaggttgctgttcatgaagcttcggaattacaaaccgacttaaaagtagaatgaccttttagtccataagtgtntgagtcgntgttgtaaacttttatgaggggcatgtttgtnattcctcacaggctgtgtcttgtgcctattaatagtgaacaatattcctttactgttcacacattcttgtanttgcaatcgcatcactcgggaattaatctttgcccaagcagaggtatt

SEQ ID NO: 5072 - DNA, 73 bp, Zea mays
  Clone ID: LIB143-069-P1-K6-B5
gggtagggttggagagttgtttgctcccgctatgaaacgagacgagagaagaatgagcaaggtttttgttttt

SEQ ID NO: 5073 - DNA, 607 bp, Zea mays
  unsure at all n locations
  Clone ID: LIB143-069-P1-K6-B6
cggacgcgtgggcggacgcgtgggcgcagcagccgcgaaccgtagcagcagccaaaggccggtccactttatttactgctcgtctagtgcagcctgcagcgcagcaaaaccagcggcgcagtgacaaaagcccacagcttcttccccctcctccttctccgtcatccgtttcgctctctgccgccgccaccgcacaagaagctagctcctgcctgtaccaccccggcatggcgatgctatcccgcgcagcctcctccgcggcccggcgcccgctgctgccgccgcctaggcttctggcggtgagggcgatggcgtcgtcgctcttcggccacgtcgagccggcgcccaaggaccccatcctcggcgtcaccgaggctttcctcgccgacccctcgtccgacaaagtgaacgtcggcgtcggcgcctaccgggacgacaacggccagcccgtcgtgctcagctgcgtgcgcgaggccgagcgccggatcgcgggcaacctcaacatggagtaccttccgatgggaggcagcatcaagatgattgaagagtcactgaagctggcgtacggagaagatnctgacttcatcaaagataagaggatagcagc

SEQ ID NO: 5074 - DNA, 485 bp, Zea mays
  unsure at all n locations
  Clone ID: LIB143-069-P1-K6-B9
gcttgacatacgattaatcttgcgttgtgttgtgctaagggattggcttatgttattatctggattggtggtttttctacgcctcatgcttgtgctgtctcgtttcacaaaaaaaaaaaaaaaaaaaaaaaaaaaaaaaaaaaaaaaaaaaaaaaaaaaaaaaaaaaaaaaaaaaaaaaaaaaaaggagaaaaaaaaaaaaaaaaaaaaaataaaaaaaagaaggggggcggccgnttaaaagatccaaagttaccccaaaattcaattcaaatgtccaactttttaaaatgggggaactaaaaaaaatctgccggcccccaattaaaaaggctggaaggaaaaaaacctttcgctaaccaaattaaaacctttgaggccaaaaccccttttcctaaccaagagtaaaaaaaaaaaaacccccacggggacccctcctaaaaatttgcataaaccaaagggcaaatggaacccccccttaaccgg

SEQ ID NO: 5075 - DNA, 597 bp, Zea mays
  Clone ID: LIB143-069-P1-K6-C10
cggacgcgtgggcggacgcgtgggcggacgcgtgggcggacgcgtgggcggacgcgtgggcggacgcgtgggcgcctcccgagttgcgccgccgtctccatctccacccctccatcctccgcggcgcccctgcactacggccatcgcactcccctcgctagcccttttcctctgtccccaccttgcccgcgcatcctccgtgcggccgtcgcggtttcttcgctggatctgcgcccgatcaccggcgggttcgcgctattcagcatggctgctgcctcctccgccacctccgtccacgacttcaccgtcaaggatgctagcgggaaagatgtggaccttagcacctataaggggaaggttctgctcatagtcaatgttgcatctcagtgtggcttaaccaattccaactacacagagctgagccagttgtatgagaagtacaaggaccagggttttgagatccttgcattcccatgcaaccagttcggtgggcaggagcctggcactaatgaggagattgtccagtttgcttgtactcgcttcaaggctgagtatccaattttcgacaaggttgatgtcaatggtgacaatactgca

SEQ ID NO: 5076 - DNA, 645 bp, Zea mays
  Clone ID: LIB143-069-P1-K6-C11
ttaattgcacgtctcctccccacctctccttccctccacccgtgccgtcgcctcgcctatccgatctgccacctcctcccgtctcgcacgttccttcccaactccgcagcgtagcctctccgcggcgcgatccagatccaggtttttcagcatgggcctggtgaaggaaggcatcgacatggaggagggaacccttgagatcggcatggagtacaggactgtatctggtgttgctgggcctctggtcatattggataaagtaaagggcccaaagtaccaagaaattgtaaacatccgacttggagatggcaccaatcgccgtggtcaagtcctggaagttgatggcgaaaaagctgttgtgcaggtctttgaaggaacttctggaatagacaacaaatacacaaccgtgcagtttacaggcgaggttttgaaaactcctgtctcacttgatatgcttgggcgcatttttaatggttctggaaaacctattgacaatggccccccgatattgcccgaagcctacttggatatctctggaagttctattaaccccagtgagagaacctatccagaggagatgatccaaactgggatatccaccattgatgtcatgaattccattgctcgtggacaaaagattccact

SEQ ID NO: 5077 - DNA, 212 bp, Zea mays
  Clone ID: LIB143-069-P1-K6-C12
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggaggaaaaaaaaaaggggaggggg

SEQ ID NO: 5078 - DNA, 648 bp, Zea mays
  Clone ID: LIB143-069-P1-K6-C2
gaaaccctcaagtacatgtccaagtaccagggacgtgagatcacgcaggtggactgcgcacgggaggcgatgaggctgatccacgcggaagacaagaacctcaaggccgaggactcagcgtgggagctgaagaagaagttcggcaacggcgtgagcaccatggtcctcgtctacaacgcgcccggggccagcctgagcctggtggacgacgggaaagactggatgggctccgtctacagctcgccgatcccggacaccttccacaacgggcagtggatcgccttcctccacgtcaagcccggctcgctggcgcagggcagccaggccgccagggtgttccgcggcagggacgtcgatggccggactcgggacttcgtcgtcgcctggtacatcccgtgggacaacataccgacacgagcttacactgaaattggcagtgaaaactacttcaagactcggtggagtagtgtcaaaacgagtctaggacattcaaggagagtgacccgtgccaaggacgagaactgtgcgtcaactgtcagcatcggtggctacactacagccttctgcatcgcagtcctacaacaccagttccagccgctgccggaagagcgcgaataatcaatcaatcgatcgatcgagtttgcgatc

SEQ ID NO: 5079 - DNA, 552 bp, Zea mays
  unsure at all n locations
  Clone ID: LIB143-069-P1-K6-C3
cggacgctgtgggtgggtgtgtatcaaggacatttccaaggatggaggcatcttgaaaaaggtagtagccaagggcgataagtgggagaaccccagagatcctgatgaagttgttgttaagtatgaagcaaggcttgaggatggaacagttgtatcgaaatctgatggtgttgagttcactgtgagagatggcgtattctgccctgccatatcaaaggctgtcaagactatgaacaaaaacgagaaggcccacctcactgtcatgccacaatatggctttggtgtgaaaggtagaccggcatctgnagaagaagcttctgtgcctcctaacgcgacattgcacattgatcttcaagtggtgtcctggaggacagtcactgagttaggcagtgacaaaaagatccttaagaagatccttaaggagggcgaangctttgattgtnccaatgattgtgcagntgtncgagtgaaacttattgggaagttggaggatggtaccttgtntgtcaagaaaggtcaagatggtgaggagccatttgagttcagactgat

SEQ ID NO: 5080 - DNA, 507 bp, Zea mays
  unsure at all n locations
  Clone ID: LIB143-069-P1-K6-C4
ncagcgtccggggagactgatgcttttatggttgctagaggtgatcttggaatggagattcctgtcgagaagattttccttgcgcagaagatgatgatctacaagtgcaacattgctggcaaacctgttgttaccgctacccagatgctcgagtcgatgatcaaatctcctaggcgggggccgngcagaggccactgacgttgcaaatgctgttcttgatggaactgactgtgtcatgctcagtggtgagagtgctgctggagcctaccccgaggtggctgtgaagatcatggctcgtatctgcatcgaggcagagtcttccctggaccacgaggcagttttcaaggccatgatcaggtncgcgcctctttcaatgagccctctggagtctcttgcgtcatctgctgngcgaactgccaacaaggccanggccgcactgatcgtcgtcttgacttgcggnggcaccacggccaagctggtcgccaagtaccgccccagggttcccat

SEQ ID NO: 5081 - DNA, 590 bp, Zea mays
  unsure at all n locations
  Clone ID: LIB143-069-P1-K6-C5
ctggtagcagcccgcatgtgctagagctagacagaagtcagtctccttcccctctctagtgctcaccggctccttccgtcgccatggacgtcctcctctgctgctgcctgctgcttctcctggcctccgccgcgtccgccggcagcgagcggtgcgtgcggcaggggaaggcgggcgacgtctccctcgctctccccggcccctcacggtagcagcggagcgtgcgggtacggcgccatggccgccgagatcaatgggggcttcctcgccgccggcgggcccaggcagcaccgcgggggcctcggctgtggccgctgtttccagatgagatgccgagacgcaaggctgtgcagcgccgggggagtgcgggtggtgctgaccgacttccacaggagcaaccgtacggacttcctgctcgccgggccggcgttcgcgggcctggccaagcccgggatggcccaggagttgaacaggcgagacgccctctccgtagagtacanaaggattccctgcgagtacaaggagaagaacctgtcgatccgggtggaagaagcgggcgacaggagccggggcaagctggtggtgaagct

SEQ ID NO: 5082 - DNA, 581 bp, Zea mays
  unsure at all n locations
  Clone ID: LIB143-069-P1-K6-C6
ccacgcgtccgcttccttgatcagcttgttgaggtatacaaacaagtccgaattggggatccgttggagaaaggcaccttactgggaccactgcacactcctgcttcaaaagagaactttttgaaaggcattcagactatcaaatctcagggagggaaaatcctttttggaggatctgccattgaatcagaaggaaactttgtgcaaccaacaattgtggaaattacaccttctgcaccagttgtgaaagaagaactctttggtcctgtcctttatgctatgaaatttcagaccttgaaggaagcaattgaaatcaataactctgttcctcaaggattgagcagttctatatttacaaagaggccagatattatttttaagtggctcgggccccatggtagtgattgtggcatagtgaatgtgaacatacctactaatggtgctgaaattggtggagcatttggtggagaaaaagcaactggtggtggacgagaagcanggagtgattcctggaagcagtacatgaggagggcgacttgtacaatcaactatgggagcgagctacctctagcccagggaat

SEQ ID NO: 5083 - DNA, 552 bp, Zea mays
  unsure at all n locations
  Clone ID: LIB143-069-P1-K6-C7
ggccctggtcgtccctggcgccggcacgtcttcctcgtcgtgtcgctgcagcttctccttgtggcgccatggcaggacgagacggccgctcgagctctcaatttcaccaggcaggatttccccagggccttcgtctttggtgccggcacgtcagcttaccagtacgaaggggcaaccgatgaagacggaaggagcccaagcatatgggacaactttactcatgcaggtaggatgccggacaagagcactggcgacctaggggcggacggctaccacaaatacaagggagacgtgcagctgatgagtgacactggcctggaggcctaccgcttctccatttcttggtccaggcttattccaagaggaagaggagccatcaaccccaagggcctcgagtattacaacaacctcatcaatgagctagtaaaacgaggaattgagatacacgtgaccctgtcccacctggattaccctcagatcctggaggacgagtaccacggctggctgagccncaggatggtggacgacttcgaggcgtacgcggacgtgtgc

SEQ ID NO: 5084 - DNA, 525 bp, Zea mays
  unsure at all n locations
  Clone ID: LIB143-069-P1-K6-C9
ccacctcttcttcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactgagccggtcaggcgatggcgcacgagagtcgagaggacgacgacgagtcgtataaatataatnagcggcgtctaaataagatcctgtcaactgcacccgccattatcgatccatggtcgctcctggggttcatgttcatctgtaacgtgctcgcggtcatgtccgtctcgtgccggatttaatatttatatgcatgtatnntgtgttntttctgcgtt

SEQ ID NO: 5085 - DNA, 96 bp, Zea mays
  Clone ID: LIB143-069-P1-K6-D10
aaaaaattaaaaaaaaaaaaaaaaaaaaaaaagggagaaaagatataaaagaaaaaaagataaagaaagaagtgaaagaaaagaaataaataatta

SEQ ID NO: 5086 - DNA, 503 bp, Zea mays
  Clone ID: LIB143-069-P1-K6-D11
tgaatcacctgaggatgaaaccggacctctcccagtggaaaccagctattgggtcgtgacattgaaattcttaaggcaaaggctaattttttgaaaataccaatcttttctaacccgtcatggtatggaatgtactgatttagaatcagtggtttgtgtcaaagatcgtaatctgacaagcgaatgtgtcgataaaatagttggttatgctttgagttatcaactcaaggatcaccctattcaaactcctggaaaggatgcgagagttgtcctttccggtgtaagccttaagtatgggattgatttgttggaaagtatccaaagtggccctaagaagaagagcacaaagaagtcactcaaggatgttgtcacagagaatgaatttgaaaaacgtcttcttccagatgtcatccctccagatgagattggtgttacctttgaggatattggagcattagaaaatgtcaaggaaactttgcaggagttagttatgcttcctttgc

SEQ ID NO: 5087 - DNA, 544 bp, Zea mays
  unsure at all n locations
  Clone ID: LIB143-069-P1-K6-D2
tgaaaatgtaaacgatcacttcatggccttcaatactatttgtgatgccactcaggaaagacaagatgctatgtatcagctggtgaaagagaaagttgaccttattcttgttgttggaggatggaattcaagtaacacctctcatctgcaagaaattggagaactcagtggaattcgagtggtactggattgacagtgaacaaaggattggaccaggaaacaggatcagctacaagctaaatcatggtgaactggttgagaaaaataactggttacccgaggggcctattaccattggtgttacttcaggtgcctcaactccagataaggttgttgaggatgctcttcanaaggtatttgagatcaagcgtcaggaaattttgcaggttgcataaattttaagcagagatttggtgaagagctgaatagttttggcttggcaaaggttactagaaacgttgcacacgcaaatgtttgtacagtagctaaggatgtaacgagttgggcacgaatactaccacgagtcactattcttgtgctggaa

SEQ ID NO: 5088 - DNA, 74 bp, Zea mays
  unsure at all n locations
  Clone ID: LIB143-069-P1-K6-D3
gtgaactggacggagttctgtacggggccgatctgcaggacannagaagagccactcagnaacgccaagacagg

SEQ ID NO: 5089 - DNA, 455 bp, Zea mays
  Clone ID: LIB143-069-P1-K6-D4
ggcaccacacctcttcttcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcgagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactgagccggtcaggcgatggcgcacgagagtcgagaggacgacgacgagtcgtataaatataatagcggcgtctaaataagatcctgtcaactgcacccgccattatcgatccatggtcgctcctggggttcatgttcatctgt

SEQ ID NO: 5090 - DNA, 528 bp, Zea mays
  Clone ID: LIB143-069-P1-K6-D5
aagagagagagaaacaatcaggggtccatccatttttgtcagccatgacgaacggctatctgttccgcgagtacatcggcgcgcagtccaccggcgtccagttctccgacgtgcccatcaacgccttcgttagcttccacttcatcctctccttcgccatcgactacacgcccgtggggcagcagccgaagccggtgccgaccaacggggtgttcagcccgttctgggacacgggcaacctgtcccccgccgccgtggccgctataaaggcctcgcaccctaacgtcgccgtcatggcggggctcggcggcgacagcgtgcaggacatcgtcaaggccttcttcaccccgacctccgtcgacacgtgggtggccaacgccgtgacgtcgctcacgggcatcattaacaggtacgggctggacggcgtggacgtggactacgagcacttcgccgacggcgccgacgtgaatacgttcgtcgagtgcatcggccgcctcctgacacagctcaagcagacgatgcccaaca

SEQ ID NO: 5091 - DNA, 487 bp, Zea mays
  Clone ID: LIB143-069-P1-K6-D6
tggttctccatcatcaccacccccaacccgatcttcagccatctggccggaaagacgtcggtgtggaaagccatctcggcggaggtgctgcaggcgtcgttcaacaccacgccggagatggagaagctgttccggtccaagaggcttgactcggagatcttcttcgcgcccccgtccaactgagcaaataggcggaagcccacggtggagtgctctcgtcaagtcgtcatggttagattagcttagctcgccttaataaagagagaatggtggtggtcctcggctcactgcttcttcagtagcttcagtcgtttcgtcggtcggttgtcgtgtccgttcgtcgaactgccaagttttgttaattattattaatgtcaccctctgttttgtctaggactagggctggaaaaaacttaagccgcggctggttcaggctcgcgagctatattgttttaattaatctataaaataataataaatattatat

SEQ ID NO: 5092 - DNA, 200 bp, Zea mays
  Clone ID: LIB143-069-P1-K6-D7
gccataccgctggttatttatgcattccatcagacgccgatgattcattgcttgtagatgtaaatcaacaatcataccaccatagtcaatagcagttgttttaatgccaatagcaacgttcatgtttaaaatggtagcatttttgttccttgttttctagaccggacattttatgttcctgaagatggtgattgtgttac

SEQ ID NO: 5093 - DNA, 560 bp, Zea mays
  unsure at all n locations
  Clone ID: LIB143-069-P1-K6-D8
cggacgcgtgggatcttttgtttggacggaatattaccaggctctatgatctaaagggatcttcaaggtcaaggtataatgcagattcaaatggtagcaacaaggttcttcttgaccagaacttaattgaagcaatgccaacttcaccgatttttgttgggaacaaggcaaagcggctactggaaagagctgtttggaacgatacatctttcctagctggaatcgatgtgatggactattccttgcttgtgggagtcgacgaggagaaacatgaactggtcttaggaattattgattttatgaggcagtatacatgggacaagcaccttgaaacatgggtaaaatcttctggcattctaggtgggccgaagaacgcttctccaactgtcatttcacctatgcaatataagaagcggttcaggaaagccatgtctgcttattttattgtcattcctgagcaatnggatgcctgcataatcaatccaagcaaatcatcatcaaatatttgccaagaagattctcaaaatgggtctcaagagtgaaatgatgttcgataagtc

SEQ ID NO: 5094 - DNA, 583 bp, Zea mays
  unsure at all n locations
  Clone ID: LIB143-069-P1-K6-D9
cgctgtccatcgttctggttggggtcggggacggcccctgggacgacatgcgcagattcgacgacaagctccccgcgcgcgacttcgacaacttccagttcgtcaacttcaccgccatcatggcccgcgccgcgacggcacagcagaaggagtcggcgttcgcgctcgccgcgctcatggaggtccccatccagtacaaggccaccatggagctcggcatcctgggacggtccacggggaacgccaagcgagtcgcccccgcgccgccgccactgccgcacgcgcagcggcaggcgtcgtcgctgaggaggggcgccagcaacgtcggcggcgccgccgcggcgccgagagatgaccaggtgtgcccgatctgcctgaccaatgccaaggatctggcgttcggctgtgggcatatgtgctgcagggagtgcggggaaagcctcaccagatgcccgatatgccggcagccgatacggtcgaagctgaggctatattcaggatgaagtggctatgctacaacagaggccacgaagaggaaaaaggatatatagcttactcgccgntaaaatgtacatgtgaatct

SEQ ID NO: 5095 - DNA, 102 bp, Zea mays
  Clone ID: LIB143-069-P1-K6-E1
cagggacgcctcttcccagtgacaggctgatccatctcggcgtcgaactcgtactactggcacgtaagtaggagtacgttgacaggatgacatcctgctgct

SEQ ID NO: 5096 - DNA, 545 bp, Zea mays
  Clone ID: LIB143-069-P1-K6-E10
ggcactcgcaccgcacccaagaaaaccgccggctgccttgcaaaacagccaacctcacagctcacagtcacactagcgttgtcctctcgcggaagcaaaggcctgctggggtgcgcgtgtccgtccgtgtgcgcgggcgcgccacagccatgacgaaccaggacgtggtggtcccggacatgggcattgcggcggctgcggccttgccgccccccggcctcttcgcgtgccgcggcgtcgcgggggccgtgtcgtcgctgcggggcacgtacggcagccttggcctccccggcgggcgccgccgccgacggtggcgagttccgttcccccgtggcggcggcggcgaatgcgccgccgggtcggaccagctgcaccagccgggtcgtcgaggccatccgcgcgtcgtcgcccgcccgctgccccgccgtcgacgagtacgacgcgtggacgaggaagcacccgtcggcgctgggcagcttcgaccagatcgcggcggcggctaaggggaagagggtcgtcatgttcatggactacgacggcacgct

SEQ ID NO: 5097 - DNA, 558 bp, Zea mays
  Clone ID: LIB143-069-P1-K6-E11
cccacgcgtccggatttgtttaccccccgaaaatttgccgtctcctcgtctcgctcctctccctgcgcagcccccagatccggcaccgcccgctcctcgatccccgcaccccacgcccgcaggccgggaccggcggggtcgcgcgccgggtaggaggaggagaagaggaagggcggtatggcggcgccgccggcgagggcccgggccgactacgactaccttatcaagctgctcctcattggagacagcggtgttggcaagagttgcctcctgttgcggttctctgatggttccttcactacaagctttattaccacaattggtattgactttaagatacgaacaatagaattggatggcaaacgtataaagctacagatttgggatacagcgggccaagaacgcttccggactattaccaccgcgtactaccgaggagctatgggcatcttgctggtttatgatgtcaccgatgaatcttcttttaacaacatccgaaactggattcggaacattgaacagcacgcctctgataacgtcaacaagattttggttggc

SEQ ID NO: 5098 - DNA, 601 bp, Zea mays
  unsure at all n locations
  Clone ID: LIB143-069-P1-K6-E12
ggcaacctccacctcagttcccgtcctcctgctcctcgccgccgccgccggcctcctcctgctccccggctcgctggcgtggcagagcagcaactgtgcaccgggcgcgcccggcagtggctcgccgacgtggccttcacccggctccggctccggcggcggccacagcaagccgcccaagcaccaccatggcaagccgcccaagtgcccgccgtgcacccctcctccgtacgtgcctccgacgcctcggccgtcaccgccgtacgtgccaccgtatgtcccgccgacgcctcggccatcaccgccctacgtgccaccatacgtccccgtcccgccgacgcctcggccctcaccgccgtacgtgccaccatacgtccccgtccccccgacgcctcggccctcaccgccctacgtgccaccatacgtccccgtcccgccgacgcctcggccgtcaccgccgtacgttcccccgacgccacggccgccgactccgccctacgtcccaccgacgccgccctacgtnccaccgacgcctcggccatcaccaccaccgtacgtgccaccctacgtncccccgacgccttgggcatcaccaccctac

SEQ ID NO: 5099 - DNA, 501 bp, Zea mays
  unsure at all n locations
  Clone ID: LIB143-069-P1-K6-E4
aaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtgggggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctcttcatggccaacgccgggcccaacaccaacggctcctagttcttcatctgcaccgtcgcgaccccttggctcgacggcaagcacgtcgtcttcggccaggtcgtcnagggcatggacgtcgtcaaggccatcgagaaggtgggcacccgcaac

SEQ ID NO: 5100 - DNA, 546 bp, Zea mays
  Clone ID: LIB143-069-P1-K6-E5
ggcagatctctgagcttggtatttatcctgctgtcgatccactggattccacatcaagaatgctttctccccacgtgctgggtgaggatcattacaatactgctcgtggtgttcagaaggttcttcagaactacaaaaatcttcaggatattattgctatcttgggtatggatgagctcagtgaggatgacaagttgacggtcgctcgtgcaagaaagattcagcgtttcctgagccagcctttccatgtcgctgaagttttcacaggtgctccagggaagtatgtggagctgaaggaaagtgtgaagagtttccagggtgttttggatggcaagtatgatgacctccctgagcagtcattctacatggttggaggcattgaggaagtcattgctaaggccgagaaaatcgccaaggagtctgcttcataaggaggcttcttgcttgttgaatcctgtacaatcaagttccatttttggattttaagcgattgtttatgcttttcacagttaggcagcacgagttggagatccatctcctgctgag

SEQ ID NO: 5101 - DNA, 601 bp, Zea mays
  Clone ID: LIB143-069-P1-K6-E6
cacaccctccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgccttcgtgggcggcaacatcaccctgttccgggggctcctgtactgggtggcgcagctgctggggtccaccgtggcgtgcttcctgctccgcttctcgacgggcgggcaggccacgggcaccttcgggctgacgggcgtgtcggtgtgggaggcgcttgtgcttgaaatcgtgatgaccttcgggcttgtgtacaccgggtacgccacggcggtggacccgaagaagggcagcctgggcac

SEQ ID NO: 5102 - DNA, 346 bp, Zea mays
  Clone ID: LIB143-069-P1-K6-E7
gcaaaaggatctatattagagcagtatagaagggtggatgtgaggcttacattggttgtgagcttgaaagggaatttgttgtttggctggtgaggttcttttgacttctgatgcaacgaggatagctgaaatagcaatcttcttcaatgtcttattatgcgggagcttgaaaatacttcaatttataagtttataggttttcatgttggagcatctttgtcatggtagcatgtaggttgctaaaatagtcagtggaataatgagacaatgtctaagaacacttgtcttttttttaggacagtataataagaactgacgtttccatgtccatatggacgttccacaa

SEQ ID NO: 5103 - DNA, 554 bp, Zea mays
  Clone ID: LIB143-069-P1-K6-E8
cagaggtcctagatctggccgtttcaagaaccagaaattgtacggccatactgtcactattgctgtgaaagggcagagccttccttctggtgaaagcaaggatgatagtgccgtgcctgatagagcacagttcaatagagacgatttccctgttcagtatgatgctgcaaagttctttgtcattaaatcgtacagtgaggatgacatccacaagagtgtaaaatacaatgtgtgggcaagcacaaccaatggaaataagaagctcgatgctgcttatcaagaagctcagtcgaagggttctgcgtgccctatattcttgtttttctcagtgaatacaagtgggcagtttgttggtgttgctgaaatgacgggggctgtcgattttgagaaaaccctggggtattggcaacaggacaagtggaatggttccttctctgttaagtggcacattgtcaaggacgtgcctaacaacattctcaaacacatcatcctagagaacaacgagaacaagcctgtcacgaacagccgcgacactcaagagatacacctagaac

SEQ ID NO: 5104 - DNA, 583 bp, Zea mays
  unsure at all n locations
  Clone ID: LIB143-069-P1-K6-E9
cccacgcgtccggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgagtccaaggtgaacgagactaaggcaaccgtcaagttccagctcaagaaggtcctttgcatgggtgtcgccgtcggcaacttggcgatggaggagaagcagatccagcagaacatccagatgagcgtcaacttccttgtttcccttctgaagaagaactggcagaatgtgagatgcctgtacgtcaagagcaccatggggaagccatacaggggtgttctaagtatgctctnttgtgaagtctgcta

SEQ ID NO: 5105 - DNA, 563 bp, Zea mays
  unsure at all n locations
  Clone ID: LIB143-069-P1-K6-F1
ctcctgcgcgccgccagtccggcttctcctggctcctgcgcgccgccagccgtcagcccgtcaccgattggagatccttggaaacctgcgcgccgccagcccgtcaccgcttggagacccgctcagccgcgcttccctgcgcgccgccagccgtcgccgatccgtggccgcgtgcgcgggcgccagctctgaggtcgcgccgtcagccagcccgtctgccgtcgtgaggtactgagcttgttgaggttcatcgctcaaccccgtcgcaaccgcaacgtccatctccccgtcctcgctgcccggaggcctggcacacctcccagtagcagcggcctcccgaagcattgtttcaagtggttattaggcttcatggatatgtctcaagagcaagaacaggattttggcgtactgctgaagcaaggtgcanaagggagggtatttgcttcgacatttgtgggacgaaagtgtgtaatcaaagagcgtttttcaanaaagtaccgacacccattgttggactcgaagttgactctaaagcgcttaaatgctgaagctcggtgcatgac

SEQ ID NO: 5106 - DNA, 595 bp, Zea mays
  unsure at all n locations
  Clone ID: LIB143-069-P1-K6-F10
ccatccttcaggtcaggaaggaattggacgatctgagggacaagctgcagcccctgaccatgaagtacaggaaggagaaggagagaatcgatgagatcaggaagctgaagcagcgccgcgaggagctccagttcaccctgcaggaggccgagcgccggatggacctggcccgtgtggccgatctcaagtacggcgccctccaggaaatcgacgccgcgatctccaagctggagagcgaaacaggggagaacctgatgctcaccgaaaccgtcggccctgaacaaattgcagaggtggtgagccgttggacgggtattccagtgacccggcttggccagaacgacaaggagaggctggtcggcctggctgacaggcttcaccagagggtggtcggccagacagaggctgtgagcgccgtcgcagaggcggtgctgaggtcgagggccggtcttggcaggccacaacagcccactggctcgttcctcttcctgggtccgactggcgtggggaaaactgagctggccaaggccctagccgaacagctgttcgacgacgagaaccttcttgtccgcatcgacatgtcngagtacatgga

SEQ ID NO: 5107 - DNA, 548 bp, Zea mays
  Clone ID: LIB143-069-P1-K6-F11
acgtctgtgctacggtgatggtgcaagtagagggccctcagcctggctagacggtttattcgctttggtacgttgaccccatgctcttaatacaaggactatgggtgcatactgtgacaacacccaaccttttctggaggccttctttatggggaattaaggacatttgtcggtttgggtctattggattaaacatgaactggattctcgataatagagctcccattataacccaatctttactcttacaatatacgaggctctttccgaggaaatgtgtgcttgacccctatttgaacattgcaggtcaagacacccacccttgtttctcaccatgagacactcaccttcgatgagagcgagactatagcagaccaacgaggagcatctctataaagcactttgcgtgtggtgccttattccctcttcttgcgggattgaggagatactgattctgctcaccatccaacacagcggaaagtaaacttatgctcccttatcaagaagaaccaccagagtgtgacatgcctctgcgtctcaaccaccat

SEQ ID NO: 5108 - DNA, 580 bp, Zea mays
  Clone ID: LIB143-069-P1-K6-F12
cggacgcgtgggtttcctccaagaactcgcaagccacagtgcctttgaaaaaggcctagttgacactcacttcattgaacgttataaagatgaccttttgagtatttctacaaagtcctcaaaagaatctcatggtgtagctgagcttggtgcaattttggctgctgcatgcatttgcaagaaggaacacattacatctaaagaatcactacgagccaacaagtcactatctgtatggtacaataatccacctttcaggatgcatcactttgctaggcatcccctggatcttgagttggaagagaatgatggattcagtgagaaacttcttaaactgttcattactcataagtttgatggaagctacttcatcgagacagaagatggcacttctggtttagatgtcaaagttgatcacaagggtgaccacgattttcgtgtggatgtttctggtctgcaaactgatgtgactctagcatcttattcaaagggaaacagcaaacacatacatgtctggcatgggaatcatcaccaccattacagacagactgtaagagctgagcatgcagttgaagatagc

SEQ ID NO: 5109 - DNA, 562 bp, Zea mays
  unsure at all n locations
  Clone ID: LIB143-069-P1-K6-F9
gggtgacactggtctcaagccttatatcctttacttgcgccagaataaaggcttcttcaatggctctatgggtattctttgccatgtgattttcgtatgtggccaaatagcacagaattcatggatggctgctaatgtccagaatcctgatgttagtacacttaagttgatttctgtgtacattgcaattggattcatcacagtgttcttcttgctgtttagatcgatagcacttgttgttcttggggtccaaacatcaagatctttattttcccagttactcaactcattgttccgtgcgccaatgtccttttttgattctacccctcttggaaggatacttagccgggtatcttcagatttgagcattgttgatcttgatgttccatttggattgatgcttgctgttggtgccagcataaatgcatatagcaatctgggggtgttggctgttgttacatggcaagttctgttcgtctctgtgccgatgatggttttggcactcangttgcagaagtactatttagcctcagctaaggaactgttgaggatcaatggcact

SEQ ID NO: 5110 - DNA, 604 bp, Zea mays
  Clone ID: LIB143-069-P1-K6-G10
cctcggtgactgacgcgtggccctcacctccgctttcccctcctcccaaataaaacccgaccgcagccgccggtcgtccaggaacgccgccgccgccatggccactgccggagccttccacgccggcggcttcctcctcctcccggtccgacgaagtctccgcgggcccagcccctcaccatggtcccacttccgcacccacttcatctcctccaagccgccgccctccacccctctcccgccgcccgtgccgccagctcgcctgtcccccgtgggttctgccttcgggcctcctagcagaaagaccggcgcggttggagccggggctggcgcgggtgtcgtcgggtggtaccttggcctcttggacgcgcggcccgtgctgaccaagagcgtcaccgccgctgtcatcttcaccgccgcggacgtctcctcccagatgctcacacttggtcctgaggattcacttgattttcttaggaccatgcgtatggctagttatgggtttctgatctcaggacctagcctccatctttggttcaattttatctcaaaattgttccccaaaaagatgtagtgaacacattgaagaagatgtttatagggc

SEQ ID NO: 5111 - DNA, 648 bp, Zea mays
  Clone ID: LIB143-069-P1-K6-G11
ggcacacagagtctcagacacaggcacagcagacagcagagcgccccccaacaaaaacccaactcgttttcagctcgcgcaacgggcggcctcgtagcggagtcccagtcctctcgctttctccctgcgattcgcctcagcttccatccgatccgattcgggagtcgggactcgggagatagaggcagacggagagagaagaaaggcaaggcaatcgccgcgcgcgtgcttcctgccttctcggtcggctccagctcgccgttcattcccgcaatcccgctccgctcgcggtatcgggccgtggtagtgatgccgctggctgagccgccccagtggcgccgcaaagccacggatttcttctccacatctagtgtcaagctgaagcaggcagggcaatcggccggggataatatagctgatgttgctgggaaggttgggtccgcggtgaagagtcggtgggtcgtcttccaggaggctaggcagcagcagcagcaacggccaccgcatgagacagtgcaagagcgtatcatcaccgctgctgccaccactggtttgcttttcaggaaaggcatttcagagacaaaggagaaggttgcagtgggaaaggttaaagttgaagaggttgctaaaaaaactgcagataaaagc

SEQ ID NO: 5112 - DNA, 640 bp, Zea mays
  unsure at all n locations
  Clone ID: LIB143-069-P1-K6-G12
cgcgaacgccatcccgcgttgggagacgtcgggcttcgtggagtacatcgagtcggggcacaagcagggggacatgctgctggtggtgccgcagggcgcgcacgcggtgcgtctgggcaacgaggcgtccatccggcagcgcctggccgtggcgcgcggcgcctactacgccgtcacgttcagcgcggcgcggacgtgcgcgcaggcggagcggctgaacgtgtcggtgagccccgagtggggcgtgctgccgatgcagaccatctacggcagcaacggctgggactcgtacgcctgggccttcaaggcgaagatggacgcggtgacgctggtcatccacaacccgggcgtggaggaggacccggcctgcggcccgctcatcgacggcgtcgccatccgtgcgctgtacccgcccgcgctcgccaggcgggcggggggaaacctgctcaagaacggcgggttcgaggagggcccctacttccttccaggcgcgtcctggggcgtgctcgtcccgcccaacatcgaggacgaccactcgccgctccccgcctggatgatcgtctcgtccaaggccgtcaagtacgtggactccgcgcacttcgccgtgccccagggcgcgcgcgccgtcnagctggtgggc

SEQ ID NO: 5113 - DNA, 628 bp, Zea mays
  Clone ID: LIB143-069-P1-K6-G2
cggacgctgtgggcgctgctcgaaggagagccaaatccagagcgccgccgcgatggcctcccctgacgcggaacagccggcgccgacggaactcgagcggtggcgtgacctcgacatgctcttgtcccgccctggaaacctcgtggaggccactttcgatcccagccccggcctgcgagacctactggggagcctcgtggaggttttggttgtgggcgcgggcgggcttggctgcgagctcctcaaggacctggctctctccgggtttaagaaactgcacgtcattgatatggacaccatagacgtctccaacctcaatcgccagtttctcttcagagttcaagatgttgggaagtccaaggctgaagtagcagcgaagagggttatggagcgagttaatggggtgaacatagttcctcatttttgcaggattgaagataaagagatagagttctacagtcagttccacataattgtcctaggtctggattcaattgaagctcgaagctacatcaattctgtggcttgtggtttcttagattatgactcaagtgacaatccactccaagagacggttaaacctatggtagatggtggaactgagggcttaagggacatgctagagtca

SEQ ID NO: 5114 - DNA, 619 bp, Zea mays
  unsure at all n locations
  Clone ID: LIB143-069-P1-K6-G3
gaagaagtccctgatgagtacagcaacaaggataagacagatgaagagaaaagcgagatggaggagaagaagggccagtacgccaagttctggaatgagtttggcaagtcaatcaagctgggtatcatcgaagacgcgactaacagaaaccgccttgcgaagcttcttagatttgagagtgccaagtcggatggcaaacttgcctcccttgacgagtacatctcacggatgaagtcagggcagaaagacatcttctacatcacgggaagcagcaaagagcagctggagaagtctccattcctcgagaggctaaccaagaagaactacgaggtcatcttcttcaccgaccccgtggacgagtacctgatgcagtaccttatggactacgaggacaagaagttccagaacgtgtccaaggagggactgaagctgggcaaggactcgaagctcaaggagctcaaggagtcgttcaaggagctgactgactggtggaagaaggccctggagagcgagaacgtggactcngtgaagatcagcaaccggctgcatgacaccccctgcgtcgtggtcacctccaagtaccggtggagcgccaacatggagaagatcatgcaggcgc

SEQ ID NO: 5115 - DNA, 619 bp, Zea mays
  unsure at all n locations
  Clone ID: LIB143-069-P1-K6-G4
gtgggttggcttctcctccccctccggttcgggttcgggttcgtgaggttctccggggttcggtttcgtgggtgggcggatcgagatggcggcgtcggatgttgagtaccgctgcttcgtcggcggcctcgcctgggccacggacgaccactccctccacaacgccttcagcacctgcggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctaccgtggtggccgtggaggcggcggctacggcggtggcgggcgccgtgatggcggcggcggctacggcggtggcggcggcggctacggtggcggcggtggctacngtggtggtggtggcggctacggcggtggcaaccgtggcggcggctacggcaactccgacggnaactggaggaactngagcggtgggcccgcgcggccaagttatcctgttcgctaccgtgatgttnaccctagtccagag

SEQ ID NO: 5116 - DNA, 475 bp, Zea mays
  unsure at all n locations
  Clone ID: LIB143-069-P1-K6-G5
attgcgtttgctctggttcttgtgagagagcatcaggcggaggcaattggatgtgccactgntgcaggattcattctgttcagaggccctcgaagatttttataccgcaatacctttggccgtttaaagactgagaaggatttactgaatgatgccgagcaaagtatgatggagtaccaaacatctattcagaacttgaagaaagaatcaaaatacactcttgacaaagtagctatcggtgaaagcgatgtgcagcgtgggcgaactgatctgagatctactgggaagcagatacaatctcttataggttccatttacaaagcagaatctacagctgcaggtctgatggatagactaagaaccattccaaccaggcattctttcgagctgcgagcagaggtggcttncatggcctccgatttgaagaaccagaggtgtgccttgcangaaaggatcaacaaaatatctgaatatg

SEQ ID NO: 5117 - DNA, 562 bp, Zea mays
  Clone ID: LIB143-069-P1-K6-G6
gctccagcagctgccacagagacatcagagagcggtcctccttgtgagtctgagctgaggaggaggagaagcagcagcggcgcagcgggaggaggaggccgggagagcgaagatgcgccgcgtcgcgctgttgctcgtcgccgccgtgtgcgcgctggcgccggctgccgcggtcgtcactgacggtcttctcccgaacggcaacttcgaggatggcccgcccaagtcggcgctggtgaacggcacggtggtgtcgggcgcgaacgccatcccgcgttgggagacgtcgggcttcgtggagtacatcgagtcggggcacaagcagggggacatgctgctggtggtgccgcagggcgcgcacgcggtgcgtctgggcaacgaggcgtccatccggcagcgcctggccgtggcgcgcggcgcctactacgccgtcacgttcagcgcggcgcggacgtgcgcgcaggcggagcggctgaacgtgtcggtgagccccgaggggggcgtgctgccgatgcagaccatctacggcagcaacggctgggactcgtacgcctgggccttc

SEQ ID NO: 5118 - DNA, 552 bp, Zea mays
  Clone ID: LIB143-069-P1-K6-G8
gcacccaaggccgcgcccaagcccaagccctcgccgaaggcgaaggccaagaccgctgcgaagcccaaggcggcgtcgcccaaacccaaggccaaggccaaggccaagcctgtcgctcctgccgccgcgtcgcccaagccccgcgggcgccctcccaaggtcgccaagacctccgccaaggcctcccccgccaaggcagccaagaaggcggctgctcctgccaagaagggaaaggcagcggcggctcctaagaaggtggcaaccccgaagaaggctgctgctgctgccgccccggccaggaagggcgtggccaggaaggccaagaagtagtctgcctgccttgtcgctggcgagatccccccctcaattccgcctatagattcccctctttcatggattttgatccaatcgtaatattgtcagtagctctagattcgtcggtagctccagcatgagtgtcggtggtagttctgtgcctgtaaaaacttgggatagttgatcgcgtgtgatcagccgtcatgctcctccagtctctatgaacaagctaagcta

SEQ ID NO: 5119 - DNA, 636 bp, Zea mays
  Clone ID: LIB143-069-P1-K6-G9
aacaacacccagctctgccccagcccgccacaggagttcccgcatctccctctggtccggtcacaggagctccgagacctctccaatggcggttaagatctacgttgtgtactattccatgtatgggcatgttggcaaactagctgatgagatcaagaaaggtgccttatctgttgaaggtgttgaggctaaaatatggcaggtccctgaaattctctctgaagaagtgcttggaaagatgggcgcgccccctaagcccgacgtgccagtcatcacaccgcaggaacttgcagaggctgacggtatcctctttgggtttccgacaaggttcggaatgatggcagctcagatgaaggcgttcttcgatgccaccggtgggctctggagggagcagagcctcgctggcaagcctgccggcatgttcttcagcactggaacccagggtggtggccaagagactacaccgctgacggcgattacccagttgacgcaccacggcatggtgtttgtgcccgtgggctacaccttcggcgccaagctgttcggcatggaccaggtccagggtggcagcccctacggcgccggcacgttcgccgccgacgggtcgaggtggccgagcgaggtggagctggagca

SEQ ID NO: 5120 - DNA, 643 bp, Zea mays
  Clone ID: LIB143-069-P1-K6-H1
gagaccttgcgagaggctgccgtgtagggaccgtagactcagcgactgcgaggagggataaggggatggccgggatcggaccgatcaggcaggactgggagccggtcgttgtgcggaagaaggcacccaccgccgccgccaagaaggatgagaaggccgtcaacgccgcgcgccgcgccggtgcggagatcgataccatgaagaagtacaacgctggtacgaacaaggcggcatccagcggtacatccctcaacaccaagcgcctcgacgacgacaccgaaaacctcgcccatgagcgagttccaagtgatctgaagaagaatctcatgcaagcaaggctcgataagaagctgacacaggcacaacttgctcagatgataaatgagaagccacaggtgattcaggagtatgaatcaggcaaggcaatccccaaccagcagatcattagcaagctcgagagggccctgggaaccaagttgcgtggcaagaaatagctttcctacgagtttgtgtcccggagcatcataataaggggaagacaaggcaagctgtctgcttatttgtctatgtttggtatctcaagtcctgcggactgtttctgttggcacaagagggaataaatgtgttcacggacctgtaatgc

SEQ ID NO: 5121 - DNA, 609 bp, Zea mays
  unsure at all n locations
  Clone ID: LIB143-069-P1-K6-H10
gaaatggataaaggtgttgtattaaggcaacaagttgtttcaaggcatcatttaggcagaacggagaagcttgctgaaagtagcattttatctggttccgtagttacttcaaagcatgcagctttagcaaggccttcaaattacaaggatccaaatgtctgttctgcaccaagtagaaacaaaacttgtgaattgaaactacggtctgagattgaagaacagtgccaaaaacatgagttagatgtagatgaacgtggcattggtcctagcaaaaactctcgtgtgctaataggatctataattgtcgcaattaaagattgtagtgaacacttgctggacttaggttccaagaatgacccagtacctcccaatgtaaagacaaagaaacatgcatcagtcaaggtggtgcaacaagttacccatgagggaaacagaaatgaaggtgttcctgatagtgataaccgttctagcctcagtgttactacagatgaaatcagttattcaacctgctgcgatgcagatntggcagtggatgaacatttacaatgcaccacgttttccagtgaagaagcgacagccttttctttctcaaagatggaaagaagcaat

SEQ ID NO: 5122 - DNA, 78 bp, Zea mays
  Clone ID: LIB143-069-P1-K6-H11
cccacgcgtccgactgaaatagctactggaatctcgtgatattgataatcaatgatgtaccatgatgctacttcctgg

SEQ ID NO: 5123 - DNA, 247 bp, Zea mays
  unsure at all n locations
  Clone ID: LIB143-069-P1-K6-H2
cggtcgaccagcgtccgcgagatgagcgtgttgccaaggccaaccgttgagtggagcttgtatcctggtgcacttgcactagtactacgtttctggcagtcgtattttttcttgtgtttttacccatgtttagactttgagacctatatctaaggttttggttctcagtgaacaatgaaaattactgtgaaatgcggttgttttggtgcagnaaanaaanaaanaanaaanaaaaaaaaaaaanaag

SEQ ID NO: 5124 - DNA, 527 bp, Zea mays
  Clone ID: LIB143-069-P1-K6-H3
caaatgctaaggaaacatggtgttgttggcaaatttgttgaattctatggtgaaggtatgggtaagctgtctttagctgacagggccacaattgcgaacatgtcaccagaatatggagctaccatgggcttctttcctgtggaccatgtgacattggattaccttaaactgacaggccgcagtgatgaaactgtgtcaatgattgaagcatacctgcgagccaataaaatgtttgtggactacaatgagcctccaacagagagaatatactcatcttatcttgagctgaaccttgatgaggtggagcctagcatgtctggcccaaagaggcctcatgatcgtgtccctttgaaggaaatgaaatcagattggcatgcttgcctggacaacaaagttgggttcaagggttttgcagtgccaaaggagcagcaggataaggttgtcaaatttgactttcatgggcagccagcagaaatcaagcatggtagtgttgttatagcagcaataactagctgcacaaacacctc

SEQ ID NO: 5125 - DNA, 552 bp, Zea mays
  unsure at all n locations
  Clone ID: LIB143-069-P1-K6-H4
gtttacaggaatgcagaggatatgaattaccactcggtctgtttgcatgtgttggcagattcaatacggagtgcaggcttgatactagcttcttggtttctttcattggggattgagaatgctgaggttctgtgcctgggaatcgtctcagtggcagtgtttatgcttgttttgcgcggtatttaaagctactggtaatatcctactgcaaatcgcacctagcaatgtgccaccttcagcctttacaaagtgctcgagacagattgctgcttgtgaagatgtctccgaagtatggcaaggtcgattctgggagcttgttcctggtcaggcagttggatctctctccattagggtgaagagcggcgctgacgaccgggcagtccttgaatacacgcatggtttatatcaggatttgggcatacaggatctgacggtccanactgatgagtttgtagggcctgttagttagacggtaggggttctatcccagcttcacgaaagtgttgttttcagtttttttttcctaccaagtagtttctttcgcaaccgtgt

SEQ ID NO: 5126 - DNA, 640 bp, Zea mays
  Clone ID: LIB143-069-P1-K6-H5
gagcacaccgcgtcgctccatagcagaggacagaggaggagcaagcgagcaccgagcagaggcagagtgctatggaggcgcggaggacggggagagactcctcgcgagcttcgtgctcgcggcgttggccgcgcaggcattcgtggccgtggtcgagtccagggccagccgggcggagaaggctagccaaggcgacgacgtgaagaagccggactgcgtgccggggatggacccgcgctcgttcccgggaatcggcagcggcggccacggcggcggcatcacgcccgtgactccgtcgcacggaggctccaccgggacgccgtcccacggcggcggcggcggcggtggggacttgccgtcgccgtcgcacggagggacaacgctgccttccccgtcctacggcggcagcggtggggacttgccatcgccgtctcacggagggacaacgctgccttccccgtcccacggcggctccgggtccacgccgacatcgccctccaccggcggctccccgtcccacggcggcttcgggtcctcgccgacggccccgtccaccggtggcggctacggtggctccccgtcccacggcggcggcgcgtacggtgggtctccgtccactcccggcagcggtggcgcctac

SEQ ID NO: 5127 - DNA, 599 bp, Zea mays
  Clone ID: LIB143-069-P1-K6-H8
agctaggctcctttccacagctgtggctttgaggccaacaagcctggtagcagtgggtcagctagggaacacgtacctcctccacggagagctcaagctcaaggttagtcgcgagctgaggacactcttggccagcagcggcgcctttctgaacggaagagagcgtgctccacggtccaggaaggtagacaggaggatggtaagcagagagagcatctcatccgctcttgtggatgtatgcgaggaatgcgagagcctccttgtcgaggccggcagaagctacaggatggccctctccatcgattcaggtgacgccaaggcattgtacaactgggggctggcacttattttccgggcacaattgctcgctgacatcggaccggaagcagcagccgacgctgaccgggtgtatctagctgcaatcgacaagttcgacgccatgttgtcgaggagcaacacttatgctccagaagatggggcactgcgttgcagcagcgctcccatctgcggcctcggagcaacggtgagaagataaggcttctggagcaggcgaagagcttgttcgaagatgtgctgtatgtggaagcagacaacaagat

SEQ ID NO: 5128 - DNA, 546 bp, Zea mays
  unsure at all n locations
  Clone ID: LIB143-070-P1-K6-A1
ggcgcagagaatccccaagcaaacaaacagggtagaggtagagggagaggagaggagaggagaggagaggagaggttgggtctgggacaccatggctccgatgaagctgtacggggcggtgatgtcgtggaacgtgacgaggtgcgcaacggcgctggaggaggctggctccgactacgagatcgtgcccatcaacttcgccaccgccgagcacaagagccccgagcacctcgtccgcaacccgtttggtcaggttccagctctgcaggatggtgacttgtacctcttcgaatcacgcgcaatctgcaagtacgctgctcgcaaaaacaagccagaaagttgtggatgagaaccttgagaagctgaagaaggtgctagaggtgtacgaggcacgcctgaccaagtgcaagtaccttgctggagactncctcagcctcgccgacctgaaccatgtgtctgtcactctctgcctgtttgctacgccctacgcatctgtgctcgacgcctacccgcatgtgaaggcctggtggtctggtctgatggaga

SEQ ID NO: 5129 - DNA, 555 bp, Zea mays
  unsure at all n locations
  Clone ID: LIB143-070-P1-K6-A12
gttattaaaaggatggaagattaccgggaacctgtaaggcctcaatcagctttccagggtgttggaagaacccttggtggtggaccttccccagatgagagtgcaacacctgctcctgcaccaacggcccctgctgcttcgaggtccgctggcatagtcgtggatgactcccagccatttacatccatacagctgaggctggctgatggcactcgcatggtcgcccggttcaacatgcaccacaccgtgggagacatcaggtccttcatcgacgcatctcggcctggaaccgcaaggccgtatcagctgcagacaggtttcccacccaagcagctggctgacccaacgcagaccgtggtgcaagctgggctggcaaactcggttatcatgcagaagatgtaatgtttcgacaacatgggtaactaggatgcatcgtactgcatcttttgagaactgtcgtattgtggttgactggtgcgtcattcatggtcttaagagtttatagttcatctatgaactgaattatgctttctgatntacagcagatactgaagt

SEQ ID NO: 5130 - DNA, 403 bp, Zea mays
  Clone ID: LIB143-070-P1-K6-A2
cttcgatggcacccaaggcggacaagaagccggcggcgaagaagcctgcagaggaggagcccgcgacagagaaggcggagaaggctccggcggggaagaagcccaaggccgagaagcgcctcccggcgggcaagtccgccggtaaggagggcggcgagggcaagaaggggaaaaagaaagcgaagaagtccgtggagacctacaagatctacatcttcaaggtgctgaagcaggtgcaccccgacatcggcatctcgtccaaggccatgtccatcatgaactccttcatcaacgacatcttcgagaagctcgcggccgagtccgccaagctggcgcgctataacaagaagcccaccgtcacctcccgcgagatccagaccctcggtgcgcctcgtcctccccg

SEQ ID NO: 5131 - DNA, 616 bp, Zea mays
  unsure at all n locations
  Clone ID: LIB143-070-P1-K6-A3
atttatagtgaaacactggaagttgagatggggcaatctatggagatgggaaccattcacgctggaaattttctgagacgtttctgctcaactcttgggatgaacaatcaagctgttagggcagcccaggatgcagttaagcactcggaggagcttgatataaggaggagccctatctcaattgcagccgctgtcatttatatgataacccaactctcagaggacaagaagccacttaaagatatatccttggctactggtgtagcagaaggcaccatcagaaattcgtacaaggatctgtatccttatgcctcaaggctcatcccgaatacctacgccaaggaagaagacctgaagaatctctgcacaccttaggaggcttacttttttccccctttctgttactacataattcggaattagatttgtcaaagaggagtgagtgaagttgttcctcgttgtgactgtaccgggcaagggtgtcgtcccgccgtgcttaactttatgatggaatttcttttcagagcacctaccacctgaagatttgtgggatacgtatactcacttncgaaagaatgtagatagcnagcagntggacaagcccagtttttaattt

SEQ ID NO: 5132 - DNA, 411 bp, Zea mays
  Clone ID: LIB143-070-P1-K6-A5
ggctaatttccatggaagaggcacacgtttctcaattgaaagctcgcaacgatagagacccgtgactgaggcaggtccatgcccgggaggcaaggacaaggtcacgttacctacggtttctgggacatacagatctgagcactccatttcattcacccgtccaaaaaccatctaatatagatcaagattagcatctccaagactgtcacaaaaaatgaggcaaaaaatagtttttaatagttgcaaaaatgtattggataaaagggaacgtaattcttctgtccctatttttggtgtacaaagcctaccaggttaaatcttattccgttattcctatcttatgtggattgaacgagattgaaaaaattatgaaagatattgatttgtttagaatttaaatccattcaattc

SEQ ID NO: 5133 - DNA, 584 bp, Zea mays
  unsure at all n locations
  Clone ID: LIB143-070-P1-K6-B1
cgaacatagctacctactactcaagtatccatccttattgagtacagtgttgatccatggactcggaaggagttgtagcagcaaaggtggcagatgagactactaaaccggcaatccaagaagacggcgccgagagcaaggccgggatgactgatctgctgatgctgaccgacaagtcgcagctgcaggcgctggcgatgctgctgcggaacaacgaggagctcatgatgagccaggcgatcaagtcggagacggagcgcattgagtacctcaagacggtgagcgactgctacacgcggacgatgaagctcctcgacgattccatggcggccaggaccacgtacgagcgttcgggcggaacgaggagcctcgtcgcccgggacatggacgactacgtcgtctacggcctcaacgcgtgcttgcagaacgtccgcaactgctgcgtgcgcctggacgccatcgacaagctgcgggcgcactacgacgccctcgccgacgccgtcgccgacccgggcgccaacgtcgagggcctcgccgcggaggcgtncgagtacaaggccgccatgtggcagtactgctacacc

SEQ ID NO: 5134 - DNA, 500 bp, Zea mays
  Clone ID: LIB143-070-P1-K6-B11
gaggcgagagagaacccaaacggagagagaaatcgagagagatggcaaactgttttggtgacgtcgtggacaattacaagctagacacaatgccaagatatatcggcaaaaagaagactcgagaagaccgggcacgagaggcctcctatctcagtaatgagaatgagaagtacaagaaagctaaagactatgtgaacatgctgaaggactggtacggcaatggagcgtcgaagctgtgcgtgatctacaaccagacgggcggaaccctgcggtacgtcgacgacaaggactggctgggctacccggggccgacgccctacccgacggagatcggcaacgggcagtgggcgtccttcctccacgtccacaagaccggcgcctcgtcggggtccatggccgctgtcgtctaccgcggcaaggacggcggcggcagcgagcgcgacttcgccatggcctggagcaccccctggggcgcctccaagaacagggcctactgcgag

SEQ ID NO: 5135 - DNA, 438 bp, Zea mays
  unsure at all n locations
  Clone ID: LIB143-070-P1-K6-B12
ggagaaacctatgtttacgtttgcaaacaaggcagggctcgacatgttagaaacatctcttattgcgctgcaagacctgacgctagacaagatcttcgacgagtcaggaaggaaagcaatattctcagatatctcaaaactaatggaacagggctacgcgtacctgccgtcgggcgtgtgcatgtcaggaatgggtcggcatgtctcattcgaccaagctgtagcgtggaaggtgctcggcgaggacagcagcgtccactgcctggcgttctgcttcgtcaactggtccttcgtttgacacgccatcccatggcctgtgtgatgagcaggccaatttttttgtatggtgatcccaatatggggaaaccatcagctgtgacagaaggctttatgttgcatgcactagttgtacgtcttgaatcgagtgtatttatgang

SEQ ID NO: 5136 - DNA, 522 bp, Zea mays
  Clone ID: LIB143-070-P1-K6-B2
actagttctagatcgcgagcggccgcccacacgatgacaagtctgctccatatagtcctgtgtacaatggcaaagccagtggctcaatgagccccaacggtcagccagaggcaggtgccaaatttgttgaaccttctgggaaacctgagcctgcatctccagtgcgctgcagcaaaggcagagatgatgatgaggaaggtatcatagacgaggatggagagattggtgaggatgatccgcgtgcaaatgcagctgtgcagaatggtaataactgacggagagtggcctgcatcttctgtgacaaccaagacttatctgttatgcaaaatgcagtcattcccatctgcaagtcctgaatacggaaatgcatttgtgtgccattaaatatctcgtagaacatgtgatactgatgcctctgccatcgatgaaccaaaactgttgatgcatgtcatgtcatgttgttaaacttaatgacattgttgtgttctggtgttttacagccagttctgtaagtgatttatg

SEQ ID NO: 5137 - DNA, 434 bp, Zea mays
  Clone ID: LIB143-070-P1-K6-B4
attttaacacctagtagttgttgttgacgatatgcttctctgtgcttccggttctgcatgatccaggcagcagccaggaacaacaagctaggccccctcacgcagaccgcacgaccgagcgcgcggcattgaccgacccatcgccgccgccgccgcctcgatcgaccatgacgcttgcgagcacggacaaggtggggctgggatgcatcgcgttcagcatcttctgggtgctggccgtcttcccctcggtgccgttcatgccggtgggccgcaccgcgggctcgctcctgggcgccatgctcatggtgctcttccgcgtgatgaccccggaggaggcctacaaggccatcgacctcccgatcctgggcctgctcttcggaccatgggtggtcagcatcttcctggagcgcgccgacatgttcaagtcctcggca

SEQ ID NO: 5138 - DNA, 530 bp, Zea mays
  Clone ID: LIB143-070-P1-K6-B5
gcctacttttgcttgctgaaatgagctcagctggcaaccttgcttatggagactacactgctgcggctgtaaagattgccgagcaacatcctggctttgtaataggatttatatcagtgaatcctgcatcttggtcaccagcaccgtcaagcccagcatttatccatgccactcctggggttcagatggctgctggaggagatgcccttgggcaacaatataacactcccttttctgtcatcaacgacagaggtagtgatataattatagtcggacgagggattataaaggccagtaaccctgtagagaccgcgagacagtatcgcatggaagggtggcaggcgtatcaatccagcttttcttgaggatgtttaagcaactctccaaacgtagccggaggacattcgggcgagtgttgatgtgataagagtgcgcctatctatgatctatgtatgcaactgcgttctttcacttttacctgcccatcattgccacgcagtgattttcagtaatgggtctgactggacccc

SEQ ID NO: 5139 - DNA, 494 bp, Zea mays
  Clone ID: LIB143-070-P1-K6-B6
cccacgcgtccgcccacgcgtccgcccacgcgtccggccgactagccgtccgcgcaaaaccctccctgctcagactcgtctgctgcagctcctcctccgccgccgtatcaaacgcactctcctccgccgccgcccgaggcaagatggttctccagaacgacatcgaccttctgaacccgccggcagagctcgagaaactcaagcacaagaagaagcgcctcgtccaatcccccaactccttcttcatggatgtcaagtgccagggatgcttcagcataaccacggttttcagccactcccagactgttgttgtgtgcccaggctgccaaactgttctctgccagcccacgggaggaaaggcgaggctcacggagggatgctctttccgccggaagggagactagagtggagtctgttattagtactggatcggttgtcaatctccagtatgtggattcaattttgctctgtgccagacgttaaggcatgaacta

SEQ ID NO: 5140 - DNA, 230 bp, Zea mays
  Clone ID: LIB143-070-P1-K6-B7
atacaacaaggtggtgtatcttgtcggccgtagtctgttgtacaacttgtttccaaaggcttaatgatcgaatataactctgttttggagggcctaagctgatttcagcttcattccatgtacattgtgtctggcgttctgcttggattgcatagtatgtatattgtgtttcttcgttgttgtcatggacagtgtcagctcctgttttagtacaagttgtttctagtgca

SEQ ID NO: 5141 - DNA, 361 bp, Zea mays
  Clone ID: LIB143-070-P1-K6-B8
ctcaaggctatagatggtgttactatgaaagatataacgtctgttgctgaaaagatcatttcatccccattgacaatggcatctcatggaaacgttctgaatatgcctacttatgagtcggtcagtggcaagttccgctcaaaatgaggagtacatgacccttcccttcattttatcaccttgtttgctggacaagttttaccagtcccttgtcattcacgtctaggccatggttcttggtcagtttcagaagaaataaggaacctcatgcagttttgttcgtgaaacctgtgatcacttcacaattattcccttttctcattcttttgcggaacattcgtgtggttaatgctggtgatag

SEQ ID NO: 5142 - DNA, 283 bp, Zea mays
  Clone ID: LIB143-070-P1-K6-C1
cgttccaagacactggagagtctgagcctcgccaacagtgatagtagtgttgaataggcttgagtgacgtgggttgggactagcatcgatcaagtctgctctctatgctgcatctgtaggctgcgtctatcgtgatatgcaatacactgctctaggtgatgatgattatatgaataatataatccccacacagagaaccaaccattacagtcgatcaccgtcaagcacaacgaccagctactcatcagccacaacccgtatggtcagactgcacgtatgcagg

SEQ ID NO: 5143 - DNA, 642 bp, Zea mays
  unsure at all n locations
  Clone ID: LIB143-070-P1-K6-C10
cccacgcgtccgagaagatcgagtgagaagttgcgcgtgtgaagccatcacaccaattaaagatcgagatcatccatggctagttctctacttcagcagctgctgtctctgctgctgctcctgctgccctctcctcttcgtctccgggagcatctatcaggaaaccatgctgtcagcgccaacaacttccaccccatctttctggtagctggggtgagctgcagcgacctggaggcacgcctcaccgaggagtaccggccgtcggtgccgcactgcggcgccatgaaggggaaggggtggttcggtctgtggaagaacagttcggagctgctgtctcgtgactacgtgcagtgcttcgaggagcagatgagcctcgtctacgaccctgccatcaacgagtaccggaacctcgccggcgtcgagacgcgagtgcccaacttcggctccacaagagccttcagccacaagaaccccctcaagtcagactggtgcctcggaaagctgagagccgcactggaagacatgggataccgagacggagacaccatgttcggagccccctacgacttccgctacgcgccgncgtnccccggccagacgtncgangtgtactcccgctacttcaaggagctgatggagctg

SEQ ID NO: 5144 - DNA, 581 bp, Zea mays
  unsure at all n locations
  Clone ID: LIB143-070-P1-K6-C11
cccacgcgtccgagaagatcgagtgagaagttgcgcgtgtgaagccatcacaccaattaaagatcgagatcatccatggctagttctctacttcagcagctgctgtctctgctgctgctcctgctgccctctcctcttcgtctccgggagcatctatcaggaaaccatgctgtcagcgccaacaacttccaccccatctttctggtagctggggtgagctgcagcgacctggaggcacgcctcaccgaggagtaccggccgtcggtgccgcactgcggcgccatgaaggggaagggggtggttcggtctgtggaagaacagttcggagctgctgtctcgtgactacgtgcagtgcttcgaggagcagatgagcctcgtctacgaccctgccatcaacgagtaccggaacctcgccggcgtcgagacgcgagtgcccaacttcggctccacaagagccttcagccacaagaacccnctcaagtcagactggtgcctcgngaagctgagagccgcactggaagacatgggataccgagacggagacaccatgttcggagcccnctacgacttccgctacgcgc

SEQ ID NO: 5145 - DNA, 585 bp, Zea mays
  Clone ID: LIB143-070-P1-K6-C3
cccacgcgtccgcccacgcgtccgcggacgcgtggcgcactcgcgcacccgtccatcgcatcgcatctgtcctcccatccacctcagcgccacgccgccaccgcaccccaatcacacgcgcgccacccgcgatgacgccggcggcggcgatctccggctccagcagccacgtcgtcgtctcctccgcccgcctcaggcagccgttcacgctccctccgcgcaccgcttgcccaatcgccgccgccgcctcgcccgtgacccgccgcggggtcgcggtcgccgccgtgtcgagccccgttgtgtccgccgccgcggggaaggatgccaaacaggctcctaaggatttccttcaaatcattgattttgacaaggatacaataatgaagattcttaatcgagccatcgaggttaaggcattgataaagtctggagacaagagcttccaaccgttcaaagggaaaacaatggccatgatttttgccaagccatcaatgaggacccgtgtttcatttgagacgggattctttttacttggtgggcatgctatttattttgggtccagatgatatccagatgggcaaacgt

SEQ ID NO: 5146 - DNA, 551 bp, Zea mays
  unsure at all n locations
  Clone ID: LIB143-070-P1-K6-C5
cccacgcgtccgtgcaggtctaactcctaaatacagagatgtgcaaactctctgctcgatgttgacttataatcaggccttccctgaaattctgcaaggaatgcctgtacagccatacgtgactcgttacaccccatcaactgatgaattcgaagttgaccgctacttgctacctcctggaaaatcagtcaccatgtctccggtgcctggtccatccatattcatcgtcttgacaggagaaggagaaatccaggcaggtttcatgactggcagtgcaaaggcgaaggaaggtgacgttttctttgtgccggctcacaccaaggtcaagctctacacttcttgccccaggtccatgcaactgtatagggctggggttaacagcagtttcctgagttgatgggcaactggtttctagggttggcatctgtaggttaggtaccagctacacaatgattntcatgtttggcacttgtccagaagtaagttaattatgtgggttctcatcgtgtataggaaatatggagataattaagtcatcccttggttatttt

SEQ ID NO: 5147 - DNA, 506 bp, Zea mays
  Clone ID: LIB143-070-P1-K6-C6
gttgatcttcaagttttctgctttgatttgacaggtgttgatgtcaagaagaatgtgattgtggccattacctctgataagggactctgtggtggtatcaattcaacctcggtgaaagttagcagggcccttcacaaactgacatctggtccagaaaaagaaagcaagtatgttatattaggagaaaaaggcaaagttcagctgctgcgtgactcgaaggacagcattgaaatgaccgcaagtgaactacagaagaaccctatcaactatacacagattgctgtgctcgcggatgacatattgaaaaatgtggaatatgatgctctgagggttattttcaacaagttccattctgtcatatcgtttaagcccacaatggtaacgatactgtcccctgaggttgcagaaaaagaatcagaagctggtggtaagatgggtgacctagattcttatgagattgaaggcggtgagacaaaagcagagatattgcaaaacctagctgagtt

SEQ ID NO: 5148 - DNA, 527 bp, Zea mays
  Clone ID: LIB143-070-P1-K6-C8
catatatattgtaggcggtatgttgtttcttctctatcaggagaggattgttgtgagtgtgaacttgcttttgctctcgagcattcaaggactgacaagggcatgttgcatctatgttacgatgttggagattttaatcgatataacggctaactaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccaaaaaaaaagggggggcccttttaaaggaaccaagtttaccccccggggcttggaaagtaaaacttttttttttggggccccaaaattaaaatcccgggccgggtttttaaaaccttggaattggaaaaaccctgggtttccccaaattaaaccctttggaaaaaatcccctttttccaaagtggggtaaaaaaaaaaaggccccccccgttcccctttccaaaaaattgcccaaccttattgggaaaggggccccccc

SEQ ID NO: 5149 - DNA, 546 bp, Zea mays
  Clone ID: LIB143-070-P1-K6-C9
accgagccggcgcccagtgacccttccagaagcttccagaaggtcaccgccatggccgcgcccttcttttccactcctttccagccctacgtctaccagagccagcaaggatctgtgacggcgtttcagatatccggtggagatgtgcaggtcctgcaggtgatgctgaagtctcaggagaagctgactgcaaaaccaggtgcaatgtgctacatgtctgggaatatgcagatggacaacaattacttgcctgaaaatgatggaggcgtgtggcagtggatttttgggaaacgtgtaagcagcaccattttctttaattctggatctgatgatggatatgtcgggattgctgcaccatttcctgggaggatactgccggtagatctaacaaactttagtggagaacttctttgccaggcagatgcttttctatgttcggtcaatgatgtctccgtctctagtacagttgagccaaggccacggaatattgagattggtgcagagatgatccttaaacaaaacttaggggccaggggatggcttttc

SEQ ID NO: 5150 - DNA, 366 bp, Zea mays
  unsure at all n locations
  Clone ID: LIB143-070-P1-K6-D1
cgaacatagcgaccgacgacacaagaaggcaagcgggacgagcacagagccgagccaggggcgcaggaggagcagnagcagccaagggggcagacgagacgaccaaaccggcaaaccaagaagacagcgccgagagcaaggcccggaagacngaccagcngangcggaccgacaaggggcaggagaaagcacaagcgaggcagcngcggaacaacgaggaacncaagaggagccaggcgagcaacnacggagaccgagcgcagcgaggaccgcaagacggagagcgacggcaacacgcggacgaggaagcagcacgacgacagcacggcggacggaaacacaaacgagcgggcgggcagaacgagg

SEQ ID NO: 5151 - DNA, 611 bp, Zea mays
  unsure at all n locations
  Clone ID: LIB143-070-P1-K6-D10
gcggtgtaaccctaacgccgccacgcgcggccatccatggcctcctgcgacgacgacttcgttctcctcggtgacgacgcacaccagccggcaactccgccacccccggcccccaccgcgcagcaacccgcgccgccgccgccgccgccacaggcctcccatcccttcagcttcactgacgcggttgcgggggctgccgccggcgccggctccttcgcgcaggcccaggaggagagcaaccaccacgccgagcgcggcaagccggcgcaccacgccaagcggggcagggagcgcgccgaggagttcagcagcgatgggggcgagtactgttcctatatcaacagcagcggcagcggcggtggtgggaagaagggccgtggcggtggagggagctcgagcgtgtcagactaccgtaaggatcgggaggagtggacggacggcgcgatcagcagcctcctcgacgcctacacggaccgatttgagcagctcaaccggngaaacctgcggngtcgggactgggaggacgtggccggcgccgtgaccgacgggcagggcaagactaccggngccaagagcgtggagcaatgtaagaaaatagatcgacatcttaa

SEQ ID NO: 5152 - DNA, 500 bp, Zea mays
  Clone ID: LIB143-070-P1-K6-D12
aggcaccacacctcttcttcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactgagccggtcaggcgatggcgcacgagagtcgagaggacgacgacgagtcgtataaatataatagcggcgtctaaataagatcctgtcaactgcacccgccattatcgatccatggtcgctcctggggttcatgttcatctgtaacgtgctcgcggtcatgtccgtctcgtgccggatttaatattt

SEQ ID NO: 5153 - DNA, 553 bp, Zea mays
  Clone ID: LIB143-070-P1-K6-D2
gtcagaatcttctctcttgacaaggagcaagcctaatcccagaaccccacggtcgtgagaccctagctgccgtcgccgccgccgtcgccgccggtgaccggcgacggcgatctagatgggggcgtcggcctccgtgctctcgttcccaacggccgccgcgttcccagcagccgccacctgccgtcgccggggcccgccggctgcttcgcgctcggctacctcctggccttcacccgcctcccgcgccacgccgccggcccaggttcgggagggacctccgatgacgattccgaggatgactcggaagaagatgatgacgaaaactccggccgcagtcgcgcggcgaagcgggcgggagggcagaagagggccgggctccggctgctctactgggcacggaacgtggtgaccaagtccgactctgccagggaggcggaaaggtcccggtctcaggccgcggccagtcccctggagatcgagaaccttgctgagataatagaagatttcaaaatggtgtttggttgtgaggaatgatctgaagatggggaagggg

SEQ ID NO: 5154 - DNA, 601 bp, Zea mays
  unsure at all n locations
  Clone ID: LIB143-070-P1-K6-D3
ggtcgaagatagtgagcttgcagatgttgctgctgttagtgcgggcaacaactacgaaattggtaatatgatagcagaggccatgagcaaggtcggtcggaagggtgtggttaccctcgaagaagggaggagttctgaaaactttctctatgttgtggaggggatgcaatttgatcgtggttatatctctccgtactttgtaacagacagtgagaaaatgtctgccgagtatgagaactgcaagctacttttggttgacaaaaagatcaccaacgcaagggatcttatcaatgttttggaagaagccatcagaggtggatacccaatcctgataattgctgaggatattgagcaggaggctcttgctacccttgttgtcaacaagctcagaggatcattgaagattgctgccatcaaagcccctggttttggagagcgcaagactcagtacttggatgatattgccatccttactggagcaactgtaatcagagatgaagttgggctgtcacttgacaaggctgacaaatcagtccttggaacagcagcanaggtttgtccttactaaagagtcgacaacaattgttggtgatggcagcac

SEQ ID NO: 5155 - DNA, 459 bp, Zea mays
  Clone ID: LIB143-070-P1-K6-D4
cacacacaacaaccacactcttgcaccgagctagcagccaagatggcgaccaaacacctggctctttgcctccttgttctctttagcataggcatgggcatggccaccgctgctgcaaaccgcaaactgggttatggccccgggggaggaggtggcggtggtggtagcggtggcggtggtggcggcggctacggaggcggtggcggctacggcggtcggcgcgagggtggtggtggcggctacggcggcggcggcggcggctggagggactgatgtgtgggcccatcctggcttcggccgagttatcttatctatctatagtatcgtgttaccgttcgcttctgtcaccgtgttagtgtccgttctacctttggattaggtgttggtacccctgttgttccctttgtttgctcccgctatgaaacgagacgagagaagaatgagcaaggtttttgttcg

SEQ ID NO: 5156 - DNA, 481 bp, Zea mays
  unsure at all n locations
  Clone ID: LIB143-070-P1-K6-D5
caggtctgtcaaacattatacacttgcaacagggtttgcatgtgcaaaggggtctctgcttgatcggaagccagaaaatgccgctgacacgattaagcttctttacgagcatttgcctgatcagaagaaaccatttgtgaaagatgaactcgagaaacttattgctggatggcctacggaggtggtaaagaggcagaagaaagataagaggaaggcgttggaagaagctttgatgaaggacatcgctacgatggtggactgcctgacaaagtccggcctcgacatccctgtggaactggacaagctttccaccccacagctccaagtggcgtagcaaaagaaggcgcgcggctcgccatacaaccggaacagacttggagtctcgaggaacagcantgcattttggtttggcactgatgcaggcagcgcagcgcagcgcaggacgcagattgaaaatctgtgatagatgaaatcatgtttt

SEQ ID NO: 5157 - DNA, 566 bp, Zea mays
  unsure at all n locations
  Clone ID: LIB143-070-P1-K6-D6
gttctttaaagaacacccctccagtcaggccgtcccgcgccgacgtcaacggagacgtgtcaacggcggcggtgagaagacccataaccttctagatttttttccgctgcctcaatggatctctgggagagggcccgggccttcgccggcgaggcggcgaagcggtcgcaggaactctccgcggaggcggccaagcgctcgtcggcgctggtctcggagacggcgaagaagtccaaggagatcttctccgaaaccgcctccaagtcgcgggagatcgccgctgaggccaccaagcaggccgacctcctcgccggccagatcaagcacctcgcctccgacctccctgtgccttcgatcccgcccatccncgcgatcccgcctatccccgccgctgcctcgtcggtgcccgacgcggccgagcttgagtgctacggcatcaccgacgacctccgcgagttcgtcaagggcatgaccataaacaccttccgcgacttcccactgcaagatgagcctgaggtgtctgatgtgccaactgtgtcgaatgtgcgtcaggatctgaacgagtg

SEQ ID NO: 5158 - DNA, 581 bp, Zea mays
  Clone ID: LIB143-070-P1-K6-D7
atggcctccgccgaaatccccaactccagccccgacgccaccaaccccgcccccgccgccgccgccgccgccgccaccggccccgacctctcctcttcgccgccgccgctcccgccgcgcaagcgccgcctttcgccttccccaccaccaacgcggtccgcgtcacgctctcggtccccccgctcccgctccccgcacggccgacgctcgcgcagccggagccgcagcccgcagcagtacccgaccgatggcaagcggcaacggcacaatggccttaccgtggatgcgtgccgcgatttcctgcgcgacaggtgcacccgctccgacctcgagtgcagatacgcgcaccctcacaactccgtttccatcgacctggacaataaggtgactgcgtgtgcggattctctgaggaacaattgcttccgggggatgacatgccgttactaccatccgcctccacatatccaggagcaattactgagatcagttggtgtggaagacccaaaggtgaagacgatctgcagagattttacacgtgggaagtgttcaagatcagcaaatgagtgccgattcttgcacca

SEQ ID NO: 5159 - DNA, 304 bp, Zea mays
  Clone ID: LIB143-070-P1-K6-D8
cggacgcgtgggcggacgcgtgggcgctaatatgggacctgagattagctttttgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggctttatttataaaaaaaaaaaaaattaaattaagctgcactttcaataaaataaacatttttataaaaaaacaaaaatttaaatcaaattaaccttattttaaaaaaatgctaatttgaaaaaaccctgttattacaaaattaa

SEQ ID NO: 5160 - DNA, 207 bp, Zea mays
  Clone ID: LIB143-070-P1-K6-D9
cacacctctcaccagtccccacacggccacaccacacccagctgtccccatcgcgcgcacactctctcggtctctccctcccagtcccagcgtttgcggtccagtccagagagctcgagcagccatggcggctcccctgttcctcctcctcctgctgctggctatgttcacaggctcaggtgagcgagctctccggatctgcatgct

SEQ ID NO: 5161 - DNA, 403 bp, Zea mays
  Clone ID: LIB143-070-P1-K6-E1
ctggcttcggcggcggttagggcggacgtgaactgcgcggacgtggacgcaagcctgcgcccctgcgtcggctacgtgacgggcaaggaggcggccccggccgccgagtgctgcgccggcgtgaagcggatcagggccatgccgtccggcccggcggagcggcggcaggcgtgcgagtgcgtcaagcaggcggcggccaattaccagccgctcaacgccgacgccatccgcgacctccccgcgcagtgcggcgcgccgctgccgttcccgctcaccctcaacttcgactgcaccacgtgcgtatatatatatatactaggtaaatgcccgtacgttgctacggagtgaacatgttatgataagatacattgaaattcaagaataatgattgcaattttaaaaa

SEQ ID NO: 5162 - DNA, 422 bp, Zea mays
  Clone ID: LIB143-070-P1-K6-E11
tgatgaggtgtagatgataccattgatgtgctcgttccaaatattgaagcctgcaaggaagatgatggggtgggttcaactaataacaaatctggcttcaagtcattcaggggatggtgacaacggcctgatggtgggcacgcctgcgttcgaccagggggtaccatcttaccagcggctgcaactaacaggcatatgcattttcgcggaaacctgcttgggccttggaagggcaaagcagatgtagaactgtgcatcttccatgttggattaacacttgatgtaatgtattggtatcggtttttactgtgcggatctccttatgatatgggaggatgtgaatgagtactgccctcccctttgcgtcctaagattcggaaagaatccattcgccaataaaaatagccagactattctccttt

SEQ ID NO: 5163 - DNA, 235 bp, Zea mays
  unsure at all n locations
  Clone ID: LIB143-070-P1-K6-E12
cccacgcgtccgcggacgcgtgggcaactatcaaaatattatactatataaatgtcaagtatattcatataaataccattacaaaattttctagcttcatttaaccatccattcaacacatcaaagataattggataaagtagtaacactatgatagtactacatagcacattacatgttccattacatggtcanttaaatntgttggttaaatagtaaaaaagttggatgacta

SEQ ID NO: 5164 - DNA, 59 bp, Zea mays
  Clone ID: LIB143-070-P1-K6-E2
aaaaaataaaaaaaaaaaaaaaaaaaaaaaaaggggcaaagaaataaaaaaaaaaaaaa

SEQ ID NO: 5165 - DNA, 628 bp, Zea mays
  Clone ID: LIB143-070-P1-K6-E3
cactagaaaccccaccaaacggaatttcacatccagcgagcaataccgcaccgcaggtaagatcaaagaggaggcgatggctggcggcgggcaggcggcgatttcgttcatgacgcggatggcgaaggtggcggcggggttgggcgtggcggcgtccgcagcctccacgtccttctacacggtggacggcggagagcgcgccgtcatcttcgatcgcgtccgcggcgtgctcccgcgtacgatgtcagagggcacccatttgctggtccccatccttcagaagcccttcattttcgacatccgcactcgccctcacagcttctcctccacctccggcaccaaggacctccagatggtcagcctcacgctccgcgtcctgtcgcgacccgacgtcgaacacctcccggacatcttcacctccctcgggctcgagtacgacgagaaggtcctcccatccatcggcaacgaggtgctcaaggccgtcgtcgcgcagttcaacgccgaccagctcctcaccgagcgtccccacgtctccgcgctcgtccgcgaatcgctcaccaagcgcgcccgcgagttcaacatcgtcctcgacgacgtcgccatcacccacctagcctacgggcaggag

SEQ ID NO: 5166 - DNA, 385 bp, Zea mays
  unsure at all n locations
  Clone ID: LIB143-070-P1-K6-E4
attgaattgagacatgttggaagtcgcatgcctatatatatgttggagctgtacggtactggaccgtagagcaaatccaatcgcctctagataccacaccagcgtcttcggcagggcttgtggcagcagctcacgcagggaatgatgacaagaggttgttattattagtgaagaatgtcgacagtggccaatagtcatgtaaattattcgtcgtgtagaggtgcaagtgacaaatagccacggttttgtaattctcaactaggattaggtattgagacctgtaattcgtctgggcagacctcaaactgaaggtcaacaacgtagcgtggccctattgtagaatgtatgttgccccacaatctaaatgattcaacgctgcaattna

SEQ ID NO: 5167 - DNA, 576 bp, Zea mays
  unsure at all n locations
  Clone ID: LIB143-070-P1-K6-E6
acaagctctcaaggccacgtatggactgttcagtgatgatggagttctgaaactcccttactgcattgcgatatcaggattcgtctgtgctcttttcgccattggaatcccttatttatctgccctcaggatttggttggggttctccacgcttttcagcctcatgtatattgtgatagcagttgtgctgtcgtcgagagatgggataaccgcacctgcaagggattacagcatccccaaatcatcgcagtcaactcgagtcttcactacgataggttccatagcagaccttgtgtttgcttacaacaccggcatgctgccagaaattcaggcaaccatcaggcctcctgtggtgaagaacatggagaaagctctatggttccagttcaccattggctccttgcctctctatgctgtagttnttgtgggttactgggcttatgggtcctcaacatcaggctacctcctcaacagtgtcacaggcccagtctgggtgaaagcggttgcaaatctgtcggcattttttcagacaatcatagcgctgcacatctttgctagccccatgtatgaattcct

SEQ ID NO: 5168 - DNA, 489 bp, Zea mays
  Clone ID: LIB143-070-P1-K6-E7
aagtgctgatatgctacttgaagaaaaagaacttgatcttgatcttatacggaaggcaaagatattccaccatggctcaataagtcttataactgagccctgtaaaactgcacatattgcagctgccagagctgctaaagatgctggagtacttgtttcatatgatccaaatttgaggctttcattgtggtcatcacctgaggatgctagagatggtatcctgagcgtatggagaactgctgatattttcaaggtaagtgaagaggaggtttcctttctcacaaatggagaggatccttatgatgatgccgttgtaaagaaacttatgcactcaaacctgaagttgcttcttgtcactgaaggtccagacggctgtaggtattactctaaggattttagtggtagagttggtggacttaaggtaagtgctgttgacacaactggtgctggcgatgcctttgttgctggagtgctatctcaattagccac

SEQ ID NO: 5169 - DNA, 608 bp, Zea mays
  unsure at all n locations
  Clone ID: LIB143-070-P1-K6-F1
ccgggcataccccccgagctcagcctagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtcggtgggcgcgaacatctccggcgggcacgtgaacccggccgtgaccttcggcgccttcgtgggcggcaacatcaccctgttccgagggctcctgtactgggtggcgcagctgctggggtccaccgtggcgtgcttcctgctccgcttctcgacgggcgggcaggccacgggcaccttcgggctgacgggcgtgtcngtgtgggaggcgctggtgctggagatcgtgatgaccttcgggctggtgtacacggtgtacgcgacggcggtggacccgaagaagggcagcctgggcacca

SEQ ID NO: 5170 - DNA, 537 bp, Zea mays
  Clone ID: LIB143-070-P1-K6-F10
cttggtcgatgcaagcggcaatcgcaccatgcggccatgcctatctagtgcagtcaagatacaggccaatgaatttagaaaggaggatttcaaaggctccaagtggctcattgtgagatatgcacaacagaacatggaacagattgtcgaagctattaggattgcgaaacaggaaggcctttcagtatcattagatttggccagtttcgagatggttcgtgactctaggtctaaacttgttaaccttttggagactggtaacattgacctttgcttcgccaacgaagatgaagctagggaggttatagggggaagcctggaatcagatccagaggaggcgcttgcattcttgggcaagtactgcaaatgggccgtggtgacacttgcttcaaagggatgcatggcaaagcatggcaaacaggtcgttcgagtcccggccatcggggagagaacgcggtggacacaactggagcgggcgacctgttcgcgagcgggttcctgtacgggctggtgaaggggctgccgctggaagagtgc

SEQ ID NO: 5171 - DNA, 447 bp, Zea mays
  Clone ID: LIB143-070-P1-K6-F11
ctaagcagacaggtggcgcagtacaaggtggctggaatgcggactggaaaaggacaatcggtgaccgcatgctatcggggtgcacggcctggtaacacctaaaactcactaaggaagcgagccatgagggagatggagagctcctctacgcctaccgcgtcgacgtcgtcttcaccggccacgtgcacgcgtacgagcggtccaaccgggtgttcaactacacgctggacgcgtgcggccccgtgcacatctcggtgggcgacggcggcaaccgcgagaagatggcgacggcgcacgcggacgaggccggccactgcccggacccggcgtccacgccggacccctcatggggggccgcctctgcgccgccacttcacgtcgggccccgccgcgggccgcttctgctgggaccgccagccggagtacagcgcgtacagggagagcagc

SEQ ID NO: 5172 - DNA, 274 bp, Zea mays
  Clone ID: LIB143-070-P1-K6-F12
caccgttgtccacgagcccatgtgcacctcctcctcctcctccgcgctgctgtcgcccacgccgctgtctccgatggtgtcctctcctgctagtgaataggagaagacttgacaactgagtgaggagatgacgatggagatggatcacaccggcccgtcacgctcagtttttctttttgtgtgtcaccgggtactaataacatgttaggaacttgtgggtttttatgtcgcttataacttctcgtcgaaataaggcttttctaagcttttgagt

SEQ ID NO: 5173 - DNA, 551 bp, Zea mays
  Clone ID: LIB143-070-P1-K6-F2
ggccgaagaagaggagaagcgaagcaagcaggcttcgagaacaagactgcagggggagggggaggaccaagcgaaaggggaactagagcaagatgggcggcgcactgctgcttgcgctcctcctcgtctctgctgctgccgcccctcaggtacttggagttggcaatggagacaatcacatgagaatcatccaggaggacatcatcgagacagtcaacaaccatcccagtgctgggtggacagcctcacgtaatccttacttttcaaactataccattgcgcaatttaagcacatacttggagtgaaaccagcaccacagaatgcactaagcaatgttcctgtcaaaacttattcaagatcactggaacttccaaaagagtttgacgctagatctgcatggtcccgttgcagcacaattgggaacatacttgatcaaggtcactgtggctcttgttgggcttttggtgctgtggagtgcctccaggaccgtttttgcattcacctcaacatgagcattttactttcagtcaatgacctactggcatgctgc

SEQ ID NO: 5174 - DNA, 537 bp, Zea mays
  unsure at all n locations
  Clone ID: LIB143-070-P1-K6-F3
gacgaaaccgcggcgatcgcccacacagctcccctccaataaaaacacccaccttgctgccgatttcgggggcgggagtgccaagtggtttctagagctgggtagagattggcggtttgccgatggggagaggcgacggggaaggagggatggcgccgcggggcggcgtggttgggtcgggggcaatgctggggctggacatgcacctcgccgcgcagcagatgcacccggccgccgccgcgttccagcaccagcaggaccaccaccacgatgggttccagctgcagcagccgcccccgccgccgtcgttctcgccctactccaacacgtcgtcgtccagggtcgtggtgagcgcggcgacggtggggcacgatgaagacacggtgggcaacggctgctgcgggaagggaggagttggtggtgcancagcagcaacagcaacagatggcggcggcggggtgcccgtggaccaggatgaagtggaccgacgacatggtgcgcctgctcatcagcgtggtctacagcgttggggatgac

SEQ ID NO: 5175 - DNA, 511 bp, Zea mays
  unsure at all n locations
  Clone ID: LIB143-070-P1-K6-F4
gtaatcggagttgttccatatgttggtctcaactttgctgtatatgagtccctcaaagactggctactccagacaaattcatttggccttgcaaatgacaacgagctgcacgtagttacaaggcttgggtgtggagctgtggcgggaaccattggccagactgttgcatacccgcttgatgtcatcaggagaagaatgcagatggttggttggagccatgctgactctattgttactgggcaaggcaaagaagcactccagtacaatggcatgatcgatgcattcaggaagactgttcgtcatgaaggagttggtgctctctacaagggtcttgtgccgaactcagtcaaggtggtgccctcaattgccattgcatttgtgacttacgaggttgtgaaggatgtgctaggagtagagatgaggatatcagactgaggatgggccgttttcaactgctatntttgtaggctttgggaaagttgtgttttttttttgtaggcagggcgggtag

SEQ ID NO: 5176 - DNA, 601 bp, Zea mays
  Clone ID: LIB143-070-P1-K6-F7
gcaaaagggcgtgtttgagactagcggaccgaccttgaagttgaagttgaaaaggtcggcctgcgcggcgatggatgtcaagtgccggcgtctggaggggaaggtggccatcgtgacggcgtccacgatggggatcggcctcgccatcgccgagcgcctcggtctggagggcgccgccgtcgtcatctcctcccgcaagcagaagaacgtgaacgaggcggtggaggggctcagggccaagggtatcaccgcggttggtgccgtctgccacgtctccgacgcacagcagcgcaagagcctcatcgagacggccgtcaagagctttgggcacatagatattcttgtctccaatgctgccgcaaatccttctgtagatagcatacttgaaatgaaagagtctgttctcgataagctgtgggatattaacgtcaaggcttctatccttcttattcaggatgctgctcctcacctacggaaggggtcatctgtgattattatttcttcaattgctggttacaatccagaacaaggattgacaatgtatggtgtcacaaagactgctctctttggtctcacgaaggctcttggctgtgagatggga

SEQ ID NO: 5177 - DNA, 470 bp, Zea mays
  Clone ID: LIB143-070-P1-K6-F9
ctggcacgcacgcaccagcaccagcaccacaccacatgaatggtggagcctagcacgggcagctagctcccggccggcgacgtgacgaccaccaccaccacatgttgcatgagcagcaggcaccgccaccggcagtagcagcgccaccgccatccatcaaccccgacgacgacggcgcccgcgatgtcgaggtcaccacgttccgcgacatccaccctctgacgcccgacgcgccgccgcccgcctccgcgtcctgggacaccgccagccaccgctccttgtcgtcgtccgacgaccagcagtacatgacgatgagccgcgagttcacggccatggtcgccgccggggcgaccatgcagcccggcggctacgacggcgccgccgaccagctcaccagcatcggcgaggacgagctggaggagaccaacccgctggccatcgtccccgacagccaccccatcgccacgccc

SEQ ID NO: 5178 - DNA, 468 bp, Zea mays
  unsure at all n locations
  Clone ID: LIB143-070-P1-K6-G1
gttcacctcgctgcaacccaaaatctggtctccactgccggcatttgggggaatttctcggttgggtgaaggctgagttatttcctcgagtggtcaagttgttttacttccacagttcaccagtttcagcttttgtaattcatcggttcatattcttcaggcggcagccagtccgtgctgcgaacgacttcccagatacatgtaacataaatcttataaaaaatatatatgtaacagaaattactttttttgtcgtttctttgtacggcacaaggacagtcgtatttaaccttgagctggttataccagagtgttactattttaaaaaaaaaaaaanaaaaaaaaaaaaaaaaaaaaaaaaaaaaaaaanaaaaaaaaanaaanaaaaaaaanaaaaaaaanaaanaaaaaaaaaaaanaaanaaanaaaanaaanaaanaaaaaaggggcggcccttttaaagaacc

SEQ ID NO: 5179 - DNA, 575 bp, Zea mays
  unsure at all n locations
  Clone ID: LIB143-070-P1-K6-G2
tgacatcattggtgtgaccaaggggaaaggttatgagggtgtggtcactcgttggggtgtcacccggcttccccgcaagacccacaggggtctccgcaaagttgcttgtatcggtgcatggcatccggctagggtctcctatacggttgctcgtgctggtcagaatgggtaccaccaccgcactgagatgaacaagaaggtttacaagatcggcaaggctggacaagagacccacgatgcctccacagagtttgacaggactgagaaggacatcactcccatgggtggcttcccccattatggtatcgtgaagggtgactacctgatgatcaagggctgctgtgtgggtccaaagaagagggtggtgaccctccgccagtccctcctgaagcagacttcccggctggcgctggaggagatcaagctcaagttcatcgacacatcgtccaaatttgggcacggtcgcttccagactaccgatgagaagcaaaggttctttggcaagctcaaggcgtaaggtgctgcggtgcancgaagtcccatttctaaaatcatcaaactgtgatacttttttt

SEQ ID NO: 5180 - DNA, 475 bp, Zea mays
  Clone ID: LIB143-070-P1-K6-G3
accaggtcttccacttgctcacgcgcgctagctaagcctccgcaccgccggccggctctggcatggagaagaagcgggtggtcatcgtcggggccggcgtgagcggcctggcggcgtgcaagcacctcctggagctggggttccggccgaccgtgttcgaggcggacacggtgctgggcggcgtgtgggcgcgcgcgccggcctgcaccgagctgcagacgccgcggcccttgtaccagtacgcggacttcccgtggccggagagcgtgacggagacgttcccgagccaccgccaggtgtcggcgtacctggacgcgtacgcgcgccgcttcggcgtgctcggctgcgtccgcttcggccgccgtgtggtcggcatggagtaccgcggcgtcggcgagcgggacgtggccgcgtgggagggagtggggccggaacggccaggccttcggcggcgccggcgccggcgagtggtctg

SEQ ID NO: 5181 - DNA, 295 bp, Zea mays
  Clone ID: LIB143-070-P1-K6-G4
ctcgagaggttctactgggtcatgtgcgtgctcagcaccatcaactacctcttcttcctgttcttggccgtcaggtacaagtacagaaacgcgggggtcatcaaaggctaatgccatcttcatatggccagtcggcgttgccattaatccccgtggtcttgagcaatgctgggtgtaactaactgtttatataggtggaaagcagagggttgaagaaaatgtaggttaattttctgcaggatgtgaggaatgatggtggtttatgaagctgtaatggatttggttgattggttca

SEQ ID NO: 5182 - DNA, 555 bp, Zea mays
  unsure at all n locations
  Clone ID: LIB143-070-P1-K6-G5
gagtatatcatcgcctattcgattctcactacttgtccatgctgcttaaaagaatccctctggtcctgattaattagaagctgtagttgtccttgacttgcaaccatgtatccacagatggtatatcatgcagatgttcgggcgagggagaaggagttggcggcggcggagacggagacggagaccatgggctgctgctcctgcgctcccttgggcaggatgatatccagatgtatcatcaaacgcaacgtaggaagagaacggcgcatgaggtacgacgagaggacgggaatggactatgccatggcgtacgctcccccgcagacatgctacgtgcgcccaacagacgcgcgcaccgtcaccttggccaccaccaacgcccacgccgaccatccggatccacacccacagcgagcgcacgcagcgacgaccatgccgcttgaaccggcgggcggcgcccctgcccaacgcgccggcatgcagccaccgcgcaagcccaagaagaagaagaagaagaaacatgtccggttcacgcctncagggccaccggtgccc

SEQ ID NO: 5183 - DNA, 580 bp, Zea mays
  Clone ID: LIB143-070-P1-K6-G6
cttgtgatctcaacccaagtcgtgcctccgctccggtcacccgtcgctccacgcaaccatgtcgaggaggaagaccagggagcccaaggaggagaacgtcacccttggacccactgtccgtgaaggagagtatgtctttggtgttgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagatgtcgcacagcgctgcaaggagcttggcattactgcactgcacattaagcttcgtgccaccggaggcaacaagaccaagacccctggacctggtgcccagtctgccctcagggcgcttgctcgttccgggatgaaaatcggacgcattgaggacgttaccccggtccccacggacagcactcgcagaaagggcggtaggaggggaaggaggctgtaggcgtctcttctgcgtgccatttgctggctcttgtcgggtggccatcatgaagctagtcctctctgggtg

SEQ ID NO: 5184 - DNA, 620 bp, Zea mays
  Clone ID: LIB143-070-P1-K6-G7
acaaaaccttcgttggatcttgcacaggagatccttagcatgttcactgcaagggagatggggaaagttttcttcacaaacagtggttcagaagcaaatgactctcaggtcaaactagtatggtattataacaatgcattggggaggccaaacaagaagaaatttattgcgcgatcaaaagcatatcatggatctacattggtttcagcgagcctaactggtcttcctgccctacaccagaagtttgatctaccagcaccttttgttctgcacactgactgccctcactactggcgatatcatcttcctggtgagacagaagaagattttgcgactagacttgccaccaatttagagaatctcattctcaaagaaggaccagaaacaattgctgctttcattgctgaacctgtgatgggtgctggtggtgtcatccctcctccaaagacctattttgacaaggtccaagcaatcgtcaagaagtatgacattcttttcatagcagatgaggtgatcactgcatttggaaggctgggaactatgtttggatgcgattactataacatcaagccagatctagtttcactggccaaggctctttcaacgcctacgtacccatc

SEQ ID NO: 5185 - DNA, 586 bp, Zea mays
  Clone ID: LIB143-070-P1-K6-G8
aatggctttccgatattgcccgaagcctacttggatatctctggaagttctattaaccccagtgagagaacctatccagaggagatgatccaaactgggatatccaccattgatgtcatgaattccattgctcgtggacaaaagattccactgttttctgctgctgggctccctcacagtgaaattgctgctcagatttgtcgtcaggctggtcttgtgaagacattggagaaaggaaagcatgctgagggtggtgaagatgacaactttgctattgtgtttgctgctatgggagtgaacatggaaacagctcaattcttcaaacgtgattttgaagagaatggttccatggagcgggtcaccctttttctgaatctggctaacgaccccaccattgaacgtattatcacccctcggattgctctaacaacagcggaatatttggcatatgaatgtgggaagcatgtacttgttatcttgacagatatgagctcttatgcagatgcacttcgtgagggttctgcagcccagaagaggtgccaggtaggcgtgggtatcctgatatatgtatactgatttggcaaca

SEQ ID NO: 5186 - DNA, 71 bp, Zea mays
  Clone ID: LIB143-070-P1-K6-H1
gaccaatttacaggagaagcgaagcgagcaggacggcacaacaagacacacgggggagggggaggaccaag

SEQ ID NO: 5187 - DNA, 199 bp, Zea mays
  Clone ID: LIB143-070-P1-K6-H10
gaaatttttggcgagtgaatgattaggttggttgagcatgagctggtgaaagctggtaccatttgtatagtgtgatgaaatctttgtagacattttgcttgtgtaataataatacttgttcgcacaaaaaaaaaaaaaaaaaaaaaaaaaaaaaaaaaaaaaaaaaaaaaaaaaaaaaaaaaaaagggcgaaccaatat

SEQ ID NO: 5188 - DNA, 624 bp, Zea mays
  Clone ID: LIB143-070-P1-K6-H11
gaaacgaattaatccccaatcaacacagcaagtcagcaacaagcaaagcagcgacccgagagatggacgcgaggatgttcgggctggagaccccccgggtggcggcgctgcatcacctgctggacgtgcccgacggcgacaaggcgggcggcggcgccacgcgcacctacgtccgcgacgcgcgcgccatggcggccaccccggccgacgtcaaggagctcgcgggagcgtacgcgttcgtggtggacatgccggggctgagcacgggcgacatcagggtgcaggtggaggacgagcgggtgctggtgatcagcggcgagcggcgccgggaggagcgcgaggacgccaagtacctgcgcatggagcggcggatgggcaagttcatgcgcaagttcgtgctgccggacaacgccgacgtggacaaggtcgccgccgtgtgcagggacggcgtgctcacggtgaccgtcgagaagctgcccccgccggagcccaagaagcccaagaccatcgagattaaggtcgcctgagtgtagaccgttgtcggagcagtgccagtgagctgggtggcaacctgcgggactctggtgaggaagaagcaatggtagaaagcagtagctgtgcttc

SEQ ID NO: 5189 - DNA, 569 bp, Zea mays
  Clone ID: LIB143-070-P1-K6-H12
cgagaggtggaggggaggtgtgccaccggaagcggaaacctcgggtgtcgtcgaccaacctcgtcgatccggttgcgacgcggtgtgctagaataactaccgaccatggtagaggaggagatcaccgagggcttgaagaacctcaccgtcaccggagacgcggcggcttcgggcggagaagggcagaggaggggcggcggcatcagcagcaaccgcatccaggtgtccaacaccaagaagcccctcttcttctacgtaaacctcgccaagaggtatatgcagcagcacggcgctgtggagttgtccgctcttggaatggccatagcgacagttgtgaccgtggcagaaattctgaagaataatggatttgctgttgaaaagaagatcaggacatctactgttgacataaacgacgaatcacgagggcgtccattccaaaaggccaagattgagataatcttgggaaagagcgacagattcgatgagttgatggctgctgctgccgaagagaggggagaagttgaagaaggcgaagagcatgcttgaaagaaaaaaaaaaacagtaccga

SEQ ID NO: 5190 - DNA, 538 bp, Zea mays
  Clone ID: LIB143-070-P1-K6-H2
caaagagctaccctgaccagatttggccggttcctcctctgcctcccgctaaccctagtccagccccccgagatctgctccgcgcgagcagccatggcggagacgctcgacatgaccctcgatgacatcatcaagaacaacaagaagagtaacccctcctccggcggggcccgccgcagccgcggcggatccgcccctggcggcggcagcggcggggtcgggccgaccaggcgctccttcaagagggctgggaacaggcaggcgccctaccagccgccgaaggcccctgacgctgcgtggcagcacgacatgtaccctgcggtcgccgcaggaggcggctgcggcgggagggtctcggcgctcgagacgggcaccaagctctacatctacaacctggactttggggtttcgaacgacgatatcaaggagctgttctctgagctaggtgatctgaagcgtttttcgataatatatgatcgaagtgggaggtctaagggaacagctgaagttgtatttgcaaggcgttctgatgctgtag

SEQ ID NO: 5191 - DNA, 182 bp, Zea mays
  Clone ID: LIB143-070-P1-K6-H3
accaaatctaccactagctcacacccactagctaatccataacataccgacaccttgctatcgggtgcagaggaagcgcgtgcccatcggctgcttcaggcgtgagccacctgccagcgtgccagctccacctaggcctcgggttccgcccgaccgcgttcgaggctgacacgggggtgggg

SEQ ID NO: 5192 - DNA, 559 bp, Zea mays
  Clone ID: LIB143-070-P1-K6-H4
gagtagaccatcgcctattcgattctcactacttgtccatgctgcttaaaagaatccctctggtcctgattaattagaagctgtagttgtccttgacttgcaaccatgtatccacagatggtatatcatgcagatgttcgggcgagggagaaggagttggcggcggcggagacggagacggagaccatgggctgctgctcctgcgctcccttgggcaggatgatatccagatgtatcatcaaacgcaacgtaggaagagaacggcgcatgaggtacgacgagaggacgggaatggactatgccatggcgtacgctcccccgcagacatgctacgtgcgcccaacagacgcgcgcaccgtcaccttggccaccaccaacgcccacgccgaccatccggatccacacccacagcgagcgcacgcagcgacgaccatgccgcttgaaccggcgggcggcgcccctgcccaacgcgccggcatgcagccaccgcgcaagcccaaggagaagaagatgaagaaacaacgtccggtcacgcctccagggccaccggtgcccgcgc

SEQ ID NO: 5193 - DNA, 263 bp, Zea mays
  Clone ID: LIB143-070-P1-K6-H5
agcagctcagccaccttgttatggcgatgcaggctgctttcctcgcggggttctctcagcgggccgggcagacgagccgcggctgcgccgctggcagtggcgccctcgctgcagggcggtgctgcggtgggtagcgccaaggcgagcgcgacggtaggcttgtaggcggagatcgggggggcggccatggcgccctgctcgtgccctgccttgcgcaggctgacaagcatgttcaagatcaaacgcaacgagcgaagaggacc

SEQ ID NO: 5194 - DNA, 61 bp, Zea mays
  Clone ID: LIB143-070-P1-K6-H7
aaaaattataatataaatatatcacaagacaaaccttaaaatgttaaatagaaaaggacag

SEQ ID NO: 5195 - DNA, 539 bp, Zea mays
  unsure at all n locations
  Clone ID: LIB143-070-P1-K6-H9
gcggcgtcgccatcgatcgagtagatactagatagtgtgtcaggttgctgtcagctagagccatggcgtccatgcagaagagccgcgagcagcgcgcccaggccgcggcgcagaaggcggccgacgagctccacgcgtcgaggcaggacagagtccccgaggaggcgcccgtcagcccccgcggcggcggcggcatcctgggcagcctgcaggaggggaaggcgaacgccaggggcgtggcggacgccgccatgggcaaggccagcgagacgaaggacgcggcggcggacaggcgggtggcgtcagggacgcggcggcggacaggacgggaaataataaggcgggggccgccgagtcggaggaggacgtgatgctaagggtgaaggcggcggaccagatgacggngcaggcgttcaacgacgtcggtacgatgggggaggagggcaccggcgttccgcggagacgacgttctggctgatggccgctggatcggaactggcctgctggcgctgtgctcctcatgtaaattagcatgcacg

SEQ ID NO: 5196 - DNA, 537 bp, Zea mays
  Clone ID: LIB143-015-Q1-E1-F10-SP6A
aaagcgaaacggggaaagcctacagtagaatatcaagaagccactaccgcatgttcggggggcgggaaatttttcgggcgaaggtaaaccgattcctgtaaaatttttgcacgattcctacgaattcatgtgctccaaaaagaggctaactatttacaactaaccagactccttgctccgacttcgcttcctccttgacctgtgtgctgaaaaggtctcactgtttctcgatctaccactccacgaatcagagctcaaatctccaccgcttgaatctgagggacccttttcagggccgctgtccacctgtttccactgggaagcttcctttttttggaatccttcggacttttacctgacctttgatgccgaacttcaatgcctggatcattatccttccttcccagcctagggcctttacagcttgaactctgatatttatttacatccgaatcaacattactatttgtggctacccaccggtcgtttgattcatggcgggtatgctttcgggattccccttttccggcatttttt

SEQ ID NO: 5197 - DNA, 571 bp, Zea mays
  unsure at all n locations
  Clone ID: LIB143-015-Q1-E1-F10-T7A
gtctgctcaagaagtacttgacanaagttgctcaagagactccgaattttggaacagaacaggataaggcccattgtccgtttcatctcaagacaggggcttgtcgctttggattgcgctgcagcagagttcacttttaccctgataaatcaatcacattgctaatgaaaaacatgtataacggtccaggccttgctttggagcaagatgaagggcttgaggtttgttagaggaaattctctaatgcataactttgtatccttaaactactgtttatttacgtttaaggatgctcaattttggtttcatgggcagtgccattttaagttgtgatagtttaatactaaagcaagctcatgtcaaaataacaagtattccactttaagcttgtaagcctttataagaagacatgagtataaataactgactacttggaaccatttgaatttttttaatctactgctcaagataactcttaccccaagttttccttggctactatcagactcgcgacagattgcatgttctttcgtgttatcttcagaacttcgacttgaggcatacagtgatc

SEQ ID NO: 5198 - DNA, 173 bp, Zea mays
  Clone ID: LIB143-024-Q1-E1-F4-SP6A
cacattacgtctgggaccaggccgaccttcgacgacgatcttgctcgccaaaaccaaagccgtaacgaagattagtattagaaaaacaataatcacgggcacggtgacagagccatttcactaaaaaggcacgctgacgctgtgccacagcgacgccgccgagttggagctgt

SEQ ID NO: 5199 - DNA, 93 bp, Zea mays
  Clone ID: LIB143-024-Q1-E1-F4-T7A
acctttattaagtatttaagcattgtagcaagtgccatccacacaggtttcagggctgtcagcaaggagcatccaatgatatttttgtctcgc

SEQ ID NO: 5200 - DNA, 581 bp, Zea mays
  Clone ID: LIB143-037-Q1-E1-G12-SP6A
catcaagcctggacagataaatacgcagcacacggagtttcagttcacgatcagtttctgaatcagtttctttaaattccatctcagcaagcgcttgttcggcatcattatcatactctgggtcaaactcgtgtctctttgcattgtatccactcagttcagtcaacgaagggccttcatctgcagaatatctgggcttcttcacaccaacacttctatcgacatgaccatcttcaacttttgatacattagacccatctttaatatgtcccacatttgaagcttttttatttgcaccaacagctatgtgcgaaggtgatcgacctgctagaccttctccaagtgcatcttccaccttgaccctggagggagaaaatggagattcagccttaggagtcagctctccaggcaacagtgaagtccctttttttactttcaccctgcactttagccatagctagaagctccttcctgttcttgccattaacatgagacatatccggtaggggataacaaggtgagttcatgtatgctgttgtgtaatgatcaatacactgtaacttagacttggaccaacatgc

SEQ ID NO: 5201 - DNA, 572 bp, Zea mays
  Clone ID: LIB143-037-Q1-E1-G12-T7A
tctcgatggtcgtcttctccacgagaccacgaccgatcaaccccaatcgtagggaactgggaacccggacccagatctcccctagatcctcaatcccaatctgccctccgccgtatcgatcatacctcccgatgcgaccccaagtctggtcgatgcgagtagcggcggcgatttagcgaactgcgcgttcgctagggttagggtttcgagggtttgcgctagggtttgggcgcacgatggggcggtcgcgaggggtgcagaattccggcgacgacgacaccgtacacaggtcgaagcggaggagggtcgcatcgggcggggatgcgacggactccgtttccgctggcatcgggggagctggagaaggagggggcaagaaagcgctctaccactgcaattactgcaacaaggacatctctgggaagatacggatcaaatgctccaagtgccctgacttcgacctttgcgtggagtgcttctctgttggcgctgaagtcaccccacatcgcagcaaccatccttacaaagtcatggacaacctgtctttcccacttatttgcccagattggaat

SEQ ID NO: 5202 - DNA, 372 bp, Zea mays
  Clone ID: LIB143-047-Q1-E1-A7-SP6A
cagcaacagcaacatggcaactagcaaggccaataacactgcagcaaccaaaatggcaactggggaaggggaacttgcttacacctgagctgcctcccgctcgcggtccactgctaaatttttgccctccgctcctggctgccttccctaaccgggctccggctccggttccttgaccgcccgcgttgacggcggctcccgtcgttgtcggggctgcggggttttttgctgcttctgcgggtgccactgccactacggtagaggggagtagtagtcggggaatcgtgggggccctggcctggacagctaccgggcggcgatgggctcggctgcggctcctcgcttggctccgaggaggatcaggtggcaaac

SEQ ID NO: 5203 - DNA, 346 bp, Zea mays
  Clone ID: LIB143-047-Q1-E1-A7-T7A
agcaaatccagcggtccgtactcatctgcttcacctccggctccgctacgcggcactcttctctggcaaccggaccacagaaacctctaggcgacgaatcgagcaggtagaggagtaatcaggcatccatggctgagcatcttgcgtccatctttggcacggagaaggaccgcgtgaactgccccttctacttcaagatcggcgcatggccgaccgcgacccggtgcttccggcttccccaccaggctttcattttcccgaaggttgtggtttggcacatggaccaaccggcggacatgaacaccccgggcgggggcgcgcaagggaaccccattgagccggagcg

SEQ ID NO: 5204 - DNA, 506 bp, Zea mays
  Clone ID: LIB143-058-Q1-E1-C3-SP6A
gggaaaaaaaacttgccgaaataatcccccggggcccggggggtaaaaaaaggcccttggggaaaaaaaatttttcaaaaaactttaaaaaaacccctattttttgggggttattgggggcaaacaaactttccaaaattttttaattaaaaattttttttttggccttttcccgggaaaattaaaattttttttttggccttaccccagcggggggggggcccttggccccctaaggggcccaagaaaaaggccaatttgaaatggggcccgggggaattcccttggggttggggggcccaaccctaggctggggggggtttttttgggggcaaccccaaaatttttggggggaaaaaccacaggggctttgccaaaaagggcataaatggcttaaagtttaagggaaaaaaactttttttggcgcttaaaaaacgggggggaatttattttttcataaggggtgggggctttcccgaaaacctttggggccccgggggaaattt

SEQ ID NO: 5205 - DNA, 585 bp, Zea mays
  unsure at all n locations
  Clone ID: LIB143-058-Q1-E1-C3-T7A
cacctagtgaaaaaaatgacagaaggacagaagctgttacaaattcagggaacgctagcaagtctgctgataaaaagcctgcacctaaagagccaccaaaagactacatccatgtgagggctagaagaggtcaagcaacggacagccatagcctcgcagaaagagcacgacgagagaagataagtgaacggatgaaagttcttcaagatattgtccctggatgcaacaaggttatcgggaaagcatcagtccttgatgagataataaattacatccagtctttacagcgtcaagtagagtttttgtccatgaaacttgaagcgattaatgctcatgtgagcaatgcaactgtagcttttccaaccaaagattttggtgttgcgccatataatactgctcctagcctgacgttggacccacaaacgccaagggaatacgcccagggctcgatgtcagattggcttctgtcatgggcatcatagggagcgagaggcaacagcanagctgggataaggctagagaataagattaagattagctgggataaggctagagaataagattgagatgagagaattgtggaga

SEQ ID NO: 5206 - DNA, 595 bp, Zea mays
  unsure at all n locations
  Clone ID: LIB143-064-Q1-E1-F12-SP6A
gaattgaacttgtgcgaccagagaaaaatgagcggtctattaatcttttgtacagtttctaatggcacacgatactccggctccagagcacaggcggccgcntgcgcttctatacagagttctaacaatcgcaaagagaatgcaattggacagcaataccgtctagggcacgacaagccgaattgagatgcagttattagctccaactctgccagaaatacgcttactagtaataacagagagaccactgaataaccccatttctgccccaggagctcctatagaacagtatatgtagttgaaatgtacattccaatcttccaatgtttacttgatggcgtctctttcggaattacttgttggcaccacccctggagagtcatggttgttcacactaagatccaccccctgagtctgggaatttgatccttgcccatgagtacgagccgggcgcatattaagatcgatcattttcgaatcaatgttaccctggccatcgcaattgccatcagagactggatcattgacgttatggtggtttgccatttgctccttgggcgtgttttgctctctctgggtttcaggatctttgatc

SEQ ID NO: 5207 - DNA, 209 bp, Zea mays
  Clone ID: LIB143-064-Q1-E1-F12-T7A
cttctctcctcgtccaaagactccaagcttctgtgacctctgttctgctgccgcctctggtccacatctctctacgccgccgccccgccgtccaccgataccgcagcgctgggaaggatcacgggggagcggagggggcggggggcccgggttttgtcgcccggatgcggcgcacgatgacactggcggcgggcggggccggcgttggg

SEQ ID NO: 5208 - DNA, 380 bp, Zea mays
  Clone ID: LIB143-070-P1-N6-A2
cagatcttaacagagtgaagtggacgcaacatcatatcgtccatcactacccctaccagatgaatcgagccgcgtataccaacaccacccaggctaggactatcagcctagaaaagaagtgaacttggtaacggccttggtgccctaggagaccgcgtgctcggcaagcttatacatgaggacgaggctcacccaggtctggatctcgtgggaggtgacggcggggtcatggttatagtgcgctagcttgtcagactcatccgcgagctgctcgaagatgtcttcgatgaacgagttcatgatggccataggcttggacgagatgccgatgtgagggagcacctggtgcagcaccttgtagatgtagagcttgtcaggct

SEQ ID NO: 5209 - DNA, 159 bp, Zea mays
  Clone ID: LIB143-001-Q1-E1-D8
aggttcttgttcatgtttcttttacccactttccgttacaaaaagatgtcattagtgagtggagaaaagcaatacgactgttctcgagagaaccgaagaattatggaaattgaggttatggcttaaaaaaaaagagattagaatgcgcagcatgcaatt

SEQ ID NO: 5210 - DNA, 215 bp, Zea mays
  Clone ID: LIB143-002-Q1-E1-B3
accacgagtccgctgcactgcactggctactggctaggtactgctcacgtgggtcgtgggtcttctgttcctgcttgatcttcaacttcaattttagatctcttttaggatctgaaaacagttttgctatttatttaaacaagctgcttaattttattttgatatttagtataattaatatttgttgactgacgtcaaaaaaaaaaaaaaaacaa

SEQ ID NO: 5211 - DNA, 408 bp, Zea mays
  Clone ID: LIB143-002-Q1-E1-C6
agaccgtagcagcgttgttaccacacagatccaaccattgggggtctttcatcatgctgaaccagaacatcagaaatttgaactgaagcgtaaaccgttcctcttgcaattgattgggaatttgccggaggaggagctcctgacatcaacactagctgcaaaactgaatgcatatgccgctgagctctgccctgtgaatacccaaaagagaattaactccaagattgatgaggtcacaaagaaaggatggcccattttaagggacatttaactctttctagcttttggactgaaaccgatcgatgcaatgtagacacagaagaggtgcatgattttgcatagaagatttttaggaatatttcagctgttcgccactgccatgatgacctcaagcatccagtcgtcagt

SEQ ID NO: 5212 - DNA, 217 bp, Zea mays
  Clone ID: LIB143-002-Q1-E1-D12
atttttgtcccttttataaaaaaaactgttgtataccattatttcgttagttacacttaacggtgttaagtgggtgtttgtcactgctctaggtttcaacttgagtgtgaagatgatgtgtttgcaatacttccatcgttaatatggtatgcttataatacccttataaacttttgtaaacactaccacctccaagcgagaagacatatccacttat

SEQ ID NO: 5213 - DNA, 289 bp, Zea mays
  Clone ID: LIB143-003-Q1-E1-B7
gcgaaggagaaagcagaccaacctatccacgcagtgagaaagaggccaaaagggaggggagagtgtcgtcatggcttccattgtcgcttccaggagggccgttcctctagttcgcgctctggagaagctcatcgcagcgtcctccgctcccgggactggctccgccctcaggccggtggcagtcgccggcggcctccgcggctacaacaccggcgctccgctccgacgctacgagggggccgagtcggaagacgatagcgtccgcgagtacgatgggcggcacggcggc

SEQ ID NO: 5214 - DNA, 86 bp, Zea mays
  Clone ID: LIB143-003-Q1-E1-C2
gacagttttcctcatgaattgcctcgagttttcccagcttcttgagggttacagcttgggtggcactttccggggatgtgtcgtcg

SEQ ID NO: 5215 - DNA, 458 bp, Zea mays
  Clone ID: LIB143-003-Q1-E1-F5-R2A
cccacgcgtccgcccacgcgtccgcccacgcgtccgtgaagaacaaggttttctccattgatctcgtttcagatgaaccttcagtgattgcttgtgatatggctcatactccattggagccatcctctatagatgttgcaatattttgtctttctttgatgggaatcaactatccaagttatttagaggaagcaaatagggttctcaaaccaagtggttggcttgttattgctgaagtgcgaagtaggctagacccgagcaacggaggtgctgatcctgaaaagttttctaaagccattatccagcttggcttttcgcttgtttcaaaggatgtgaaaaacagaatgttcattctgttctacttcaggaaaaaggaaaaaagtaaggtggcgaagagcatcgattggccacagctgaaaccgtgcttgtacaaacggcgatgagccgcttgtctcgta

SEQ ID NO: 5216 - DNA, 434 bp, Zea mays
  Clone ID: LIB143-003-Q1-E1-G1-R2A
cccacgcgtccgcccacgcgtccgcccgtttcgagccagggcatcctcgcgtctcgctctcacccctcctcggcgcctccccgaccacagtgtaaagcccctgtcccttcctcccccccgactcgcccctcatggcgaggaggcgctgctgatgcctcgcggcgtcggatcggacgcggcggccacgacacctagccgcttgcggtggcgctcgcctacgcgcccaatccgccgacgctgctcctcggaccccccgagagattcaggccccgtctcgcctcgtcctgcctagtgcctaggtgaggctctggccttcaaaggtgcgtgggtgggatttgctgcctcggtttgcgttattcccaagtgccctgcccatactccaacagcggtccagtcgacttccccaagtgctcgacccctacaaggcagcgcgc

SEQ ID NO: 5217 - DNA, 559 bp, Zea mays
  Clone ID: LIB143-004-Q1-E1-B11-R2A
cccacgcgtccgcccacgcgtccgatcacaattcacacagcgaaccgagaaaccaacacagcaacaagcaaagcagcgatccgacatccgagagatggacgcggtgatgttcgggctggagactcccctgatggcggcgctgcagcacctgctggacgtgcccgacggcgacgccggcgcgggcggcgacaacaagacgggcagcggcggcagcgccacgcgcacctacgtccgcgacgcgcgcgccatggcggccaccccggccgacgtgaaggagctgcccggcgcgtacgcgttcgtggtggacatgccggggctgggcacgggcgacatccgggtgcaggtggaggacgagcgggtgctggtggtcagcggcgagcggcgccgggaggagcgcgaggacgacgccaagtacctgcgcatggagcggcggatgggcaagttcatgcgcaagttcgtgctgccggacaacgccgacgtcgacaaggtcgccgccgtgtgcagggacggggtgctcacggtgaccggtgagaagctgcccccgccggagcccaagaag

SEQ ID NO: 5218 - DNA, 365 bp, Zea mays
  Clone ID: LIB143-004-Q1-E1-C12
acccacgcttccagtgagtcagaaccgcctaccaggaaaaaggacaaaggtggtaagggaaacggaacccacggaggaggtggtgtcatttcctgggataaaggggcaattgatgcattgaacggcaacacgggtaatgctattgggactggtggatggtaagatttccgccaatataatatgaactctgtcggtgcgtgtgtctaattcgtatccgttacttctccatgtgtactctacactatctcgaacatggcttgtgaccatttatacatttaaacattaccttattggtggcagtatcaactaagagatatttgtgttcgaagaccgaaacataatgcaaaggtatttcaacaatgtac

SEQ ID NO: 5219 - DNA, 366 bp, Zea mays
  Clone ID: LIB143-004-Q1-E1-D11
gacgcgtggggcgctgcgtccccatccagaaccatcctccgctcgacaccttctctggcagatagcgtcgtcgtgtttaccgcatcgttgctcaccatggcgtcgtagttgttgccggacccattgccaccagatggtcacgacctcttcatagcttcactccgtccatggccgtcgccgctcgtgccaccctcccgcagctgtaactccctctcccttcctcatctcaccgcaggcctcatcacgccctcatcaccgatcgttgctggttctgccctctgttgctggagatcgtgaccatggaactcgcgtcgtcgtcctagcgctcctcacgatgttgctgctctagggcgtcatcctcatgtc

SEQ ID NO: 5220 - DNA, 553 bp, Zea mays
  Clone ID: LIB143-004-Q1-E1-E9-R2A
ggggcacgtcctccccaacgcgctcgacatcaccgccgtcgactgggtcaacgccgcgccgctcccgtcccccgtggcccccggcagcgccgtgcgcctcacgctggcgaaggtgaaggaaggggtggaggtcgcgcagctcgtggagaaggtggccgcggccacccaggccgccggggacgccaaggtgagcttcggggagaacttttccccggcgcgggccaaggggtaccagttcgggatggtggcggtgttcgacagcgtggaggagctggacgccgtggaaggggacggcaaggtggaggaggccaaggcctcggtcaggccgctgctggacgaggtgatggtcctggacttcgtcgtcggagatgctccaacgcccgcgagcctctgattacaggctgcagggtctcactttcgggattctgagtgtgttgttgatgtcggaataatggatagatggactccctggtcctgcagcttttcaacttgtgatttgtgaaattgggaatgacagtgcaatgaataagaattgctttcctcgataaggatc

SEQ ID NO: 5221 - DNA, 453 bp, Zea mays
  unsure at all n locations
  Clone ID: LIB143-004-Q1-E1-F12-R2A
ctttggttcgccagaaagctcttgcttatgggtccatctttccacggttgattctggtcgcccggcggccagaagcccagaacctttgctggcaggccgcgaaccaaccaaacagctgaagtctgacgacgagccttggttcagagaaacagggcactgggtttagagcccttcggatctagtattgtcgttcaccggcggcgaccaggccaaaccctagaaccttgccaagatgaggtcgttgcgagcggcgcagaccctagtctcccgttcccttttctcagcgcgccatctaagcggcgcagcctcccccgccacggccgccgccgcgggcgcgcggtggtgtgcagcgccggcgccaccgccccgttcgccgcttncatcctcgagggtgatgcctgccggggttgccggcgcagnatccttctcccttaccttcgctactgtagcggc

SEQ ID NO: 5222 - DNA, 230 bp, Zea mays
  Clone ID: LIB143-004-Q1-E1-G7
ggatctcatcaagctcgccacatccaaatccaaactatgaaaattgtttttcgtgtttacagtgctggaatacgcttgtcgtccacgagcggcgagccattctctacgctgccccggtagtttggttgtagaatgcttgtataactgaagatcccgtcggctatgtgcttgcttgtgtacagtgctctgttctcgtacaatacaatattgggagggaatactaggcgtct

SEQ ID NO: 5223 - DNA, 68 bp, Zea mays
  Clone ID: LIB143-005-Q1-E1-C5
aaaaaaaaaaaaaaaaaaaaaaaaaaaaaaaaaaaaaaaaaaaaaaaaaaaaacaaaaaaaaaaaaaa

SEQ ID NO: 5224 - DNA, 521 bp, Zea mays
  Clone ID: LIB143-005-Q1-E1-G2-R2A
tgcagtttcactgacggagctcattgaattagttccgcagctggtgagcagatcatcgacatcggcagatgcacatcctgacaagaagaagcttttctcagtgcaagacttcttcagatatgcggaaattgaaggaaagcgattctttgaagagttagacagagatggtgatggccaagtcactctagaagatctcgaaattgcaacgaggaagaggcggttgccaaggaggtatgctcgagaattgttcaggcgtacaagaagcaacttcttttcgaaatcaattgggtggaagcaatttttatccttgatggaacagaaggaagcaaccattctccgagcatataccacgttgtgtttgagcaagtctggaacacttcacaagaatcaaattttgacttccttgaaaggtgctggacttccagccaatgaagataatgccgctgccatgctacggtatctaaatgctgattcagaaggatcaatctcatatggccatttccgcaacttcatgcttctac

SEQ ID NO: 5225 - DNA, 433 bp, Zea mays
  Clone ID: LIB143-005-Q1-E1-G7
tacctggggcggtagcatcagaaggactgaagggttcaagatgagcaacagcctgaatgcgtcgagatttccgttttgtgctgtggtcatggcttctacaaaccagagaatcgtgctattgcagcaggttgaagggcccaaatcacctgaagagatgataacagttcttcaacgtgttgttgaagaatgtgctacatcacttgttgctgctaggattgaagctgaagagagactaaacaaccagcgattgcgtgaggaacaagatgctgcttacagagctgcacttgaagctgatcaggccagggaacgtgaaaggttagaggaactggaaagacgtgaaagagaggctgcagaggctgagaaaaagcgtaaagaagaggaggaagctgtagcaagggcatcccaagaagcagctgagaaggaagctgctctt

SEQ ID NO: 5226 - DNA, 438 bp, Zea mays
  Clone ID: LIB143-006-Q1-E1-A5-F2A
ggggccaagccaactaactgatcggcattatttgatatcgacaggtcatatatacagaggtttttttgccgttttttacaatatactccacccgttctttttatttggcacattttagttcacaaatttatattccaaaacggggttaatacaaaagatacatgggccctgctatatcaaactatctttatctggggatcagggaactttcaagtttccactttttaaaccagcttgttgcccgacgactccaaaatctccaatgctggaacgtaaatttccggttgcaaaggcctgatcactctttttgtctggaccttattttttagcaataacagggcccctattgcttctggaatgccaacggtcaacgccatggcatggggggacctgccattttaaaccttccccaactccaataacgtcgcttggggcttt

SEQ ID NO: 5227 - DNA, 437 bp, Zea mays
  Clone ID: LIB143-006-Q1-E1-D6
cagacgcgtggggtcggcgtcaagccgtctcccgtcgtcgcggcattctcctcccggggccccaacactgtgacgtcgagcgtcctgaagccggacatcatcgcgcccggcgtgaacatcctggcggcgtggtcggggtccgtcggcccgtcggggctccccggcgacggccgccgcgtcggcttcaacatcatctccggcacgtccatgtcgtgcccgcacgtgagcgggctcgccgcgctgctccgcgcggcgcacccggagtggagcccggcagccatccggtcggcgctgatgacgacggcgtacaacgagtaccccggcggcggcaacggcatcctggacgtggccacggggcggccggccacgccgctggacgtgggcgccggccacgtcgaccccgcgaatgccgtcgacccggggctggtgtacgacat

SEQ ID NO: 5228 - DNA, 87 bp, Zea mays
  Clone ID: LIB143-006-Q1-E1-H2
acgcatccggaaacacagaaaaatgataaagcaaaatctacaaaagaaaaatgatttccctgactttgaagcaagtcagaaaaacaa

SEQ ID NO: 5229 - DNA, 268 bp, Zea mays
  Clone ID: LIB143-011-Q1-E1-C10
atagtgagtcgtataaatacgcactaccaagatccgtgcagcacacacacaaacacagaggccagccccgttgtactcactgtctgtgtgtatgtaaatgttgtgttgattgcggccgtgttggtcctgtgaatggcgtcgtgagtcgtcggttgtcagtgatgtttgatttccagggattaatcttttgtctctttattttcattttatttaataatttacatattaccatacaatagaatatatgaactaaaacgagttagacaag

SEQ ID NO: 5230 - DNA, 180 bp, Zea mays
  Clone ID: LIB143-011-Q1-E1-D12
tgttggttgagttcctgttctttctgtctatctattctcacgcatggcagtttgggtatggtatgggtcgtcttctttggttacgttctgtttgtgtcattgtgtgatgatatgatcttctttatataataatagagccagtcgttcatcagaaaagggttcaaacaaaattcataaaaa

SEQ ID NO: 5231 - DNA, 541 bp, Zea mays
  Clone ID: LIB143-011-Q1-E1-D2-F2A
agccccaactcagctttctcgtgtttttttctttctgcagtacattatcatcgccgttctatagctgatatgacagtacttgcatggtcagcatgatcaggaagaaacaacacagatacacgcatatgtgacatgtccttgtgtctaataacgggaacaataagctctatgcagtaaagtgctgtcataaatagaataaatttcacagcatcagcgttaagagctctgtatccaagttcagcaaaccgtgttctcagttcgtgttctcagtaaggaacgatgatggattcgatgagctcctgaagtggagccagctccttcttgtcaatcaggccaaactcatttgtaaacagaatgaagtgcttgaaacaggtattgagatgggcctcctctttaaggctaacaatcttctggaaatgggagtggtaggtatgggcatagacccgaaacaatcgcttgaatattgtatttactacttccttgaagttcggtggaaatggcgtgccaagtttttgaggaaatatggattcatcatcaagct

SEQ ID NO: 5232 - DNA, 207 bp, Zea mays
  unsure at all n locations
  Clone ID: LIB143-011-Q1-E1-F8
ttacaaaaccctatagtgagtcgtttatgctggttgngttcctgttctttctgtctatctattctcacgcctggcagtttgggtatggtatgggtcgtcttctttggttacgttctgtttgtgtcattgtgtgatgatatgatcttctttatataataatagagccagtcgttcatcaaaaaaaaaaacgtaaagcaaaaaataaaa

SEQ ID NO: 5233 - DNA, 335 bp, Zea mays
  Clone ID: LIB143-012-Q1-E1-A4
aaaaaaaaaaaaaagaaaaaaaaaaaaataaaaaaaaaaaaaaaaaaaaaaaaaaaatcaaaaaaggcggattctcgaaaggttacaacgttttcctactctataaggtaacactcagggctcttccaatgggtgacttagcttcattttcttagccttgtttttacaacgtccatgcttgggaaagctctggcgttatccggcttaatcctcattgatcgtattcgcctcttgtaacactagcgtcataaccaggaggatgagcccgatggcccttcccatatagttgtccatcgtgactgtgcactggaactctccctgtgcctcctcttttg

SEQ ID NO: 5234 - DNA, 185 bp, Zea mays
  Clone ID: LIB143-012-Q1-E1-B11-F2A
gcgcctcagcctcactatttattgaatataagaatccagatcgaatttgtttcaactcgggatatggattgagcatagagaaaattacgacactttagatatgtcattgctattctctgctgctaccaccatagaacttgaagccggcagaggccatggtgcgccagccattacagcctcgatct

SEQ ID NO: 5235 - DNA, 59 bp, Zea mays
  Clone ID: LIB143-012-Q1-E1-B6-F2A
gaagaaaaaaaatcggttctttcacttccaaaatatacatgttttcgggctattttttt

SEQ ID NO: 5236 - DNA, 366 bp, Zea mays
  Clone ID: LIB143-012-Q1-E1-B8F2A
ataggattgcagatagagagctcgtttttcattagaattccgtttgggtcatgtcccactcttttgttcagacagactaaactagatgaagctgacttacccagaaaagatacctaaacaactggtttggaaagagctaggaggtcctcggcatgctatgggttgaaatccaactaaatcccctcatcaaattctgcatccagaaccagcagcattcgccagatactacaaccaactaaatcccctcatcgaattctgcatccagaatcagcagcattcgcccagatatccagtgccatcaatcatcatcttatttcacgacaacatggttggcccctttctcctcctgttggttggcccaacgcc

SEQ ID NO: 5237 - DNA, 406 bp, Zea mays
  Clone ID: LIB143-012-Q1-E1-B8R2A
cggacgcgtgggcaaatttcaatctccatcgatcgattcctcccgaacccgacccgatggcctccgacgccgccgccgagccctcctccggcgtcacccaccccccgcgctacgtcatcggttacgcgctcgcgccgaagaagcagcaaagcttcatccagccgtcgctggtggcccaggcggcgtcgcggggcatggacctcgtccccgtggatgcgtcgcagcccctggcagagcaagggcccttccacctcctcatccacaagctctacggagacgactggcgcgcccagctcgtggccttcgccgcgccgccacccggccgtccccatcgtcgacccgccccacgccatcgaccgcctccacaaccgcatctccatgccttttcaggtcgtcttttttcccc

SEQ ID NO: 5238 - DNA, 207 bp, Zea mays
  Clone ID: LIB143-012-Q1-E1-D1
acgcgaccgctgaggtcgatagcatcagagggctcttcaataagtttgtccatttcttttttttctctctctctctgaatctcttgtagctagtgacgtagatgttgcgcggatctgaaactggactgtacttttagcgtttgttgcctgtaattaggggtgataatgggctctgaattttacagtataatatttaaggttcggatt

SEQ ID NO: 5239 - DNA, 287 bp, Zea mays
  Clone ID: LIB143-012-Q1-E1-D2
tttttttttttttttttttttttttttccactaagcagtgcacaaataatcgactagtgacatatgctgaactggaatccagtaagcataacagttagtatcggaggttgctaagatatcgttttgacatggtagatggcaaaaagggaaatgcaaaacatcctacggcatagagttgacaaaccaataacttcatgtggagttatctccatcctcaacaatcttctagaccaagcaaacacgacaaacaaataagtaacgacttattttgcccatcttttcagaac

SEQ ID NO: 5240 - DNA, 335 bp, Zea mays
  Clone ID: LIB143-012-Q1-E1-D4
aacgcccaagcgtccgcccacgcgtccgggggcgacgacttcagagcgctggtgttcgagttcatgcccaactacagcctggacaggtggctgggcgtcaaccccaggtctgaagagccgaggatcgtgaagagcctgagcgtgatccagaggctcaacatcgccgtcgacatcgccgacgcgctctgcgatctctacacacaatctcgttagcgcatatcgtcaagtgagatgtcaagcccagcaacgttctcctcggcgaggacatgagggcggtggtgggcgacttgggccttgcgaagctgctacatgagtccgggagccatgacacttgc

SEQ ID NO: 5241 - DNA, 325 bp, Zea mays
  Clone ID: LIB143-012-Q1-E1-F6
cccacgcgtccgcccacgcgtccgcggacgcgtgggtgaactcaagaagctagtggaagaaggaaaggttaagtacattgggttatccgaagcatctgcatcaacaatccgaagagctcacgcagtccatcctatcactgcagtacagcttgaatggtcattatggtctagagatgcggaagaagatataattcccacttgcagagaacttggaattggaattgtagcttacagtccactaggcagagggtttttttgtagtggagcaaaactagttgactcactgtcagagcaggacttccgcaagcatatgcctagacttcaa

SEQ ID NO: 5242 - DNA, 286 bp, Zea mays
  Clone ID: LIB143-012-Q1-E1-H1
gatcgaaaaggtcaggatcacaccccatcacatctacattcatggtacagtctagattgcgatcacttaacgccgcagtaccgcctacatcaacacacatcacgtcggctcactgcagacacacccatcgcgctgccagcaaagccactgtcgatcactccaccaatgctgcaggcggtggcggcgaccgccacactactgcctcagcagctgctatcaccgtcgagcacgcagccgcattcgtccccggctgtcgcgccgggccacacatccgggaccgggatcg

SEQ ID NO: 5243 - DNA, 379 bp, Zea mays
  Clone ID: LIB143-012-Q1-E1-H10
acaagggcacgccctacttgattgtccccgagaacgacatgcacaacattaacattataattgatgagcgggggtctcttgcagtattcagtccgattcgtggccgagttccgagcttattaaagccatcgaagacacctcctcgtgttggtatgactggtgatgttctgcgcttgaaaaactcaaaggtaaacttgttctgcagtcaccctgcatgcataaacatgctccattgcttactattggtagtaaggtgatgccgactaatctttatgtactgtgcttaaggttccaattattgtcgatagcctcaagcaaactattctgaaggaacatgaagctgctagtaaagctagttatggagtgttagcaatactgt

SEQ ID NO: 5244 - DNA, 417 bp, Zea mays
  Clone ID: LIB143-013-Q1-E1-A1-F2A
ttttttttttttttttttttttttttttttttttttttttttttttttttttttttttttttttttttttttttttttttttttttttttttttttttttttttttttttttttttttggggggaaaaaaaaaaaaaaaaaaccttttaatatttgggggggggtttttaaaaaaaaaaaaaccggtggggggaaaaaaaaaaaaaaaaaatttttttttggaaaaaaaaaaacctctacattttaaatatcaaaaaaatcaggatatttttctaaaaaaaggggggggtaaaaaaataaaatatttattattatgtggaaaaaaacacaagaagcctttaatttaaaaaaaattttgggaaaaagggggttaaaaaaaaaaatccccatgattaataaaaaatgggggggggggag

SEQ ID NO: 5245 - DNA, 423 bp, Zea mays
  Clone ID: LIB143-013-Q1-E1-A2-F2A
aaaaatctgcggaaaccaaacacggcatagagaacgtgtgtccaggtaggaaatacaaagaaaataaaataaacataggcgactccaccggccttgacacgaaaactgaagcgacgttgcttatttcatactgatagaagatagacgagaaaaatgaaagaagagaaatctgattccagaatccagatcagattgagagagaggaatcctagtttggcagtgcccctccaggctccaatcctccatcccgtaccggcacttgcttctatttggaaacatctactcgacgttgacttggaacacgtccttgcgctgctgctccttcaccttcggcacgaccaccttgagcacgccgttcttcatctccgccttgatcttgtccatcctgtaaacctctggcgcgagctcgatgcgaccgctgta

SEQ ID NO: 5246 - DNA, 460 bp, Zea mays
  Clone ID: LIB143-013-Q1-E1-A2-f0a
agctgattttgtattatccgatgggatatactcctgtgcgaaaatcgaggatactgactcagtgtgcctgtggttgtgtgcaaatgtgatgctggagtactcttgcgatgaggccaatgccctcttgaagaaaaacttggaaaatgctaaggccagcttagaagtccttgttgctgatcttcagttcttgcgagaccagcaaaccatcactcaggttacaattgctcgggtattcaactgggatgtacaccaccggagaagcaaacaggctgtaaaggaaccttaatgagttagatcacgaggtcaaccaatgtgattgggacaaattttttcgtaccttttggtacctctggcagattagtccatcatagcgagctctttgtttgttgatggtttctttgctgtgtaacaatgtatcggtttattctctttaatggtgtgggaacattagtagaagatg

SEQ ID NO: 5247 - DNA, 307 bp, Zea mays
  Clone ID: LIB143-013-Q1-E1-B4-F2A
ggcataatcatttttttattcggtgatgataacgatacacatgctgcttacatatataatgacaatatatatatatatatgattaatatatatatatatatatatatatatatatataattaattaattggtgatggtgatgagcctgccgtaggccttgcggtcgttgtccttgggcacggtgacggtgagcacgccgtcctggagcgcggcctgcgcgccgtatgtgttggcgttgggcggaaggcgcacggtgcgcacgaagcggtcggagctgcgctcgactcggttcccgaggacgacctta

SEQ ID NO: 5248 - DNA, 358 bp, Zea mays
  unsure at all n locations
  Clone ID: LIB143-013-Q1-E1-B9
aacagtagtagtagttgtagcggcataactagctatggctaccaccatggcggctaacgacccgacgagcatccgcgtggttagccgccggctggtgaaggcctccgacgcttccatccagcctcatgtcatgtccctctccaacctcgacctctacgtctgcgactcacagctcggcacgctgtgcgtctaccccaacgccggcggcggcttcagcgcgcgcatccccagcctgttcgagtccctcttgccgtccttgctcaactacctctacccattcgccggccgcctcgtcanccaaccaagctccggcctcnccgaactccactgccacaaccaaggcgcagagctcgtggtc

SEQ ID NO: 5249 - DNA, 388 bp, Zea mays
  Clone ID: LIB143-013-Q1-E1-C7-F2A
acgaaacgatcagaggcctaagcatgtaacgagataacaggggttccagttgggtgatgatcatttacatcatggcgggcgaacaaaacaggagcagctacactactgctgggaagtaccgacgaacattacattacaaaatactggtaacaactaaaaacgaccctaggcatttaccagtctccacctgctacattcttaccttaactactctggaccaacatgcgccagtttactggcttaacactggccgtactccttcgcggtcagataatttacatagtttcagctctctcaggtactgctgagccccttctctcccagatggtgcagcaatatcaccttcacctgcaaccggccctgcacatggggtaccaagaccaaaaac

SEQ ID NO: 5250 - DNA, 424 bp, Zea mays
  Clone ID: LIB143-013-Q1-E1-E10
aaaaggctcacctgatggagattcaggtcaatggtggtaccattgctgacaaggtggactacggctataaattttttgagaaagaggtccctgttgatgctgtcttccagaaggatgagatgattgacatcattggtgtgaccaaaggtaaaggttatgagggtgtggtcactcgttggggtgtcacccgccttccccgcaaaacccacaggggtctccgcaaggttgcttgtatcggtgcatggcatccggctagggtctcgtatacggttgcccgtgctggtcagaatgggtaccaccaccgcactgagatgaacaagaaggtctacaagatcggcaaggctggacaagagacccacgatgcctccacagagtttgacaggaccgagaaggacatcactcccatgggtggcttcccccacta

SEQ ID NO: 5251 - DNA, 327 bp, Zea mays
  Clone ID: LIB143-013-Q1-E1-E2
caaaagcgtccggttcacgcgtccatggagaacggcgtgctcaccgtcaccgtgcccaaggaggaggccaagaacccgcaggtcagggctgtcgagatctctggttgatcgatccgttcactgcatgcattacgagtgcccgagctgtactacaggtagtataacttttcgaaattcgctggtaggacatctgccaagcaaatacaaactgtctatctgtccatcgttcgtgtatggaagtgttgtgcttttggtgtcaagtacgtctggccagtgttttgtgtctatgtgatgtgtaatgcatctgtgcttttctttttgctgttg

SEQ ID NO: 5252 - DNA, 421 bp, Zea mays
  Clone ID: LIB143-013-Q1-E1-E9
gatagatacttggcagtggtatgtccaacaaaatgtgggatgcccttgtggaacatgcaaagacttgtgtcttaagtgggaaatattacatatactattctgatgagagcagaagtattggtgctattttcaacaacatctatgcattctgtgggttgatttctggcgaacagttctattcatccgagagtcttgatgatagccaaaagctgtttgctgatgcattggtaaagaaagcatatgataactggatgtatgtcattgaatatgatggcaaaggtctattgaaccttaaaccaaagaagaatgctgcatccactggtcaagctgagacgcatgcttctgcaggtggttcgacgtcgtatcaacaacacctctcctcaacgagcatgccatggtcatcaccattcaggtggactga

SEQ ID NO: 5253 - DNA, 634 bp, Zea mays
  unsure at all n locations
  Clone ID: LIB143-013-Q1-E1-F11-F2B
atacacacgtacgtacgcatcatatgcgtactgtagtttttattcaatctgcagattaatcagtacatatacgatcgagacggctagctagccagcttcttcgtcgtacaagatcgactaggtacatctgctaccacagcagagcgaagaattataatcgaatgaacggccagctagctagtagctccacactccatgcattacatactactacgtacacgttctgctagctagccggccgagatcgatccggaacgacgacgacgacgtacggtgtatatacagctaagcttcacttccacttggcttatttttattggtcggtcgtcttctccgagatgatagatagatattatcaagtgtctctgtacgttttactttgtcatggactcatggcagcgcgttcttcatgcccctggcatactcccctcagctcctcaggncttgcttggaagagccgcttccccagctgcctcaccatggcgctgccgatgatcaccccgtcagcgccccactgcgcaatctgcttcacgtgctctggcttggatatgccggagccaacagcaacgggcttgttagtcaccttcttaacctcctggatgagtgactccactcgcgggttcacgtttgcgcg

SEQ ID NO: 5254 - DNA, 450 bp, Zea mays
  unsure at all n locations
  Clone ID: LIB143-013-Q1-E1-F2
taaatatttgttatttccatgtatggtaaccgatttctccaaagggatacatttgtagaactaatcatttactcttgatggtttgtaggcatttcgtttgttactcatccatcggacatgcatttggtcncaaaaaaagggtcaagctcctatcactgttcatcatttggaatctttgagaactacaagtttgtagcggctcatttatctcttcaaaatcctaccagcacgtggtagtaaaatatagatgataatttagttgtttgtcaggatgaagcttgctaacgaacaaaactagatatctccgccactagcactgatggcgagaccgccccggtgcatcttaaggggcgagagggcaagggaaaagcagcagcagcaaaactggtcaagggccagcacaccgagattcaagcatttcactatcgagcaacggagaaggacaacgat

SEQ ID NO: 5255 - DNA, 417 bp, Zea mays
  unsure at all n locations
  Clone ID: LIB143-013-Q1-E1-F9
ggtcgagattcacggggccacgcacgcgtccgcatgaagaagctgatcaaggccgagggagaaaatagtgttggcctgctggggaatctggtagtgagaaatgagatgaaatgacagatgccagagttctcgttaccaatatatatatatgttacggcgttacacactgaatctgtattagtgctagtgttggatctgtaagtttttgttcgtgaataatcagtgggtgcacagactattaagtggactatgttttgaggcgctgcttgaatgatctgtactgtacgtangggagtgtacggtgttagcaatatccctggctgcgcttcattgctctctcgtggcacgagcacgacatgtttgtaataaagttaccaggtagtggggctgtcgggcaaaaaatcaggacagcacctt

SEQ ID NO: 5256 - DNA, 417 bp, Zea mays
  Clone ID: LIB143-013-Q1-E1-G10
tagcaattcccgaaatccccaaaagtcgcccttcccccaaccctatccaaccgaatccagcggcggcggcggcggcggcggctatggcggcggttatgaacgccgatgtggaggtggtcgacttcgacctagacgacgacgacctcatggacgaggatgccgggccggatccagcgccggcccccacctcgcgtctccgctccaccatcgcgggcgacgacgcgccgcgtaggaccaagggccgcggcttccgcgaggaccccaactcctctgcgccccgcgattcgcgctttggcgcggggggacgcgccgacctcgactcgctcggcggcccgggacccatccaatcaattgaaggatggattgtgttggtcactggagttcatgaagaagctcaagaagatgacctccaaaatg

SEQ ID NO: 5257 - DNA, 420 bp, Zea mays
  unsure at all n locations
  Clone ID: LIB143-014-Q1-E1-A11
aaaaaccattggtgcttgctcctggaggattctttgaccaagcctggtttgcccaacttattgtcaggaccaggccgaatctactggatgtgatcactcaccacatttacaatttagggccaggaagggacacacatctgattgacaagatcctcaatccatcagtcctcgacgggatgagaagcacattcagcagtcttcaggggctactgaaatccgcaggaacttcgactgtcgcatgggttggcgaagctggaggcgcttacaacagcggccggcacctagtcactgatgcatttgtgttcagcttctggtttttagatcagcttgggatgtcagcanagtatgacacgaagagctactgcagacagagtttgattggtggcaactacggcctgcctaaatacacaacgtttcaac

SEQ ID NO: 5258 - DNA, 438 bp, Zea mays
  Clone ID: LIB143-014-Q1-E1-A6
attctcttgaacataaaggagaaaatgatctcttcgcacatcagacaaggcttctactctttcagaagaaagtcatttttaggagaatcgtgaacaaaatgaccagatgtttaggcctggttggaaggacatttttcgaatgaatcagagtgagctcgaggctgagatttgaaaaggtctctcgagattctactcttgatccaaggaggaaggcctatctgatccaaaatctcatgaccagccgttggatagttgctcagcaataatcaccacaaccaagcgtcgaagggcataatggatgtacacgatgacctggatgtgttccttcgtaccgagacccagggaaacaaatatttggctgtgagcattacaaaagaaactgcaagcttgttgctgcatgctgcaataagctattcacttgcagattctgtcacgata

SEQ ID NO: 5259 - DNA, 434 bp, Zea mays
  unsure at all n locations
  Clone ID: LIB143-014-Q1-E1-E8
gaaaaagcaaagcacgcaatccaatttccctccatttctctagatctcgagttgctctgctacttcttttagattccttctttcgttcgggagagcgattctctagctggtggcaatggcgaagggcgagggtccggcgatcgggatcgatctcggcaccacctactcgtgcgtcggcgtgtggcagcacgaccgggtggagatcatcgccaacgaccagggcaaccgcaccacgccgtcctatgtcgccttcaccgacaccgagcggctcatcggtgacgccgccaagaaccaggtggccatgaaccccaccaacaccgtcttcgatgccaagcggttgatcggcangaggttctctgacccgtcagtgcagagtgacatgaagctatggccgttcaaggtcatccctggccctggtgacaagcccatgattg

SEQ ID NO: 5260 - DNA, 439 bp, Zea mays
  Clone ID: LIB143-014-Q1-E1-F7
tatgaacgttgatgtgaacgagttccagaccaacctggtgccctacccgaggatccacttcatgctttcgtcctacgctccagtcatttctgctgagaaggcctaccacgagcagctgtccgtggccgaaatcaccaacagcgccttcgagccatcctccatgatggccaagtgcgacccccgccatggcaagtacatggcatgctgcctcatgtaccgtggtgatgtggttcccaaggacgtgaacgctgctgtggccacaatcaagaccaagcgcaccatccagttcgtggactggtgcccgactggcttcaagtgcggaatcaactaccagcctcccagcgtcgtccccggcggtgacctggccaaggtgcagcgtgccgtgtgcatgatctccaactccaccagtgttgtggaggtcttctcccgcattgaccac

SEQ ID NO: 5261 - DNA, 315 bp, Zea mays
  Clone ID: LIB143-015-Q1-E1-C9
tgtatcctgttgtcaatgaatgggtatataatttgcccaatgaaaaaagtacagcatactgcatacaactccaccacgtaatcgagatgacctgcaaggtacgacaagaaccggaagaaactgtagcatttactactatactatagtacgtactagctgtagctgtatcgactaccgagtacaagacagtagcaagacggctacaccctgcacctcggaagaagtacatctgagacatatgaggagcacacgacagcaggctatctagccgaaacacggcggcgatcaccaaccacaggccgctcttcgcccgtt

SEQ ID NO: 5262 - DNA, 452 bp, Zea mays
  Clone ID: LIB143-015-Q1-E1-D8-F2B
agcagtggccgctcttgcgctcgatccgggcgacgacggggttcgtctgcgggctgccctccgcgccggggccaggacgtgctgcatcgtcgcgaggaacttgagcgtgtgcgacggcaccacgcggtcgtcgtggtccgccgtcagcagcatggtggcagggtactggccgcccaagccctggcagcttgcgtcggctgcggctgcccgtttgttctccttctcccacggccgccgcacgttgtggagtggggagtacttgataagccactggaactcatcctccttctccgaacacccgaagtcgcatgtccatgcacgaccaatggtgaacttgtggaaccgtagcatgtccatcactccgacatgggccagggcacagccaaacagatcagggcgctggttcacgcaggcagctaccaggaggcccccgttgctaccgccctcgacgc

SEQ ID NO: 5263 - DNA, 559 bp, Zea mays
  unsure at all n locations
  Clone ID: LIB143-015-Q1-E1-D8-R2B
gtgtcggtgtgcagtgtgttgtcatctccatctccagctccagcgccgccttgctctgtgtgcttccgcccgctctgtgttgctattgctaaactagtgtgttctgtcgctatgggctccctggccaccgcggacgggccgttgccgccgctcaagtaccctcaggctcgccgggacgaagacatcgtcgacgactaccacggcgtcctcgtgccggacccttacagatggatggagcaggtggattcgaaggaggtgaaggagttcgtggacgcgcaggcggccgtgaccagcgccgtgctgtccagctgcgaccaccgcgggcgcctgcgcgggcagctcaccgcgctcttcgaccacccgcgcttccgcgccccttcaagcgccggggcagctacttctacttccacaacccgggcctcccgccgcacagcgcgctctacgttcagcacgggctgggccngcgagcccgacgtgctgcctggaccccagcaacgttcagcgaggacggcacggttgtcgctcggcgttggtcggccgtgagcgacgacgggcgaag

SEQ ID NO: 5264 - DNA, 471 bp, Zea mays
  Clone ID: LIB143-015-Q1-E1-F10.R2A
aagccaaacggggaaagcatacagtagaatattaagaagccactaccgcatgttcggagggcgggaaatttttcgggcgaagttaaaccgattcgggggaaatttctgcacgattcctaccaattcatgtgctccaaaaagaggctaactatttacaactaaccagactccttgctccgacttcgcttcctccttgacctgtgggctgaaaaggtctcactggttctcgatctaccactccacgaatcagagctcaaatctccaccggttgaatctgaggtaccctcttcagtgccgctgtgccacctgtttccactgggatgcttccttcttttgtgatccttagtacttttaccttaccttttatgccaaactttaatgccggtattataattttttcttcccaaccttgtgcctttacaggttgaactttgtttttattttaccttcgattaacattactttttgggg

SEQ ID NO: 5265 - DNA, 520 bp, Zea mays
  unsure at all n locations
  Clone ID: LIB143-015-Q1-E1-F10F2A
gcggtctgctcaagaagtacttgacaaagttgctcaagagactccgaattttggaacagaacaggataaggcccattgtccgtttcatctcaagacaggggcttgtcgctttggattgcgctgcagcagagttcacttttaccctggtggaatcaatcacattgctaatgaaaaacatgtataacggtccaggccttgctttggagcaagatgaagggcttgaggtttgttagaggaaattctctaatgcataactttgtatccttaaactactgtttatttacgtttaaggatgctcaattttggtttcatgggcagtgccattttaagttgtgatagtttaatactaaagcaagctcatgtcaaaataacaagtattccactttaagcttgtaagcctttataagaagacatgagtataaataactgactacttggaaccatntgaatttttttaatctactgctcaagataactcttaccccaagttttccttggctactatcagactcgcgacaga

SEQ ID NO: 5266 - DNA, 64 bp, Zea mays
  Clone ID: LIB143-016-Q1-E1-A10
tacatacgcgtggacgatactgcattctgcgtacatgatctaatcgcatatgatgacgacggtc

SEQ ID NO: 5267 - DNA, 238 bp, Zea mays
  Clone ID: LIB143-016-Q1-E1-A7
cggacgcgtggggtttcctttagaaaccaaactctggtaaataaatcatttgtatcttgtgttgcctttccttgtgatttatttctcccttccctcttctaagtttgcttgctcgtgtttgattgaaaatcatttgtgttgctactgaagtaattctgtaaccattaagagcaacactagcaagaagaacacctctccctcaaaaaaagattgaaaggggagtaaacaagcagggaaa

SEQ ID NO: 5268 - DNA, 262 bp, Zea mays
  Clone ID: LIB143-016-Q1-E1-B1
agcatgttatatgcatgtatatagccagcccaagcccccacacgccggatcgagtactggcactggatgcgatgcaaatacgtgcggacgacgaatactgtataatataatggtacaggcagaggaggcagtacgtacagtacaatagtacaattaatatactagtagtagtgtatagacgaggaggatctgacgacgagaatggaatggaatgatgatggcatcatggataggatggatcatgatgggttaactcccctgc

SEQ ID NO: 5269 - DNA, 332 bp, Zea mays
  Clone ID: LIB143-016-Q1-E1-B10
accaagacggagcagatcacggccgccatggagaacggcgtgcttacagtcactgtgccgaaggaggacgccaagaagcctgaagtgaagtccattcagatctccggctagacctcggtctgcggtcgtcgtacctgcgtggtttgaggaacggcagttcgcctcggtcgttctgtgaaataaaattgggttacaagaattatggcgtttgtcaatatggtcgtaatgtcgtacgatggtggaatgtggtcacaaactttgcgtatgttgggtctacatgtggtgtctgaatctatgtatggatgtcatgagtttgtctaaaaggtaaaaca

SEQ ID NO: 5270 - DNA, 355 bp, Zea mays
  Clone ID: LIB143-016-Q1-E1-B5
ccgtcgcggtgccgtgcgccggtgctggccagtctaggttttcggccctcgcccgccgatccgtcccccccgccggccatgtcgaagcaaggagggaaggccaagccgctgaaggcgcccaaggtcgacaagaaggagtacgacgagagtgatcttgcttatttgcagaagaaaaaagatgaggaaaaggcgctgaaggagctgaaggccaaggcacagaagggcgcaattggaggctcgggtctcaagaaaagtggaaagaaatgagcattgcccacccacccatctccaaaacacctaagagaacgataagacagctgcttatctgtgttgcgcttcactatatgatatatgt

SEQ ID NO: 5271 - DNA, 345 bp, Zea mays
  Clone ID: LIB143-016-Q1-E1-G1
ccctccggttggcatggtaaggccgccacctcctcacactggtatgtcagcaccacctatgtggatgccacccccacccccaccacatcaaggtggtggtatgcctccgcctcccatgtctatgccaccaccgcctccagcaccatctagttgaacacatgcaaaggacagtaccgtctggtcaatgtgtaagctgtaactgtagactaaggatgctggttcctttcatgtctccatgtaacttcgtcaacactaagttaacatgacgtttgagagttaacctgacagatacactcaagatttacagctatttattcatgttctgttgaagataacaaagatggt

SEQ ID NO: 5272 - DNA, 70 bp, Zea mays
  Clone ID: LIB143-017-Q1-E1-B7
actagtccttaataataaacgaatatagaataaaacaccaaagaaaccaaaaaacaaaaaaaaaaaacaa

SEQ ID NO: 5273 - DNA, 369 bp, Zea mays
  Clone ID: LIB143-017-Q1-E1-D11
actgacgaagaacagagtcactttattccttgcattatttaatcttgttcccggtacagctagcaagacacaagttttacagatgtaggattatcaggaagcaatccttggaacaaggagaagcttctccttccggcgaagcgtcagcccaaaggactcgtccatggacacccctgctgcagagcccggaacctcccaatcaaaatggtacatgagattggccagcatgatctccatggtcgcgaatccgaagttcatcccggggcagatcctccggccggagccgaacgggatgaatctgaggtccttgcccttcatgtggacgtccactgcgcccggttcctgcactaaccgctccggcatgaactc

SEQ ID NO: 5274 - DNA, 273 bp, Zea mays
  Clone ID: LIB143-017-Q1-E1-E2
cccaagcgtccggttgaaacatacgctgcagtctgcattacttgttctgaggcctgttgcaacaccgaacattgaagtctgtactcgagacgttccgtagttctctccctcgcttgacaggttgcaaatgttgagtgatgcttgtcctacgtcgttgctggagaagtggagaggtttttttggtactgatgttttgaatgtaaactcgttgccactggccagcacacatgacgaagagcattctgtgataaaaaaggaagcggggaacaaaaa

SEQ ID NO: 5275 - DNA, 373 bp, Zea mays
  Clone ID: LIB143-017-Q1-E1-F10
aatccggaaccatacactctatctctcctcagacgcccccagtgctacatctgatgggtcatcaccagaattgcgatcatatcaacatcaaatcgccacgcattctcatagacactatccatcttttcttccatactcatggacaccatattaaattggaactgtacagattcaagcagattcaatcacctagacatactaaaggctgcctaacattatatttgcatgcacactctatcagccattttcacgttacatatttgcggttcactacggtggcgatgaaacaaactgttgaacttgcatggcgctttactgcttgacctgtgtatttacgcccgcattttctcactctacgttccgtcacgttgaa

SEQ ID NO: 5276 - DNA, 360 bp, Zea mays
  Clone ID: LIB143-017-Q1-E1-F7
actgacgaagaacagagtcactttattccttgcattatttaatcttgttcccggtacagctagcaagacacaagttttacagatgtaggattatcaggaagcaatccttggaacaaggagaagcttctccttccggcgaagcgtcagcccaaaggactcgtccatggacacccctgctgcagagcccggaacctcccaatcaaaatggtacatgagattggccagcatgatctccatggtcgcgaatccgaagttcatcccggggcagatcctccggccggagccgaacgggatgaacctgaggtccttgcccttcatgtggacgtccacggcgcccggttcctgcacgaaccgctccgg

SEQ ID NO: 5277 - DNA, 367 bp, Zea mays
  Clone ID: LIB143-017-Q1-E1-G5
acgcggtctcatctcctcccgggacgggcatgcagagcacggctgccatcggtctcgttaagccatgcgccgcgcggccactccccacctaccctagcccacggcgcggcgccggcgcgtgcagcggcgccgcacagccgatcctcgcgccccgcggcctctgcctctccgcccgcgccagcctactgccggactcgccgctggaggaggagtaccggagatgcagggccggccggcacgtggccgcggccgggaaggtggcggcggctgatggggccgtagaggaagcggggggagggctcgtcaagacgctgcagctggggtcgctcgtcgggctctggtacctcttcaacatctacgtcagcat

SEQ ID NO: 5278 - DNA, 404 bp, Zea mays
  Clone ID: LIB143-018-Q1-E1-A1
tacggattgtgatggatttatgctcattgctttgatctggcaatacgatttctctcccttcatggttcttatcattgccattctcaatgacggtactatcatgaccatctctaaggacagagttaagccatctccattgcccgacagttggaagctgaaggagatctttgctacgggcatcgtgcttggaagctaccttgctcttatgactgtcattttcttctgggctatgcacaagaccgacttcttctcggacaaattcggtgtgaggtcgatcagggacagcgagcatgagatgatgtccgccctgtacctccaagtgagtatcgtgagccaggctctgatcttcgtcacccgttcccgtagctggtccttcgtggagcgccctggtctgctcctggtca

SEQ ID NO: 5279 - DNA, 75 bp, Zea mays
  unsure at all n locations
  Clone ID: LIB143-018-Q1-E1-B5-R2A
tgttcacgaattacttctatctactagcgggctactttagttgtgnctacgtcatccattggcaacacttctttc

SEQ ID NO: 5280 - DNA, 359 bp, Zea mays
  Clone ID: LIB143-018-Q1-E1-B8
tacccacgcttctgataaaaaaaaaaaaaaaaaagaaaaaaaaaaaaaaaaaaaaaaaaaaatggaggatgctcaaacgggtaaaaggctaagatagcagtgcaagcaatgtcgtggctcttcattagtatcaccatcatttcaggtggtttggcgtctggttatgatgcgttgactgggacctgccggctttcatggtccttaacctactcctagtcgaactcccattccatcagcctgattcgtccacgctagtggttttgtcatgtcgatttgccacctgagacaactatgcagcgcttgggcattggcctcgatggcgtggtatagatcaggcggctattcttctcatgcgctac

SEQ ID NO: 5281 - DNA, 204 bp, Zea mays
  Clone ID: LIB143-018-Q1-E1-C4
tacactgacgtctgagcacgagtcatcagctcgcgttgactacgtccctgccctttgtacgcaccacctagagaaagacgatgcgtttcaggagcttgaaacgatcgaatttcagaacccacgatcactatccatactggtttatgtttacaatcactcgtaatggacaaaaggccagagacgatcatgtttgttgtagcaagg

SEQ ID NO: 5282 - DNA, 119 bp, Zea mays
  Clone ID: LIB143-018-Q1-E1-D10
attctctcgtgcacgtgcatgcatcgtcgactgtctcaggccgccgctgcgccggcgccgctcgcatcgtttgcttccttggaccagcagtcgtcgccgtcaggctgaactgcttgtaa

SEQ ID NO: 5283 - DNA, 499 bp, Zea mays
  Clone ID: LIB143-018-Q1-E1-E12-R2A
cagacatgatcattggtgatgacactgtgtactactatcatgacatgatagtggaaatgattaaatggggatatcaagaaggaaaaactctctttggatttggttatgatttccgtcaaagcaacaggctctcagagacacttgacagattttctaaaaagctggagtcagtgtacacagcttctggtggaaagaagatcaatctcattactcattcaatggggggattacttgtgaaatgtttcatctcactgcacagtgatatatttgaaaaatatgtcaagagttggatcgcaattgctgcaccattccaaggtgcccctgggtacataactaccagtctgctgaatggaatgtcttttgtcgaaggatgggaatcaagattctttatttccaaatggtgtatgcagcaattgctacttgagtgcccatcaatctatgagttgctggcaaaccctaacttccagtggagagacatcccactgctacagatttggag

SEQ ID NO: 5284 - DNA, 52 bp, Zea mays
  Clone ID: LIB143-018-Q1-E1-F12
aaaacaaaaagaaacaaacaaaaaaataaaacaccaatcaaaaaagacgaac

SEQ ID NO: 5285 - DNA, 408 bp, Zea mays
  Clone ID: LIB143-018-Q1-E1-G3
acccacgcgtccgtagatcgcgatctagaactagtcctcccctgccctcgccgagcctgaccgactgaccccacctcgccactgttctttcccttccacctgggccccacagcgcccccttaccgtcgccaccaaatccccaaatcccggaggcacgaggagggaattcgtcgcctgaccgatcggccgatccactgccgtcggcaccccaatccgccgctgccgccaagttcaacaagattatcaagaagggaaaccgcaagggcgcgcgccgggacaacgcggaggccgccgcgcgccccgcagcgccctcctcgtcctccgggagcggcggcggcggcgcgggggcagccgcgcccgtcaccgtcaaccacgcctcccgggccacagcgccttcgccgtcctcgc

SEQ ID NO: 5286 - DNA, 479 bp, Zea mays
  Clone ID: LIB143-018-Q1-E1-G4-R2A
cggacgcgtgggttcccctttcgtccactgcattttatccttcctggtgctctgtccacctctctcgctctgggccgccgccgccgccctaagccacgtgctgaggctttcgttggtctcttcgccggcgacgagcacccagcagttctgtagaaatggctgatggtgaggacatccagcctcttgtctgcgacaatggcactggaatggtcaaggctggttttgctggcgatgatgcaccaagggcggttttccctagcattgttggccgtcctcgccacactggtgtcatggtagggatgggacagaaggacgcatatgttggcgatgaggcacagtccaagagaggtattcttacgctcaagtacccgattgagcacggtattgtgagcaactgggatgacatggagaaaatctggcatcatactttctacaacgagcttcgtgttgccccagaggagcaccctgtgttgctcacc

SEQ ID NO: 5287 - DNA, 187 bp, Zea mays
  Clone ID: LIB143-018-Q1-E1-H10
agtcgagtcgtgtcagttgcttagtttatttggctgttctatttccaaatcatcggatcgggttcctctggtatcttgttaaaggttcttcattcaataatacatttgtgcgtgctggtctaaaaaaaaaaaaaaaaaaactaagaataaataatcatcaaaaaaaaacaaaaaaaaaaaaaaataa

SEQ ID NO: 5288 - DNA, 343 bp, Zea mays
  Clone ID: LIB143-018-Q1-E1-H12
cccacgcgtccgcccacgcgtccggaagcctaccattacgtcccgcgagatccagacctccgtccgcctcgtcctccccggcgagctcgccaagcacgccgtctccgagggcaccaaagccgtcaccaagttcactagctcctaggcgagcgatgcgacgtgcactcgtctcctcttcttgcagtagtgcaatagtagtacggttaggtgtgttgccgtggtggtagttgccgctgtgtttgctttctgggctgggctcggttgatgtgttttatgtaagaaagtaactgtattgtgtctgcagtaccttaccatgcatgttttaagtagcacaatagacaag

SEQ ID NO: 5289 - DNA, 317 bp, Zea mays
  Clone ID: LIB143-018-Q1-E1-H8-R2A
cttatctgcattccaaggacatatggcgggcccgacatctcacgaattacgacgcacttaaattcatgtaatggcggcatgcgcagatatatagtagagacgcggcgtagctagatgcggatactcctgtgaaggcgccatgataggggcgggcagtggtgatcagcagcaactccggatggggctgctgctgcagcatcctctctgggttgagtggcacggcgcacctacgtggccgaccggcccgcagaggcgcacatggtgcccgaggtgtacgagctacgcgactcgtacgcggacgtgggggacatgccggg

SEQ ID NO: 5290 - DNA, 281 bp, Zea mays
  Clone ID: LIB143-019-Q1-E1-A7
aagaatatgaacggtcattttttttcaggcataaatataaatccgttctcttgccatggtatttagcacgcacaagcaacgcttgaataagtcttgcaaattcaacacaggttctacgaaagtggctttggctaaggaacgactgcaatgtcgagaaacgacactaagttctttcagcgcttctcaacaccgccgcccaacttggggcccttggaacccttctggaccgcaccctttgtctgcgtcttctgggacttgctcaactccgccttcttcgcttt

SEQ ID NO: 5291 - DNA, 381 bp, Zea mays
  Clone ID: LIB143-019-Q1-E1-B2
tagcgatgctgaagatccgcctgagcaagattggctcgtcggactccggcgctgccgccaccggctcggcagccgccgccggtgccgccgccgctgtggggtcggctgcggcgctgggcggcggcatcccggaatcggtcaccgtggcatgccccgaccacctggtgatcgcggacctacccgtcgcgaagagcctcggtgccgtcacgacctccgctgccgccgccacgcgcgccatcggccgtcgctcccgtcgcccgctcggggagcgcgtccacatctgctctcgctgcgagttccccatcgccatctacggccgcctcatcccttgtgaacatgccctttgtttaacctgtgcaagaagtgattctagctgctatc

SEQ ID NO: 5292 - DNA, 388 bp, Zea mays
  Clone ID: LIB143-019-Q1-E1-B6
tacagactgtaagtacctgggaacaagaatcagagcagatggaacaattggagactacaaatggatgacatatggagaagctagcacgagcaggactgcagtaggttctggccttatatatcatggagttcgtgaaggtgcatgcattggtctgtattttgtaaacagacctgagtggattatagttgaccatgcttgttctgcatattcatatgtatctgtgccactttatgacacacttggcccagatgctgttcaattcattgtgaaccatgcagcggtggaagttatattctgtgtgcctcaaactctaagcactctgttaagttttatagctcaaatgccatgtgttcggcttatagtggtagttggtggagatgattcaaat

SEQ ID NO: 5293 - DNA, 428 bp, Zea mays
  Clone ID: LIB143-019-Q1-E1-C12-R2A
atcaacttctaaaggaaagaggtgagaacattccagcagaagaatcttttgatgtagcaagaaggattaaagaaatgtactgctatacttcttcggacattgtgaaggaattcaataaacatgacaaggagccatcaaagtacattaaacactggacgggcactaaaccgaagactggtgcaaaatacacatgtgacattggatatgagcgattcctagggcctgagatcttcttcaacccagagatatataacaacgacttcaccactcctttgcaagttgttattgacaagtgcatccaatcatctccaatcgacacaaggagggctctttataagaatattgtcctgtctggaggctcgactatgttcaaagatttccacaggaggttacagcgggacctaaagaagatagtggatgcacgggtc

SEQ ID NO: 5294 - DNA, 379 bp, Zea mays
  Clone ID: LIB143-019-Q1-E1-E6
cccacgcgtccgcggacgcgtgggctcctctcctctcgccggcgcatcgcccgactgtcagtcagcctcagccatggccgcggaggaggagcagggcttccgcccgctggacgagtcgtccctgctcgccgacatcaacgccacgccggcgctcgcctcccgcctcggcggtcgtggcagtctagactccatcgagatcaaggaggtctgcgacggcaacctcaacttcgtcgacatcctgcagtccgaggccggcgccatcgtcgtcaagcatgcgctcccgtacgtgcgctgcgtgggggattcgtggcccatgacgcgggagcgcgcctacttcgagggctccacgctgccggagcaccgccgcctgtgccccgag

SEQ ID NO: 5295 - DNA, 329 bp, Zea mays
  Clone ID: LIB143-020-Q1-E1-B5
atccgcagtgcgcgctgggagacgtcagatggcaggcttcggcacgcggcagcgagcgggcggcaacaccgcgtgacgccgacatgaggggacgggtgatcgcgatccacagcctgtgatgagtggagcatccatatcgaggaggccaacagcgccaataagctggtggtgattgacttcactgcatcatggtgtcctccgtgccgcgccatggctccaatttctgctgatatggctcaagacatcgccaaatgttgttttcctcagatttgatgtggatcaactcaagaccattgcggagcaattcagcgtataggccatgccaacat

SEQ ID NO: 5296 - DNA, 421 bp, Zea mays
  Clone ID: LIB143-020-Q1-E1-E6
taactatttacaggcttgtaatgacagctgtgatgttgtttattgatgaggacataaatttggcagaaactaggagtatctagacttcgccaccaacttgtcatggggatggagcagagttgtagcttgaaccagggagaccacaactcaatgccttgacttagttgtgagaaacaagatcagtttgtgccctgtagctggaggagctaacctggtactccttttaccctaaatcgtaagttgttttagttttttctagatgcatagcttttacgatgtatcctccagatgcatagtaaaagttatatatttagaagaaacagaacaacttataatttggaatggagtattcatttcatccatcagattgtgatgtacaatgaattcccatagtttggtccatcggtaccatgtttgtaaa

SEQ ID NO: 5297 - DNA, 413 bp, Zea mays
  Clone ID: LIB143-020-Q1-E1-E9
aagctcccggttcgcgttcccgtcggaggagagcgggtcctcctcgccgttctactactcgttcgacgccggcggcatccacttcgtcatgcttgcgtcctacgccgactacagcagatcaggtgcgcagtacaagtggctggaggcggacctggagaaggtggacaggtcggtgacgccatggctgatcgcgggctggcacgcgccctggtacaccacctacaaggctcactacagggaagccgagtgcatgagggtggagatggaggagctcctctacgcctacggtgtcgacgtcgtcttcaccggccacgtgcacgcgtacgagcggtcgaaccgggtgttcaactacacgctggacgcgtgcggccccgtgcacatctcggtgggcgacggcgggcaacgcgagaaga

SEQ ID NO: 5298 - DNA, 260 bp, Zea mays
  Clone ID: LIB143-020-Q1-E1-F10
cgcgtccaagtagataaataagcagctggtttgtactactatgcacggtttacgttcaagatcgtttcaaggaaacgacctgaggtccaggtaaccggagtccgcccagcacctcgcgtgctactgtccgcttctgtagctgtacagtgctctgctatcttattatccgtgatgtgaaacactgtgtgtcgtccagtcgtgctgtaaaatcatcaactcgtacattgtaaacctgagtcggtatggaatgtctctgcaac

SEQ ID NO: 5299 - DNA, 420 bp, Zea mays
  Clone ID: LIB143-020-Q1-E1-H11
atccgaaacgccgagtgcacaccacctttccccactccgatcgagtcgatggccgccgaaggcgagaagaagatgattaccctcacaagctccgatggcgacgagttcgaggtggtagaggccgtggcgatggtgtcgcagaccatctgccacatgatcgatgatgactgcaccgacaacggcatcgctcttcctaacgtcaactccaagatcctatccaacgtaatctagtaatgcaacaagcacgtacattccgccgcagccgcagccgccgcctctaatgccggttccgacgacgtgggtgccgcctccgccatacagcaccgccgcctccggtgaggacctcaataactgggattcggacttcgtcaacgtcgaccaggccacgcttttccacctcatcttgggtgcatactatct

SEQ ID NO: 5300 - DNA, 505 bp, Zea mays
  Clone ID: LIB143-020-Q1-E1-H2-R2A
cccacgcgttcgaggacgcatgggtcaccagctgccattgccatctactgacctgtgacctacgcattcccaaacagcaccgagcgagcgagctagcaaagcggaggcgaggcacctccctcctcaaggaacatggcccgcacgcatcaaatggcagaagtggccaccgccgtggaggccttggtgctgctggcggcagcgacctctgaggcggccatcagctgcgggcaggtggcgtcggccatcgcgccctgcatctactacgcgcgcggccagggctcggggccctccgccggctgctgcagcggcgtcaggagcctaaacaacgccgtccgtaccaccgtcgaccggcgtgccggctgcaactggctcaagaacgccgccgccggcggtagcgggctcaacgccggtaacgccgccagcatcccctccaagtgcggagtcagcattccctacaccatcagcacctgcaccgactgctccagggtgaactgaaccctaaacg

SEQ ID NO: 5301 - DNA, 517 bp, Zea mays
  Clone ID: LIB143-020-Q1-E1-H4-R2A
ggggtttggttttgttaccatggccgctgttaaagatgcagatcgctgcataaaatatctggaccgttctgtgttgcaagggcgggtcataactgttgagaaggcaaagagaagacgaggtagaaccccaacacctgggaagtatcttggcacaaaatcatcccgtggacggaggtactccacaagctactcacctgatcggaggggccgttacagttcccgctactcacctgatcggagggactgtcatggtagagaccggtcatactctccatatgacagaaggcgatcatactctccctacagcagggatggatcatactccccttactatggccggcgatcatactcaccttactacagcagacggtatcgttcaaggtccccatactgctacagaagacgtaagtcaccttctgtttcgccatactaccgccggcacaggtacagatctgtgtccaagtcatccagttcatctccaagggccagaggacggagctattcgtgcagtttatca

SEQ ID NO: 5302 - DNA, 373 bp, Zea mays
  unsure at all n locations
  Clone ID: LIB143-021-Q1-E1-A1
taaattctcaactccgctactatatatcttactatgcattgatgatgattgtagccttttgttttatttatctagttttctgattacttgatgatatgtgagatatagtgtattgtacaagatgttaatccttatggtacctgagagtgtacacctatggtgtatgatggacaacgttgctaagttttgccactgtttanagatccattgctgctttgacgaggttgcatatgtgatgattgattaagttgattttaagattgctatttgatgaagttgtactgtgtaggacatgttgggtacttttttctttcaaattctcattaaattaaccccactgggggtgtaacatgaatattagacagtatacatg

SEQ ID NO: 5303 - DNA, 512 bp, Zea mays
  Clone ID: LIB143-021-Q1-E1-B8-R2A
cccacgcgtccgcggacgcgtgggcgcacgcaccatcgtcctgccgatcgatcgcagccagccagtcttgctgagagacgaactgaagcctgaagtgaaccgatcgatcgatcgatcgagcgagcgagctcccatgaaggcgttgattctggcggcggtgctgctgctgcagcacgggggagccgcgagcgccggcggcaacttctaccaggacgtggacatcacctggggcgacggccgcggcaagatcctcgacaacggccagctcctgacgctgtccatggacaggtcctccggctcgggcttccagtccaaggcccagtacctctacggccgcttcgacatgcagctcaagctcgtcccgggggactccgccggcaccgtcgccaccttctatctttcgtcgcagggttcgcagcacgacgagatcgacttcgagttcctggggaacgcgagcggggagccgtacacggtgcacacgaacgtgtacagccaggggaagggcgggcggg

SEQ ID NO: 5304 - DNA, 426 bp, Zea mays
  Clone ID: LIB143-021-Q1-E1-F10
tacccaagaaagggaatctagctattcacggtctcccagtaggaagagtgaaatgaggcatgagaagaagcctgatgatggagaaactaactcatctaggagtctcagtgtctctgacaataatgatgatagaaaaaaggagacactgttaagtggtgatgataaagaggatcacgaaatacagctcaaacaaataagacaggacatggaacttttgcgtgatgataaatctctcttggagataattttggatgagaagaatgctgaagtgcgcaagatttctagcagattaaatgatcttgatctgcagctaaggaaggagaaagaggaatgccacaggatgacctcaaaaattaaaaagttccttaaagcccatgctcgctttttgaaagcacaggaagaattgaaaaggtcacaagctcgttt

SEQ ID NO: 5305 - DNA, 391 bp, Zea mays
  Clone ID: LIB143-022-Q1-E1-A5
aacgggtgtgatgataaattcacatatcatacatcagaagcaatcatctgctatttccatgtatgtcatagatgcagagtcagacgagacacaaacccaattatcagaggacaaaattccaagtcaaggtcagacacggaaagatggcaatgatcttgacaaaatacaaacccaaggaattgaaaagcacctgaaaaatgcgtcccagctttcgcaaaatggtggttcagattcactccttgtggtgtgctgcgaggatgttttgcttttgttatccctggcgtcattgattcacggaagcagcaagcatctacagaagacgaaacttgcaaaaccttgttgctggtcagcacttttcagacacatggatgacagagtctgtgggctgata

SEQ ID NO: 5306 - DNA, 284 bp, Zea mays
  Clone ID: LIB143-022-Q1-E1-B1
aattgaatgcatatactatggacgacgatcaggcgtctcacatagcagcggattcgacgtatgtattcgcgctcggcccggatcgatgtcgagagaactagccaggagctagtgcagattatagcgaggcgttcgagaaggccagccggaagatcctctctggtcagtcaccgaggacgatctgtgctccactcaggtgtagtctcacatgtgtctcagcgatgacgttcgacatctcgtcgtggactggaggtcatcttcggtagtatgaattgcgcagcgga

SEQ ID NO: 5307 - DNA, 422 bp, Zea mays
  Clone ID: LIB143-022-Q1-E1-B9
gacaggcagccaaagccacccaccgcttttaccgatcggcgttgccgccaccgctagcattgtcggcttcagctccatccaaatccaccgccagcaagcaagccggcgccatgggtctgccgatgaggagggagagggacgcggaggcggagctgaacctgccgccggggttccggttccaccccaccgacgacgagctggtggagcactacctgtgccgcaaggcggcggggcagcgcctccccgtgcccatcatcgccgaggtggacctgtacaggttcgacccctgggacctgccggagcgcgcgctcttcggggcccgcgagtggtacttcttcacgcccagggaccgcaagtaccccaacggctcccgccccaaccgcgccgccggcaacgggtactggaagggcaccggcgccgac

SEQ ID NO: 5308 - DNA, 430 bp, Zea mays
  Clone ID: LIB143-022-Q1-E1-C8
tactactcaagtatccatccttattgagtacagtgttgatccatggactcggaaggagttgtagcagcaaaggtggcagatgagactactaaaccggcaatccaagaagacggcgccgagagcaaggccgggatgactgatctgctgatgctgaccgacaagtcgcagctgcaggcgctggcgatgctgctgcggaacaacgaggagctcatgatgagccaggcgatcaagtcggagacggagcgcattgagtacctcaagacggtgagcgactgctacacgcggacgatgaagctcctcgacgattccatggcggccaggaccacgtacgagcgttcgggcggaatgaggagcctcgtcgcccgggacatggacgactacgtcgtctacggcctcaacgcgtgcttgcagaacgtccgcaactgctgcg

SEQ ID NO: 5309 - DNA, 458 bp, Zea mays
  Clone ID: LIB143-022-Q1-E1-D3-F2A
ggggtcaacttcattttgttcattctcaagagattgcaaccagccaaccaggggggacagaatcggagctacaagaccggtcagttggtgcgtaaatcatacaaaaaaaaaactaaaaaaccctgttcttattttgctactacatccagtcggctacgcaaaaaactcccatcaaacctcttattaaacaatttcacacacaatatggagacctgcaggctgctccagtggccagtctccactcccaaaaactgtaagaacaaagtaaaggacgcatctttatagcgcagcaccgagttccagcatcaaagtatggttcgagtcattacttccagggccactgaactggatggggccagggctgatgtatctgttcttgatggcccactcatcacgcattgatgcatatttcttgaaaggtgcagcatcaagtttgaccatagccttcttgatcactg

SEQ ID NO: 5310 - DNA, 341 bp, Zea mays
  Clone ID: LIB143-022-Q1-E1-D7-F2A
aaaaaaaagggggattaaaaccatggtgggggggtttaaactcatttttacatttttccaaccaaattaacacacttgggtttttgtttttattggataccaaaaaaaaaagggaaatgggaacaacaaactggttctttttttgtcaaagtttaaaggacaaaataatgacctttttttttaaaatggaattttcaataaacataattttggctttaaataaaaaggcgaacttcttaaccggaaaaaaatgtttgttggccggggaggttttttttttttttttgaaaaaggggggacccctttttaagataaaatcgggtggaaaatagaaaaggggt

SEQ ID NO: 5311 - DNA, 103 bp, Zea mays
  Clone ID: LIB143-023-Q1-E1-C4
tgcacctgttccaaataattcctacgatggattcgaggcttgtgctgaatttgtgctaccctgttataagatctatggtaaggatgactgcacagctcaaaag

SEQ ID NO: 5312 - DNA, 91 bp, Zea mays
  Clone ID: LIB143-023-Q1-E1-D12
aaaaaaaaaacaaaaaaaaaaaaaaaaaaacaaaaaaaaaaaaaaaaaaaaaaaaacaaaagaaaaaaaatcaaaaaaaaagaagaaaaaa

SEQ ID NO: 5313 - DNA, 75 bp, Zea mays
  Clone ID: LIB143-023-Q1-E1-F12
aagctagcgctgtatttgtaagatcgagcagttgtttgttcacttctttgcatatataataatcatataatgcgc

SEQ ID NO: 5314 - DNA, 344 bp, Zea mays
  Clone ID: LIB143-023-Q1-E1-G11
ggcgacaagacgctcgtcttctcttcggcgtggcaatagaagcttgcttgtactattgcctatctgagcactttccagcgtttttaggagcatctggggcaagggctgtaaagagatttctgtcgccgtattgttgacctaccatataagtacactcgtagctaaccttagcgtgctgcctgcctgtaggcttgtgacttgtgaggtctacggtttacctagtttcttagatgaaagtatgttgtgcattgtacacctaaaaaaaaaaaaaaagaaaaaaaaaaaaaaacacatgcaaaaaaaaacaagaaagaaaaaaaaaaatccaatataggaggatagaa

SEQ ID NO: 5315 - DNA, 421 bp, Zea mays
  Clone ID: LIB143-023-Q1-E1-H8
acagtggtgcttttgcatgggagattattccggttcaagttcctgttggtagaggaaaacccccaacattaattgagagagatgaaagcctggataagtttgacccagtaaaactaaagaaacttcgcccaagtttcaaggagaatggtggtacagttacagctggaaatgcttctagtataagtgatggagctgctgcattagttttagtgagtgggcagaaggctcaagagcttggccttcaagtccttgcaaggatcaaaggttatgctgatgcagctcaagctccggagctttttacaaccactccagcacttgcaataccaaaggctatcgcaaatgctggattagagtcatcccgtgttgatttctatgagattaatgaagccttttcggctgttgcgcttgcaaatcaaaaact

SEQ ID NO: 5316 - DNA, 314 bp, Zea mays
  Clone ID: LIB143-024-Q1-E1-A9
taccagtgggtgtactgggtcggccccctcatcggcggcggcctcgccggcgtcatctacgagctgctcttcatctcccacacccacgagcagctcccctccaccgactactaaaagccgaagccgaccgacccaggggtgcgcagcgcagcgcagctagcatccagcgctctctccccgctcgccgccgtttagtttctctcgtgcacgtgcatgcatcgtagactgtctcaggccgccgctgcgccggcgccgctcgcatcgtttgcttccttggaccagcagtcgtcgccgtcaggctgaactgcttgtaa

SEQ ID NO: 5317 - DNA, 116 bp, Zea mays
  Clone ID: LIB143-024-Q1-E1-B3
cacgcgtccgcatgaaataagcttttaggagaaccatccgtcctccgctcttgaatatggtctggtatcgatgccaacctttgaacggcgtgtttattaatacaaacttatatatc

SEQ ID NO: 5318 - DNA, 166 bp, Zea mays
  unsure at all n locations
  Clone ID: LIB143-024-Q1-E1-B5-F2A
aaataatatatttttttttttaaaaaaaaaaaaaaattatataaaattttttattaaattattttaaaatatttttttttatattaataaaaaaaaaaattaatattttttattataaaaatantaaaaaaatattatttattttaaataaaattatatttttttt

SEQ ID NO: 5319 - DNA, 423 bp, Zea mays
  Clone ID: LIB143-024-Q1-E1-F6
caaggctggagttgagtgaggtcttgatggatcatggagctatcaagataccatgacgagaactttttgcacaccgtggacatggaggatggagaccggaaggtcaatcgtcaagtgcatacaattcctagagatccgatacatgtaaagccttacatagaaaagagctgttttgtcgtttcttattctttccccaattgcctaatgtggtggtagggcattcgttggcttgtaaaacaaggctgactacaactaacttagtgatcgcgacgcgtcatacatgactaagtcaaaagcagccggcagttttgctgggatcgtgttacgaatcttttctcggctgcagtcatgttttccttgcggcttgttggggctgcgtcttctacagtcttttttatttatatggattgcacctgcaacaga

SEQ ID NO: 5320 - DNA, 355 bp, Zea mays
  unsure at all n locations
  Clone ID: LIB143-024-Q1-E1-G3
gctggcgtacggtccgagatcacgggtgcgcaccacgcgtccgcaatgggaagaagaattcagaatacttgcggccgggatgagccatagacggctgcttcgcagatcaaaaacacctccttgaatacanatangaggcacagaaatgatgaaaaataaatggttttgcatagctgtaacagttttggtgccttgaactgtaactatggcagagtttctgtgaacagagtggcatgcattaattatacttgaccactctatatgtcgctgtttgtataattttcaatacgtacaagaactaaaatatattattggatagtattttttataataaactcatctgttgctatacttt

SEQ ID NO: 5321 - DNA, 226 bp, Zea mays
  Clone ID: LIB143-024-Q1-E1-H10
attcccgctgcagcccgtgggcgacctgatcctcaacccatacatgatctcttatgcgcagtcgtgcaataccagtcttgtgcatggtctttggatcgactacgatccaatgaagggttgtcctacacatcatacgcgggatctagaatcgtttagtgagatggttttggttgagcaatcccaaaaagcaggaaccgatgaggatggatggaaatgcagactggat

SEQ ID NO: 5322 - DNA, 292 bp, Zea mays
  Clone ID: LIB143-025-Q1-E1-B10
cacggtgcccgtgatcgcgtcgggggtgtgagttcgcgtcggcgcaaggcgaggagtgcgcgcgcctgtcgcggtggaccgtggccatcatgagcgggctgctcctgatggccgcgctggcgggcttcgtgggcgcgtactggatcaggcgcggactgctggccttcaatctcgtcgcgatgacttcgcgcgtggtactcatcatctcactcctcgccatctccgacacagtcatgcgcgggtccggcgcctacaacgtgcacagctgcacatacaactactatagcatcga

SEQ ID NO: 5323 - DNA, 328 bp, Zea mays
  Clone ID: LIB143-025-Q1-E1-B5
aagcagcctaaaaaaaccgtatcgtctcgcctgttcagtttccttctcttcccgcagcccggtttgccgaccaggttccaccgttccagagtagccaagcgaatcccgtgtctggttcgcgcgatggcggaggagcagtccaacccccagcaccagcaagcggaggagagggaggttatggtggagcagcagcagccgaggagggccccgaagctgaggtacctggacttcgtccaggtggcggctgcccaggccgcggtgtgcctcgctgggctctacggcctcgccaaaggacacgccgggccgctccgccccagcgttgacgccg

SEQ ID NO: 5324 - DNA, 385 bp, Zea mays
  unsure at all n locations
  Clone ID: LIB143-025-Q1-E1-D10
tactgagcttcaaagaaaccttggcgtcctaccggagcgtatattatgttggcacaattgttcccattgtgtgtcttctgctgggcaatgttatcaagccagcaaggaaggcgaaggctcggaagaccgagtgaggaaatactcaatcaagtgacctttacatagaataaataaattgaaaactagaatgtccttatcttcgttgaagcttcaccatctttctttttgtacggtatcaaatttagcataaggataatgtggtgaccccggttctcctacctcggaactcgaatgccaatggattaatcattaaaacgtgacacaaccactggattttcctttacttaatgactactcatacgtgtgtgcgataaanagataaata

SEQ ID NO: 5325 - DNA, 151 bp, Zea mays
  Clone ID: LIB143-025-Q1-E1-D11-R2B
ctcacgagtggggatacgcgtccgctcgtctcgcagtcctactcgcaatgtcgcatacagccgtcctgcatcctcttccggtctcgtccgtacctctcgccgcttgatgcgtcctgccggcgaataccgacctgcgtcaatcgtcatgact

SEQ ID NO: 5326 - DNA, 64 bp, Zea mays
  Clone ID: LIB143-025-Q1-E1-D12
cgggaagagatcaactattaaccgagtgaaagtgtttggagaatatcgtgaagtacggccgcag

SEQ ID NO: 5327 - DNA, 320 bp, Zea mays
  Clone ID: LIB143-025-Q1-E1-D5
atttctcgcgagccatcgcttctgcatccggaagaaatggccaagtcgaagaaccacacggcgcacaaccagtcgttcaaggcgcacaagaacggcattaagaaacccaagcgccaccgccagacctccaccaaggggatggaccccaagttcctgaggaacctgaggtattctaggaagggcaacaaaaagagtggtgaggctgaagctgaggagtaggaaggaaagcatggctttgtttcctctgtttttagctcagttccacctttaggacctggggttttgctaaagatggaacttaagtggtgttactgtatgat

SEQ ID NO: 5328 - DNA, 393 bp, Zea mays
  unsure at all n locations
  Clone ID: LIB143-025-Q1-E1-E12
cacttctgcctcctcctccacgaggtgaggaaaccctagcgactgaccatggcgttgctcccgcgcaccgcacggttggccttcctctctaccccgcggtcgtactccgccgccgccgctgccgctgcgggcgcctccccgacctccccagcgccatacgggggcgcgcccccaccggcgatgtcgaagacggccgagttcgtggtctccaaggttgatgacctgatgaactgggcgcgtaagggctcgatttggcccatgaccttcgggctcgcctgctgcgcggtcgagatgatgcacgccggcgcgtcncgctacgacttcgaccggttcggcgtcatcttccgtccctcgccgcgccagtccgattgcatgatcgtcgccggcacgctc

SEQ ID NO: 5329 - DNA, 238 bp, Zea mays
  Clone ID: LIB143-026-Q1-E1-A11
caggtacgacgtccgggactgaaaacttttgctgtgtagcaatgtggcatgacttatgtaacttgtcgtatgatctgtttaattagcgtgtgaaaggctagaagatttcaatataggttgatagtttggtagtttaaaacatgcgtgctttggttctctactgtacgactggaaacttttgctgtgtagcaatgtggcatgacttatgtttggtgctttcaaaaagaatcaaaacatc

SEQ ID NO: 5330 - DNA, 228 bp, Zea mays
  Clone ID: LIB143-026-Q1-E1-A12
gtccggagctgaaaacttttgctgtgtatcaatgtggcatgacttatgtaacttgtcgtatgatctgtttaattagcgtgtgaaaggctatatgatttcaatagaggttgatagtttggtagtttaaaatatgcgtgctttggttctctagtgtaggactggaaacttttgctgtgtagcaatgtggcatgacttatgtatggtgctttcaaaagaagtcaacacgtc

SEQ ID NO: 5331 - DNA, 399 bp, Zea mays
  Clone ID: LIB143-026-Q1-E1-B6
ccttctccaacgggaaatagccattaccgaaggaggcccgtcagcagcgtcggggcaaaaatttcaccgcgcgcgatcaagcgattgatgcccccgtcacggcggcaaggggttcgggtcgattcgcggcggactacgtctcgctcggcgtcagggagcccgtctacgaggtgatagaagtgagatcaaatgggaggatgtccaccaagaaaataagcaggcggcagctactgaaatctagtggtctccgcctacgagatactagaagtgttgacccatcactatggttaatgaattcaatgccttccctgctggtacgtgagcaagctattttactcaatcttggttcgttgcgagcaattgctatgtatgcgcgtgttcctatattcaactataaca

SEQ ID NO: 5332 - DNA, 294 bp, Zea mays
  Clone ID: LIB143-026-Q1-E1-C6
cgctgccaaattataagcatcgcagaagcataagagatatatcaatacaaaatgaatcatactagtatgtgttgggaccatgcttcgtcgctgaaggtcctacggaaagaaacagcttcggctgaagctgctcgtacgtgatgctgaaggtaccattcatgaagcttcggtattatagcatatccgaagatgaagggtcgaactgacttaaagatagaatgaccttttagtccataagggtctgagtcattgttgtaaacttttatgaggggcatgattgtaattcctcacgca

SEQ ID NO: 5333 - DNA, 416 bp, Zea mays
  Clone ID: LIB143-026-Q1-E1-G11
aagcagcctaaaaaaaccgtatcgtctcgcctgttcagtttccttctcttcccgcagcccggtttgccgaccaggttccaccgttccagagtagccaagcgaatcccgtgtctggttcgcgcgatggcggaggagcagtccaacccccagcaccagcaagcggaggagagggaggttatggtggagcagcagcagccgaggagggccccgaagctgaggtacctggacttcgtccaggtggcggctgcccaggccgcggtgtgcctcgctgggctctacggcctcgccaaggaccacgccggcccgctccgccccagcgttgaacgcgtcgagtctgccgtgaagggcgtcgttagccccgtctacgaacgcttcggcggcctgccgctcgacgtcctcgccttcgtcgaccgcaa

SEQ ID NO: 5334 - DNA, 183 bp, Zea mays
  Clone ID: LIB143-027-Q1-E1-A11
aagctcccactcctcccttcctcgcttcccaatctccaaacctctcacttgcacgggagcacgtacagccgtacaggcggagccaaagcgatcggcgccgcggcggcaagacgtcgtcggcggcgacgatgacgtggcacgaggacctggccactcacgtggggaacacgggcgttcgcctcc

SEQ ID NO: 5335 - DNA, 214 bp, Zea mays
  Clone ID: LIB143-027-Q1-E1-C4
aggaatagattaaaattattctgtctttttttcatgttcttctgtgggtcagtcttcttagagaacttcgtgatctgagagacagctcctgttgtatgcagtactccgttcaaatttcaatttattctgtcttttttccctaaaaacatggaagcttaaaaaaacacatcttgttaaaaacctataagattttcccaataaaaaagggcggccg

SEQ ID NO: 5336 - DNA, 370 bp, Zea mays
  Clone ID: LIB143-027-Q1-E1-H3-F2B
gaaacgatgcagatgtcccactcgggttttacgatacaagtacacggggaacttgcctcagaaaccaccaaacagatagtaaaacaggtaccgcgtgggggcgagatcaagaaaactagtaacctaaccacagacggagcacaacagaacggcgggcacagggggggagccctgtttattggaaacaaattggcatcgacgacgccctcctcggaaacgaaaaaggccaaaaaaggtgctcacttggcgctggcgaactgggtgcgaatgagcttagcagcggagaccatgttggtcaaggcgggcttgacctccgtgtacttgcgggtcttgaagccgcaatcggggttcacccaaaggattttggggt

SEQ ID NO: 5337 - DNA, 391 bp, Zea mays
  Clone ID: LIB143-027-Q1-E1-H3-R2B
ctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagcaggttgctaacgacctcacggccactatctggcagcagatggctgatgctgggatcaagtacatccccagcaacaccttctcgtactatgaccaggtccttgacaccactgccatgctcggcgctgtccccgaacgctactcatggactggacgagagattgggtttgacacctacttctccatggccacgggcaacgcactgtccctgctatggagatgaccaagtggtttg

SEQ ID NO: 5338 - DNA, 212 bp, Zea mays
  Clone ID: LIB143-028-Q1-E1-F4
aggcacgcgtccatgcacgctagctgcttgtccgtcccggccaatggaaaaaaaagggggaagaaaaaatgtctgtcggtatatgtgttctcgccgaataactctcgcgcatagctagctggtggggctgagtcactgccttcgctatatgtatacgtgcaaaaattagaggtggagggttgttttagctaatcccaccttaattccaaggc

SEQ ID NO: 5339 - DNA, 172 bp, Zea mays
  Clone ID: LIB143-028-Q1-E1-H2
gacgcgtggggcgctgcgtccccatccagaaccatcctccgctcgacaccttctctggcagatagcgtcgtcgtgtttaccgcatccgttgctcaccatggcgtcgtagttgttgccggacccattgccaccagatggtcacgacctcttcatagcttcactccgtccatgg

SEQ ID NO: 5340 - DNA, 94 bp, Zea mays
  Clone ID: LIB143-029-Q1-E1-H9
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 5341 - DNA, 54 bp, Zea mays
  Clone ID: LIB143-030-Q1-E1-C10
aaaaaaaaatcaaaaaaaaaaaaaaaaaaaaaaaaaaaaaaaaaaaaaaaaaaa

SEQ ID NO: 5342 - DNA, 119 bp, Zea mays
  Clone ID: LIB143-031-Q1-E1-G1
acaagactctatagtgagtcgtattataccatttcacgtttaataccgaaaacaagccccctctcgatgtactcgtttcatatcgttctgtggttgattgaaaaaaaaaaaggcaaaaa

SEQ ID NO: 5343 - DNA, 65 bp, Zea mays
  Clone ID: LIB143-032-Q1-E1-A9
aaaaaaaaaaaaaaaaaaaaaaaaaaaaaaaaaaaaaaaaaaaaaaaaaaaaaaaaaaaaaaaaa

SEQ ID NO: 5344 - DNA, 292 bp, Zea mays
  Clone ID: LIB143-032-Q1-E1-B4
aggaagcaaggcgttatagaagtttctaggctccgcgcctggggccgctgatctgagtggtccctgatctaatggcgccatcactcctcggagccatgtcaagatcaccattcgtagccaacaacgggaggagtcacaggacactaggtgctgctgatacccaagaggctggacggcgcgtagacgcgcttacgtgcgagcctgacagagttgcgccgcagaatgagcgtgttctcgtccgtcgtgagcatatcgctgaaaaatctgctggcggtgtgttacaacaaaaatc

SEQ ID NO: 5345 - DNA, 318 bp, Zea mays
  Clone ID: LIB143-032-Q1-E1-H11
agaactagatatatgtatgttctaattaatacaccccgagcaactttactacatgtatcagtacaaggcacatagatacagctgcagtaacgtatacatgaataccctttgtctcgctcctgtttatctatgcaactgctggcatgcatgcaaaagacgcctcgggagataagacccctgttattctgctagtacgtatgcatgcatgtgcacgatcgatgggcgcgatggtcatatcatccgttgggtcagtagtatggctggatcttccaacactggttgtcgccctcgcaccacttccaaagcacgacgttggtg

SEQ ID NO: 5346 - DNA, 465 bp, Zea mays
  Clone ID: LIB143-033-Q1-E1-A12-R2A
caagcgctccgccgccgtccgtccgtccgttggcgtcgtcaccgtccaaatcaaacaaaaagaacttggcgataatgtgtcgctttcgtaatgaacgcggggataagcgtggcccatggttttgggccgctgaattttttttacgtgggccatgctaggtggggtggggggctgcaccgtgcccaatgattcgaccgcgtcgcagtcctccgcgcgcaagtattcgatgcccatgggtcatagcgaacagatcattttcgcccgtcgcgccctgcgacggcgacggcgacggagagccagtggggtctcactgggattagacatcgaaatgacgctttgtgattctttagctcatccatttctcgtcagctgcacggacgacaaactaagttctctattgtgttgacgggtgcagttggatgactgggtcctgtgccgcatctacaacaagaagggcggcgggct

SEQ ID NO: 5347 - DNA, 399 bp, Zea mays
  Clone ID: LIB143-033-Q1-E1-D2-R2A
gtggtggcttgttcctgaagatgatcctattgcaaaacgagacttagttcctagcatcgattcaaacagcaaacctagcactgtgactgatgataaccagcaattgaacctaaaggagtcacaagctctagaaaatccaataacagaattggccaaacgtctggggattgcactttctgaagaagtttcagcaagttttgttgacgaagccaatgataaagaacttgtggaattgtcatctagacttgctggtcaatcgcttccagctagtgaccaggttgcatcaattcaggtacttcgtgatcattggaaaagttctccagcaagctcactacaactgcaggaactaggacctttgctgagggactatcaacgcctcatcttgcgacactatacggg

SEQ ID NO: 5348 - DNA, 432 bp, Zea mays
  unsure at all n locations
  Clone ID: LIB143-034-Q1-E1-A6-R2A
cccacgcgtccggccttcccggttacttgttcactaacaaggtcgggacggcatggcccttggagctgcgtaccatcactacctgcagctcgccggcgaccatggcaccgccacacacgcactgctcctcggcgtacttatcttcctcgtcatccgcctagtatccgcaaggcgaaccggcacaacctcagccaacaaacgtaagcagcaacagcggcttccgctcccgccttcgcccccgggcaagctgcccatcatcggccacctccacctcatcggcgccgagacccacatctcgatccgggacctggacgccaagcacgggcgcaacggcctgctgctcctccgcatcggcgccgtgcccaccctgttcgtgtnctcgcccagcgccgccgacgccgtnctgcgcacccaggaccacatcttcgcgtc

SEQ ID NO: 5349 - DNA, 235 bp, Zea mays
  Clone ID: LIB143-034-Q1-E1-C7
agggaaagttaacgaacagtgtagtaactgttcagctttgtgtttattcagttgttttgctgcttgaggttattcgtttctaggtgggggttggaatccttttcgccataaacctctcagtggcataaataagatggtttgcataagagtacttcatggataccgtaagggctactactgaaagagaaatgtttaagcagcatggtatgtgagcaactaaaaagaaaaaaataaa

SEQ ID NO: 5350 - DNA, 480 bp, Zea mays
  Clone ID: LIB143-034-Q1-E1-E6-R2A
gcctactaccgctaacaactcagcagcaaataagcgcaggcggaagaaccagtacaggggaatccggcggcggccctggggcaagtgggcggccgagatcagagaccccagcaagggcgtccgcgtctggctcggcacatacagcaccgccgaggaggcggccagggcgtacgacgccgaggctcgcaggatacgcgggaagaaagccaaggtcaatttccgggacgaagcggcggcggcaggtgctcagaagccaccagccgcaactactccaactgcttgtgccagcgcagcgaggctagctcctccacctccaccgccgaagttccgtgctgacgaggttttcgggaacatggacggtggcagcaacgatctgttcgcgatgctggcgttcagtgacagtaaggtgaaggtcgttcgtgtggagccaggtgagggcgccgccggtttcctccccgcaatggaagaagtgttggtcga

SEQ ID NO: 5351 - DNA, 428 bp, Zea mays
  Clone ID: LIB143-034-Q1-E1-G12-R2A
ctcgactccaagcgcaatggctcatccttgcttaattaccaaggtacctttgcaggtaggtaggtagctagccgccatagcaagctaggccgaagcagaggagtgatggccaaggtccaccccaacgccgcggagtccgtccaggcagaggccgagggagagctgcccacggtgctgacggtgtggcgcaagtcgctgctcttcaactgcgacggcttcaccgtctacgacgcccgcggcgacctggccttccgcgtggactgctacgccggctcgttccgccgccggcgccgcgccgacgtcgtgctcatggacgccacggggaagccgctgctcaccgtgcgccgcaagacgcggttcggcttagcggagcgctgggtcatctacgacggcgacgccgacgacggcacgacggccggggccacgcc

SEQ ID NO: 5352 - DNA, 425 bp, Zea mays
  unsure at all n locations
  Clone ID: LIB143-034-Q1-E1-G9
aagcgctaccaaacgcagcctaaatacctccgccaaggagctaggagtgtggcgtgaactaaccagcacgggcgctgagggctgaggccgcgacgacgacgaccatgatgaggctgaagcagcacatgggcctggtctcctcccctacccctgccatcgtcgtgaggctcggcaacaacacaccccaccgccgccgagcaactcggtctcggatcgtgtcgtcctccgcctccgacgccgcgccgttcgagaagcccagggccgtggtcaagaaggtcctcgcgcagtcgcagcccgagggtcagggtgccaccgtccgtangagcatcggcaggcacgagctccgcaacctggacccgttcctccagctcgacgagttcactgtctccaagccggcggggtttccccgacaccggcacagagga

SEQ ID NO: 5353 - DNA, 215 bp, Zea mays
  Clone ID: LIB143-035-Q1-E1-B4-F2A
ataaaattattttatgagttgtgttgtgaggaggggcccggggcaaaaaaatgtggagaaaagaccccccaatagggggggggcgacaaaaaaagaagggaaagggggaaaaacgacacaggcccctaaaaaaaaaaaaggcggaaagaccccgcgggggggccagggggggaagaggcccacacaaaaaggaaaaaaaaaagccgagatgttga

SEQ ID NO: 5354 - DNA, 174 bp, Zea mays
  Clone ID: LIB143-035-Q1-E1-E1-F2A
gaaaaaaaaaaccaaaattaaaaatttgggacaaccccccaaataaatttttgtgtttcttttctttttaaaaaaaaattttgaaaaccaaggaaaaaagattttgggtttatgacaaaacattttggaaaaattgggggggggtgtaaaaaaatcgttattaaaataaaatgg

SEQ ID NO: 5355 - DNA, 63 bp, Zea mays
  Clone ID: LIB143-035-Q1-E1-G1
aaataaatcttaacaaacatggaataactgtatgaatcaatgaagaactgacgattcacacaa

SEQ ID NO: 5356 - DNA, 403 bp, Zea mays
  unsure at all n locations
  Clone ID: LIB143-035-Q1-E1-H5
cagcagtcggcctccctaaccagggcacccactacgagacgtggaacgtcggagtgctcggtccggtcacgctgtccggcctcaacgaggggaagcgggacctcagcagggaggaagtggacctaccagatcggcctccacggcgagtcgctgggcgtgcagtccgtcgccgggagctcgtccgtcgagtggggcagcgcggcanggaagcaacccttgacatggcacaaggcctacttcagcgcgccgtccggcgacgcgccggtggccctggacatgggcagcatgggcaagggccaggcgtgggtgaacggccgccacatcgggcggtactggtcgtacaaggcatcctcctccggcggctgcggcggctgcagctacgcggggacgtacagcgagacca

SEQ ID NO: 5357 - DNA, 309 bp, Zea mays
  Clone ID: LIB143-036-Q1-E1-A3
gggctgcagcctgcagcatgcactgtgcgagcacagccgatcagcgccaataaactggaggataagaacgactggtatgtgtgtgtgtgtgtcgtgcgtgcccaccggccatatcccggtgcggcagcacgtgctattgttacgtgttgtactgccgccagcgtacgtgtctgtgtgtctcgatcatatctgtacgtttttagatttagaacaaaaaaaaatggcatgtccgtgtctgtatgtctggatcatatctgtacgttcttagatttacaagaaagaagaatcacattatatagaaaaaataac

SEQ ID NO: 5358 - DNA, 92 bp, Zea mays
  Clone ID: LIB143-036-Q1-E1-C10
aaaaaaaaaaaaaaaaaaaaaaaaaaaaaaaaaaaaaaaaaaaaaaaaaaaaaaaaaaaaaaaaaaaaaaaaaaaaaaaaaaaaaaataaaa

SEQ ID NO: 5359 - DNA, 318 bp, Zea mays
  Clone ID: LIB143-036-Q1-E1-D11
aagaactagttttcctgttaaacattgccagtgccgaaactttgtcgtctcatgttgataaacatttatcggggccattgggcagctgctactttggcaattgcaaatcaatttaccttttggttcagagggcataggctgctaccctagtggctaaaaatttcgttgacagggtctacgttgccagtttattctgtacattgccagtgccagtttattctgttacattgccagtgcaggaacgctgtgatctcgtgttaataatgatttcacaccatgaatcataaaaacataaggtgacaggaccacacatgatgc

SEQ ID NO: 5360 - DNA, 73 bp, Zea mays
  Clone ID: LIB143-036-Q1-E1-D12
aaaaaaaaacatacaagaaaaaaaaaaaaaaataaaaaaaaatagaacatcacatgtaaataaaaaaaataac

SEQ ID NO: 5361 - DNA, 264 bp, Zea mays
  Clone ID: LIB143-036-Q1-E1-G9
cgttcaggctgatgcttcgcaggaacgagccgctctaccttgttcctagggccgtctagctagctagttactgtgccgccgccgcctcctatccaagaatgcatgagtcttagacgtgtggcagtaataattgcgtggggtgtagtaaaataataagcacgtttgttgagttgtaatggattcacattatgtgcattcgagacaggtccaaggaattgtatctctaaagtgaaaatttcctttttcaccaaagatgtagtggat

SEQ ID NO: 5362 - DNA, 176 bp, Zea mays
  Clone ID: LIB143-036-Q1-E1-H5
ggggtgcgcagcgcagctagcgcatccagctctctctccccgctcgccgccgtttagtttctctcgtgcacgtgcatgcatcgtcgactgtctcaggccgccgctgcgccggcgccgctcgcatcgtttgcttccttggaccagcagtcgtcgccgtcaggctgaactgcttgtaa

SEQ ID NO: 5363 - DNA, 411 bp, Zea mays
  unsure at all n locations
  Clone ID: LIB143-037-Q1-E1-E4
agggcattggattgttgggccagggataccaccccaaggaaggccaacatttctccccggccgccgccggtaaacctaatcggctcctccggaaccccttaccctttccccccggaggcggccctttccctaaaaggcttgccttacaacctgatcctgaaggacctgttcggaaccaaaaccaagctcctgctcaacaacaaccccgtgcacaagaaggtgcccgtgctcctccacggcgacngcanggccatctccgagtccctcgtcatcgccgagtacgtcgacgaagccttcgacgggccgccgctgctccccgccgacccctacgcgcgcgccgccgcccgcttctgggccgacttcatcgagaacaggctcaccaagcccttcttcatggcgatctgggtggag

SEQ ID NO: 5364 - DNA, 99 bp, Zea mays
  Clone ID: LIB143-037-Q1-E1-E8-F2A
ggtgttgctggccggcaggcaaaggcaagcagtgttagagttgaccattaattacgggcggcattccaaacacaagagttatatacaacacaaccttgc

SEQ ID NO: 5365 - DNA, 412 bp, Zea mays
  Clone ID: LIB143-037-Q1-E1-F5
taatcacccactctactactcgaagttactaccagcagcttgcttcaacagtagaagagagcgagaggatggcgtcaccgaagccctcgtcggcggccctgctcctcctggcggcggcggccgtgctggcgctggcgcgcgcggacctgacgcacgacaactgcgtgaagaacaagaaggtgacggtgcagaacctgtgcagccacgacgtgacgctgacgctggagccgctggccaacagcccgccgctgttcgcgggcaactaaaccctgcacccgcgcagccacgccgagttccccgtgtgctggtggacggggcgcctgcgcgcgcccgacgccgcccaggtggagttccacgtcggcgtcgacggcggctccttctacctggcccccaacgcgcagccgggccagcg

SEQ ID NO: 5366 - DNA, 616 bp, Zea mays
  Clone ID: LIB143-037-Q1-E1-G12.R2A
catcaagcctggacagataaatacgcagcacacggagtttcagttcacgatcagtttctgaatcagtttctttaaattccatctcagcaagcgcttgttcggcatcattatcatactctgggtcaaactcgtgtctctttgcattgtatccactcagttcagtcaacgaagggccttcatctgcagaatatctgggcttcttcacaccaacacttctatcgacatgaccatcttcaacttttgatacattagacccatctttaatatgtcccacatttgaagcttttttatttgcaccaacagctatgtgcgaaggtgatcgacctgctagaccttctccaagtgcatcttccaccttgaccctggagggagaaaatggagattcagccttaggagtcagctctccaggcaacagtgaagtccctttttttactttcaccctgcactttagccatagctagaagctccttcctgttcttgccattaacatgagacatatccggtaggggataacaaggtgagttcatgtatgctgttgtgtaatgatcaatacactgtaacttagacttggtaccaacatgctctgcaacttcaagccagtttcccagaccataca

SEQ ID NO: 5367 - DNA, 630 bp, Zea mays
  unsure at all n locations
  Clone ID: LIB143-037-Q1-E1-G12F2A
tctcgatggtcgtcttctccacgagaccacgaccgatcaaccccaatcgtagggaactgggaacccggacccagatctcccctagatcctcaatcccaatctgccctccgccgtatcgatcatacctcccgatgcgaccccaagtctggtcgatgcgagtagcggcggcgatttagcgaactgcgcgttcgctagggttagggtttcgagggtttgcgctagggtttgggcgcacgatggggcggtcgcgaggggtgcagaattccggcgacgacgacaccgtacacaggtcgaagcggaggagggtcgcatcgggcggggatgcgacggactccgtttccgctggcatcgggggagctggagaaggagggggcaagaaagcgctctaccactgcaattactgcaacaaggacatctctgggaagatacggatcaaatgctccaagtgccctgacttcgacctttgcgtggagtgcttctctgttggcgctgaagtcaccccacatcgcagcaaccatccttacaaagtcatggacaacctgtctttcccacttatttgcccagattggaatgcagacgaagaaattctcctncttgagggaattgaaatgtatggtctgggaaactggc

SEQ ID NO: 5368 - DNA, 302 bp, Zea mays
  unsure at all n locations
  Clone ID: LIB143-038-Q1-E1-B7-F2A
acgtaaacccggaaccccgagtgtggccgccacggccgncctgcagcgcgctgagcccaaagtcggagaccttgaggtcgccgcgcgcgtcaaggaggaggttctcaggcttgaggtcgcggtggtacacgccgcggctgtggcagaacccgacggccgtcatcagctgctggaagtagcggcgcgccacgggctccgggaaccgcgtgctctgggcgaggcgcgcgaagagctccccgccgctggcgtattccatgacgaagtagatcttggaccgcgtggccatcatcccgtggaggccg

SEQ ID NO: 5369 - DNA, 249 bp, Zea mays
  Clone ID: LIB143-038-Q1-E1-C11-F2A
aaaacacgaccaatctgccttattgcaagcaaatttcgggagcagaattttgacacaacaaacaaaatacaacagattcccactggtgaatacactaactctatgcatgcttttgcaactcctcacaaaacacgggagagtgatgggcttccacgcactgcaacaccagcctgatgccctgcttcggtttgggcggcattaggtacccaacggtggggactgatgttcacggtgtcattcaggggaaac

SEQ ID NO: 5370 - DNA, 233 bp, Zea mays
  Clone ID: LIB143-038-Q1-E1-D12
gtcgatacaagcctctagattgagtcttactacaagctttgaaaaggtctaggtcctactgggcacaacccgaagatggatggccaaaatggaactttcctctttagtatctgtgcccttcgcatgttttggcttcacctattctggcaatttcacttatactgcttgtaactaccattaacccagtgtgtaaccgagaaaagtagtatcatgtgttaaaaaaatcaaacaaa

SEQ ID NO: 5371 - DNA, 405 bp, Zea mays
  unsure at all n locations
  Clone ID: LIB143-038-Q1-E1-E6
acccacgcgtctgatattgctgtttacaccctttcttgctcagtttattatgcaagttcagttcttcccccctgaatttatcactgggttagctatgttttgctgcatgccaacaacactatcaagtggagtcacactaacacagcttgttggtggtaactctgcacttgctcttgcaatgacagttgcatccaatttacttggcattataattgtacctctttctcttgcaaaatacattagcaatggtgttggggtttccttgcctactgagcaattattcaaaagtcttgtcaccagccttctaatccctcttattatanggaaggttgctcgagaaacctcaaaaggtattgctgattttgttgaaggaaatccaacaaggcttttaagttgcaagtgctg

SEQ ID NO: 5372 - DNA, 401 bp, Zea mays
  Clone ID: LIB143-038-Q1-E1-H2
cccacgcgtccgcccacgcgtccgcccacgcgtccgtacaatcctaaaaccatctgcttcagctagccccaagtttagtcggccgatcattcactgaagtagtaatggcctccgtcaacagctggaccctcgagatcgcgtcgccggtggctccgcagcgcctgttccgcgccgccgtgatggactggcacaccctggcgcccaaggtcgcctcccacgtcgtcgccagcgcgcagcccgtggagggcgacggcggcgttggcagcgtcaggcagttcaacttcacctcagtcatgccgttcagcttcatgaaggagcgtctcgagttcctggacgcggacaagtgccagtgcaagaacacgctcatcgagggcggcgggatcggcgtcgccatcgaaacg

SEQ ID NO: 5373 - DNA, 521 bp, Zea mays
  Clone ID: LIB143-039-Q1-E1-A12-F2A
caaagtcaacatttcagaccatttttcatgttgccaccaacttgattccttacacgaaaacaaatagtgcaatttaaccacatatgtaaagtacagcctaacattttcaaatttcagtatgattatgacctggatccaagatcttacatagttgccctttatcatttatactcacagatgaaacagatcaatggaacaaatatcgaagcaacatgtgtatgacctgcagtcttccagccgtgtccactataattacatcagccttattgacttttgcctccttcaagccgtttttggctatttgtgaaggttttgcttcagttccttctgagtaaactggtacaccaacctttttacccagaatagtgagttgatcaatagcagcaggcctgtaaacatctgcagcaactagcatacagctcttgcccagttttttgagatagaaggcaagcttcgcacaaacagtagtttttccaacaccttgcagacctgccaataatttaatagttggtccagatttt

SEQ ID NO: 5374 - DNA, 229 bp, Zea mays
  Clone ID: LIB143-039-Q1-E1-E3
ggtcgatacaagcctctaaaatttttctgacaagtattcatccgagcagatacatggtcctacaagtaacacatatatgtaactaaaaatagtgaggactgttccatgtatgtactctctgactcctaacttttaattggtatcgactaaaaaaaaaaaaaaaaataaagaataaaaaataaaaaaaaaaaaaaaaaaaaaaaaaaaaacaatcatttagaaaaaataa

SEQ ID NO: 5375 - DNA, 417 bp, Zea mays
  Clone ID: LIB143-039-Q1-E1-G12
tacacacgcgcctggcatcaccggcgcactggactgcagcctcctcgacacgtttgcttgcggttcggacgccgtcgtcgtcgccgaggagcccgccgcgcagcccaccgcgtcgagcaacgccttctccggatacagcagcaccacgggcggcaattacggcaacatctcctccggcgagtccaacacgtacggcggcagcggcggaggccatgacacggaggttgcgtcgccgacctgcgcctcgaagcggaagctggccggcaagtaccctgcaatagccgcgtcggcctcggccacagccacgacgacaacggcggaggggcaggttgcagccccgcggcgtggcacgaagcgcgactccgcgacgtcgtcttcgtcgaacagaacaacggtcgcggggcatggcggcggcaa

SEQ ID NO: 5376 - DNA, 369 bp, Zea mays
  Clone ID: LIB143-040-Q1-E1-A1
taccaatgtgactttgacattgctggtgtatatgaacctatggaaccggattttgaggtcataaaagttctgactgaattgctgaatcagctggatataggcacatatgagataaaattaaatcacagaaagttgcttgatggtatgttggagatttgtggtgtgccccctcaaaagttcagaacagtttgctcgagtattgacaaactggacaagcaaacattcgaacaggtgaagaaggaactggttgatgagaaaggtatatcaaatgaaactgcggatgaaattggcaatttagtgaagactaggggccccccgttggaagttttgatggagttgagaaaggagggcagcaagtttatgaataat

SEQ ID NO: 5377 - DNA, 201 bp, Zea mays
  Clone ID: LIB143-040-Q1-E1-F4
agccacgcttccggtttgttttcctgtaacatgtgtcacaagctgtgctatgtaccagtaaaccagtgttgtgcgatatgtagtgcctcagaatctagtcaagggaaagcagatgtaatagcatacttgtcgtctcacttgtgtgaatgtacaactaccaccaacagaccatagttgcgagtgccaaaaggcagcagaagc

SEQ ID NO: 5378 - DNA, 381 bp, Zea mays
  Clone ID: LIB143-041-Q1-E1-A11
aaccacgcgtccgccccagtctcggaagagaactatccagaagcgcaagactccaaagccgtcgccttcctatccatcccttcctcgccgcgggggtcgcctgagatcacataaacaatggtgaaggctgttgctgtgcttggtagcagcgatggtgtcaagggcaccatcttcttcacccaagagggagatggccctaccactgtcaccggaagtgtctctggcctcaagcctggcctccatgggttccatgtgcatgcacttggtgacaccaccaatggctgcatgtcaactggaccacactacaatcctgcgagcaaggaacatggagcaccagaagatgagaaccgccatgccggtgatcttggaaatgtgacagct

SEQ ID NO: 5379 - DNA, 204 bp, Zea mays
  Clone ID: LIB143-041-Q1-E1-A12
ctcgcaggtcaatacaacactctagagtgagtcgtactaccgtctggttcataaatggtaatgtaaatggtaacactaatgatttagactgtgcatgaattgtctcttggcttcaacttttgtccaatatcagccaaaccataggtctagacattgaagtacctttttcaaacaatcaactttttgacaccatcttcttcaccc

SEQ ID NO: 5380 - DNA, 279 bp, Zea mays
  Clone ID: LIB143-041-Q1-E1-E1
cgcgtccagctaaacctaagaccgccaccgatggtaagaagaagaagaaaaagaaggctaaggccgaggatgatgagtagccaagttatttgttgtatggcgtatgaatccgagagtatttgttgaaaaacagagatgaacgcctgcctagctcaactagcttgtagttcatgaggcgtttgatgcaaacccaactcaaagtacgaagttttcctaaaaaaaaaaaaagagaaaacagaaaaaaaaacagaaagagaaaaacgagaagagaaacaaaca

SEQ ID NO: 5381 - DNA, 53 bp, Zea mays
  Clone ID: LIB143-041-Q1-E1-F5
agggaagtggaaaaaaaaaaaaaaaaaaaaaaaaaaaaaaaagaaagaaaaac

SEQ ID NO: 5382 - DNA, 401 bp, Zea mays
  Clone ID: LIB143-042-Q1-E1-B10
agcggtgcaccctccatagcgcctgagcgctctgtcctcggatcggagcttctctgcgtgtcgcagccaagcttccttccccatggcgcccggcgcccaagtccccagccgtgaccctgccgagctccgccccgactccacgtctcctggtcgggctctcgttctatgcctgatgccgctgttccctggtgctccctgctcggtccctgcccagcgcctgactacagctccagctcgcggcgtcccctctgcttagccaggattgtcgtgcctctgctccctggttttccctacgcgcgagctcgctggcgttgcccctgctccgcttggccgcgtccccctcagtccaccactctgctcggccatggaagacacgccgcaccctggttccagctcgcgat

SEQ ID NO: 5383 - DNA, 418 bp, Zea mays
  unsure at all n locations
  Clone ID: LIB143-042-Q1-E1-E11
aaacggctgcttgcctagggtttcgcctgctcncggccccgcctccagccgtcgcttgagatctcgccgctgccgccactcgatcctccttcgttgttcctcactgatcctgctgagctcggattttcgcccttcctccccgccggaacagcgtccggacgcgcgggcgcagatctgggttttggtggcccgcttgttgtatgagaaggcctctaaagcttgggagcaatggaggtggagccagcgaggagggacgcggcagcgctggacctggagctgctgcagctggcggagctcgcgccgggcgcgcttcgtgagaactccatagctgatgcactgtacgcgcagtggctcgtgctacctgagacgaccaagctggtaaagtctttgattgaggatgcaaagactggtgctgtgc

SEQ ID NO: 5384 - DNA, 411 bp, Zea mays
  Clone ID: LIB143-042-Q1-E1-F5
tcgcgtttcgatacaagcctctacactgacgctactggtgacattctcttcaaatggctctaagccagcgagagacgcaggataaaggccgtagttttgcaaggcgagtagagcagtatgtcagtaatacagcatctatggcatgtgcttttgctcgtccagttcatgagccccgttgtgtatttggtttccgttttcttggttggagtttttagttccaaggtccgatcatgttttgatcccataaattctcttccagccttcgagcaactgagtccatcttcctaagtcatcagccccagcgagacattgaagcatggggaaacttaaacagtatggtgatgattaatctcagcattttttttcttgcagcaatcaatatggactttgcttaaaaaaaaaagagaaaga

SEQ ID NO: 5385 - DNA, 433 bp, Zea mays
  Clone ID: LIB143-042-Q1-E1-F7
caccgctgttaggttctaccaggagaccttcggcgtccctccggccacgcgagctcgccgaaatggtcgcccacaggttccatcagtaccaggtggtgggtcgcgcgctgccgaccccaaccgatgagcaccccaagatctaccgcatgaagctctgggccaccaacgaggttcgcgccaagtccaagttctggtacttcctgagaaagctcaagaaggtgaagaagagcaatggccagatgcttgccatcaacgagatctttgagcgcaacccgaccaccatcaagaactatggcatctggctgcgctaccagagcaggactggttaccacaacatgtacaaggagtaccgcgacaccaccctgaacggcgcagtggagcagatgtacaacgagatggcctcccgccaacgcgtgagggtcccctgcataca

SEQ ID NO: 5386 - DNA, 346 bp, Zea mays
  Clone ID: LIB143-043-Q1-E1-C4
caactctctatagtgagtcgtattattcgcgatagatagcgcgaccgatccactgcgatggccaccgtccagcctcaatccccggcaggtcccattcatctcccgcacgaggatcgacacggggacgccccggtaccgccctccgtctccggcggaaccgccgccgcaacgtgagctggcggccagatctccgcgcatcacaagcaactcggcctcgtcagccgctgtgaaggataggacgccggtctgggccaccatcgcaagtcggggatggaatcttgtggctgaggccatgcgcaagtacgctgccccgcggtcttctcgcttccacagcgttaccaggctc

SEQ ID NO: 5387 - DNA, 96 bp, Zea mays
  Clone ID: LIB143-044-Q1-E1-A2
aacactctaaagtgagtcgtattaaaaaaaaaaaaaaaaaaaaaaaaaaaaaaaaaaataaaaaacaaaaaaaaaataaaaaaaaaaaaacaaaaa

SEQ ID NO: 5388 - DNA, 376 bp, Zea mays
  Clone ID: LIB143-044-Q1-E1-B2
tacttagcatcattgtactacgatcggtttggatgaagatgtctggatattacgattgcgttttgcacctactgaatcgatgatattgtgtagatggacaaccataattgttgtagatatgttgtggcgatggaactcatgtaatggtcatgtcgcgaatgtttcatgctgctggaaattatgtattcacactggactctagttatgtgcctcactagtttcttgaaggtagttgttgaactaggtatttcttcgtctcttgtctgatataggtgtaaaccatgtggcactgccatgggaggttgactgtccgaatgctacgcttttattaaagctgccagaagcactgaccaataaaaatactaggctgattaaa

SEQ ID NO: 5389 - DNA, 402 bp, Zea mays
  unsure at all n locations
  Clone ID: LIB143-044-Q1-E1-C1
ctctagctagactcatatcagtctccttcncctctctagtgctcaccggctccttccgtcgccatggacgtcctcttctgctgctgcctgctgcttctcctggcctccgccgcgtccgccggcagcgagcggtgcgtgcggcaagggaaggcggcctactctccctcgctctccccggcccctcacggtagcagcggagcgtgcgggtacggcgccatggccgccgagattaatgggggcttcctcgccgccggcgggcccaggcagcaccgcgggggcctcggctgtggccgctgtttccagatgagatgccgagacgcaaggctgtgcagcgccgggggagtgcgggtggtgctgaccgacttccacaggagcaaccgtacggacttcctgctcgcccgg

SEQ ID NO: 5390 - DNA, 312 bp, Zea mays
  Clone ID: LIB143-044-Q1-E1-G8
ccaatagtgagtcgtactaaacgatacttgatcgggtggagtttcttgctcactgatcgtcgagttcctgttcgatcgaagttccaggtgcgcacgtacgcactgaagccggtggggtccgtgacgatgtctaggagagcgggagcgttgttgctcgcgtgcctcgtcaccgtgacagcggcggcgctgggggacggcgcacggctctcgtggttcggctgcggccggcgcgggctcgacgaggcaggcgtgtccgacgtgggcctcgtgggggccgacccgttccggatcctggagcacgtccggttcggc

SEQ ID NO: 5391 - DNA, 425 bp, Zea mays
  Clone ID: LIB143-044-Q1-E1-G9
gtgggtcgatgcaagcctctagatcgactcgaattactcatttcctccacgtacgcgtgcatactctgcgagtccaggagatttttttccccttcttcacgatactctcgacgagagtgtctccatggccggaaaaggagacgggccggcgatcggcatcgacctcggtacgacctactcgtgcgtcggggtgtggcagcatgaccgagtcgagatcatcgccaacgaccagggcaaccgtacaacgccgtcttatgtcgcgttcaccgattcggagaggctcgtcggcgacgccgccaagaaccaggtcgccatgaaccccatcaacaccgtcttcgacgcgaagcggctcatcggccggcgcttctctgacacgtcggtgcagagtgacgccaagctatggcctttcaaagtgattccgggct

SEQ ID NO: 5392 - DNA, 416 bp, Zea mays
  Clone ID: LIB143-044-Q1-E1-H1
tattacacaggattagggtttggttttgccttatgcctatatgcaatatgtacactacgatgctttatcctttttgcctactaaagccatataagtttggagtgtcaacaaacgggccaaataataagtattaaataactctattttcctagataactagactgaaattttggtcagacaacatgcacatttgttaaacatgtattattaatcggagttaatgcagatgcttatttgtgctattggctattgactggctctttctatgcaagcaatgcagttgtagtttagatgaatatgcttcttagtttggctggtttacatgaaacaattcatattgctgcttattttaaatatatttgtgtgttgacctacttttgcttgtgatttcgggtgggtttgagtgtccatttcat

SEQ ID NO: 5393 - DNA, 249 bp, Zea mays
  Clone ID: LIB143-045-Q1-E1-A2
ctaaagtgagtcgttgatgtttttgaggtttgtaaacagttttgggtcttgcagcactggactcggtctgcgattgttgttttttgttgcccttgctcagtccgcggtgtgtatgtcgtgcatgcacgtggttcctttctgttggtgtttttgtgtgccaacataccatcaaacttggtttgtatgtcattagctgatcattctttgacactgaatctcattatatttgtattagccgatatgcgctgt

SEQ ID NO: 5394 - DNA, 94 bp, Zea mays
  Clone ID: LIB143-045-Q1-E1-B3
gtcgtattaataaaaaaaaaaaaaaaaaaaaaaaaaaagaaagaaaaaaaaaaaagagggcggccgcactaagggttgcagccctatatgatca

SEQ ID NO: 5395 - DNA, 295 bp, Zea mays
  Clone ID: LIB143-045-Q1-E1-E4
atcagaatcgttgcgttggcgtgtgtgtgcttctggtttgctttaattttaccaagtttgtttcaaggtggatcgcgtggtcaaggcccgtgtgctttaaagacccaccggcactggcagtgagtgttgctgcttgtgtaggctttggtacgtatgggctttatttgcttctggatgttgtgtactacttgggtttgttgaattattatgagcagttgcgtattgtaaaaaagaacaaaaacaaaaaagaagaatacaaaaacaacaaaaaaaaaaaaaataaaaaaacacaaaa

SEQ ID NO: 5396 - DNA, 348 bp, Zea mays
  Clone ID: LIB143-045-Q1-E1-H7
gattgagtcgtattacagtcccaccgaccccgccgccggtcgccctccatctcctcgccgctgcctctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagccaaaccaataactaccacagggctgatggtcagaacactggcaacttccttacggaccgtccttcaaccaagggccaagctgctcc

SEQ ID NO: 5397 - DNA, 452 bp, Zea mays
  Clone ID: LIB143-046-Q1-E1-E2-R2A
cggacgcgtgggattgaaaaaaaaaacaggcaaggaaaatggctccgaccgccgccaaggacagtggctccgccgatcgctggcgcgaggtgcaggcgttcgaggacagcaagctgggtgtgaagggcctggtcgactccggcgtcaagtccatcccggccatgttccaccacccgccggagtccctcaaggatgtcatttctccaccagctctgccctcctccgacgatgcgccggccatcccagtggtggacctgtccgtggcgcggcgcgaggatctggtggcccaggtgaagcacgcggccgggacggtgggcttcttctgggtggtgaaccacggcgtgccggaggagctgatggccagcatgctcagcggggtgcgccagttcaacgagggctctctggaggccaagcaggcgctctactcacgggaccccgctcgcaacgtgcgc

SEQ ID NO: 5398 - DNA, 116 bp, Zea mays
  Clone ID: LIB143-046-Q1-E1-F2
ccttggaggcaacgtcgaacctctccaagagggccacgaaaattcaatccaagggctgtcatttaacaacgtcggaacgggaaaaactgtgcgttacccaccttaaacccccgttg

SEQ ID NO: 5399 - DNA, 366 bp, Zea mays
  Clone ID: LIB143-046-Q1-E1-F3
cacgtctgggtgtggccgtctcgcttcgccccttcctctctccttcggttctcctccagatctctaagaccaggagcccgggaatccaccgcgcccgcagcgatgtcggcgagcagcacccccgtagacgcctcgggggagccgatcccgacttcgtcggtgctgatggcggcgtcgaagcacatcgcggtccggtgccgcccggagaacgttgccttcctcaactgcaagaagaaggaccctaaccccgagaagtgcctcgagaagggccgccaggtcacacgctgcgtcctcagcctgttgaaagaacttcaccagaagtgtcccaaggaaatggatgaatatgctggttgcatgtattactac

SEQ ID NO: 5400 - DNA, 381 bp, Zea mays
  Clone ID: LIB143-046-Q1-E1-F9-R2A
gcgccgaccaccaaggccagcgccggcggcttcgaggcggccaccgagggcggcggctgcgactgcaacacctgcaagtgcggcaccagctgcggctgctcctgctgcagctgcaactgagctggcccggcccggcgatggcgcacgagagtcgagaggaggaggacgacgacgaggcgtataaatataatagcggcgtccagtaaataagatcctgtcaactgcacccgccattatccatggtcgctcgctcctcgcctgcgtctcctggtcctggggttcgtctgaacgtcctcgcggcttcacgacggcgatgccgcctccgtcgatcctgtccgtctcgtgccggatttaatattagatctatatgcgtgtttttct

SEQ ID NO: 5401 - DNA, 439 bp, Zea mays
  Clone ID: LIB143-047-Q1-E1-A7-R2A
cagcaacagcaacatggcaactagcaaggccaataacactgcagcaaccaacatggcaactagggaaggggaacttgcttacacctgagctgcctcccgctcgcggttccactgctaaatttttgccctccgttccttgttgccttccctaaccgggctccggttccggttccttaaccgcccgcgttgacgggggctcccgtcgctgtcgtggctgcggtgtctttcgctgctcctgcgggtgccactgccactacggtagtagtggtagtagtagtcggggtaatcgtcgcggtccctggacctggacaagctaccgcggcggcggtatgggctcgggctgcggctgcctcggctgtggctccggagggagcgatgcaggtggccaaacagtttccgccgaaggtcccggccgacctgcttgacgtgcataaagttg

SEQ ID NO: 5402 - DNA, 587 bp, Zea mays
  Clone ID: LIB143-047-Q1-E1-A7F2A
gcgagcaaatccagcgggtccgtactcatctgcttcacctccgggctccggctacggcggcactcttctctggcaaccggaccacagaaacctctaggcgacgaatcgagcaggtagaggagtaatcaggcatccatggctgagcatgttgcgtccatctttggcacggagaaggaccgcgtgaactgccccttctacttcaagatcggcgcatgccgccacggcgaccggtgctcccgcctgcacaacaagccttccatctccccgacgctgctgctctgcaacatgtaccagcggccggacatgatcaccccgggcgtggacgcgcagggcaaccccatcgacccggagcggatccaggaggacttcgaggacttctacgaggacatcttcgtggagctgagcaagcacggcgagatcgagagcctccacgtctgcgacaacctcgcggaccacatgatcgggaacgtgtacgtggagttccgcgaggaggagcatgcggcccgcgccctgcaggcgctgcagggccgctactactcgggccgacccatcatcggcgagttctcgccggtgacggacttccggga

SEQ ID NO: 5403 - DNA, 364 bp, Zea mays
  Clone ID: LIB143-047-Q1-E1-B8-R2A
ttgatgcctggttcctgacgacgagcgtgttgcaccactagacgtacggcattagcatgcattcaaatcataaacctaggggctcgtcacgcgagcacctcgaaagttgaacctaacggctcacagggctgtgcagacccaagaacaaacaccgcccatgcgcgggtgatcgctcataatgaacaggcgctagcaggctgtgttgacgaacctacagggcctgaacctgaccaaaggccatctcgagctggtggccaagtgctaccacaaggacagcagcctggatgagtacacggagtgcgtgaagattggaaaagatctccagcaggttcactacaagctgctttaacatgacctttgctga

SEQ ID NO: 5404 - DNA, 185 bp, Zea mays
  Clone ID: LIB143-047-Q1-E1-C10
caacacccaatagtgagtcgtattaaacggcatccagcgctatctcccggctcgccggcgtttagtttctcacgtgcacgtgcatggatcggtagactgtggtacgccgccgctgcggggggtgatctcgcatcgtttgcttccttggaggaggagtcatcgccgtcaggctgaactgcttgtga

SEQ ID NO: 5405 - DNA, 194 bp, Zea mays
  Clone ID: LIB143-047-Q1-E1-C9
cgggccgacccacgcgtctagcgcagcgcatcgcagctagcatccagcgctctctccccgctcgccgccgtttagtttctctcgtgcacgtgcatgcatcgtagactgtctcaggccgccgctgcgccggcgccgctcgcatcgtttgcttccttggaccagcagtcgtcgccgtcaggctgaactgcttgtaa

SEQ ID NO: 5406 - DNA, 98 bp, Zea mays
  Clone ID: LIB143-047-Q1-E1-D11
aatactctatagtgagtcgtattataccatttcacgtttaagaccgaaaacaagccccctctcgatgtactcgtttcatatcgttctgtggttgattg

SEQ ID NO: 5407 - DNA, 500 bp, Zea mays
  Clone ID: LIB143-047-Q1-E1-H6-R2A
tgactcggtcgcatcttccccattctgcatcgacgcaccggcggcggcgcaagtgaagcgaagaggaaaggaagctacgagatgtcggcgaccactgcagcggtgcccttctggcgggcggcggggatgacctacatcggctactccaacatctgcgctgcgctggtccggaactgcctcaaggagcccttcaagtctgaggccgcgtcccgcgagaaggctcatttctccatttccaagtggacggatggcaagcaggagaagccaactgtccgcacagaatcggatgactaagggctggcgccatggcgacatagtccttcctacagatgatttgaagcgtcgttgcaagtttctgggacttgttatttagttggcttgatttgtaatcaatgctgaagaataaatactttttgcgacaatggtctttatacaatgtcgcgttgttttcgttgctaattgcacttgccctaccctaatcaagcatgtgaactaatgga

SEQ ID NO: 5408 - DNA, 383 bp, Zea mays
  Clone ID: LIB143-048-Q1-E1-D1
gcacccttctccaaccaccgtttctaatccgcgctgctaatcccactcccagtcccagctcgtccgctgagatggacagtagcagcctcaaatccgcgcagctcctggagctgatgcgccagcacctggccaccgatgccggcaaggaggtcaccaagaaggtcggcctcgtctaccagctcaacatcgcccccaagaagatcggcgttgatgaggagatcttcgtggtcgacctcaagaagggcgaggtcaccaaagggccgtaccagggaaagccggatgccactttctccttcacggacaacgatttccttggaatcgccaccggcaagacgaatccgcagattgcattcactcgaggggggattaaaatccaagggagc

SEQ ID NO: 5409 - DNA, 70 bp, Zea mays
  Clone ID: LIB143-048-Q1-E1-H3
acagacacttggaaaaaaagaaaaaaaaaaaaaaaaaaagaaagaacaaaagaaagacaaacaaaaagct

SEQ ID NO: 5410 - DNA, 478 bp, Zea mays
  Clone ID: LIB143-049-Q1-E1-B4-R2A
cgaaaaccctaaaccctcgctacccggcggcggctacaagctcttcgtcggttcagcaccatgaggccaccggctagaggaggacgtggtgggaggggtggcaggttcgatggcggcggccgtgggggcggcggcggcggccgtgggtttggcggtggtagaggcgggagaggggacaggggagggagaggtggcaggacccccagaggcggccgtggcggcggtggcaggggtggccgcggcggtggcatgaagggcgggagcaaggccgtcgtggtggcgcacaagcacgccggtgtcttcatctccaagtccaaggaggatgcgctctgcaccaagaacatggtcccgggagagtccgtgtacggagagaagcgtgtctccgttcagaatgaggatggaacaaaagtcgaatacagggtgtggaaccccttccgttccaagctggctgctgctgtgcttggtggtgttgacaaca

SEQ ID NO: 5411 - DNA, 77 bp, Zea mays
  Clone ID: LIB143-049-Q1-E1-E10
aaataaaaaaaaaaaaaaaaaaaaaaaaaaaaaaaaaaaaaaaaaaaaaaaaaaaaaaaaaaaaaaaaaaaaaaaaa

SEQ ID NO: 5412 - DNA, 364 bp, Zea mays
  unsure at all n locations
  Clone ID: LIB143-049-Q1-E1-F4
acacttagctacactcggttctgcttctacacatctatatatcgttagtttggcanagaaaagaggcaaccaagattggctgccgccgcggcgatgattgtctccggaaggacggcggcccctgcngtggccggccgtgctctgcccccgtggcggccatggctgccgcgcagcaggcgtccaacgtgcgggcgacgtaccacctgtacaacccggcgcaaaacgggtgggacctgaaccgcgtgagcgcctactgcgccacgtgggacgccgacaagccgctgtcgtggcggcaaaaacacggctggacggccttctgcgggccccccgggcagaatggccangccgcctgcggcaagtgcat

SEQ ID NO: 5413 - DNA, 500 bp, Zea mays
  Clone ID: LIB143-049-Q1-E1-G3-R2A
gtacgtagcacagtccattattgccgtctcccttttgcgtgagcaaagaaagagagcgagaagcagtcgccatgtctggcatcatccacaagatcgaggagaagctccacatggggggcgaccacaagaataaggaggaggagcaccacaagaaggccgaggagcaccacaagaaggaggagggggagcaccacaagaaggacggcggggagcacaaggaaggcatcgtggagaagatcaaggacaagatcaccggcgagcacggcgacaagtccggcgaccacaaggagaagaaggacaagaagaagaaggataagaagaagcacggcgagggccacgaccacgacggcggccacagtagcagcagcagcgacagcgactgagatctggtgtcgcagcacaggtgcaacacatgtatgcttgctggatggaggattcataccagctgatgctgatgtagtgtttcactggtgtcatgcatgtatcgggctattataatc

SEQ ID NO: 5414 - DNA, 211 bp, Zea mays
  Clone ID: LIB143-050-Q1-E1-E1
tgaagagattcgcagaaattgctttgaggacatcttcgtcgtcactacactcgaggctgatggcatggagtttgatagagtttctcgtgttgaagctcgcactgaacacttagatatgtatgtgcagctagatgttgtacagatgtttatcctatgcatgctggtaagaaatttaagatggttatagcaccaactctgaatttggatggca

SEQ ID NO: 5415 - DNA, 324 bp, Zea mays
  Clone ID: LIB143-050-Q1-E1-E12-F2A
gtgctgcgctgttgctgcccaaggcaacgcgcgccaaattaaagggtcattacaagatataggaccccggatgtgctcttaatatgatgtggcgttggatgaaaaagctaaaccgaatgctacgtggactggacggaatattacagtacaccccaatactgcggcatgattggtttgatcaaaggtgttttagacattacacggatgccaatcctccttttgtacggcgcgatcaggaatggacaaggcctgtgggactcggctaaggacctcgtctatcaggttccaaacagatcattccgatgcggaacacggaagcatgcc

SEQ ID NO: 5416 - DNA, 321 bp, Zea mays
  Clone ID: LIB143-050-Q1-E1-E12-f0b
ttctttgcaggaacgtcgataatatggatgcttctgcagtggaattctcatgggaaccctttttttcctatgctgggaagcagtcatgactgattcttgggttgttcgcttcacttgatgtggtctgggcccgctaggggaagaaggatggttgaagaaagctcgctggaaagccgcctgatgatggctctgcaccatttgtacttcagttttcaacttttcatcatgttatttcattgcatgagacgttcgtgtccgactgagcagggagatttccgaacagttatgccactggttgggaatgagaatttttgaacactg

SEQ ID NO: 5417 - DNA, 448 bp, Zea mays
  Clone ID: LIB143-050-Q1-E1-E7-F2A
cctaagaaaaattagttcatttccctttgaaaaatatgaattctttgaaaaatgaacttcccaaaccagccctaaacaaaacatgccagctgctagtgcacagcaggtcgacatgtccaattattcaacttttcgagtgtcatgttcgaagcacattattatatatatgaacatacaaaatcttcaaaaaaacacaaacttaaaacatgagcacttaaaaacatcggacggcacataattaacacggtaattatatgctgcagaaaagggtcgagacgaggagaggatccgatctttgcacttggatgcatccatccgctgatcagttccagaacatggatgtccagttggccagctgcacctcctcggcgccatggtgggtgaacccggcagcgaacatggcatccgggagagcgaagctgcacccctcgtcactgaccacgccacc

SEQ ID NO: 5418 - DNA, 362 bp, Zea mays
  Clone ID: LIB143-050-Q1-E1-F5-F2A
aaaaaaaaaataatttaattttttttttggggtcggaaagggttcccccttttttatttaattaaaccaggtgggttggggtttaatttgtcccgacttttttaatttttacggggtttttttgtttagaggttattccccgggattaaaacgaaagggagaaagttttttttttgggtgtgttttaaacaatttttccttgaaaaaaatgttttgaaaacaccaaaatttttttgtttgagatttcaactttttttaataagggggaggagggtgttgtcgtttaaaaatatatgagggggggcgggttttttttttcggattttttgaatgaaaaaaaagctctgtggaggctttttttt

SEQ ID NO: 5419 - DNA, 491 bp, Zea mays
  Clone ID: LIB143-050-Q1-E1-G8-F2A
catcttctactaatgttcccacaccattaaagagaataaaccgatacattgttacacagcaaagaaaccatcaacaaacaaagagctcgctatgatggactaatctgccagaggtaccaaaaggtacgaaaaaatttgtcccaatcacattggttgacctcgtgatctaactcattaaggttcctttacagcctgtttgcttctccggtggtgtacatcccagttgaatacccgagcaattgtaacctgagtgatggtttgctggcctcgcaagaactgaaaatcagcaacaaggacttctaagctggccttagcattttccaagtttttcttcaagagggcattggccttatcgcaagagtactccagcatcacatttgcacccaaccacaggcacactgagtcagtatcctcgattttcgcacaggagtatatcccctcggataatttaaaatcagctataagtgccttaaccaaatcctttttagctt

SEQ ID NO: 5420 - DNA, 305 bp, Zea mays
  Clone ID: LIB143-051-Q1-E1-A9-F2A
aaatgtaactgcttcatgcggaaacaaaaggttaacttggctaagtatagaaatggtccgctatatgcctgtatattcgatatctcgacaggactgcaaaatttgcataatttacattggcacggttgagggagagatgtacttagtaactctggtttaccgaacgacaaaactgtccagcaaacgctctacgattttactctttttgtacatctatgtgcaggtccttaaataagataataaggggttgatctaaaacccttgcaacttgcaataatcgtttacctaaggacaagtttttgttt

SEQ ID NO: 5421 - DNA, 419 bp, Zea mays
  Clone ID: LIB143-051-Q1-E1-F12-F2A
agttgagccccgccgagtgctcgcgcagctcgtgcaggatctcgttcatttggaacaccgctggcaacgtctccaccagcaccgttgcccggatgctcccgagctcgatcccagcagctttctccgctctctggaacaccccgttccatatcctcgcttccctggagtgctccatcttgggcaggtaaaagaacggcccgaagccggcgccctggcctgcgcggaaggcagcgtggttgtggaagaagtagaggccgaagtcgacgaggcagccaatggccggctcgccgtcgatgaggatgtgcgcctcggggaggtgccagccgcggtgccggacgaagagcttggcggttcggtcgttgagctcgtacgtccgcccgcgcgccgcgtcgcggaagctgatggtgccagccacggcg

SEQ ID NO: 5422 - DNA, 443 bp, Zea mays
  Clone ID: LIB143-051-Q1-E1-F3-F2A
aggagaaaggagatgagatctcatacatagttgattcagagtacagacataagacatcatcagaaattcataatgcagcagcctatgaccaggcccttctcttgagtcagtgaccccccttcctcgcgcaagcaggctgacaaatgttggaacactagccccacagtggctggctgtctgacgcaaacaccactcgagaagtccgagatgcatcgcacccggcctcttttattttgggatcgccgcagccagcagaattattattagggtaccagctagtaggttctttcgttcgttcaccaagggaggatcttccagcgctggttgtcgccctcgcaccactttcagagcacgatctcggtaccgtcatggacgccggcgtgggccttgtcgacgtggaaggcgtcgaaattgaggtagatgttgttgaccatgcggacgca

SEQ ID NO: 5423 - DNA, 96 bp, Zea mays
  Clone ID: LIB143-052-Q1-E1-B4
aaaaaaaaaaaaaaaaaaaaaaaaaaaaaaaaaaaaaaaaaaaaaaaaaaaaaaaaaaaaaaaaaaaaaaaaaaaaaaaaacaacaataaaaaaaa

SEQ ID NO: 5424 - DNA, 299 bp, Zea mays
  Clone ID: LIB143-052-Q1-E1-F4
gggccagcacgcgtccgaattgggtccgaattctgattagcccgtgctgatgcttgcaatgacattggttcttctgtgtagagtgcagacagagtcccggtcagtaacgtgtgtgtacttgttcttcctctgtgttgacattcttgctcgatggtggaacctgtcgcagttggcggagttgaagccgcgtagctcacttagatcggccaaacaattcacttcttagactgtttctgtgaaaatcgcttctgttgaatgcaaaacttattaatttgttgcaaaaaagaaaagagagaaaa

SEQ ID NO: 5425 - DNA, 400 bp, Zea mays
  Clone ID: LIB143-052-Q1-E1-G1-F2B
gcgcaggcccatcttggccggcagaagcggcttggtctcgaccaggccgaacggaggccgggaggggcggaggcagcgggtttgggcatgacgaccgtctggccgggcgggggaagaagcgcggccacaacgtggaacgtcgcgcggcggggctcggctgctggcacggagcggaagatgcgaggagggcgtgcctcgtgctcatccccgccgttcccagctgccgctggctgctcaaccgccgacggctgctgtggtgcgaaagcggacctgaccatcctttcgggatctccggtggcggcacaaccgcgaccgactcctgctgctgctgctgctgctgcaggtagtagtggtggttgggaagaacaagaacctgtacgccttcattaatgacatcatc

SEQ ID NO: 5426 - DNA, 83 bp, Zea mays
  unsure at all n locations
  Clone ID: LIB143-052-Q1-E1-H6
tagtgagtcgtattaaacgtttanncncanncccccccccccccaccccccaccaaaccacaaaagaaaaaacacacaaaagc

SEQ ID NO: 5427 - DNA, 60 bp, Zea mays
  Clone ID: LIB143-053-Q1-E1-A7
atagtgagtcgtattaggcgtccgcccacgcgtccgcggacgcctggggttccagatcgc

SEQ ID NO: 5428 - DNA, 205 bp, Zea mays
  Clone ID: LIB143-053-Q1-E1-E4
atagtgagtcgtattaaatcgattataattcttcgctctgctgtggtagcagatgtacctagtcgatcttgtacgacgaagaagctggctagctagccgtctcgatcgtggatgtagtgattaatctgcagattgaataagaacgagagtacgcatatgatgcgtacgtacgtggtgtaaggtttgtgctcaaagagggcgagcg

SEQ ID NO: 5429 - DNA, 416 bp, Zea mays
  unsure at all n locations
  Clone ID: LIB143-053-Q1-E1-G1
tgcacacacgtctgcccacgcgtccgaagcaaagcacgcaatccaatttccctccatttctctagatctcgagttgctctgctacttcttttagattccttctttcgttcgggagagcgattctctagctggtggcaatggcgaagggcgagggtccggcgatcgggatcgatctcggcaccacctactcgtgcgtcggcgtgtggcagcacgaccgggtggagatcatcgccaacgaccagggcaaccgcaccacgccgtcctatgtcgccttcaccgacaccgagcggctcatcggtgacgccgccaagaaccaggtggccatgaaccccaccaacaccgtcttcgatgccaagcggttgatcggcangaggttctctgacncgtcagtgcagagtgacatgaagctatggccg

SEQ ID NO: 5430 - DNA, 410 bp, Zea mays
  Clone ID: LIB143-054-Q1-E1-C8-R2A
ggacttttcttccttcgcctctacaggtttggaatcggcgctgtccgtcttcgctcttctcgccagggcaaattaaagctacaatgcaggctgcctactatgcaaaggatcttttggtttgaagtccagttgaccgaagttggaaaatacttctgatacttacagatttcacagaggtcttgtttattttctactattttccttcaagcacgtggaatagtacgtttgacaaacaatttgctgacgaggttttcgaacacggctgaacacgcgcgcaaggcgtgcacagtacacgcgcgcagggggaggaggagaacaagaggatggtgaaggcaaggcccaagccaacgccggtcaaggcggccccagaagtgatcttcgacccaatggcctctggtgcccggaagccc

SEQ ID NO: 5431 - DNA, 319 bp, Zea mays
  Clone ID: LIB143-054-Q1-E1-E5
aggtctcacctccgcaggcaagaagttccgtggcctgcgtggcaagggccacactcaccacaagaataggccgtcgaggagggccacctggaagcgcaaccagaccctttccctccgccgctaccgttgagcacatacaacttgatgttctgctactgtggaacctacctcatgcatgctctgatagtatttggtatttttgttgcatcgttaaattttgctacccatgttacaagctccttgaactctgttatcagtgtaccatggagaaattgaagcgaactatgtttgtggttaaaaaaatcataattcagaaaca

SEQ ID NO: 5432 - DNA, 449 bp, Zea mays
  unsure at all n locations
  Clone ID: LIB143-054-Q1-E1-F12-R2A
ggtcttcttgttcaatccccatctcgatcggggaggccaccaaccaccatatggcgggagggaaggtttactcgttcgaggaggtgaggaagcacagcgaccgcaaggactgctggctcatcatcgccggcaaggtgtacgacgtcacgccgttcatggaggagcaccccggcggcgacgaggtcctgctggcgtccgtcggcaaggacgccaccgcggacttcgaggacatcggccacagcgcctccgccaaggagctcatgccccagtactgcatcggcaaggtcgacgcggctacctttccggccaagcccggctacgtngtcaccaaaggacgaccccaggtcgtccgagaaggccgcgacgagcgccggcgcttgggccacgctcctgcagctcgccgcgcccgtcctgctgctggcgctggccttcgcgctgcagcaaaacta

SEQ ID NO: 5433 - DNA, 537 bp, Zea mays
  Clone ID: LIB143-054-Q1-E1-F8-R2A
cctcctgcccccgccgtcgtcgggggtgccggaggtcatctggctgccgacgagcgggggagcggggcccttgtcctgcgcgccgccggaccccgccgtgtatgaccgccccgtcatcggcatcgtctcgcacccaggggacggtgcgggcggcaggatcagcaacaccaccgcgacctcctacatcggcgcctcctacgtcaagttcgtcgaggccgccggcgcgcgcgtcatcccactcgtctacaacgagcccgaagaccgcctcctcgagaaattgagtttgttgaatggagtgctgttcactggtgggtcagagaaggaaggtgtatattttgacacgataaaaagagtatttcagtatgttttggacaagaatgatgcaggtgaaccatttcctttgtttgcccaatgtcttggctttgagcttgtaagcatgattgtcagcaaggacaataatatcttggaggcatttgacgcccaggatcaagcatcaactctccagtttcccagctatgctttggagggttcagtttt

SEQ ID NO: 5434 - DNA, 296 bp, Zea mays
  Clone ID: LIB143-055-Q1-E1-C11-R2A
ttcgaggcggagggcaacggctagggcgactgcaaaatgatgctgcaggaacagatggactaggtggaggccgacgacctccgcagcgggggagggtcccctgaagaaagggccatggacgtacgcggaggacgccatactgtgggactacgttaagacgaacgtccagggcaactggaacacggagcataagaacaccgggctgttccgctgctgcaagagctggcgcctccggtgggcgaaccacctcaagcccaaccttaacaagggggccctcaccccctatgaggagcgcc

SEQ ID NO: 5435 - DNA, 374 bp, Zea mays
  Clone ID: LIB143-055-Q1-E1-D9
taaacagaatggagtttaaccaagctcacatgccctgatacaacttgctgcagcccacttccaccatcagttttgaaaagcctcctgggagatgattgctataagcgatgggaatcattcgcgttacagaagctcttagatacaatgcctgatctggtatattgtccgaggtgtaatgctgcctgcttggaggatgacaatgatgctcaatgcccagagtgttttttcaccttctgctctttgtgcaaagaacgcaggcatgtggggaaggattgcgttactccagaagaaaagattaggattctgagggaaaaacaccagaaatattccctcccagaaaaacaattgttgaaagaacagagggaaatagatga

SEQ ID NO: 5436 - DNA, 328 bp, Zea mays
  Clone ID: LIB143-055-Q1-E1-F5
ccgggccgacgcacgcatccacacggagagaccgcgcagcagcagagctagttcgttcaggcagctttatttgagcagacatatataggagaagatccgaggagaaagatattagcttgctaagagatctcgccatggcgtccatgatgggaggagacttggtggaggcgtacgtgctcaagaacgcgtgcaaggagaagctccggcgcatggaggcggcggcggcggcggccgacgataagacgagcaagcagggccgcctcgcggagaagaaggtctcaggcagaggacgacgcctgcttgggctcctgaagaagaaggtgcaccc

SEQ ID NO: 5437 - DNA, 487 bp, Zea mays
  unsure at all n locations
  Clone ID: LIB143-055-Q1-E1-G1-R2A
cccacgcgtccgcggacgcgtggcggacgcgtggggcctgccctgtcctgccttgttaagcaacacagcgagacatcacgagagctagagagagatggcggccacggtttcctccttcccggtggtgaacatggagaagctggagacagaggagagggccacggccatggaggtcatccgcgacggctgcgagaactggggcttcttcgagctgctgaaccacggcatctcgcacgagctgatggacgaggtggagcggctgaccaaggcgcactacgccaccttccgggaggccaagttccaggagttcgcggcccggacgctggaggccggcgagaagggcgccgacgtcaaggacgtggactgggagagcaccttntttgtncgccacctnccgggcttcaaccttgccgaccttcccgacgttgacgaccgctacaggcaggtgatggagcagttcgcatcggagatccggaagctgtcggag

SEQ ID NO: 5438 - DNA, 279 bp, Zea mays
  Clone ID: LIB143-056-Q1-E1-C12
tctctgcagcatcgcgcgtgaaaaaagatcagccaattccacgagcattgatgttgtcatgacttcaaaagaggagagactatgctaggaatagtgcattatgacatttgtcaggcttacatatcgactgtttgatatggatagatgtataggtttatgaccaatctagttcaaagcaattggagtatagacgagatactgacaaacatcgcagaagcgcaaccgcaggatgctggtaagccgccctcagattgcgctgcctgttggatcgcccgaaat

SEQ ID NO: 5439 - DNA, 577 bp, Zea mays
  Clone ID: LIB143-056-Q1-E1-D10-R2A
tatgattctcgcttcgggtgcgagaggtcgcgagttcgtttctcgcaacaccccccaccccagtccccagacaagtcgctcgcgcgccacaagttcgtcgatgactgcgaggccgccctcaacgagcagatcaacgtggagtacaacgcctcgtatgcataccactccctcttcgcctatttcgaccgcgacaacgtggctctcaaaggatttgccaagttcttcaaggaatccagcgacgaggagagggagcacgctgaaaagctcatggagtaccagaacaaacgtggaggcagggtgaggctccaatcgattgtgacgcctttaaccgagtttgaccaccctgagaaaggagatgctctgtacgctatggagctggctctggccctggaaaagctggtcaatgaaaagctgcacaacctgcatggtgtggcaacaaggtgcaatgatcctcagctgacagacttcatcgagagtgagttcctcgaggagcaggtggaagccataaacaagatctccaagtatgtcgcccagctgaggagagtgggcaaggggcacggggtgtggcacttcgatc

SEQ ID NO: 5440 - DNA, 422 bp, Zea mays
  Clone ID: LIB143-056-Q1-E1-D7
atggaaatcaacccggagaacccaatcatggatgagctccgtaagcgcgccgaggctgacaagaatgacaagtcagtcaaggatcttgtgatgttgctgttcgagacagctctcctgacctccggcttcagcctggatgaccccaacacctttggcacccggatccatcgcatgctaaagctcggtctgagcatcgatgaggacgagtctgctgaggccgaagctgagatgcctccgctggaggatgacgccggcgaaagcaagatggaggaggtcgactaagcttcggatcactgtcgtttatccctaattacatatgataagctaaatcttgactactgtttgaggttttccgcacgttaacggttctcctgccggccaggcaatgagtttgttgtatagctatatggtactctgtttta

SEQ ID NO: 5441 - DNA, 340 bp, Zea mays
  Clone ID: LIB143-056-Q1-E1-E5
agagagagagcggcagaggcgcagagcgcaaccgagcgagagagagaggacggcgacggcggagatgatggggtggggagaggaggtggtggctctgtccctgcgaggctacggctatggcaacgaggatgacgaccggccggagaagccgcggcggtacggggtgaccgagatgcggagccccttctactccttccgccccgcaaaccaggcgctccaggaaatattggattctcttagtccattcgttgatggtttgaagttctctggcggatgccatagtttgatgggaaaggacttggttacacagatcacttatctagcacacacgcatgacctt

SEQ ID NO: 5442 - DNA, 373 bp, Zea mays
  Clone ID: LIB143-056-Q1-E1-E6
atccagagcgggtcataatggggaaggtggagcttttgctttgtactcacttctttgcaggcatgcaaaattcagtctgctgccaaaccagcaagcagcagatgaagagctgtcaacttattaccatccaggcactgatcgagctgtggtttcctctccattcacaaggtttctggagaagcacaggaagctgcggacctgtttacttctttttgtactgtttggtgcctgcatggtgataggtgatggtgtctttacaccagctatatctgttctgtcagccatctctggattacaagatcctgccacaagtggactaggagatggatggatcgtattcatcgcatgtgttatgcgtgttggtctctttgct

SEQ ID NO: 5443 - DNA, 382 bp, Zea mays
  Clone ID: LIB143-056-Q1-E1-E8
accaccgacctccagacgaaaccacccaagacgcgtgcttccattcctagcccaacagaagcgaagcacgccaccgaccaccggcctcgaagggatcatcttctctacaactcgtcctcgtggccttgttcctcctcttgtataggggactgcggcggagtggagatccgtgccgacatagtccgacttcttcgctcgctgcctacgattgatggcctcatcttcaccaagcgatgagttcagcagggaaacagctcgtcagtctctgatcgcgatctccgagtccactccggagacagcttcaccgcagacggttaggacaccgccgatctccagcgcagagaccgggaatccgggcgatggggcggacgagttcagatcg

SEQ ID NO: 5444 - DNA, 369 bp, Zea mays
  Clone ID: LIB143-056-Q1-E1-F9
gctatacaaggattgttgatggttcttgtagtaattaaggtggctgttattgatacataactccgactattcgagcagatatgcccagcgcaggcaattacaattgaggctgaagaacgtgaagatggcagtcgccgaaccacaagatatgatattgacatgaccaaatgcatttactgtgggttctgtcaagaggcttgcccagtcgatgctattgttgaggggcctaactttgagtttgccactgagacacacgaggaactactgtacgacaaggagaaattgcttgagaatggtgatcgctgggagactgagattgctgagaacttgagatctgagagcctctatcgctgaatctgccttccatta

SEQ ID NO: 5445 - DNA, 385 bp, Zea mays
  Clone ID: LIB143-056-Q1-E1-G10
aagccctatcacaccaggctctggatcagggcttataaacacaaaaatgtcacccatgacagtagctcgaattgctagtgaagatgcacgtgctatttgcatgcgggagtatggatcatctcctaatgtcgacatatatgggaatgttaaccccggatcaccatatattacaccacatctacatctcatgatttttgagctggtgaagaactcccttcgcgcagtacaggaacggtatatggattctgataagcttgcacctccggttcgaatcatagttgctgatggagcagaggacgtgactattaagattactgatgaaggtggtggaataccaaggagtagtctctcaagaatttttacgtatcgctatggtacagcagaa

SEQ ID NO: 5446 - DNA, 198 bp, Zea mays
  Clone ID: LIB143-057-Q1-E1-A1-F2A
gtgccgtggtaatcgggcctttcataacggaaccaagttacgacacttgcgaagtattgagagcagacaatatgaggcaaagaacaaggtaagaaacaacttcattcaaaaaagttaatatgagaggggacaaaacttttaggcgtagaaaaatacatacttgccttagattcaatcgcttatggaaaagctatagat

SEQ ID NO: 5447 - DNA, 245 bp, Zea mays
  unsure at all n locations
  Clone ID: LIB143-057-Q1-E1-A9-F2A
antanaanaacaaagcgaacattgcgccagttctcttttcccctttttttttgtttagattctttttacaaattctatacaatgatatgttcgatgcctctcagcaacaaaatttttgagggttcacaaaatgaagtggtggttcatataagactttttttaggcttgtaaaggcctgaacaaatagaaaaaaatggagcggtacattttacaaccttgtacgcgtacgacggatgaatgtaatg

SEQ ID NO: 5448 - DNA, 290 bp, Zea mays
  Clone ID: LIB143-058-Q1-E1-A7
atagtgagtcgtattatactgccgttgggaaggccgccgccgcctccaccgccgccacagcttcttccacgactggtgacggttcatcgtccgggggtgcctggcgtaccgccggactccgcttcaacgagtcggcgccccgtgagcgtgaatcatccctgacaaaataacttggagctgtactgtgttgtcttttacagttacacgcacgtacgtacgaactgccgtcagctgtaattttcttgttcgtcaatctgagctgtaattttcgactctaccagctacgtgca

SEQ ID NO: 5449 - DNA, 489 bp, Zea mays
  Clone ID: LIB143-058-Q1-E1-C3-R2A
ggaaaaagaaccggcgggaaaaattcccgggggccaggggggttaaaaaaaggggggggggaaaaaaaattttccaaaaaaatttaaaaaaaaccccacttttgggggcttattgggggcaaaccaaacccccaaaaatttttaaaataaaatttattttctagccttatcccaggaaaattaaaacttattttccagccctaacccaagggggggggggcccctcgccccctatgaggcccaagaaaaaagccaatttgacattgggcccggggggtattccctggggggggggggggccaaccccggggggggggcagtttttttgggggcaaccccaaaattttgggggggaaaaaccacaggggcattgcccaaaagagcaataaacggttaaaggttaaaggaaaaaaaccctacttggccctgaaaaaaccggggggaatttattatcccaaaaagggggggtgctttcccgaaaaccttggg

SEQ ID NO: 5450 - DNA, 617 bp, Zea mays
  Clone ID: LIB143-058-Q1-E1-C3F2A
cacctagtgaaaaaaatgacagaaggacagaagctgaaacaaattcagggaacgctagcaagtctgctgataaaaagcctgcacctaaagagccaccaaaagactacatccatgtgagggctagaagaggtcaagcaacggacagccatagcctcgcagaaagagcacgacgagagaagataagtgaacggatgaaagttcttcaagatattgtccctggatgcaacaaggttatcgggaaagcatcagtccttgatgagataataaattacatccagtctttacagcgtcaagtagagtttttgtccatgaaacttgaagcgattaatgctcatgtgagcaatgcaactgtagcttttccaaccaaagattttggtgttgcgccatataatactgctcctagcctgacgttggacccacaaacgccaagggaatacgcccagggctcgatgtcagattggcttctgtcatgggcatcatagggagcgagaggcaacagccaagctgggataaggctagagaataagattaagattagctgggataaggctagagaataagattgagatgagagaattgtggagagttggttagcatcagataagtccaagaaagta

SEQ ID NO: 5451 - DNA, 105 bp, Zea mays
  Clone ID: LIB143-058-Q1-E1-E8
ctcccgggccgacccacgactccatttagagtcataataaaaaaaaaaaaaaaaaaaaaaaaaacaacaaaaaaaaaaaaaaaaaaaaaaaaaaaaaaaaataaa

SEQ ID NO: 5452 - DNA, 322 bp, Zea mays
  Clone ID: LIB143-058-Q1-E1-F106B-A11
gaacaaaggcaaggggcacgcggcgatgttggacaacaacaagcacccccgaatggggaagccgcaggagaacccaaccctgagtacgcggagcgggacaggcaccgaggtggagcaatacgacgaaacgggagacgagatcaggacaatgcaggacggcaccacgatcgacaagaacttgacgacggaggaggagaaaggcgccaaccgcatgctggagaagacccggaagcagacggaggagggcaagaaggaaaaggagaaggcagaggaggaaggagaagccgcagaggggcccaatgaccaaaaggagaagacccgt

SEQ ID NO: 5453 - DNA, 60 bp, Zea mays
  Clone ID: LIB143-058-Q1-E1-F12
aaaaaaaaatcaaaataaaaaaaaaaaaaaaaaaaaaaaaaaaaaaaaaaaaaaaaaaaa

SEQ ID NO: 5454 - DNA, 90 bp, Zea mays
  Clone ID: LIB143-059-Q1-E1-D8
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 5455 - DNA, 387 bp, Zea mays
  Clone ID: LIB143-059-Q1-E1-G9
cccacgcgtccgcggacgcgtgggcgcccacggttccacctcctcgtccacgaggtgaggaaaccctagcgaccgaccatggcgttgctcccgcgcaccgcgcggctggccctcctttccaccccgcgggcgtactccgctgccgctgctgcgggcgcctccccgacgtccccagcgccatacgggggcgcccccccaccggcgatgtcgaagacggccgagttcgtggtctctaaggtggacgacctgatgaactgggcgcgtaagggctcgatctggcccatgaccttcgggctcgcctgctgcgcggtggagatgatgcacgccggcgcgtcccgctacgacttcgaccggttcggcgtcatcttccgtccgtcgccgcgccag

SEQ ID NO: 5456 - DNA, 340 bp, Zea mays
  Clone ID: LIB143-060-Q1-E1-B1
cgctccgtccccgcggcccaccaaccgccgccgccgccgccacagccatgcacgggagccggcacctcgcggcgtcccttacccgggccctgatcgaggcgccatcccgctccatctcctccactccgtctctcgtccaaaccctcgacccctcagtgccgtcgcctcccgccgcgggagcagggcggctcgcggagctgcggaggtggctgcatgcggacgcgccgtcgctgggtgacttcacttactctgtggaggtggggacgcggcagcgcccgctgcccaagcccaagtggatgaacgagaccgtgcctgacggcgccaagtacgcggccatcaa

SEQ ID NO: 5457 - DNA, 338 bp, Zea mays
  Clone ID: LIB143-060-Q1-E1-D8
gacgcgtgggcaaggcaccacacctcttcctcctcttcctcctcctagcacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcgaggcggccaccgagggcggcggctgcgactgcaacacctgcaactgcggcaccagctgcggctgctcctgctgcagctgcaactgagccggcccgcccg

SEQ ID NO: 5458 - DNA, 99 bp, Zea mays
  Clone ID: LIB143-060-Q1-E1-E9
gacccacgcgtccactggttgaaagtgcaagcgataaggcataaaaaaaaaaaaaaaaaaaaaaaaaaaaaaaaaaaaaaaaaaagaaaaaaaaacaaa

SEQ ID NO: 5459 - DNA, 288 bp, Zea mays
  Clone ID: LIB143-061-Q1-E1-B9
gtacggtctagggattcgcgggccgcgtcaggtcgtatcgtctgtcgcattatattccttattattattcacagcaaccacatcgtcgagaccaaccaactcaagggaagcacaaacctccaattcgattcagaataatcatccacgcatcatgctatatatgtaccctcttttatttttttctctctcttttaaacttgctgctgttatttgttatttgaattaaagttacgtataccgtatacgtacgtcaaagagtaaaaaaaaaaagaaaaaaaacaagaaaat

SEQ ID NO: 5460 - DNA, 190 bp, Zea mays
  Clone ID: LIB143-062-Q1-E1-D1
ccctgcatgcaagttaaaacccctccaaaaggggccccaaatttaaattcacgggccctcgtttaaaaacgtcgtaacgggaaaaacccggggttaaccaaatttaacccccttgaagaaaacccccttttcccaagctggggtaataccaaaaaggccccaactgttcccctttccaaaaatttgccca

SEQ ID NO: 5461 - DNA, 229 bp, Zea mays
  Clone ID: LIB143-064-Q1-E1-C6
catctttgtaataaatttatctgttcttggtactttgtctatggttgaatcggaacccattttccgtttgcctagattcttaatttctggtgctgtatccagctgaaactagtagatctatgatcgtgtggctgcagcatgttcttgtcacttttatctggtctccgttggttcggttcacaggttgtgtgctttaacgtcagagcaagatacaaacggaaaatgtcat

SEQ ID NO: 5462 - DNA, 374 bp, Zea mays
  Clone ID: LIB143-064-Q1-E1-D10
tttattgttgacctcaaggcagacaagaaaaagatcaaggctgcggtcaagaagatgtatgacattcaagcaaagaaggtcaacaccctgatcaggcctgatgggaagaagaaggcttatgtgaaactgacacccgactacgatgcccttgatgtggccaacaaaattggcatcatctaagttaataggcaactggattcgacatctgtgtcctactagttctgagcataccaacagatttttctatgttactagtaattttgtttgtcatatttggtttttttgcaactaagtcttgttcgcagttgcagactacatatgcctgtattgagatcctggttgccaaattaaccatcttgaactggcattattcc

SEQ ID NO: 5463 - DNA, 114 bp, Zea mays
  Clone ID: LIB143-064-Q1-E1-E10
aaaataagtcgtattataaaaagaaaaaaaaaaaaataaaaaaaacaaaaaaaaaaaaaaaaaaaaaaacaaagaaaaaaaattcaaaatactgaaaaaaacaataaacaaaaa

SEQ ID NO: 5464 - DNA, 492 bp, Zea mays
  Clone ID: LIB143-064-Q1-E1-E5-R2A
ggccactgcagatactggggtacggctgggctgggttgctgaggaggtacctggtcgaccctgccgagatgtggtggccttctaaccttgcccaggtctcactcttcagggcgctgcacgagaaagaagaggagggcggcaagtcccgtggcccgtcgcggatgcgcttcttcctcatcgtcttcttcgcgagcttcgcgtactacgcgctgccggggtacctgctgccgatcctgaccttcttctcgtgggcgtgctgggcgtggccgcacagcatcacggcgcagcaggtcgggtccgggtaccacggcctcggcgtcggcgcattcacgctcgactgggcgggcatctcggcgtaccacggcagcccgctggtggcgccgtgggcgtccatcgccaacacggccgtgggattcgtcatgttcatctacgtcatcgtgccgctctgctactggcagttcaacacgttcgacgcccgcaggttccccatct

SEQ ID NO: 5465 - DNA, 563 bp, Zea mays
  Clone ID: LIB143-064-Q1-E1-F12-R2A
gaattgaacttgtgcgaccagagaaaaatgagcggtctattaatcttttgtacagtttctaatggcacacgatactccggctccagagcacaggcggcagccgctgcgcttctatacagagttctaacaatcgcaaagagaatgcaattggacagcaataccgtctagggcacgacaagccgaattgagatgcagttattagctccaactctgccagaaatacgcttactagtaataacagagagaccactgaataaccccatttctgccccaggagctcctatagaacagtatatgtagttgaaatgtacattccaatcttccaatgtttacttgatggcgtctctttcggaattacttgttggcaccacccctggagagtcatggttgttcacactaagatccaccccctgagtctgggaatttgatccttgcccatgagtacgagccgggcgcatattaagatcgatcattttcgaatcaatgttaccctggccatcgcaattgccatcagagactggatcattgacgttatggtggtttgccatttgctccttgggcgt

SEQ ID NO: 5466 - DNA, 615 bp, Zea mays
  Clone ID: LIB143-064-Q1-E1-F12F2A
cttctctcctcgtccaaagactccaagcttctgtgacctctgttctgctgccgcctctggtccacatctctctacgccgccgccccgccgtccaccgataccgcagcgctgggaaggatcacgggggagcggagcgaggcggggggcccgcggttttgtcgcccggatggcggcgcagcgatgacactggcggcgggagcggcgcggcgttgggatgcggacgatctgcgatgtgtgcgagagcgcaccggcggtgctcttctgtgcggccgacgaggctgcgctttgccggccttgcgacgagaaggtacacatgtgcaacaagcttgctagtcggcatgtgagagttgggcttgcagaccctaataaactggcacgttgtgatatatgcgagaattcacctgctttcttctactgtgagatagatggcacctcactttgcctgagctgtgatatgactgttcatgttggtggcaaaagaacccatggtagatacctgctcctaaggcaaagggttgaatttccaggagataaaccgggccatatggatgacgtgcctatggagatcaaagatcctgaaaaccagagagagcaaaacacgcccaaggagcaaat

SEQ ID NO: 5467 - DNA, 404 bp, Zea mays
  Clone ID: LIB143-064-Q1-E1-F6
tatcaatgtgcaggttttggatctttgggtttgatgacatcagtgttggtgtgccctgatggaaaaaccatcgaagctgaagctgcccatggcacggttacccgtcatttccgtgtccaccagaaaggaggcgaaaccagcacgaacagcattgcttcgatctttgcatggacaagaggacttgcccacaggtacaactggtgtttgcttttttacgaccttctataacattataatatagtcggggggggggggagttttacggctagctgattcgcttggggtactcccttaattatgcgccgcagggcaaagctcgacgacaacgctagactactcgacttcgctctcaaactcgatgctgcttgcgttgagaccgtggagtccgggaagatgactaaaga

SEQ ID NO: 5468 - DNA, 417 bp, Zea mays
  unsure at all n locations
  Clone ID: LIB143-064-Q1-E1-F9
aagcaatcgactacctaaaatcccttcagctccagcttcagatgctggtcatggggaaagggaatgtcacagtggttcctcttgagctgcaacaatacatgcattacatcacggctgaccctgcccagttgcctccgttgcgcccctccggccagcagcaccggcaatttcagataactcaagccaatccccagagacaatctaacgtcgagtcggatttcttgagccagatgcagaacttgcactcttctgagccgcctcagaactttctcaggccaccgaaattgcaactttatacaccggaacagaggggtggcctaaccagcacgagccacaacactggatggatttctgggagttcctcgtataacttcatggagtgatgtgctccttgcctccttatgacanaatttgaca

SEQ ID NO: 5469 - DNA, 439 bp, Zea mays
  Clone ID: LIB143-064-Q1-E1-H12-R2A
ggcgcagcgtcttccacccggggagcaacctggccaccaagggcatgggcccaacctcttcgaccggccgcagcccaactcccccaccgtctacgactggctctacagcgacgagaccaggagcaaccaccgctagatcgggcgagatggatggacagtgaagaggccatgtttgctggtccttgtggttatctaaaacgcacgcatgctctattatagctagtcatcactatatatatacttgtgtttgtgtattgttgttcttgttctgctggtgtctccgccgtttaatttgacctatgttatggagtgagtgatatatgtgccgtcactcctagtatatagtagtgagtgactagttggtatgtgtagtactgtactatcttttctccatatgcatgttttgccagcgcgtaatgaatgtaatgtcagtactgct

SEQ ID NO: 5470 - DNA, 445 bp, Zea mays
  Clone ID: LIB143-064-Q1-E1-H6
acacaaagcgcctagcaaaagcaaagttcccgaagcactcttgcaatccactgagttctgtttgttgagacgcatagagctagctgctagcgacgacaatgtcgctcgtgaggcgcagcaacgtgttcgaccccttctcgatggacctctgggaccccttcgacaccatgttccgctccatcgtcccgtcggcgacctccaccaactccgagactgccgccttcgccagcgcccgcatcgactggaaggagacgcccggggcgcacgtgttcaaggccgaccccccggcgtcaagaaggaggaggtcaaggtcgaggtcgaagacggcaacgtgctggtcatcagcggccagcgcagcagggagaaggaggacaaggacgacaagttggcacgcgtcgagcgcagcagtgggcagttcgtcaggcgcttccgcctgccggagaac

SEQ ID NO: 5471 - DNA, 386 bp, Zea mays
  Clone ID: LIB143-065-Q1-E1-E4-R2A
gcgtggagcgcagcagcggccagttcgtgcggcgcttccgcctccccgagaacgccaagaccgaggaggtgagggccgcgctggagaacggcgtgctcacggtcaccgtgcccaaggccgaggtcaataagcctgaggttaagagcatccagatctccggctgaagaagacatggacgcgaggtgaatggtcgcgtcgcgttcgcgtcgcggcgttaggtcttgggtttcagcgacgcgactcgtgtgtgtggtactgtggttgctctgctttggtatgtctggtgtgtacgtgtgctgttcagtgtttcgtggtcatcgtctgtacattgtgctgttcggtgagctccccgactcagtgagttgtgttctgcgagtgaataactg

SEQ ID NO: 5472 - DNA, 332 bp, Zea mays
  Clone ID: LIB143-065-Q1-E1-G8
tacacgcaactaaaatgcgtccgtatagcttggttttgccgaaatattgtgggggaggagtgataaggtcggtggggtttctatgttaaagtcgtggtctcgggcaatatgcgatttttctttatgccatgttttgggaaattttgtagctgcctaggcctcgtgctgttgtggtggttcattagtatgaagacgaaggctctgctggctatgggagtcctttttctttttgttagtattttgtttaaaactatgtatgaccgaattatttgtcatccttgactcaattctgctgcaaaaaaaaaaagttgaaaaagaaatacaatgaaaaa

SEQ ID NO: 5473 - DNA, 376 bp, Zea mays
  Clone ID: LIB143-065-Q1-E1-G9
acaaaatgtttcagaaaagagataaagggcatgaccggtggtgccttcactgaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccccccaaaaggttcaaaccttacttacccttgaatgcaatttcaaacctcttcaaaagtgcccccaaatttcatttcaggggccttcttttaaaaacttcgtaatgggaaaacccttgggtttaccaaatttaacccctttgaaaaaaatccccttttcccaaccgggcttaaaaccaaaaaggc

SEQ ID NO: 5474 - DNA, 379 bp, Zea mays
  Clone ID: LIB143-065-Q1-E1-H8
taaacacacttctggcagagatgcttcccactgaatcactgatcgttgatcagtgttccaatattttggcaagtgcagctttgaataaattgaacagattggcctcgtggccattttcctgtatttatctgtagtcaggtccaattcttttctgttggtgagcgcaagttattcatagatgactcggtcatgggaatatttgtaatattatgtcatgtatcgttaaatttcagttgttttgtttcagctgccagaactgttagcaagagtattctggagctggaagctcgaacgcaactggttgtatctatatccttgaatgccgaataaaggaagggcaataaactgcagcgaaatatgtgctgtcagacattgttga

SEQ ID NO: 5475 - DNA, 347 bp, Zea mays
  unsure at all n locations
  Clone ID: LIB143-065-Q1-E1-H9
atttttgggttcaaactcatctagaggtccttttgtgtttgtacagtatattactgtaggcaaccatgaaaaccaaaggtttaggctgacctacgtttaggcctcatttctgatacggctccggagcgagcaaatgcagtgccgtagaaggtgatatcagtcgtatgcatgcctgtttcttcgtctcttgtactgtaacatgtcttaaatttacctagtgatggcgcatgtacttctgtcgatctgtaccattgttgctgttgaagacaaagtgcgccaaacaaacacgaaccttttccggtctccttccatgcttgtggggaaggttcaaaannnnnnnnnnnaaa

SEQ ID NO: 5476 - DNA, 362 bp, Zea mays
  Clone ID: LIB143-066-Q1-E1-A1
aagctataggaactgtcatacagggagcctgagtgctggtcgagcccggacgccgtgagcagcgtgacggagaggccgtggagtatggtcgctagccgtcgtggtcgccgtggtgtatagtcgctggccgcgcgtagcacctgttgccgtgcatgcggcgcatgtggccgaccatggcgctgggaagaatcaaattagttgctgccggtgtgcacaaggaagaagaaacacctggatcgtggttatggcctcgccaggaagactggaggctggcgctgccggggtttctcgctagagcgttttcctcgccgctgggtcaacctacatgtggccagcactgccgcaaccttaatcgacgcgcg

SEQ ID NO: 5477 - DNA, 85 bp, Zea mays
  Clone ID: LIB143-066-Q1-E1-C11
gtcatgtgaacatttgtacggttgaatgaagccaaaaaaaaaaaaaaaaaaaaaaaaaaaaaaaaaaaaaaaaaaaaaagaaaaa

SEQ ID NO: 5478 - DNA, 476 bp, Zea mays
  unsure at all n locations
  Clone ID: LIB143-066-Q1-E1-C5-R2A
cccacgcgtccgcccacgcgtccgctcccttctctcctcttcgatcccgacgaacgccgagggccgcggcgatggaatactcaggcggcggtgcgacgctgtcggagatgtaccagagcgcgcggcggctgctactctcggcgcgggatggcgtgggccgcgtcgagcgccttgcctcggcacccacttcgtcctcctactcctcggcgccgctcgtcggtggtgcgtcgggggaccccgcggttgctgaggaggtgcggcgagaggtggcgcanatccaggggctgtgcgcgcagatggaccgactctggcgatccatccccgccaaaggccaacgggacctctggaagagaaaagtggagcagctctctgaagaggtagattcattgaaggaaacccttgacaggcattctctgcgacagaaaaaacggattctggaagcaaaagaaagggctgggctatttgaaagagctaac

SEQ ID NO: 5479 - DNA, 284 bp, Zea mays
  Clone ID: LIB143-067-Q1-E1-C11
cagagaatctgtgtagccctcatgaggccacattcagatagatcacctcttcgggtgataccacctgcttggtactgtatgctttttttttactggtaccacattagcagccaaaatctcttgtaaacgggaactccttctgaatgagcgcaattgtacaaaacacatatgaagaggccctccgtgagatgctccgaacactgcaatgggatgtcaaatagttctgaatggtgagtgctgtttttgcatctataggggcatatatatgtttccattccatgtgc

SEQ ID NO: 5480 - DNA, 363 bp, Zea mays
  unsure at all n locations
  Clone ID: LIB143-067-Q1-E1-D11
gatgggcttcgagaagcagatcctgagatccggcaccggccccaagccgataaagggccagaaggtcaccgttcactgcaccggctacgggaaggatcgtgatctgtccaagaaattttggagcaccaaggaccctgngcagcagccattcagtttcagcattggtcagggttcagtgatcaaaggatgggacgagggagttatgaccatgcaagtgggtgaagttgctcgtatccagtgcacgcctgattatgcttatggagccggcgggttcccagcctggggaattcaaccaaactcagtgcttgtgttcgagattgaagtcctcagtgcccagtaattcgcatctgtcagctatggaaa

SEQ ID NO: 5481 - DNA, 287 bp, Zea mays
  Clone ID: LIB143-068-Q1-E1-A3
gcgtccaggggataccagtaccaggaggcggcgtatggcggaaccgacccgggacgatacgagctcagtcaccgtcaggagcacgatccgccattcagaagcacggctacaggaaggacgtgtacgagagcgagactgagagcgaggacgacgagagcgactgcgaagaggcgttcgcgccgcgcggcggccaaatgcagggcggcgtgcaggtgcatcagcgctacaaatgcgccatacacttgggtgtagcccgaggatctcaaaccgagagccgagaagaacac

SEQ ID NO: 5482 - DNA, 455 bp, Zea mays
  Clone ID: LIB143-068-Q1-E1-A4-R2A
cggacgcgtgggtgactgtggaaaccgaacctgcccaaaaactcagcagaagctccagaacctttcgttgaccccaaactacgtgcttagaagcttaatactgcagtggtgcgaggaaaaggggatggaaccacctagcaggtctaaaagcgacggttctcctcttgaggttgctggcaacagattagcaattgaagcgttagtccgcaacctctcgagcagttcattagatgatcggaaatctgctgcggctgaaataagatccttggccaagaaaagcacagacaaccgtatacttctagcggaatctagcgctataccggctctggtgaaactcctgtcgtccaaggacccgaaaacccaagagcacgcagtgacagctctcctgaacctctccatatacgatcagaacaaggggctggtagtgggtgcccgtgccatcgtcccaatcacac

SEQ ID NO: 5483 - DNA, 55 bp, Zea mays
  Clone ID: LIB143-068-Q1-E1-A6
aaaaaaaaaaaaaaaaaaaaaaaaaaaaaaaaaaaaaaaaaaaaaaaaaaaaaaa

SEQ ID NO: 5484 - DNA, 442 bp, Zea mays
  Clone ID: LIB143-068-Q1-E1-B3-R2A
agaagagcaacccaagtcgccgagagtgactcccacacgacccacctaccccgccggcgtcggcgtcgcatccccctcgattccgtctggcgatcgggggctcccagacacatcacagatacaccacgccaagccaaatcgagcaacgcctatcaccatattataatttcccctcattcatctcacagtcccaggcctcccctccctcctcccccgtcggcaactaacctacaacccccagccgatcgcgtcggagatgctgggcgtcgcgcggaggcggctcggatccggatgcgtgctcgcccagctggcgcaggccctgcgacccgccgtcgctcccgccaggacctactcccggcgggccaaggagataactgtacgggaagcattgaatactgcattagatgaagaaatgtcagcagacccttctgttttcttgatg

SEQ ID NO: 5485 - DNA, 458 bp, Zea mays
  Clone ID: LIB143-068-Q1-E1-E4-F2A
agaatctagaaatgtactttcttatttctgggaagccacaaacatcatccaaaaaacttcattattgaactataactcataagcaatctaaaagagggcaccaccaatgatgggttgttggtagaacgctgatgggtttgccacagcaagttggttgaatggcatcatttgttgcaaatgtaagatgccgccagcgttagacacaaagtgcacgtggaacgggaacaactgtagctgtgttaagagggcattagggctcacataagctagctgtttttaagccggttgttttccctgcagcaaaaaagcagcacagttcaatgctgacagttggttgaatggaagaaattgctggcggttggcagcagctagctgactgaaaggtagttgttgctgcaaaatagcagcaaagctcaatgcagccagttggttgaatggaagaaactgctgttgctgag

SEQ ID NO: 5486 - DNA, 105 bp, Zea mays
  Clone ID: LIB143-068-Q1-E1-H7
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 5487 - DNA, 514 bp, Zea mays
  Clone ID: LIB143-013-Q1-E1-D11-38Aa
gtcagtatatgccttacggcgcatatgttggtgggccccccccccccccccttcccccccccccccccccccccccccccccccctctccccccccccccccccccccaatataaaaaaatgcttgccggacttcctcttaaataatttcaccgccacctctcccggaaaaaggtcccgaacttttttaagccccaaatatttttccaaaccaaaaaaaaaaaggttctttcgcccctacccggatgaaagggcccgcctgatttctgggggaaagaatggttcacctgggaaatttttttcccattaggcccacctaatgccgggtgccgaataaacttatgacctgaagagaactgctgaccctgcggccaattggcctggtaaaaaatattttttggttactggaggccgtgtccaacgagcaatgataaccctactttaaagttgtttaaaattttcacctaaggaacccgggcgggggattataaatctcgataacccacgattttttt

SEQ ID NO: 5488 - DNA, 452 bp, Zea mays
  Clone ID: LIB143-015-Q1-E1-D8-39Aa
tagtgtagtaatgccttacggcgcatatgttggtgccccccccccccccccccccccccccccccattaaatacatacccccatcccacggcccccctcccgccgctgaccgcagaaaactagaatccctcccgaccttcagagacaccccggggactctagacccaaagacttaacaaaatcaaaaatttacagaaaactcccaatttatgccccgcgcaacggaaatggatcggcaccccactcgactcctggctaccaattgggcgaagtgcctaaaaattactagccaacgccccaccagcactcgctttggaaatgcgccgccgtttttataacgggcttgcccagcgagccttttgcttgtaaggtaatctggacccgacaaaatagccatagtctttatggcctttaccgttagcattacggacgccgataggccccgggccgcg

SEQ ID NO: 5489 - DNA, 667 bp, Zea mays
  unsure at all n locations
  Clone ID: LIB143-025-Q1-E1-D11-41Aa
acgcacagnctcgcggggctggtgtcgccagcggacacgaggaactcggcggcggcgacgaagtcgtcgaagcagttctgcttcttggcgagcgacccggccctgtgccagccctcgccgtactccccgccgcccctgaggttggcgacgcacgccacgaaccccaggttcctcatcaggaccacgcgggcgacgctgaactgcggcgtcacgctcacgccgaagccgccgtagccgaacagtagtgccgggtgcgatccgtccaggctgatctccttcttggatacgatgaacattgtgatctgggtcccatccttactcggataaaacacctgcttcgcttcaaactcgtttcgatcgaagcctggaaccgagatctctctgtagacgtccatctgcgggaccgcagagccgacatcgcacctgacgtccgacaggtagctcaccagcagcttgtggccgtggacggcgcacgccgactccaggaccgtcttaccgtcctcgtcctcaggaaccacgtcggtccacggagacccggccggctcgtcgtcgtcgacgtccaccctcgccagcttgtaccttggagcgtctttgttcgtgaggaacgtgaactgagtgccgtcgatagcgatgagcccgtagtaggcctcgaacctgtccacgagct

SEQ ID NO: 5490 - DNA, 632 bp, Zea mays
  Clone ID: LIB143-027-Q1-E1-H3-23Aa
ctactggcccggcctaggagcaccctcccagtctacaaggaggtcattgctgagttgtaggccgctttttcttcatggatccagttcgacgagcccactcttgtcctcgaccttgattctgacaaattggctgcattctctgctgcatacacagaacttgaatctgtactttctggattgaatgtgcttgatgagacttactttgctgatgttcctgctgagtcctacaagaccctaacatctctgagctgtgtgactgcttatggttttgatcttgtccgtggaacccaaactcttgggcttgtcaagagtgctggtttccctgctggaaagtacctctttgcttgggttagggatggacgcaacatctgggctgatgaacttgctacatctttcatcactctccagtctattgatgctgctgttgggaaggacaagcttgtcgtatcaacttcctgctcgctcatgcacaccgctgtggatcttgtgaacgagactaagcttgacagcgagattaagtcttgacttgcttttgctgcccaaaagggtgtggaaggtgaagctcttgctaaggcattggttggtcaaaaggatgaagcttacttctccagaaaatgctgaagcttaagcct

SEQ ID NO: 5491 - DNA, 451 bp, Zea mays
  Clone ID: LIB143-039-Q1-E1-B6-42Aa
ggagaggacagcccagcccaaggagaatgcatgctcagccttgcagagcggcaccccttctctgagagcagcctagtcgatatggataacctgaataccaccagcctcgagatcctcgactaccttcttgatcgcaagagcgatctggaagcaagtctcaaacctgggctggtcattccggacgaaggaccagtagaggattgtgactgggccagtcagcatccccttcattgagcgagacgtcatgctctgagccgaactcgaccagaaaacggtcatggggatggggcggctcacgacaccgtagatgatcggaggctggacgcacccttgacccataagactgcgcccagccatgggcagtgaacgcaaaaccggagagctgctcaccgaaggactgaaccatatcgattctctcaagctgggcatgcacaagcacatcaatgtcaag

SEQ ID NO: 5492 - DNA, 672 bp, Zea mays
  unsure at all n locations
  Clone ID: LIB143-052-Q1-E1-G1-43Aa
gggggacgatgggggttggattggggtactgtattgcggctgcagcagctgaacctgaacgactcgtggttgctgtggagggcgattctggattcggcttcagtgcaatggaggttgagacgttggtgaggtaccagctgcctgttgttgtaatcgttttcaacaacaacggtgtctacggcggcgaccggagaagccctgacgagataaccggaccatacaaagatgacccagccccaacctcatttgttccggcagcagggtaccataagatgatggaggcttttggagggaaagggtatcttgtggagacaccagacgagctcaaatctgccctttcagaatcgttccgcgccaggaaaccagcggtgattaatgttatcattgatccttacgccggcgcagagagcggtcgaatgcagcacaagaactgaaggcgttgggcttttgtaccataccatagcaggatgcagatgcgacttgatacaaataagcagcaaccgtcaatcaatccttttgtttcttttttacgacctcgcttcgttgttcgtggtacagacgtggggcgctttttaattgaaagtnccatttgaaggcatgtgaatgtngtattgatatctaaatgccaaacttttanaggcgtgttgtttgagatgtggtggaaaacctgtg

SEQ ID NO: 5493 - DNA, 600 bp, Zea mays
  Clone ID: LIB143-052-Q1-E1-G1-44Aa
agcaaaagcatgaagaagagtagtgagttttaatttggcaaaagcttcttcaccatcctctatgcctcctcttgatcagattgctttgcttgagaccattttaagtcttttacctgaaaagagaggaagatctttttgtaagttcttgttaggtctccttcgtgttgctttcattttaggagttgatgggaactgtgtaaagaagttggagaaaagaataggaatgcagttggagctagcaacgctcgataatcttctgattttgaactattctgattcagagacgttgtacaatgtagattgtgtagaacgaatagtccgccattttgtatcatcattgtcatcatcatcctcacagttacctgagttctctccttcatctttggatccagtgacatctccttctccagcaccgttaaaaaaagtggcgaagctagtagatagctacatggcagaagtcgcttctgatgtgaatctgaaaccggataaaatgcggtctcttgcagcagctctttcagaatcttcaagaccgttgtatgatggtttatacagagcgtttgatatttatttcaaggaggcatccatggctatcagatagag

SEQ ID NO: 5494 - DNA, 549 bp, Zea mays
  Clone ID: LIB143-058-Q1-E1-A11-45Aa
tggaaactcacccttttttttggttgaggaggtgcagcatcaactggagaaagtgccatagatttatttgctaatttgtacaacgctgctgcaccgtcaagttgatgcttagagttcaaagaaccaagaagaccgagtagcaactgcaaccctgacaaaagacaactcaatattaactctcttggacaaagaacatctaaactggacgggtaacgcattatacataacgcatgcatctcatttagctcatgaaaatataaaaaaactgtcacatgccggtgacatctatgaatatgggtcgttgatcctcgggtgaacagagatgagcaagggcaagagcaactcgtttttggatagacttctttgaaatgcgcattaggtacaacagatgtttcataacctacacaagaaaatcttagcacagaactctcaaaggttgaataaagaaaagctaaacttaaacagagctttagaaactcaaccaggataaagcagttttagtcatcaaagatggaaaaaaaaaagaattaaagaaaaagttagtttcac

SEQ ID NO: 5495 - DNA, 669 bp, Zea mays
  Clone ID: LIB143-058-Q1-E1-A11-Fa
tgttgcatagttgttccttgtctctatctgatagccatggatgctccttgaaataaatatcaaacgctctgtataaaccatcatacaacggtcttgaagattctggaagagctgctgcaagagaccgcattttatccggtttcagattcacatcagaagcgacttctgccatgtagctatctactagcttcgccactttttttaacggtgctggagaaggagatgtcactggatccaaagatggaggagagaactcaggtaactgtgaggatgatgatgacaatgatgatacaaaatggcggactattcgttctacacaatctacattgtacaacgtctctgaatcagaatagttcaaaatcagaagattatcgagcgttgctagctccaactgcattcctattcttttctccaacttctttacacagttcccatcaactcctaaaatgaaagcaacacgaaggagacctaacaagaacttacaaaaagatcttcctctcttttcaggtaaaagacttaaaatggtctcaagcaaagcaatctgatcaagaggaggcatagaggatggtgaagaagcttttgccaaattaaaactcactactcttcttctgcttttgctactgtcacttgttccactctgccaccgtcctaaacccggtaagtactttc

SEQ ID NO: 5496 - DNA, 619 bp, Zea mays
  unsure at all n locations
  Clone ID: LIB143-058-Q1-E1-D1-46Aa
agaagaagatttttgacgncctgtcacaagattgctgatattccgttcttggcaccctacaagaccaagattattgatgttatcgagaagggagagaaacagcccaacatcactattggcattttggtctccgttgtcatcgtgttcgttaccgttctctgcaagctcctgtttggtggcaagaaaccagtggcacctgtgaaacctgcagctgaggcgaagaagcccaaggccgcggagacggacggtgctggaagcagtggtgacaaggatgagaaagaggatgaaaaggaggagacaggcccacgtcggaggacccgaagggagacatagacctgtttttgacgtgttttagctcttctggcgtctgcttattttgagaactcttaatatttgtgagtgtataataggagcttatgtcacctctgcggcttcccccgctgctgatttgtttttaatggttagaccaggacccttcacgagcgtagaatttagttcttgttggtcatttatgtgctgtgcctgacggtgttcaatcagatagaggtgatggttttttttggtnaaaaaaaaatttgtttattcaaacaatggtatatacgcaaagagaaatattaat

SEQ ID NO: 5497 - DNA, 560 bp, Zea mays
  unsure at all n locations
  Clone ID: LIB143-015-Q1-E1-F10-F3A
gacttcacttgaggcatacagtgatagaccagttgatttcacttgattgaggacgtcttgaactttgatctgctcatttcacagatgaagagattgaacaaagctatgaagaattttatgaagatgtacatacagaatttctgaaatttggtgaacttgtgaatttcaaggtatgtagaaatgggtctttccatcttcgagggaatgtttatgtgcactataaatcgttggattcagctcttcttgcctacagcagcatgaatggacgctattttgctggaaaacagataacatgtgaatttgttgctgtgacaagatggaaggcggccatatgcggtgagtacatgaggtcaagatacaagacatgttcacatggagttgcttgtaattntattcactgcttccgcaatcctggaggagattatgagtgggctgattgggacaatcatcctcctagatactggattaggaagatggttgctctttttggtccctcagttgatgagatgaatgaaaaggcgagtcataccccagatttagaagttcagtgggctctgata

SEQ ID NO: 5498 - DNA, 451 bp, Zea mays
  Clone ID: LIB143-015-Q1-E1-F10-R4A
ataaaaaattaaatggttcaagtagtcagttatttatactcatgtcttcttataaaggcttacaagcttaaagtggaatacttgttattttgacatgagcttgctttagtattaaactatcacaacttaaaatggcactgcccatgaaaccaaaattgagcatccttaaacgtaaataaacagtagtttaaggatacaaagttatgcattagagaatttcctctaacaaacctcaagcccttcatcttgctccaaagcaaggcctggaccgttatacatgtttttcattagcaatgtgattgatttatcagggtaaaagtgaactctgctgcagcgcaatccaaagcgacaagcccctgtcttgagatgaaacggacaatgggccttatcctgttctgttccaaaattcggagtctcttgagcaactttgtcaagtacttcttgagcagac

SEQ ID NO: 5499 - DNA, 669 bp, Zea mays
  Clone ID: LIB143-037-Q1-E1-G12-F3A
catgcaccacctccttgtaaattcgaattttgctggccttgagggaattgaaatgtatggtctgggaaattggtttgaagttgcagagcatgttggtaccaagtctaagttacagtgtattgatcattacacaacagcatacatgaactcaccttgttatcccctaccggatatgtctcatgttaatggcaagaacaggaaggagcttctagctatggctaaagtgcagggtgaaagtaaaaaaagggacttcactgttgcctggagagctgactcctaaggctgaatctccattttctccctccagggtcaaggtggaagatgcacttggagaaggtctagcaggtcgatcaccttcgcacatagctgttggtgcaaataaaaaagcttcaaatgtgggacatattaaagatgggtctaatgtatcaaaagttgaagatggtcatgtcgatagaagtgttggtgtgaagaagcccagatattctgcagatgaaggcccttcgttgactgaactgagtggatacaatgcaaagagacacgagtttgacccagagtatgataatgatgccgaacaagcgcttgctgagatggaatttaaagaaactgattcagaaactgatcgtgaactgaaactccgtgtgctgcgtatttatctgtccaggcttgatg

SEQ ID NO: 5500 - DNA, 149 bp, Zea mays
  Clone ID: LIB143-037-Q1-E1-G12-F4A
ctaatgtatgacaaggtgaagagggccatgcacagtgacgtgtacgtgtgaccaaccccatatgttctgcagatgaaggccctccgacgactgaactgagtggatacaatgcagagagacactagtttgcccacagttgatcgatgccg

SEQ ID NO: 5501 - DNA, 582 bp, Zea mays
  Clone ID: LIB143-037-Q1-E1-G12-R3A
tgtatgctgttggtaatgatcaatacactgtaacttagacttggtaccaacatgctctgcaacttcaagccagtttcccagaccatacatttcaattccctcaaggaggagaatttcttcgtctgcattccaatctgggcaaataagtgggaaagacaggttgtccatgactttgtaaggatggttgctgcgatgtggggtgacttcagcgccaacagagaagcactccacgcaaaggtcgaagtcagggcacttggagcatttgatccgtatcttcccagagatgtccttgttgcagtaattgcagtggtagagcgctttcttgccccctccttctccagctcccccgatgccagcggaaacggagtccgtcgcatccccgcccgatgcgaccctcctccgcttcgacctgtgtacggtgtcgtcgtcgccggaattctgcacccctcgcgaccgccccatcgtgcgcccaaaccctagcgcaaaccctcgaaaccctaaccctagcgaacgcgcagttcgctaaatcgccgccgctactcgcatcgaccagacttggggtcgcatcgggaggtatgatcg

SEQ ID NO: 5502 - DNA, 232 bp, Zea mays
  Clone ID: LIB143-037-Q1-E1-G12-R4A
ccctcaaaccctaaccctagcaacgcgcagttcgctaaatcgccgccgctactcgcatcgaccagacttgtggtcgcatcgggaggtatgatcgatacgagcggaaggcaagattggagaattgaagaatcttaagggaagatctgggtcccggtcccaggtccctaccattgggggtggaccgtccagggcttggtgaaaaaaacaaccttgaaaccgacccctgggttga

SEQ ID NO: 5503 - DNA, 552 bp, Zea mays
  Clone ID: LIB143-047-Q1-E1-A7-F3A
gaacgtgtacgtggagttccgcgaggaggagcaggcggcccgcgccctgcaggcgctgcagggccgctactactcgggccgacccatcatcgccgagttctcgccggtgacggacttccgggaggccacctgccgccagttcgaggagcacagctgcaaccgcggcggatactgcaactttatgcacgtcaagcaggtcggccgggacctgcggcggaagctgtttggccacctgcatcgctccctccggagccacagccgaggcagccgcagcccgagcccataccgccgccgcggtagctcgtccaggtccagggaccgcgacgattaccacgactactactaccactactaccgtagtggcagtggcagccgcaggagcagcgagagacaccgcagccacgacagcgacgggagccgccgtcgacgcgggcggtcgaggagccggagccggagcccggtgagggaaggcagcgaggagcggagggcaaagattgagcagtggaaccgcgagcgggaggcaactcaagtgtaagcaaagtccccttccct

SEQ ID NO: 5504 - DNA, 627 bp, Zea mays
  unsure at all n locations
  Clone ID: LIB143-064-Q1-E1-F12-F3A
gcacctcactttgcctgagctgtgatatgactgttcatgttggtggcaaaagaacccatggtagatacctgctcctaaggcaaagggttgaatttccaggagataaaccgggccatatggatgacgtgcctatggagatcaaagatcctgaaaaccagagagagcaaaacacgcccaaggagcaaatggcaaaccaccataacgtcaatgatccagtctctgatggcaattgcgatggccagggtaacattgattcgaaaatgatcgatcttaatatgcgcccggctcgtactcatgggcaaggatcaaattcccagactcagggggtggatcttagtgtgaacaaccatgactctccaggggtggtgccaacaagtaattccgaaagagacgccatcaagtaaacattggaagattggaatgtacatttcaactacatatactgttctataggagctcctggggcagaaatggggttattcagtggtctctctgttattactagtaagcgtatntctggcagagttggagctaataactgcatctcaattcggcttgtcgtgccctagacggtattgctgtccaattgcattctctttgcgaatgtagaactctgtatagaagcgc

SEQ ID NO: 5505 - DNA, 660 bp, Zea mays
  unsure at all n locations
  Clone ID: LIB143-064-Q1-E1-F12-R3A
cctgacgccgacctcgcaattgccatagagactggatcattgacgttatggtggtttgccatttgctccttgggcgtgttttgctctctctggttttcaggatctttgatctccataggcacgtcatccatatggcccggtttatctcctggaaattcaaccctttgccttaggagcaggtatctaccatgggttcttttgccaccaacatgaacagtcatatcacagctcaggcaaagtgaggtgccatctatctcacagtagaagaaagcaggtgaattctcgcatatatcacaacgtgccagtttattagggtctgcaagcccaactctcacatgccgactagcaagcttgttgcacatgtgtaccttctcgtcgcaaggccggcaaagcgcagcctcgtcggccgcacagaagagcaccgccggtgcgctctcgcacacatcgcagatcgtccgcatcccaacgccgcgccgctcccgccgccagtgtcatcgctgcgccgccatccgggcgacaaaaccgcgggccccccgcctcgctccgctcccccgtgatccttcccagcgctgcggtatcggtggacggcggngcggcggcgtaaagagatgtggaccagaggcggcagcagaacagaggtcacagaagcttggagtcttt

SEQ ID NO: 5506 - DNA, 306 bp, Zea mays
  Clone ID: LIB143-015-Q1-E1-F10-TAA
ctggcggcgggggtgttcacgcggagcctggacgcggccaacaccctgtcgcgggcgctgcgggcgggcaccgtgtgggttaactgctacgacgtgttcgacgccaccatcccgttcggcggctacaagatgagcggcgtcgggcgggagaagggcatctacgccctccgcaactacctccagacaaaggccgtcgtcacacccatcaagaaccccgcatggctgtaaatcacatcctccgtccttgcccgcacggcgctgcgccggttctcggagaacgtgacgaataaaacaaacggtttggtt

SEQ ID NO: 5507 - DNA, 90 bp, Zea mays
  Clone ID: LIB143-015-Q1-E1-F10-TCA
gacccaaatatatctgagtgcagtggccaccagagactaggcctttcttatatttgtggggtgggggtgggggggggggggggagcctct

SEQ ID NO: 5508 - DNA, 281 bp, Zea mays
  Clone ID: LIB143-015-Q1-E1-F10-TGA
acattgaaaccgatggtggggatggtggtgacgatctcgccgagcttgagcttgtagaggatggtggttttaccgtcggcgtcgaggccgaccatgaggatccgcatctccttcttggcgaagagccggctgaagagcttcccgaacgcgagccccatcttcctccgcgtcccccttccttcacacctgcgctgcgctgaatgcgagatccgaaggaggaattggggatcggaggcaaggagcggggcggagaccagaagagggaagggaggggagatatt

SEQ ID NO: 5509 - DNA, 670 bp, Zea mays
  Clone ID: LIB143-037-Q1-E1-G12-F4B
aaaataagtcgaagatagaagagcccagattcaaaatgaagaaatggaaactcgaaatggatccttctgattctcaaagaatgaggggcaaggggattgataccgagaaagatttcttcttattataagacgtgatttgatccgcatatgtttggtaaaagaacaatcttctcctttaatcataaatggaaagtgttcaattagaacatgaaaacgtgactcaattggtcttagttagtcttcgggacggagtggaagaagggcggagactctcgaacgaggaaaaggatcccttcgaaagaattgaacgaggagccgtatgaggtgaaaatctcatgtacggttctgtagagggacagtaaggatgacttatctgtcgacttttccactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccctagatgctgtcgcagtaaagaatcgtcaacaagggcgttctaaatatggggccaaaaagccaaaaaaataagtgattcgtttttagcccttat

SEQ ID NO: 5510 - DNA, 675 bp, Zea mays
  Clone ID: LIB143-037-Q1-E1-G12-F4C
acaaagctaccaaatcacagcacatcaatcgccgatacatgcgtactctaaaaatgctactaatgaatgatactacgtaggcaaaccattggagttgagttgagctcagaactcctcgacagagatggcttcacgagggacctcataagcatccttcggtctcagcttcttcacaccggcgatgaagcatatcttgtcagacttgtagctctcgatgctcacgctggccaccttcacccataccaccaccttggtcttcatgccttcaaccccggaaagcttgcctcgggacagagtcgccttgacacgaggagcataccttacggtggaggaatccttgaagctcacctcgcagggcttggacaggtgcaccaccagcttcgaggtcgattcgtcgtactcgtagcagatgatgttacgagggaagagacctggagggaggttgtgctcgcgcagtagatcagggagcgacttcttgtgccctttgagtttctcgaacacccattttgccttctcctccaccgtgctcgaaaaacgggagatgtcgtcaccgatggcggagagctcctgcttggccttgcgggagattgtgaagctgccgagcttggtgagagccttctccatcctccttcctcccttcggaagcgcagtcgctccgctcggctggttctctct

SEQ ID NO: 5511 - DNA, 686 bp, Zea mays
  Clone ID: LIB143-037-Q1-E1-G12-R4B
aagctaccaaatcacagcacatcaatcgccgatcacatgggacccgaaaaatgctacgaatgaatgatactacgtaggcaaaccaatggagttgagttgagctcagaactcctcgacagagatggcttcacgagggacctcataagcatccttcggtctcagcttcttcacaccggcgatgaagcatatcttgtcagacttgtagctctcgatgctcacgctggccaccttcacccataccaccaccttggtcttcatgccttcaaccccggaaagcttgcctcgggacagagtcgccttgacacgaggagcataccttacggtggaggaatccttgaagctcacctcgcagggcttggacaggtgcaccaccagcttcgaggtcgattcgtcgtactcgtagcagatgatgttacgagggaagagacctggagggaggttgtgctcgcgcagtagatcagggagcgacttcttgtgccctttgagtttctcgaacacccattttgccttctcctccaccgtgctcgaaaaacgggagatgtcgtcaccgatggcggagagctcctgcttggccttgcgggagattgtgaagctgccgagcttggtgagagccttctccatcctccttcctccctccggaagcgcagccgctccgctcggctggttctctcttctctgcgccgctc

SEQ ID NO: 5512 - DNA, 583 bp, Zea mays
  Clone ID: LIB143-037-Q1-E1-G12-R4C
cattggtgcgggccgaagaaccgaaaagcaagcttttgattggcccgagttgtgactgatgattgtacgtacggttgtaacttcaggttttcctgatcgccgacgctaaaaatccgttcagaacgtcgtttatccgcctgacgtttcatgcggtcctgggcacgtaacagatgttgctgaaccaacttggataccacctcacgatcgtgaagccaagtagacagatctgaaacagtcactgcactccctggttgcaagccgaagtgccgagggggctgtccatataacacctcaaatggagaacaattcagagctgaatgaaagttggtattataccagaactctgcaacagctaaccattggtaccatttgctgggacaggcgtgcacaaagcatcgcaaataagtttcaatgcactagtttacgcgctccgtctggccatcggattgtgggtgataagccgaactcatgcataattgggtgccactgagagtgaataattgctgccagaacagacttgtgaacactctatcccgatcagatactatattgtccggcataccatgaagcttatagatattat

SEQ ID NO: 5513 - DNA, 240 bp, Zea mays
  Clone ID: LIB143-047-Q1-E1-A7-TAA
tcgacgtcggcgtcgtccatgacgatgaaaggggacttgccaccgagctccatcgtcaccggcttaaggttgctctcctccgccagctcgagcacgatctgccccgtgcccgtcgatcccgtgaacgcaagcttgtcgacacccatgtggctggagagcgctgcgccggccgtcgggccgaagccggacaccacgttcagaacaccctcggggagcccagcctgcaaccggacgcgtggg

SEQ ID NO: 5514 - DNA, 81 bp, Zea mays
  Clone ID: LIB143-047-Q1-E1-A7-TCA
ccaaaatatctgagtgcagtggccaccagagactaggcctttcttatatttgtggggtgggggtaggggggggggctaatt

SEQ ID NO: 5515 - DNA, 453 bp, Zea mays
  Clone ID: LIB143-047-Q1-E1-A7-TGA
aggccatcaggttcgacttgagggcctccacgtcggttgccgggactttgtggatcttgccattgttgtacacaaagctcccgtcaacagccttgaagttgagatacttggtcacgctggtgcggatcaggacgcggaccagcgcgccgtttgccatcatgaacttgggcaccatgtcgacgttgtactctttgctgacgcccaggtgctcgggagggctgtcgttgcccttgaacctgttccagagcttggttagattcagggacgaagattctcctccgtagtagtcattcctgtccatgtgaaggaccttgaggccatcgacggagaggaggccgctgatgatgcactccttgagccccgtccccaacacgatcacgtcgtactcctcatccatctctctctctctctctctttctctgcctgcttgccttcttctcctcgatctcacgc

SEQ ID NO: 5516 - DNA, 195 bp, Zea mays
  Clone ID: LIB143-047-Q1-E1-A7-F4A
cgccgtcgacgcgggcggtcgaggagccggagccggagcccggtgagggaaggcagcgaggagcggagggcaaagattgatcagtggaaccgcgagcgggaggcagctcaggtgtaagcaagttccccttccctagttgccatgttggttgctgcagtgttattggccttgctagttgccatgttgctgttgctg

SEQ ID NO: 5517 - DNA, 440 bp, Zea mays
  unsure at all n locations
  Clone ID: LIB143-047-Q1-E1-A7-R3A
accgnataaagaaggcaggcgcggggaggcgcgccggaagnacgncaccggcgagaacacggcgacgaagggncggacgctgtagnagcggcccngcagcgccaggaggcgcgggccgcctgctccgccacacggaacaccacggacacgnncccgancangnggaccgagagggagccgcagacgnggaggcacncgaacacgccgcgcaagcgcagcnccacgaagaagaccncgcagaagnccncgaanggcgccgggaaccgcnccgggnagaaggggcagcccggcgcgaccacgcccggagagaacaagaccggccgcnggnacaggcggcagagcagcagcgacggggagaaggaaggcccgnngagcaagcgggagcaccggncgccgaggcggcacgcgccgaaacagaagnagaaggggcagaacacgcg

SEQ ID NO: 5518 - DNA, 177 bp, Zea mays
  Clone ID: LIB143-047-Q1-E1-A7-R4A
acgcggtccttctcctgccaaagaggacgcaagatgctcagccatggatgcctgattactcctctacctgctcgattcgtcgcctagaggtttctgtggtccggttgccagagaagagtgccgccgtagccggagcccggaggtgaagcatatgagtacggacccgctggatttgct

SEQ ID NO: 5519 - DNA, 539 bp, Zea mays
  unsure at all n locations
  Clone ID: LIB143-035-Q1-E1-B4-f12A
gagcagnggcttacggaggggtcccaactttaagaatccgtggtgaatatgtggacccagnactttggggctgttttataagagaaaggaggaccacctggatacgccctgtcgaaacataacaaggcacaagggctctccagcaaggacagatggcagcaggggttcagattacatgcctacacctgatagagattaaatattttcacgatcacgaggtttctttactgtacggccacacatgtcttagaccttgttcgtttacgtcggattgcacccggaatcgttccagctaatcaaagtttatataaattagagaagcaatccggctaggaatcgttccgacccaccaatccggtagaaacgaacaaggccttaatcattttgtagcatatatatgaatgaacgagttcctgctaacaccgtcatataatcgactctgtacaacactaggcccgccattgggtgaccgcttcttggttctccaaggtgcagttgtcacttgagagcctactgatcatgattgtcgatacctgggc

SEQ ID NO: 5520 - DNA, 571 bp, Zea mays
  unsure at all n locations
  Clone ID: LIB143-035-Q1-E1-B4-f13A
ttttgagctcgcagcaattaatgcttgctcattgcaccatatatgtactcagtgattggcaactcctgccgctggatagacctttcacttcttgacttgtgaccctgcatgtcatcaccactgctatccacctccatatgatcagtagaacttccattcctttgataatcatttatcaaaacggcagattcgactgaaaccaaaccatgtagattcaagcgaattnttactttgactttagaagcttcggtatgtgcttggaatgggccaatctgaaaactaccgatgtctgttgaggtaccaggaggcaattcattagcatccacataatatgcatcaaaactaaaactgtcattcttctctagagtaatgatcttaacactgggaaagtgcaggccttttcggaacaatgcatcacttgacaatgttgaaactgggccgtcactagtgttaaatccttatggagcagggattgcatcctgcacctcgtattcccgacacggaacgtaggactaaacattgcacatttgaacgcgcacccccgagccacacacttactagcaattgagtg

SEQ ID NO: 5521 - DNA, 573 bp, Zea mays
  unsure at all n locations
  Clone ID: LIB143-035-Q1-E1-B4-r10A
gccttttgctgntctcgctctcgagctcccagcaattcatgcttgctgatggcaccatatatggactcagggatgggcaacttttgccaggggatagaccccccacttcttgactcgcgaccctgcatgtcatcaccactgctatccacctccatatgatcagtagaacttccattcctttgataatcatttatcaaaacggcagattcgactgaaaccaaaccatgtagattcaagcgaatttttactttgactttagaagcttcggtatgtgcttggaatgggccaatctgaaaactaccgatgtctgttgaggtaccaggaggcaattcattagcatccacataatatgcatcaaaactaaaactgtcattcttctctagagtaatgatcttaacactgggaaagtgcaggcctctccggaacaatgcatcacttgacaatgttgaaactgggccgtcactagtgttaaatcctatggaagcagggattgcatcctgcacctcgtattcccgaacacggaacgtaggactaagcattgcacattgcaacgcgcacccccgagccacacac

SEQ ID NO: 5522 - DNA, 468 bp, Zea mays
  Clone ID: LIB143-015-Q1-E1-D8-F50A
gcgtgccgttgtcaggggcgctctttaaaccatccggggcatattggtcgcagtacgacagcttgtgcaccggcttttacgtctctgagaccgaaaggatcacgtacttgccatcatgtgcgacttgagggacgtatatgcacttgggacgatcacggtctctccagcacaacacgtactgagactgctctgatacaaggaaatgagagcatacttcttcgatgagatagacgtcagtcttcatcccataatccagcgcatcccttggagccggaaaacgcgagtagaagaacccttggccgtcacgagtgcacgcgatgcgcgagaatttcacccaggacagcgtatagggcaggtgctccttgtcgcgcacgcgcatgaccccgatggtgacccaatcgctgacgctggcgctggcgcccgaggccaggtgctcgccgtcaacgttaacgccgaccacgccgagcg

SEQ ID NO: 5523 - DNA, 517 bp, Zea mays
  Clone ID: LIB143-015-Q1-E1-D8-F51A
cgaccacgccgagcgacaccgtgccgtcctcgctgaacgtgttggggtccagcagcacgtcgggctcgccgcctattccgtgctgcacgtagagcgcgctgtgcgggcggaggcccgggttgtggaagtagaagtagctgccccggcgcttgaagggcgcgcggaagcgcgggtggtcgaagagcgcggtgagctgcccgcgcaggcgcccgcggtggtcgcagctggacagcacggcgctggtcacggtcgcctgcgcgttcacgaactccttcacctccttcgaatccacctgctccatccatctgtaagggtccggcacgaggacgccgtggtagtcgtcgacgatgtcttcgtcccggcgagcctgaaggtacttgagcggcggcaacggcccgtccgcggtggccaaggagcccataacgacagaacacactagtttagcaataggaacacagagcgggcggaagcacacagagcaaggcggggctggagctggagatggagatgacaacac

SEQ ID NO: 5524 - DNA, 637 bp, Zea mays
  Clone ID: LIB143-015-Q1-E1-D8-F52A
cccgcggacgagacgggaaggcggtcctggagtcggcgtgcgccgtccacggccactttctgctggtgagctacctgtcggacgtcaggtgctatgtcggctctgcggacccggacatggactcctacaaacagatctcggttccaggcttcgatcgaaacgagtttgaagcgaagcaggtgttttatccgagtaaggatgggaccaagatcccaatgttcatcgtatccaagaaggagatcagcctggacggatcgcacccggcactactgttcggctacggcggcttcggcgtgagcgtgacgccgcagttcagcgtcgcccgcgtggtcctgatgaggaacctggggttcgtggcgtgcgtcgccaacctcaggggcggcggggagtacggcgagggctggcacagggccgggtcgctcgccaagaagcagaactgcttcgacgacttcgtcgccgccgccgagttcctcgtgtccgctggctacaccagccccgcgaggctgtgcgtctagggcggcatgaacgggggcctcctggtagctgcctgcgtgaaccagcgccctgatctgtttggctgtgccctggcccatgtcggagtgatggacatgctacggttccacaagttcaccattgg

SEQ ID NO: 5525 - DNA, 435 bp, Zea mays
  Clone ID: LIB143-025-Q1-E1-D11-F53A
aaggcgacattgtagagtaccagctacgccatcacttgtatagttttttagagtgactaaaagtaagtgaccaattgttaattgtcctcagaataaaccagcgtttgatgctgtcttgatgatctgaaagagagatgatccaacaacaacaaagacaaagaacccaagaagaataggtccaacaggataatcatttgccttcttgactgtctcaggaacagagcccctctttgtgatattcttctcaaatcgtgctatcttcctatcggcaagacgccttgaggtagtcatggcgattgacgcaggtcgggttgccgcggccggacgcggcgagcggcgtgaggggagggcgagaccggaagaggatggggacgggtgtgtgcgacagtgcgagtaggactgcgaagcgagcggacgcgtgggcggacgcgtggg

SEQ ID NO: 5526 - DNA, 494 bp, Zea mays
  Clone ID: LIB143-033-Q1-E1-E7.F2
atcccacaaccctttgaaaaaggttatttatccccctgaacaaattacatgattcaggggattgaaccccagggaatacgaagcaagattttggccccaaaaattgtacgggtggagcaaccccaaattaaaacagcccctcctaaaggtttgaagcaaattatatcagcccaatttggaatatattaaaaatttccacactacattgttcctcgagcaacctattagcactggcctaaaagtccgaggaaacaaaacaaagccgtcgttccgggcgggggggatctaaaaggaagaaaacttggtaacggccttggggccctcgaaaacggggtgcttggcaagctccccagaaaggacgaggcccaccgaagtctggatctcccgggaggttatggggggctttttgttgtagcgggcaaacttgggggcctaaaaagccagcttttaaaaaatgtcgttgataaaggagttcatgatggacatggccttgg

SEQ ID NO: 5527 - DNA, 654 bp, Zea mays
  Clone ID: LIB143-033-Q1-E1-E7.R2
gccaccagcgctcgtcacctccaatcaacaaattcccaatccgccgcttcccatcccgcgttcgccgctccatttgatcgaattcccgatggcgcccaaggccgagaagaagcccgcggagaagaagccgacggaggagaaggccgagaagaagcccagggcggagaagcgcgtgccgggcaaggagggcggcgagaagaaggggaagaagaaggccaagaagagcgtcgagacgtacaagatctacatcttcaaggtgctcaagcaggtgcacccggacattggtatctcgtccaaggccatgtccatcatgaactccttcatcaacgacatcttcgagaagctggctgctgaggccgccaagctcgcccgctacaacaagaagcccaccataacctcccgggagatccagacttcggtgcgcctcgtccttcctggcgagctcgccaagcacgccgtctccgagggcaccaaggccgttaccaagtttacttcctcttagatcgccgccgcacggagcgacggctctgtttcgtttcctcgtacttttaggccagtgctaataggttgctcgaggaacaatgtagtgtggaaatttctaatatattccaaattgtgctgatataatttgcttcaaaccttgaggaggcgctg

SEQ ID NO: 5528 - DNA, 275 bp, Zea mays
  Clone ID: LIB143-039-Q1-E1-B6-F56A
ccataccatagcaggatgcagatgcgacttgatacaaataagcagcaaccgtcaatcaatccttttgtttcttttttacgacctcgcttcgttgttcgtggtacagacgtggggcgcttttaattggaagtcccatttgaaggcatgtgaatgtgttatgattatctaaatgccaaactttaaaggcgtgttgatgaggatgtgtggaaaacctgtgcccatatatgagccggtataattatttctcaaagtaataaagtcagtgttttagggtc

SEQ ID NO: 5529 - DNA, 507 bp, Zea mays
  Clone ID: LIB143-046-Q1-E1-C10.F2
accaccatgactaaattcataacacaggcaaaagccactggaccacttacacacaccagccaaccaccactactaccatgagaagcggcacatcacagtgcttgcttgagaagcagacaacaacgacgcctactacaagggggctaaaacgaggggaacttggtgacggccttggtaccctccgagacggcgtgcttggcgagctccccggggaggacaaggcggacggaggtctggatctcgcgggaggggatggtgggctttttgttgtaccgggcgagcttggcggcctccgcggcgagctttttgaaaatgtcgttgatgaaggagttcatgatggacatggccttggaggagatgccgatgtcggggtgcacctgcttcaggaccttgaagatgtagatcttgtaggtctccacgctcttcttcgccttcttcctacccttcttgtcgccgccctccttgccggcggacttgcccgcaggtagccgcttctccgccttgggc

SEQ ID NO: 5530 - DNA, 620 bp, Zea mays
  unsure at all n locations
  Clone ID: LIB143-046-Q1-E1-C10.R2
tcccggtcgacccagcgtccgccccgcgtccgcggccgcgtgggccgcaacttcacagcgtatcatcgttttccatcgctcctactcctatcatccagnaaaatctgagcggtattgatggcgccccaaggcggagaagaagccggcggcgaagaagtggcggaggaggagccctcggagaagcggctccggcggagaaggcccccgcgggngaaaaagcccaaggcggagaagcggctacctgcgggcaagtccgccggcaaggagggcggcgacaagaagggtaggaagaaggcgaagaagagcgtggagacctacaagatctacatcttcaaggtcctgaagcaggtgcaccccgacatcggcatctcctccaaggccatgtccatcatgaactccttcatcaacgacatcttcgagaagctcgccgcggaggccgccaagctcgcccggtacaacaagaagcccaccatcacctcccgcgagatccagacctccgtccgcctcgtcctccccggcgagctcgccaagcacgccgtctcggagggtaccaaggccgtcaccaagttcacctcgtcttagcccccttgtagtagggcgtcgnttgttgtctgcttctc

SEQ ID NO: 5531 - DNA, 640 bp, Zea mays
  unsure at all n locations
  Clone ID: LIB143-052-Q1-E1-G1-F57A
gcctccgtggcgacggcgcgacggaggcgccgttgatgcggacgcggccgttgaaggtctgtgggcggagggcgttgtggtcctggaggcgtcggtcgtggaagacggagacgtcgatggggagggaagggaagcgcgcggggtcgcggacgtcgaagaccagcgtctggttccagtacggggagcggtcggcgggcttggtggcggtgcgctggcgctggtcgtcgaagtccacctctacgtaggggttgcaggaggcggtgccgtccttgggggcgaggtcggctgcgtcggagatctcgacgacgagcttcatggctggctcggctgagtggctgaccctggcctaccaacaaccggcgggccggcgggcgatgaacgagtgatgtgatgatgaaggtgatcaccgtaccgtcgtagacgccatgttcttcatctgccggtgcgtgctggtggagcgctagcggaggagagaggattggaattaatggaggcgagcgagactatggaagaggcgcggcgtgcgtggtgaagacgacagcgttcccactcggccgtatgtacacgatggactcacgaacttggcccggcctatctgttgctgttgnctttgctctctctctctctctctctctctctc

SEQ ID NO: 5532 - DNA, 452 bp, Zea mays
  unsure at all n locations
  Clone ID: LIB143-052-Q1-E1-G1-F58A
ctggtcgtcgaagtccacctctacgtcggggttgaggaggcggtgccgtccttgggggcgaggtcggctgcgtcggagatttcgacgacgagcttcatggctggctcggctgagtggctgaccctggcctaccaacaaccggcgggccggcgggcgatgaacgagtgatgtgatgatgaaggtgatcaccgtaccgtcgtagacgccatgttcttcatctgccggtgcgtgctggtggagcgctagcggaggagagaggattggaattaatggaggcgagcgagactatggaagaggcgcggcgtgcgtggtgaaaaccacggcgtcgccactcggccgtatgtacacgatggactcacgaacttggcccggtctatctgttgctgttggcttggctctctctctctctctctctctctctctgtgtgcgcgcgcgcttgcccacgcgtncg

SEQ ID NO: 5533 - DNA, 449 bp, Zea mays
  Clone ID: LIB143-057-Q1-E1-D9.F2
atgaagcaggcaagctagctactggcctttgttcacccgacgagaacatcaacaatttcacagcacatacataggcggggagggggaggggtagaggacacgacgaaaaacccttgtaagaaggggagacctaacaaatccgtggacgctgcaggctgctcaattgctggtgaacttggtgacggccttggttccctcggagacggcgtgtttggcgagctctcctgggaggacgaggcgcacggaggtctggatctcgcgggaggtgatggtgggcttcttgttgtaccgggcgagcttagcggcctcgccggcgagcttctcgaagatgtcgttgatgaaggagttcatgatggacatggccttggaggagatgccgatgtcggggtgcacctgctttaggaccttgaagatgtagattttgtaggtctccacgctcttcttggcct

SEQ ID NO: 5534 - DNA, 567 bp, Zea mays
  Clone ID: LIB143-057-Q1-E1-D9.R2
gccaaccacatccagtccaccccatccccctcgaccccgacaaccccgagtcccgacccgatggcgcccaaggccgagaagaagccagcggagaagaagccggcggccgaggagaaggcggagaagacgaccgcaggcaagaagcccaagtccgagaagcgcctgcccgcctcgaagtcctccggcaaggagggcggcgagaagaaggggaagaagaaggccaagaagagcgtggagacctacaaaatctacatcttcaaggtcctaaagcaggtgcaccccgacatcggcatctcctccaaggccatgtccatcatgaactccttcatcaacgacatcttcgagaagctcgccggcgaggccgctaagctcgcccggtacaacaagaagcccaccatcacctcccgcgagatccagacctccgtgcgcctcgtcctcccaggagagctcgccaaacacgccgtctccgagggaaccaaggccgtcaccaagttcaccagcaattgagcagcctgcagcgtccacggatttgttaggtctccccttcttacagggttcttcgtcgtg

SEQ ID NO: 5535 - DNA, 569 bp, Zea mays
  unsure at all n locations
  Clone ID: LIB143-058-Q1-E1-A11-F59A
cttccacaagaagatttttgacgtcctgtacaagattgctgtattccgttcttggcaccctacaagaccaagattattgatgttatttagaagggagagaaacagcccaacatcactattggcattttggtctccgttgtcatcgtgttcgttaccgttctctgcaagctcctgtttggtggcaagaaaccagtggcacctgtgaaacctgcagctgaggcgaagaagcccaaggccgcggagacggacggtgctggaagcagtggtgacaaggatgagaaagaggatgaaaaggaggagacaggcccacgtcggaggacccgaagggagacatagacctgtttttgacgtgttttagctcttctggcgtctgcttattttgagaactcttaatatttgtgagtgtataataggagcttatgtcacctctgcggcttcccccgctgctgatttgtttttaatggttagaccaggacccttcacgagcgtagaatttagttcttgttggtcatttatgtgctgtgcctgacggtgttcaatcagatagaggtgatggtttttttggtnna

SEQ ID NO: 5536 - DNA, 554 bp, Zea mays
  Clone ID: LIB143-063-Q1-E1-G12.F2
aaaacaaacgtctattgtgatctgagatttaaaacaggcaccatagatgcttggggtaagtacagactgcaggctaaacatcccaatccaacaacggtcgagtgccgatgaagcgaagaaactacaaactaaactgcctcactccagggacgggacgacacttgcaaggaaactactcagaagacggcactaatctactgcatctagaaagtccttcgagaaaacccggttaggccgacaacgacgagattttttccctgactgcaaacacttggacagagtttcatccgtcatacatcactcgtcaccctcctcgtcctcgtcgttcacctcggacttggacttgtcggaatcaccagacgccgtggggtctccagactgcttgttgttgtaagcgtcgatcttcttggtgtactcagccttgagcttctctgccttagacacgtagggagccttctcggcatcagacagggacttccacttgtcaccaccagccttgccaatcagggagacttgcttcacattggggtgcttctccttgtggtccttcctga

SEQ ID NO: 5537 - DNA, 737 bp, Zea mays
  unsure at all n locations
  Clone ID: LIB143-063-Q1-E1-G12.R2
ggcgccggcccctacaaccgttttgcgtgctcacacccacccaaaccttagtcgcgatcgagggccccaggggactcgagnnatgaagtcgaggggcnnacggtccccaccgccggnncgactccaggcttttctcggtgagnggaagaaccaaggcttgagnaagggactcctaaacannagcccaagnaggggcctccgnagctgcgtgtgcgttcgtgnnnttcatggnaggnnnagttcaggnaagggacttacaaggnagaaagnncacccnncaatgtgannnagcaagtcttccctttgattggggcaaggcttggnntggtgnnacaagtgnngaagtcccttttgtctgatnngccgagnnaaggcttcccttacnngtgtcttaagnngcagagnaagctttcaaggcttgagtacccaccaagaagaatcgacgcttttacaacaacannagcagtcttggagaaccccacnnggcgtctggtgggattccgtattatttccannagtccgaggtgaacgaaacgaggacgaaaggagggtgacgaagtgatgtantgacggatgaaaactcttgtccaagtgttttgcagtcaggggaaaaaatctccgtcgtttgtcggccctaaaccgggttttcttcgaaggactttctagnatgcagtagaattagtgccgtcttctgagtattttccttgcaagtgtcgtcccgtccctggagtgagggc

SEQ ID NO: 5538 - DNA, 571 bp, Zea mays
  Clone ID: LIB143-066-Q1-E1-H1.F2
gataaacaggtcgtccaaaggatgcactccttatagcaaaatatacagaactaatccttggcagtggtacagggagacacatcccgaactacaacgcaacacctaaggcatttctagagcgtactacacaggcacaagttgatacggcagcatccacaagaggtgccaccaccggatgaaaggctaggcgtggtcggtctagtcctcatcaccagccgcagccttggcactgccgccgccagacttcttgggcaacagcaggttatggatgttgggcatgacaccaccgctggcgatggtcaccgtgcccagcaagcgggagagctcctcgtcgttgcggacggcgagctggatgtggcgcgggacgatgcgggtcttcttgttgtcccgagccgcgttcccggcaagctcgagaacctcagcagcaagatactcgagcacggcagcgaggtagacgggggcgccggcgccgaccctctcggcgtacttgccggccttgaggaacctggcgatccttcccactgggaactggagcccggccttggagctcctggacatggccttcttggcg

SEQ ID NO: 5539 - DNA, 671 bp, Zea mays
  unsure at all n locations
  Clone ID: LIB143-066-Q1-E1-H1.R2
gctgcctccgtcggtttcgctttccccccgntcttcccaagcctttgctntcgctcttcgcttcgngattccctctgctcatggcccgggagagggaaggcgatcggctcaggggccgccaagaaggccatgtccaggagctccaaggccgggctccagttcccagtgggaaggatcgccaggttcctcaaggccggcaagtacgccgagagggtcggcgccggcgcccccgtctacctcgctgccgtgctcgagtatcttgctgctgaggttctcgagcttgccgggaacgcggctcgggacaacaagaagacccgcatcgtcccgcgccacatccagctcgccgtccgcaacgacgaggagctctcccgcttgctgggcacggtgaccatcgccagcggtggtgtcatgcccaacatccataacctgctgttgcccaagaagtctggcggcggcagtgccaaggctgcggctggtgatgaggactagaccgaccacgcctagcctttcatccggtggtggcacctcttgtggatgctgccgtatcaacttgtgcctgtgtagtacgctctagaaagccttaggtgttgcgttgtagttcgggatgtgtctccctgtaccactgccaagnattagttctgtatattttgctataaggagtgcatcctttg

SEQ ID NO: 5540 - DNA, 346 bp, Zea mays
  unsure at all n locations
  Clone ID: LIB143-015-Q1-E1-F10-F4A
tgctcccgcaaggcggaggagaaaatgagngggccgantgggacaancatcctcctagatactgttttaggaagangggngcnctnnncggggcctcagttgaagagaggaaggaaacggccacncataccccagacnnnagaagnncagnggggcnganaggaagaaacccaaaaaaacccgccacagaaanggnccaagaggacccaggaacgaagangcgcanacacgacacncnccncaagaggaagcacaancaaagcaagaacgaatnagccacaacaggaaanangaggacagacgacanaaaagagacgcnccagcagcagaaaagcaccgaagacaa

SEQ ID NO: 5541 - DNA, 376 bp, Zea mays
  unsure at all n locations
  Clone ID: LIB143-015-Q1-E1-F10-F5A
agangaangaaaaggcgagncataccccagannntagaagcccagcgggctctgataggaagaaactnaaaattctgcaacagatatgtttcaagaggatctaggaacgaagatgtgcatacacgacactctcctcaagattattcacattctaagcaagaacgaagtagccacaacatgaattatgagtacagacgacataaaagagattcttcagcagcagataagcaccgaagacaagatgttggagatacaaatgacagacaattttcaacaatgggaaatgacagcaagtcccataggcataaccatgaagaacgggttagaagggaccatggtaatggagaaaaaggaagaggaccagcaaaactagggc

SEQ ID NO: 5542 - DNA, 654 bp, Zea mays
  unsure at all n locations
  Clone ID: LIB143-024-Q1-E1-F4-F2B
acatcacgtttgggaccaggccgacctccgacgacgtgccctgctcgaccaaaaccaaagccgagacgaagattangaatagaaaaacgtactcacgggcacggtgacagagccacttcactaaaaggcacgcttacgctgtggcccagcgacgccgccgtgtaggagctgtaggacggctgcttggcggcgacggcgacgccgccaccaaagtcgaagtccacagcggcgccgcagctggatccatcgttcggcacgacgctatcggcgtgcgggaacctggcgaagtcttgggcgaggaacgggtcgacgacgtcgtcagcgaacaggaggtccagcttactggcgtcgacgacgaccttggccgcgtcgtcgtcgccgccgtccttcccttccgcggcaaggccgaacagcagcgccgccttctccgcggcgggatcagcggcggcgccgatgggctgcacggggacgcgctcgtggcggcgcgccagcgggttggcgtcgtggatgtcggcgtcgcacgcggcgcaaagcgcggcggcgtcggcgcggcacgtcacggtggccggcgcgcactcgcacaccttgcagacccacacccgctcgtgccccgcccgcgcgtgccccgcgtngaaccccgcgcacaggtacgcg

SEQ ID NO: 5543 - DNA, 577 bp, Zea mays
  unsure at all n locations
  Clone ID: LIB143-024-Q1-E1-F4-R2B
tcggctaaatccctgccattagnagcatgcaagaaagcagtggnagnaggggccaggcacactgtttacacggctgccgggggggagcgaccgaggagatcgtcgtcacgctcgaggggccctggtggggaggtactggggtctggggggacggcggtgcggggcgtgcggcgggtcgccggcggcggcgcactgccggacgtgcccgggcggcgcgtacctgtgcgcggggtgcgacgcggggcacgcgcgggcggggcacgagcgggtgtgggtctgcgaggtgtgcgagtgcgcgccggccgccgtgacgtgccgcgccgacgccgccgcgctctgcgccgcgtgcgacgccgacatccacgacgccaacccgctggcgcgccgccacgagcgcgtccccgtgcagcccatcggcgccgccgctgatcccgccgcggagaaggcggcgctgctgttcggccttgccgcggaagggaaggacggcggcgacgacgacgcggccaaggtcgtcggcgacgccagtaagctggaccttctgttcgctgacgacgtcgtcgaccccgttcctcgccca

SEQ ID NO: 5544 - DNA, 388 bp, Zea mays
  unsure at all n locations
  Clone ID: LIB143-047-Q1-E1-A7-R3C
ccggcgagaactctnccatatttgaacggccccatagaaacggcccggtagctactgcaaggcgcgggccgcctggtcctcctttctgaactccacgtgcgcgccccccacatgccgccgcgaggtgcgagacgggaggctctcgaactcgccgaactaactcaactccacgaagatgtcctcgcagaagtcctcgaaggcctcctggatccgctccgggacgatggggttgccctgcgcgcgcacgcccggggtgagcatgtccggccgctggtacatgtcgcagagaaggaccgacggggagatggaaggcttgttgggcaagcgggaaccaaccggacgcaaaaggcgggaatgaggcggaacgacacagaaaacagggggaaaa

SEQ ID NO: 5545 - DNA, 287 bp, Zea mays
  Clone ID: LIB148-042-Q1-E1-H1-F2A
tagtttgacaaataaaaaagagacgcgccgacatccacagacactatcaagcgccagcgctacctgcgaaatacctaagaaatgctccgaagccgaggagctgcacgactgcacacaggaatgaggactatatacgcgcctggaactgaaaacggggtgcacacctcccgacaaggacgacccacacattaagctccacgagatggacaactgagcacactacctcgaacagctgccaaagtgcaagacaagaagcccccccaagccatcagcctgcaagcacgagc

SEQ ID NO: 5546 - DNA, 455 bp, Zea mays
  Clone ID: LIB148-042-Q1-E1-H1-R2A
gaggggcacaggaggagtagctaccgaaaaggttgatgcgtgagggaggaggcgccatggacgtcgacatgcaagcccgcggtggcggtggtagccatggcggcgaacttgacgacgacggcaaggagaagaggacagggacggtgtggacggcgtcggcgcacatcatcacggcggtgatcgggtccggcgtgctgtcgctggcgtgggcgatggcccagctgggctgggtggccgggcctgtgatcctgctgctcttcgcggccatcacctactacacctcctgcctcctcaccgactgctaccgcttcggcgaccctgccaccgggaagcgcaactacacctacactgaggccgtcgagtcctacctaggcggccggtatgtctggttctgcggcttctgccagtacgccaacatgttcggcaccggcatcggctacaccatcacggcttct

SEQ ID NO: 5547 - DNA, 410 bp, Zea mays
  Clone ID: LIB148-060-Q1-E1-H6-F2A
cggagcagccttctcccttccaagaacacacaacgcgggggtggccttgtgcccggacggagaaggtgggagtgaacggttctaggcggagggggcgcctggtcaccagagcggcgcgggaactgtggctgagaggacattgtggcgagaaaagacccatacggggacctcgactacaggggaatgctatttgtgtagcaagagactacattgaggatgcattgcttctaaaggacgattgaggtaagcttgtcatcactggataggccatcaccatctgccaggagcgagatcccgccgggatgaggagaggcgaagctggcgctacgtgcggtgtggcgaccagtggtgccctaacgaccacggagaacgccgggggacagtcgaagggaggggcaaagagggggaga

SEQ ID NO: 5548 - DNA, 213 bp, Zea mays
  Clone ID: LIB148-003-Q1-E1-B8
aacacctatagtgagtcgtattaaccgggaggccactggctaaggcaacacaaaccgcagatcaccgatatgcacgtacggcagccaccgaagcacacgggcggagaacgactcggatatcatcagcatccacatcggcaaggccggggtccaggccagcacatcctgcgtggaggtcgactgcctcgagcagggcatcgagcacgatgggtc

SEQ ID NO: 5549 - DNA, 213 bp, Zea mays
  Clone ID: LIB148-003-Q1-E1-G7
atgcaaacctctaatagtgagtcgtattaaatcctcaactctggcacgcgtgcaacgcttgcacagtcatggttaccactagtccagtctcgttcaaattcatcactgcttgccactactcatgcgcctatccgtaatgtccttgttaggcttgggcgacacttatagcattttcacaggccacacgcctaccgctcagtcgcagttggccca

SEQ ID NO: 5550 - DNA, 93 bp, Zea mays
  unsure at all n locations
  Clone ID: LIB148-004-Q1-E1-A4
aattccagggtcgacccacgcgtccgaaaaanaaaaanaaaaaaaaaaaaaaaaaaaaataaaaaggaagggcggtcgctctagaggatccat

SEQ ID NO: 5551 - DNA, 77 bp, Zea mays
  Clone ID: LIB148-004-Q1-E1-E5
ttctctagagtgagtcgtattattcgctctcgtgtggtatctgtagaccctgttgtcggtttttagtcttcgtcttg

SEQ ID NO: 5552 - DNA, 355 bp, Zea mays
  Clone ID: LIB148-005-Q1-E1-D7
gatcgattgaacagtttgacatcagcattttcagaggaacaaattaaatccacatgccatcagtcgaagtcacatccacagcagagtcggtcagttagaaaaggaaaccaatcgattaatcgagcagagcaggccggatcacgagagggacttggcgacgggggcagttgagaggaggccggagagcaagccgacgacgagcgcgctgttgtacgtggtcggctcgttctgctgcacgttctccctgtcgtcgacgaacgagtcgttcttgaacggcccgccgaccagcgcgcccgtggcgacattcgggttgggctcgggcgacttgagccactcctggccgtcgcagccggtg

SEQ ID NO: 5553 - DNA, 87 bp, Zea mays
  unsure at all n locations
  Clone ID: LIB148-005-Q1-E1-E9
gtgagtcgtattaancgtcntnttcttcgcttgttgtggcgctggtgcttgtcctgttgtcgatgctggtcgtcctgctatcggtgg

SEQ ID NO: 5554 - DNA, 68 bp, Zea mays
  Clone ID: LIB148-008-Q1-E1-F6
tctcgttgtctgttgcaattctctatagtgagtcgtattacttgtggtggttcctcctgtggctgtcc

SEQ ID NO: 5555 - DNA, 127 bp, Zea mays
  Clone ID: LIB148-009-Q1-E1-D3
gacgcacgcgtccgaactgaaataacgtcggcctcaaatcgagatggtcgaacaagaggatacaagcttacatgtgcattcatgctaaggcagtgctcttctatagtgtgtgtaacattcaattaat

SEQ ID NO: 5556 - DNA, 186 bp, Zea mays
  Clone ID: LIB148-010-Q1-E1-B3
aacactctatagtgagtcgtattatgtgaatccggtcatcgcatgatgcactccgacccaagtggcgtgcatgttctgcaacatgaccgtcgaaatgggatacggcatggccaattacggtgacagctactacaccgcatgcgctagatgctggctatgcaaatgcgacgacgcgtgctccgccta

SEQ ID NO: 5557 - DNA, 79 bp, Zea mays
  Clone ID: LIB148-010-Q1-E1-D3
tagtgagtcgtattagggccagccgagctcaactggtaagcggatttggccggacatatcgcttacgagcatagctgtc

SEQ ID NO: 5558 - DNA, 58 bp, Zea mays
  Clone ID: LIB148-010-Q1-E1-E5
atgcaaacctctagagtgagtcgtattagcttctccgacgtagacggcgactcttctt

SEQ ID NO: 5559 - DNA, 127 bp, Zea mays
  Clone ID: LIB148-010-Q1-E1-F8
caagcctctacagtgagtcgtattaatgtactgccatctgggcatcaaatgtcaatgtcaatgatctcaccatcatgatcatcatcggcacctcttcgatatcggtcgcattgaccctgctctgaac

SEQ ID NO: 5560 - DNA, 441 bp, Zea mays
  Clone ID: LIB148-010-Q1-E1-H11
gggccgacccaaacgtccacccacgcgtccgtctccgtcccccaagcaaagaaaagaagctagctagctaggcgtagaacgaatgacgacgcagggcggcaacaggtcgacgacgacgctggtcgccgccgtggccgtagttctggccgtggcggcggcgtcgtccctggccggcgtggcgtccgcggagaaggcgggcgggttcgtggtgacggggcgcgtgtactgcgacccctgccgcgccgggttcgagacgaacgtgtccaggagcgtggccggcgcgacggtggaggtggtgtgccggcacttcggcgcgtccaaggagacgctcaaggcggaggcgacgacggacgacagcgggtggtacaagctggagatcgaccaggaccaccaggaggagatctgcgaggtggtgctggcccggagccccgacccggggtg

SEQ ID NO: 5561 - DNA, 68 bp, Zea mays
  unsure at all n locations
  Clone ID: LIB148-011-Q1-E1-H12
attcncgggccgacccacgcgtccacccacgcgtccggttctagatcgcgagcggccgctctagagga

SEQ ID NO: 5562 - DNA, 306 bp, Zea mays
  Clone ID: LIB148-014-Q1-E1-G1
acgcgtccgaagccacctacgagcataccctcacatccgctctggtgaggacgagcggccgcatgaaggtgacgcccgggtccgcaccaccgcagatgcgcaggaaaccgtagtgctccgcgtggacaaagccgccgggttaccacggtcatggggcatcaacatcgagaaatcggacgtgtccgctatacacctgacgctcaggccgtcccacaaggcgatcatgttcgacacggccactactgggccgtcgctgacgccgctgcccaatgtgaactgtcgcctcgatctccgaaacaagcatgt

SEQ ID NO: 5563 - DNA, 299 bp, Zea mays
  Clone ID: LIB148-015-Q1-E1-A3
taccggtgaacaattcccgggtcaactacgcatcaaatgagggcaagattcggcgtccctagctcaatcttgaaccatagctagccagcatggcgcccatcagcagcatagcaatactgctgctcctcgtcatcgccgtcgtcctctcagacgtcacctcctcgggcgccctggcctcctcgtcgtcgtctctgctgcaccagtcgtctccgtctgagagtgagactgagaccgacagtagcagcggagaatcttcgtcgtcatcctcgtcgccagaggcactggtacatccagagcac

SEQ ID NO: 5564 - DNA, 54 bp, Zea mays
  Clone ID: LIB148-017-Q1-E1-D5
ccacgcgtccgcccacgcgtccggttctagatcgcgggcggccgctctagagga

SEQ ID NO: 5565 - DNA, 324 bp, Zea mays
  Clone ID: LIB148-018-Q1-E1-E3
gcgttggtagatgcaactctctaaagtgagtcgtattaaccaagacttaagcctccccgtagcgccacatctagtaggtgcagccatgggtgcctgtgcaacgaagcctaacactcttgaggggaaagccccagctgacgccaccatctccatacccagtgttgcaccccagaccgctaccatccacattgaggttgcggcaaacacatccagtaggtgtgaaggtcgcggagtgaccgctgacgatggactaacatgttgctgcgaagcactagcgagcagccacgattgagagtcagcacattgcgagtgaggtgaccactt

SEQ ID NO: 5566 - DNA, 361 bp, Zea mays
  Clone ID: LIB148-018-Q1-E1-F5
cgcgttgttcgatgcaacaccctagagtgagtcgtattaaggcaggtcgtcgatcgccttgggtggtgaataattgaagaagaagaagaggcggagacttgagcaggtgatgtcttcgctgccaggaggcttcctgtgcgtgcgcgtcctgcgcgggatcgacctcgtcagctgcgacgccaagggcagcgacccctacgtcgtgctcagcctggatggacagaaactgatgacgagcgtgatgaagaagacggtgaacccgttgtggaacgaggacctcaccttggccgtcatggacgcgtcggcgcccatcaagctagaggtcttcgataaggacacgttcagcaaggacgacatgatg

SEQ ID NO: 5567 - DNA, 358 bp, Zea mays
  Clone ID: LIB148-019-Q1-E1-A12
gagtcgtattagccgtcgcgatggcggccttctgccgccgccgccgtcacacgccaccgcagagctagctaccgacgaagacaaggcgggcaatggccaaggcgcccctgccgcttccgtcgctgctcgtcctcgccgccttcttcttccaccacccctgctgcacggcgcacggccgcgccgaaaacatctcggaggtctaggccgcggtccgcgcccgcgcgtccgagctgctccgccacgccaccagccagctcgtcgacctgcccctcccggccaacctctccggcgcgggcgtccgggcctcggccctcagcgtgcgcaacaacgcgctctgggccggcggcgtcaacaccaa

SEQ ID NO: 5568 - DNA, 51 bp, Zea mays
  Clone ID: LIB148-019-Q1-E1-C7
ttacaactccctatagtgagtcgtattaatctttctcgccttgtccgacca

SEQ ID NO: 5569 - DNA, 76 bp, Zea mays
  Clone ID: LIB148-019-Q1-E1-F12
ctaaaggatccaacctaacttacccttacaggcaacgtcaaaacccttcaaaagtggcaccaaaattcaattcaag

SEQ ID NO: 5570 - DNA, 123 bp, Zea mays
  Clone ID: LIB148-020-Q1-E1-B11
ctctggcgccatagtcggccactactgcaccatttgggcccaaaacagcatattcccagagttcaagccagacgagatgacccatatcgttaaagacatcgacgagcctgggtttctggccgc

SEQ ID NO: 5571 - DNA, 413 bp, Zea mays
  Clone ID: LIB148-020-Q1-E1-B9
gggtcgagcccgcgtccgacggtaaaagcacctgtgacaccggcggaagctagtggacaatctgggctgaaaacacatgtctgctagttcatcaagcctaagaccgagactaacgcacgctatggtctagaagaattctcaataacgctgctttcttgccgtgaatacgacactgcattggaacgacgctgatgatgagtccccgatagctagaccaggtccactgccacactgcatcaaaggatcttgctgcttctgtggccgaatcaacggacaagccctcgacattggaacccgagacgatggtatcaccactagatactccagcatagtagatggcaagctctgaggagaccacgacgcagccagctaatgccgtgaaatctgccaagtgtaagaccaacgatgaaagg

SEQ ID NO: 5572 - DNA, 448 bp, Zea mays
  Clone ID: LIB148-020-Q1-E1-C12
gcatgatccctaccgccatggccgcgggatacctgcccaggcggccgctcgaaccattttcttttttttttttttaaaagacagtgacgttggttttatggatcaaaaccagaattttcatgtttcacaattttggtgctagagatccccaaactgcctaactcactggggaaggtttctgaaggtgtgcattatagtaaacagcagcaaaatacccaacaacgttactgctaaaagcagctgctcctgcttgcgcctttagaatactagccgtaaaacagcaaaaacccgcacatctgtgtcagcagttgggatgtgagctactctaaacaacaaacaactgtgaacagtccaaggcaggacctctacaatcatactgggcaagcgctgagctgtggggagaaaatgtcagcacatgcccaagaggagacaatgcacacgtttagta

SEQ ID NO: 5573 - DNA, 104 bp, Zea mays
  Clone ID: LIB148-021-Q1-E1-A10
ttacaactctatatagtgagtcgtattaaagcgtcagcagcactgatgggtagatcattgagaagggagggcacaatatctcctttacatgcgccgatggtcca

SEQ ID NO: 5574 - DNA, 342 bp, Zea mays
  Clone ID: LIB148-021-Q1-E1-A8
tgcaattcactagagtgagtcgtattagacagagacttcctcgcctccatcgcatcccgccgccgccgtctctacggtcgctaataaaccgcggcatccagggatggagatgaccaagatcgcctgcgccgtcgtcgtcgccgcctcgggcaccgtggcgctggccgcggaggcgccggctccgtctcccaccagcggctcctccgcggtcgcagccgccatcgtcagggccgccgtggcctccttcttcgcgtactacattcactgatccgccggacgaggagccggagccggagggaacagaccatagtgtggggagagacttggctgcgctgcgctgct

SEQ ID NO: 5575 - DNA, 142 bp, Zea mays
  Clone ID: LIB148-021-Q1-E1-C7
actactcccaatagtgagtcgtattaaaagtcagcagacgccacgtagcagcagctagatagtgccactgggcgctcgtcgacgtgattcagcacgaacaacactcgcgagactcatcgtgagcgtcatccggcagcaagtg

SEQ ID NO: 5576 - DNA, 248 bp, Zea mays
  Clone ID: LIB148-022-Q1-E1-B10
caaaaggatcaaaacttaattccccttaaaggcaaagtcaaaccccttcaaaagggtcaccaaaattcaattcacgggcgttcttttaaaaacgtccgaactgaaaaaacccggggttaaccaaattaaacccccatcaaaaaaacccccttttctcaagctggcgtaaaacaaaaaaggcccgcaccaattacagttccaaaaatttgcccacccaaattgaaaaatgggcaccaccttatcagggc

SEQ ID NO: 5577 - DNA, 411 bp, Zea mays
  Clone ID: LIB148-022-Q1-E1-B8
tacaagactctacagtgagtcgtattatggccatggagggtcgtcgtcgtcgtcgtctcgttctgtggctcgtgatatccgcgcaaacaatgctagttgccgccgcggccggcgccaagcggcaggcgccggtgatgttcgtgttcggcgactcgacgctggacgtcgggaacaacaacttcctgtcgggggcggccgtccccagggccaacaagccccactacggcgtcgacttccccggcggccatcccaccggaaggttcagcaatggcgacaacacggctgacttcgtcgcgaagagcatggggttgaagagtaaccctccgccgtatctgtcgcttgcacccaacggctccagccctctgctcacgcagactgctctcaacactggtgtcagctacgcttccgcag

SEQ ID NO: 5578 - DNA, 396 bp, Zea mays
  Clone ID: LIB148-022-Q1-E1-C10
cctatagtgagtcgtattatctggacaacgggttcaagttcgacgccaccaccgcgcgggggcgtgacgtccacaggctccagggatgtctaggcgagccacgcagtcgcgacgggctccacgtgggcactgaactgcacaggtcacgtcggtatatcggtgctgctgcccgagaagccgccgcgaccgtctggagtgaaggccacgtggtgggcatggcccgtgggtgtccgcgccggtggggtgctgggaaccagcgccttgacgctctctgtaggcggcgcggtgagctggaccaggatacgggcaatggatgagatggatcagcgggccatgggcggggaggagccggggaggatgacggtgcgctggagcaggatgccatcggcgaccgtg

SEQ ID NO: 5579 - DNA, 364 bp, Zea mays
  Clone ID: LIB148-022-Q1-E1-G1
gccaacccgacgctaattaaatctgtccacaacaatgtgacctgggacgacattagatcgagcaacaaggtcaattgatctagtttcactcggacacgactaattcatcgccatcgcaaccacttgtacgggtattatgtatggaagaagagcgtgaataaaacactgacgaggatcagctcgagtgcttcactgaacaagccactacttgagcccagtgcctgagccttgtcttcacaagcagagggttatctcctgggttgcaaatcttccatgactccaaggcgttactagagtgcgcaccagggctacctgggctgggcgtgccgcagaggttgggcgacgacttggtggccgacagaga

SEQ ID NO: 5580 - DNA, 245 bp, Zea mays
  Clone ID: LIB148-023-Q1-E1-B6
cgtagtccgttacaactcctatagtgagtcgtattaagccctctgatcctcgtcttctttcacctctccaacatgaaggtcaacaccaagatcaagctggagccggtcatggcgccgtcgtcgtccgggccgcggagcgccagcgagctagcagagccgccgtcagcgtacagctccagcacggcgcaccaccccgtcgacgtgcggaccacacggaggttgtccgtagcgcgctcgtcgttcgg

SEQ ID NO: 5581 - DNA, 378 bp, Zea mays
  Clone ID: LIB148-023-Q1-E1-B7
tacaactccctatattgagtcgtattacttctccttctctcccggacctctatcgtgttcatcatcacgggctacataactctctccctcgcacccatggcgacgccggacaacacggggcaccggcatccgctgcacatatttggggagtggtacgtgtacaatccggccacgtccgagggcttcatcgtcatattcaacaacgccagctactacaagaagaccaccaccggccctgaggctgggaacgcgcgcacaggcattccgccggtcttcaggaacagcggccgcgacggcgggtacaggcccgacttcggcgacggcaaccagtacacgcagcccacactgaagaagttggccttctgtgggtgctgaatc

SEQ ID NO: 5582 - DNA, 99 bp, Zea mays
  Clone ID: LIB148-023-Q1-E1-B9
agtgagtcgtattaaagcgtccgagaaaccatccattttcttacggccggttattcgagcactactcacacctgatcattgtcaagtttttacttgctg

SEQ ID NO: 5583 - DNA, 264 bp, Zea mays
  Clone ID: LIB148-023-Q1-E1-C6
atgcaatcctctatagtgagtcgtattaaagctgacggctgtcagactcgagatgctggctcatctgcctcaggagctattattgtatgtgaccgtttgcgtgtcgcaaatgttgctgaggcaacagccgtgatttctattggaggacaagggattgcggtttcaacggattagaaagctgatcagacagattatacacagagatctgagcaggcatgagggccagctctgtggcctgcgatatggcgactgggtggtgttctt

SEQ ID NO: 5584 - DNA, 87 bp, Zea mays
  Clone ID: LIB148-023-Q1-E1-F10
tatagtgagtcgtattaggccccggttcgctgcgccggcgcctgcgcgtccgcgtccccggctcgcgaggcccccgcttctccgctc

SEQ ID NO: 5585 - DNA, 342 bp, Zea mays
  Clone ID: LIB148-023-Q1-E1-F6
ggtctcgtgggtcgatacaattctctagagtgagtcgtattagtaggtgcattgcttcggtggtccaccatggcgcaccgagcggtggccacgatgacgactaataagcccctcctcctcgtcgccctggcgtcggcgctccttggtgcggcgccggccgccgcgaactctcccggtggggcgttcatcacttgggtggcgatgattcagcagagctacgcgctgtccgcgcagaattccatcggggatgggggcactgagcccttggacgagaagctgtctgacgcggagaagaataaggtcacatacgtggtggacccgagaggtactggctactacacc

SEQ ID NO: 5586 - DNA, 57 bp, Zea mays
  Clone ID: LIB148-024-Q1-E1-A10
cccggttcgacccacgcgtccacagaatcaagaaacatcttggaatgtctgtataag

SEQ ID NO: 5587 - DNA, 366 bp, Zea mays
  Clone ID: LIB148-024-Q1-E1-A3
tgagtcgtattacctgaccactaccaccacccgggacgtcttccatggcctcctcatagaataagctctatctcaccgcaacaactcctcattacaatccttcaggagagcagcactacactacactacattagagagaggtcgagcgcccctcctccgatccgccggcccgccgagagctagctgctgatcggtcgaggagagtcatggcgacgtcgacgatgcgcgttgccgccggcgtgctgctggtcgtgtcggcgctggcgaccttggcccgggccgaggacccctacctgttcttcgagtggaaggtgacgtacgggagcaggtccctgctgggagtgccccagaaggtcatcctcatca

SEQ ID NO: 5588 - DNA, 315 bp, Zea mays
  Clone ID: LIB148-024-Q1-E1-A9
taaaccctagagtgagtcgtattacactggcgcaggcgtcgacgaagtcgccgtcgatgaagtcggtggagaagacctggagcttgtcgccgaggcccttggcgaagacctcggcggtgaacatccgcgcgtagccgtggatccgcctcgtcacgggccacacgcacaccaccgggttgtcgggcctgggcgtcaccgtgttctccacccggtacaagaagccgcggcccgccaccggcggctgctgccccaggaacttgaggttgcgctcgaacttggtctccggcaggtccgtgtcgactcagttgtcgatga

SEQ ID NO: 5589 - DNA, 391 bp, Zea mays
  Clone ID: LIB148-024-Q1-E1-B12
acaataccctatactgagtcgtcttagccgggtggatgttcatcatgaccaccttcatcgccctcttcctgccggagaccaagggggtgcccatcgaggagatgaacctcgtctggagccgccactggttctggggcaagtacgtcaacgtcgacacacaacacggcggcgccagcccgagatccaacggcgtctgatctgagcaagctgcagcaacacctcggcacctgacctggccatgcatgcacacgtatactataatctaacaacgtagctgacctgggcaaattgccagcctgacaggggccagggtgctcgaatgtctcactctcaccgccgactaactttccatcaaaattgattcttgttcatactccatagcatgcacaga

SEQ ID NO: 5590 - DNA, 422 bp, Zea mays
  Clone ID: LIB148-024-Q1-E1-C11
tacaacaccctagactgagtcgtattatggcgactagggttaggggcgaccggaggtcgccgcgcctgcccaaatccacccatcccttccgttcaagccgccggagctcccatgccgctggtgtcgaagccggcgtcccttccttacaggcccgcctcctctctgtccgttctgtcttggtcgacgaagctcaagaccacagtgtcaggaagctctccagatcttccagccaaacacaattcatcagtcagatacacttttaccaaggaatttttcagaatcactccacgagaggttcagctctcgaagctagagaaccagagctctaccaaacaggccaggacgtctctcaaatccccagttcagtaactggctaactgtaggagaatgagagagatggagaacggccgcgctaaacgcga

SEQ ID NO: 5591 - DNA, 387 bp, Zea mays
  Clone ID: LIB148-024-Q1-E1-C12
acaacaccctatagtgagtcgctattaagagagagtgcgggttgcgggcgccgtcttggttcgccgccgccgcatgtgcatctcggcgaatccgcctgcggagaccaagttagcgccagggacgtttgtgggggcaaccgtgcatccattccctaccggcgattgggcgtggaaggcggtgtggcgtgggcaattcttcgtcgaagatcgcgcttcgtcgtgaagccgctcacatccgcggtcggcgtccggtgctgcctaaattttggtcaagaacaggtaccacaggatgaggcgcatggaggatgctgcgatgtgttcgtgagagatctaggtcgtcgtctcccagtcaactgtgggttgctggaccgttgtctccttataatg

SEQ ID NO: 5592 - DNA, 434 bp, Zea mays
  Clone ID: LIB148-024-Q1-E1-C9
ttacaacaccctacagtgagtcgtattaggtggtcatgacaatctacaagccagcgcggcggggggcgccgtacaagaaccgcaccgtccagcgcgcgaacccgcacgacgagttccgcatgatggcctgcttccacagcacgcgaaacatccccaccatcatcaacctgatggagtcctcgcgcggcacgcggaagcgtggcatcaccgtctacgccatgcacctcgtggagctctccgagagatcgtccgccatctgcatggtccacaaagctcgtcgcaacggcatgccgttctggaacaggcggcgcaacggcgacggcggcggcgaccagctcgttgtcgccttcgagacgtaccagcagctgagccgcgtgtctatccgggccatgacggccatctccgacctggaaacgattcacgaggacgtcgtc

SEQ ID NO: 5593 - DNA, 430 bp, Zea mays
  Clone ID: LIB148-024-Q1-E1-E2
atagtgagtcgtattatgatccatcaacaatcgccgagagcgatcgagagataaataaagatgaagaaagtggcatcatcgtcagccgttctcttcgtgctagccctgacgctagtttgtgccccgctgatagcagaggcaaagaagaagagagtcgccgccgccgccgccgaggagaagaaggtgcaggacaacttctgctcgacgctgtgcgagggcaggaaggggatggacctggtggtgtgcaaggagtcctgcgacctctcacagcgctccaacctggtgctgtacggccggattcagtgcaagggcaagtgcaccgagcagaagggcatcaccgcgccgcagatgaaggtgtgccaagaggcgtgcgacaaggactacgtggtcaaggcggctgaggtcaccaaggcctgcaacacaacctgcg

SEQ ID NO: 5594 - DNA, 375 bp, Zea mays
  Clone ID: LIB148-024-Q1-E1-F12
tacaatactctagagtgagtcgtattaatctcctccatcaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaaatgcaccgagcagaagggcatcacggcg

SEQ ID NO: 5595 - DNA, 275 bp, Zea mays
  Clone ID: LIB148-024-Q1-E1-F8
gatacaacaccctatagtgagtcgtatcaccacacgcgcgagaggggggagaggaaacagcgagcacccaccgacgaacgaagagggtgcttcgcacgtgcatgtgacatccggcgatgccgatcgtccgccggcgcgacttgaactaacgacgacgtacgtgcgaccgggccgggcgttggattagtccggcctgagcaatgggcaagatcgagtactgcgtggtagcgcacggagcagtggtgctggcggagcactacggcgcagcagatgca

SEQ ID NO: 5596 - DNA, 56 bp, Zea mays
  unsure at all n locations
  Clone ID: LIB148-024-Q1-E1-G1
atagtgagtcgtattagaangtncggancacaattcgaccgtccagtgactactcg

SEQ ID NO: 5597 - DNA, 365 bp, Zea mays
  Clone ID: LIB148-024-Q1-E1-G10
acaacactctatagtgagtcgtattaccaaaaaaaaaaaaacaaaaaaaaaagaaaaaataaaaaaattcaaaagaaaaaaatgacactcaaggagcaagcaaaagaaactcgaccagggcatcctgattataatgtttgagatgccttttaacatttggtgtggtggatgcaattccatgatagcgaagggagtaagatttaatgctgagaagaaacacgttgggaattattactctaccaagatatggagcttcatcatgaaatcgccctgttgcaagcatgggattgtcatacagacagacccaacagatactgaatatgtcataatcagtggggcccacaagaagacagaagattttgatg

SEQ ID NO: 5598 - DNA, 391 bp, Zea mays
  Clone ID: LIB148-024-Q1-E1-H12
tgagtcgtattaacccaccacctcccccaattgcctcttctcttctcccagcagcagccgcgacgcagttcgagttcgaggaagtcatgtcagcgatggacagagccgacggcgagtttctcgaggacctcgacatctatgtctcaagcttcttagcgtgatctgctggatgtaatgtaaccgatgaacgctagggaatgggaatctgaggcagctgttactgttaccatgagttgctctctgccgtttgtccaggggcagagcagggaagaacacatgttcttcctcggcccgtcccgttgtaaaccttaggatgtgagaatattgaatgtcccatctctctctctctttttcttcggtcgagggtttgcaaggaaaacaatttcataat

SEQ ID NO: 5599 - DNA, 449 bp, Zea mays
  Clone ID: LIB148-024-Q1-E1-H7
acaacaccctatagtgagtcgtatctagcgatagtgtcaaagctggagcagatcgctgagacagagcgcttcatggtgaagaaacaggacgggctggtgaagctgcaggggtccaagcaagggaggaaggggcagctcgcgatcgacgccgagatcttcgaggtgacaccggcctttcacgtcgtcgaggtgaagaagtcggcaggcgacacgctggagtatgagatgttctgcagcaagggcctaagaccttcactcagcgacatctgctggagcagccgatctgaggagaacatggctccttcagtggttcagccatcacaattggagccatcctcttagaccgtctccgacagtttactcacccctcttagtcaattgttatttaagtgcagtctcttcggagatgcaattacagtccatcctctctttcttttccctttctcaaa

SEQ ID NO: 5600 - DNA, 381 bp, Zea mays
  Clone ID: LIB148-025-Q1-E1-A11
tacaacaccctatactgagtcgtattacgttccggtcactggccggggagggctcagaaacctttcacccaatacatacatctatctgagccctttcccgcggtgaggcccgaccggagtccacacacacacggtgtcgatggcggccgtaataaggagccgccgccgcgtgtccgttttcttctacgtcgtcctcgccgcagctgcagctgcagccgcggcgcaagcatccaataacgtcacctccgacgaggagtactgggcggagcgcgccgaggtggctcggtcgcgcaacctcgccgcctacgtcagcgaccccgtggccgccacgaaccgcttcaacgcggacgtgctgagggccacgacgcggcgggcgctggc

SEQ ID NO: 5601 - DNA, 408 bp, Zea mays
  unsure at all n locations
  Clone ID: LIB148-025-Q1-E1-B12
ttacaacactctagagtgagtcgtatgtagtcccctccttctcgcccggcaccgtcgagctcggctgtggaaacagaacaaacccatcaaccatggcgaactcggcgtcggggatggccgtgagcgacgagtgcaagctcaagttccaggagctcaagtcgaagcgaagcttccggttcatcacgttcaagatcaacgagcagacgcagcaggtggtggtggacaggctggggcagccgggcgacacctacgacgacttcaccggctccatgcccgagagcgagtgccgctacgccgtcttcgacttcgacttcaccaccgacgagaactgccagaagagcaagatcttgttcatctcctggtcnccggacacctcgagggtcaggagcaagatgctgtacgcgagct

SEQ ID NO: 5602 - DNA, 178 bp, Zea mays
  Clone ID: LIB148-025-Q1-E1-C7
ttactacacactatagtgagtcgtattaaatatgccatgactggacagcttagcacgaagagtgatgtctacagctttggcgttgtgctgctggacccttttggtggtcgcaaatcacttgaccatagattgctccatagacaacagagctcgtgtgacatgggctacaccgaggctt

SEQ ID NO: 5603 - DNA, 432 bp, Zea mays
  Clone ID: LIB148-025-Q1-E1-C9
acaacaccctagagtgagtcgtattagggatccctcgctaataacatcatggtcgtgggtgtcgtccttgcagcgctcgtcgccggcgggtcatgcgggcccccgaaagtgccgcccggtcccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggaccgcaagggctgcggctcatgctaccaagttagatgcaaggaaaaagcttgatgctcgggcaatccagtcacggtgtacatcactgacatgaactacgaagcttatcgcgccctaccaattcgactttagcggcaaggc

SEQ ID NO: 5604 - DNA, 265 bp, Zea mays
  unsure at all n locations
  Clone ID: LIB148-025-Q1-E1-D6
atagtgagtcgtattagaacggcgancatacggctgggggacgttgaggggcgcttcacagatcgtctcggcgatggtgcgatcgtcggcgcgtgcttgtggggaggtcgtgcggcaggatcggcagagggcacttcggcgaggcggcctcgcatcgagagttgtcacggagtgcgacgatgaggatgaggagacggatagggggagtcacgctcgtaggatgtcaggcggcggtggcgccgaggaggagagctacgggccgccg

SEQ ID NO: 5605 - DNA, 106 bp, Zea mays
  unsure at all n locations
  Clone ID: LIB148-026-Q1-E1-A2
atagtgagtcgtattaaagggggngcgtcggctagcgcgggttgggtgccggttgcgtttcgctgcgcggtggcgattctactcgtagccagggatcgggatccac

SEQ ID NO: 5606 - DNA, 375 bp, Zea mays
  Clone ID: LIB148-026-Q1-E1-B11
tacaaaactctatagtgagtcgtattaccttgcagtcatcccatcagtcacggcaacacatccggccatgtcaaggaaaatgtctcgcgccatagttgaggtcctcttcgacatcgtcgtcatcgctgccctcagagcggcagaggcaccggcagaatgaacgcatgcaagcagtcctgccaaggcaccggacgaatgaactcatgcaggtagtgctgcagctcctgccactgcagccaagtctgctgccacgagaactgcacctgctaaggcatctaaagccgccgttaccgccgccgtagccgctgcgtcatcgacgtcgtcgtctacgaagtctggtccaactgccgcgccgaccacagcctcctctacaac

SEQ ID NO: 5607 - DNA, 388 bp, Zea mays
  Clone ID: LIB148-026-Q1-E1-D8
atacaacactctagagtgagtcgtattaatcatccacaactgctcaaagactatatcaatggcacggagaggacaacctttctgtacccaagtgctgtcgaccaatttaggaaccaatttgctcatcttgaagaaaatagtggcaacggacctgtgattccaatggaaagaaagcatacttctcatcctaggtctactattgttcactcatcaccaattcctgtcaaggaacaaccccgtatcggaccatgtatggaaatgccttcatctgatgagtcctacaggaatcctcgggagacagaacaatattcctggaatctccgccagaacgtcacaggctccagaaagagtgccaacagtcagaccagtaaagggtttttggccaata

SEQ ID NO: 5608 - DNA, 238 bp, Zea mays
  Clone ID: LIB148-026-Q1-E1-E8
agtgagtcgtattaaaaccgcctagtcacgcgagtgatcggcgattgaggtatggaacgatcatcatcgacgcgggcaactagactgacggagcggactgctgccgggcgggtctgaacgtcctccatcagcgtttctcagcaccgcagtctgctcggtagcaggcacggcaatgcgtatgaatgggaaccggctaggaatccagaacgtgcatacgctgaccatcagaggcgacggc

SEQ ID NO: 5609 - DNA, 339 bp, Zea mays
  Clone ID: LIB148-026-Q1-E1-F10
tctatagtgactcgtattactggttactccgcgcgccttctcgttctctctcggacgtccatcgtgttcttcagcaccggctagctaattccctccctcccagccatgatgacgccggacatcacggggcacgggtatccgctgcccaagtttggggagtgggacgtgaagaatccggtcacctccgacggcttcaccgtcatattccagaaggcccgcgactacaagaagaccaccaccggccctggggctgggaacgcgcgcgcaagcattccgcaggccttcacgaacggtggctgcgacggcggctacatgcccgacttcggcgacggcaaccag

SEQ ID NO: 5610 - DNA, 338 bp, Zea mays
  Clone ID: LIB148-026-Q1-E1-F12
acaacaccctagagtgagtcgtaatataaacagatcgatcgattacagcaatggcggccaaggtgttcctcctcctccgactcagcatggtcgccgtcgtcctggctgccatcgccacagtagtgctcgcggaggaagccgatccgcgggcactgccggcacagtggaccaccgcgaagaagtacaaggccacgatggacgccaagacgcggcaggctttcgacggcgtggtggccgccgctacggcagagaagcggtcccaggcggtggaggccgtgctgcagcagcagctgaacatggacgtgtccctgtccaaggcgacgtcttccggggacgag

SEQ ID NO: 5611 - DNA, 359 bp, Zea mays
  Clone ID: LIB148-026-Q1-E1-H10
caacactctatagtgactcgtattatcctccattgaccaacaattaagcctccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagagga

SEQ ID NO: 5612 - DNA, 388 bp, Zea mays
  unsure at all n locations
  Clone ID: LIB148-027-Q1-E1-B1
gcgcggtccgatacaacaccctagagtgagtcgtgttacatgcagatctttgtgaaaacccttactggcaagaccatcactcttgaggtggagtcttcagataccattgacaatgtcaaggccaagatccaggacaaggagggcatcccgccggaccagcagcgtcttatctttgccggcaagcagctggaggatggacgcacccttgcggattacaacattcagaaggagagcaccctccacctggtgctgcgcctcaggggaggaatgcagatcttcgtgaagacattgacaggcaagaccatcaccttggaggttgagagctccgacaccattgataatgtgaaggccaaaatccaggacaagganggtatccccccggaccagc

SEQ ID NO: 5613 - DNA, 381 bp, Zea mays
  Clone ID: LIB148-027-Q1-E1-B10
tacaacaccctatagtgacgtcgtattagctatctccatcatcggtggacctctcgccgcggtggtctcgaccccattccgcttggttaccacgaacatctatgggatggcggtgatggccgtcggggtgtactgcgcgagcaggtatgcagctgatattggcaaccgccgtgatgtggtgaaaatggaagtcgaggacctgacggccggactggccagcggcaggatatgtgctgtggagaacatcgcccagctggtggctccggaggcagaaggcccggccgatgccacggccacggccacgctggctgcttaacgggccattgtgccattattgctgcgacagagatgtgcgtcagccaacatgtgtgctgttgtttt

SEQ ID NO: 5614 - DNA, 323 bp, Zea mays
  Clone ID: LIB148-027-Q1-E1-B11
aacaccctaaagtgagtcgtattacacgcctcacacacgctctcgcgctcaccggcgcctcgcacctctcccacgctggccgcacccgcaatggggtgcgccgcgtttgccgccaacggggccggggcccgggcggcgggggtggcccggccccggtgcgcggtaaaccaagggttcactcggtctgccgcgcgccgccgccgccgcagggagcggcggagtcgtcgtcccggggcaagaggcgaaggcgcaaggtggcgccggaacccaaggagccggcggaggaagggaccgccgcgctgccgccgatgcccggctcgccc

SEQ ID NO: 5615 - DNA, 332 bp, Zea mays
  Clone ID: LIB148-027-Q1-E1-B6
atagtgagtcgtattaaaagatgctattgactacgtcgagtggcactacagggagcccagcgatgacaagttccggcatcgcaagtcgtggctcacctccagtcgcggcggcagctccagctgcgacgacggctgcatcgacctgcccatcaacggcgacaacgacgacgtcatcaacttcatcctcgacttcgacaaactgcaccgcgtcaggctggaccgcatcacccacgcatgcggctgcatgtgcgcaagcatcgtcatgcgacactccatcggcggaacgctctcctacagcgcagtcgggttctgcggaggtttcgcagacgcat

SEQ ID NO: 5616 - DNA, 296 bp, Zea mays
  Clone ID: LIB148-027-Q1-E1-C2
tacaacacccaatagtgagtcgtattattccggccccggcgacaattagcgccgccgtagtcctaagcggatgcatcgtccacacgagagccgcaggtgatgaccacagttgcgacgagtagttgatcaatagcctcatgtagggctagacctgacttgacgggttcgtgaccaacgtcaccgaggtagatccccgacacgaatgtgacgcaggtgtgcatgcacgtcagctcaggcaacctcgagcgcgtcatctacggtgtcatcgatgccagtggtatctacacgatgtaact

SEQ ID NO: 5617 - DNA, 126 bp, Zea mays
  unsure at all n locations
  Clone ID: LIB148-027-Q1-E1-F1
ttctattactacaccgtatagtgagtcgtattaaaangtacgacacactagagggtctcgcactattccgggatacgcaggggggagaggaagtcaccgtgcacggcgtcgattccggcgaggagc

SEQ ID NO: 5618 - DNA, 167 bp, Zea mays
  Clone ID: LIB148-027-Q1-E1-G3
atagtgagtcgtattaaaaaccaagcctcagctgttgtcgctgccatcagccgtgtcatcagtggcagccgctagagcaactgccggtcattcgactccactgccgacatgcaggcgagtggtatactacaagcagtcgaatatctacaggttgaacttgcaagtgc

SEQ ID NO: 5619 - DNA, 381 bp, Zea mays
  Clone ID: LIB148-027-Q1-E1-H9
gggtcgagacacgcgtctacccacacgtccgacacctagcgaggcagcgccatccacgcctgccgctgaggagacgacgacgactccttcgtcaggcggcgggggttacggcggtgcaaccggcaaggcttcctcaggcggcggcgggctggaccccgacggcgacccagaggttgggctgaacgggaaggcgatcgaggagatcgtgaacgagcacaacgtgttccgcgccaaggagcacgtgcctccgctggtgtggaacgcgacgctggccaggttctcgcagcagtacgcggagacgctcaagggcaactgccagcagatccactcgtcgtcgccgtacggggagaacctgatggagggcaccccgggggctgacct

SEQ ID NO: 5620 - DNA, 359 bp, Zea mays
  Clone ID: LIB148-028-Q1-E1-C1
gcaacactctatagtgagtcgtattaatgcctgggccagcctgcatcttctacggccggaacatcggtctacacggacaagctgacggagatcggcgtcgtcgtggacgcgatgtggaagctgctcgacgcctggcctaacgagctgcccgcggtcgcttaagtcatccgagtttgtttttttgcaggattcttaaaagttggaccgtcctgctagtactccatgtgtcgtgttttcacattggaggacgtctgtatatgtaagaaaatcctctggcgcttgtgctcagcttgatgaaatatccttgtacggttggtacctggacccgctagagctggctggttcgtcaaattgtgttc

SEQ ID NO: 5621 - DNA, 321 bp, Zea mays
  Clone ID: LIB148-028-Q1-E1-D5
tctagagtgagtcgtattactgtgatcgtaacggagcacgcccatgtggtcccggcagctcccggccgtcctccaaagtcacaagatcctcaccgtgatgcacatctacatggtagatcgccacgggttcagttcatggcatcaacaggcgctaaatgaaagcgacagggtcatcgagatcccgtacgacctattcctctccgtctacgttgcgctacagctcgacttcatcaatcacagccataatactgtcatcctagaatggtacctcgtcatcttacgtcattcgcataagcattcacccaacataatgttcgaaga

SEQ ID NO: 5622 - DNA, 323 bp, Zea mays
  Clone ID: LIB148-028-Q1-E1-E12
atagtgagtcgtattaacacgtaggccgagcttcagctgcatgcagtactgccacaaccagttgtgtactgccaacagcgcctccaacgtcaccgtcaagggtgtcagcatcacgaccatcaccggcacctccgcgacaccggaggcccttagcctgctcagcactgccaaggtcccatgcaccggcatcacgatggctgacgtcaacgtcgagtagagcgggaccaacaacatgaccaaggatatatgcacgaacgccaacggcagcaccaagggttgcctcaaggagcttgcatgcgtctagaccctccatcgactgaacc

SEQ ID NO: 5623 - DNA, 201 bp, Zea mays
  unsure at all n locations
  Clone ID: LIB148-028-Q1-E1-G6
atagtgagtcgtattaaaanagtgtcactcttctcccggactctcatctacacggtggcgtcgatctcgggattcatcatccgcatcatctactgctgcacaggaggaggatagactgcccggtgctaatccagctgtcgagcagtggtacacttcaccatccaggcgcccgctcacactcgcagactcgcatcctacgtg

SEQ ID NO: 5624 - DNA, 57 bp, Zea mays
  Clone ID: LIB148-029-Q1-E1-A6
ccgggtcgacccacgcgtccaaaaaaaatcatattatgaagcaaaaaaagaaacaat

SEQ ID NO: 5625 - DNA, 411 bp, Zea mays
  unsure at all n locations
  Clone ID: LIB148-029-Q1-E1-B12
cgttgcaacactctatagtgagtcgtactaangccgacgggcccgggcagtacaacttcaacgggtacatggagctcatggagatggccaggaagaccgggctcaaggtccaggccgtcatgtccttccaccagtgcggcggcaacgtcggcgattcagtcaccataccacttccgggatgggtcttggaggagatggacaaggaccaggacctggcctacaccgaccggagtggccgccggaactacgagtacgtctccctgggctgcgacgcgatgcccgtgctcaagggccgcacccccatccagtgctacgccgacttcatgcgcgccttccgcgaccacttcgccaccttcatgggcaacaccatcgtggagatccaggtcggcatgggccctgccggcgagctgc

SEQ ID NO: 5626 - DNA, 278 bp, Zea mays
  Clone ID: LIB148-029-Q1-E1-E7
aactctctatactgagtcgtattagagccccggccccggcggcttgggcgcgcggcgccccggctggggtgcgggctgcacaggtgagcggcctccagcccctcggcggctcggcacagaccggcagcccgtcgcacgagggcgggcgtaggccctcggcacgagcgcggctgcacgagcatggccggcgcgggggcacggccggcgcggctccccggcgtccaagcggccctgcggcggtgcgggcagcaccggcgtgcggccctcggaccctttgg

SEQ ID NO: 5627 - DNA, 354 bp, Zea mays
  Clone ID: LIB148-029-Q1-E1-G11
acaagtctctacagtgagtcgtattagtgtctgctgttcggggacatcgacgtaacgtctaatgacagggacatgcatgtcagtctcgcattcagcgactttgagacggtgctggtgcagcgggcgctgcgcagccgtgagcgcttcatcgacgtggtgaacagcgactacacgcactggctcaggtacgcaataggaggtaaacggcatcctaccatcatcagcgacggcaaccgcgtccgcgtcgtcatcgacaatacgtgtaatgacgtgaggaagctggagtacacgcagtatagcgagtatccgagctgggtgtggaagtctcaggacgacctgttcctcaacggcgcc

SEQ ID NO: 5628 - DNA, 271 bp, Zea mays
  Clone ID: LIB148-029-Q1-E1-G5
atagtgagtcgtataaggcgtcatgacgttcatggacacctgcgtcgacggcttcgtcgacgagaagctcaaggccgacatgcactccgtgctgcgcaacgccaccgggctcagcagcaacgcgctgggcatcagcaacagcctcggcgggatcctgaagaagatggacctcggcatgttcagcaaggactcgcgccgccgactgctgtcgtcggagcaggatgagaatggctggcccgtgtggattcagtcgccggagatgaagctgctg

SEQ ID NO: 5629 - DNA, 365 bp, Zea mays
  Clone ID: LIB148-029-Q1-E1-H10
gtattactggcgagccaaggaccagatcggcagcttcgtctactaccccagcaccggcatgcagcgggcggcgggcgcctacgggctgatcagcgtcgacaggggtgacctgatcccggtgcccttcgacacgccggtcgacgacttcccggtgctcatcggcgactggtacaccaaggaccacgccgtgctggccaagaacctggacgccggcaaggggatcgggcggccggcggggctggtgatcaacggcaagaacgagaaggactcgtcgaacccgcccatgtacaacgtgaaggccggcaagacgtaccggttccgcgtgtgcaacgtgcgcatcaaagcgtccttcaacgtccgcatcc

SEQ ID NO: 5630 - DNA, 227 bp, Zea mays
  Clone ID: LIB148-030-Q1-E1-E8
gttacaacaccctagagtgagtcgtattaaccgagccagtcgattgttcacgatcgatagcagcttaccaacaccaacagcaccaggcccacgcgttcgacaacatggcccgcctcggcgccggcgccatgttggcactccgagtggcggtcgcggtggtggccgcgttcatcccggtgacggtctcggcgaagtcctccgacctgaggccgatggggttgctggcg

SEQ ID NO: 5631 - DNA, 345 bp, Zea mays
  Clone ID: LIB148-030-Q1-E1-G4
tatagtgaatcgtattatgagatccatgtccgataagtcgacggaggctggtgtggcagtactggctccatgtgagacctccgcacgccgccgctgaggcatcggcagcatgcacggagttggtgcagacttctggcgtaactgcttctggacatgaacggcatcctggttcgaagcaacaacattctttgtgcctgcaaggtcttgaacttggtgagaaccactgtgagtcaaattggttagacaggtggatggctgtacgtccatgggagaacaggttacttgactgtaatgccaaagagagtctgccaacgcatgaagataaggatgacgaagcaaattccc

SEQ ID NO: 5632 - DNA, 418 bp, Zea mays
  Clone ID: LIB148-032-Q1-E1-A12
tcgcgggtcgatgcaagcctctagagtgagtcgtatcactcgatcgaccgcctccgtgtccgtgccctacagctggtcatgagcgcccgcccaaccatggcggcggcggcgcccgtgcgcgcctgggtggtggcgctggcgctggtgctggcgtgcgcgctgctccagccgcggccgtccgacgccgcggcgcagcccgccccgcagtcgccggcgacggcggtgtcgtcgggcgccgccaagcccaagtgcgtggccggcgccaggaacgaccacgcgtgccgcgtcggcgccgtgcacgacccgggcagccaggaggatgagggctccagcgtcaccatcgacgcgcacgccggccgcgcccgacgacgtcggccacgacgaccggagcgactacaacgaccccgacgtgcccaac

SEQ ID NO: 5633 - DNA, 68 bp, Zea mays
  Clone ID: LIB148-032-Q1-E1-F7
gtattatgttacaactccctatagtgagtcgtattagtctactcggtagtctggtcgctgatcagcgc

SEQ ID NO: 5634 - DNA, 244 bp, Zea mays
  Clone ID: LIB148-032-Q1-E1-G11
cctatagtgagtcgtattaacacgcgtgcgcacacctcgcgacagccaccaggagtacaccgtttcacgcgacagccgtcacgcgtcacgtatccaggctgaccgtaggagagacactcatcttcaggacggagggagacgactacacaggatgcacgggttcaggcagctgcagcgatcgccagctcaagagcaacatcaggcgccgtcggatcagctgtacgcctggggtgtcggaagtcgt

SEQ ID NO: 5635 - DNA, 83 bp, Zea mays
  Clone ID: LIB148-033-Q1-E1-B11
taggcgtccagaattctagggccgaccgacgcgtccactcacgcatccggcatgaatgtaagtgtggcaaggtcgtcatcgtc

SEQ ID NO: 5636 - DNA, 351 bp, Zea mays
  unsure at all n locations
  Clone ID: LIB148-033-Q1-E1-H9
tccctaatagtgagtcgtattacttgntgaccatgtttccgtgaaagtgcgtagtacatgtcaccacaggttttccattaacctctctgtctgcctcctgaagttactcaaccgggtgttcggtgttgccaagattaccttgttcattctctacacatgttgtcaactagggtcacacggaaagtttatatattatcataccattagagttatagaattggttcccaaacctggagtagtatgtcattctaattcattcgttcctgcagctttgactttcgggaccgcacctcgtcaaagttcatctgttatcaagttcaaataataggagtttccttacgttaacacatt

SEQ ID NO: 5637 - DNA, 61 bp, Zea mays
  Clone ID: LIB148-034-Q1-E1-E12
cccgggccgacccacacgtccggctagagctagctcctcaacgacgacgcagtagtacata

SEQ ID NO: 5638 - DNA, 364 bp, Zea mays
  Clone ID: LIB148-035-Q1-E1-A1
cgttacaacaccctatactgagtcgtattacgggggtagggccgggtgagcacgagcgctgcccgctcgctgaaccatggcgggctccgcggtggccgtcgtcctcctgtcggccgtcgcgctgctctgcctgtaccacctccttttcctctccctgtccgtcccggacccggcagcagcagcagcagccgtcccccgccgcgccggtggccaccgtggcagcaacgttccgtccgggtcaggaaccgccaacgtcgtcctccgcttcggcctgtccgggcagccgctccgcctccacgaccccgccgccgccgccgggctcccggacatcgacaccttccgcggcaagctcgagcgggtgctt

SEQ ID NO: 5639 - DNA, 152 bp, Zea mays
  Clone ID: LIB148-035-Q1-E1-A4
tacgttgcaacacctatagtgagtcgtattaagagcgagcctcttcagctccggtatccccctcatcgcggacgcgccgccgaggcgcacggtgagaaacttcgcgcggtgcgacgtgactgtggcggcaggcgtttgcacaggcgatgcag

SEQ ID NO: 5640 - DNA, 408 bp, Zea mays
  Clone ID: LIB148-035-Q1-E1-A8
ctcgcgggtcgatacaaccctctagagtgagtcgtattaccatccaggtggatggcaatctgctggcgaccacggacctaagccagtacaaggaccatggtaattggatcgagattctacgtgtggataacctgttcagcaccggcaagggaaaccttgacgggcagggcccagccgtgtggagcaagaactcctgcaccaataagtacgactgcaagatccttcccaactcgctggtgatggacttcgtgaacaacggggatgtgtccggggtcacgctgctcaactccaagttcttccacatgaacatgtaccggtgcaaggacatgctgatcaaggacgtgaccgtgacggcgcccggggacagccccaacacggatggcatccacatgggcgactcatccggga

SEQ ID NO: 5641 - DNA, 421 bp, Zea mays
  Clone ID: LIB148-035-Q1-E1-B12
attacattacaacatcctatagtgagtcgtataaacatcacatggacgtccagtaccacacgacccatgggttcgccatggttgagaccacgcagggtgcgctggaggctgaaatgaatgagatctttgtcccctacagaggattcttcaaccggaatggggtggaagtatccgaggtagtattggaagaggcagacgtgtccaaagccattctaggttacatcactgcaaacaagatccagagcattgcgctcggcggagccagcagaaatgcgttcaccaagaaattcaagaacgcggacgtgccgtcgaccctgatgaagtgcgctccagactactgcaacatctacgtcgtggccaagggcaagtccgtcaatgtcaggctcgccaagtgcggcgtcccgccgatgcacactggcgc

SEQ ID NO: 5642 - DNA, 405 bp, Zea mays
  Clone ID: LIB148-035-Q1-E1-B4
tcgtgggtcgatacaacaccctacagtgagtcgtattatttagcgtgtagttctcggagagcattggcattttgcacctgaaactaagtcaattgacccgccctgatacatttgcttgccaaaatgtggcgacctatacacaaaacactgaaaactgggtacagttctcgcattctctgttttagttgagtttgcaggtagtagagacgacatgactcagtcaaccgcttgttctttgacaacgacggctgctgcagcaagtgggccattgttagcgtcaagcttcagggagacatccttgaacatcttgcggctgagggtgttgtaaaccgctctcgagtactgccgcgacgtgttcctccagtccattccagctttcatcatcagctcgaactcctcgtagct

SEQ ID NO: 5643 - DNA, 452 bp, Zea mays
  Clone ID: LIB148-035-Q1-E1-B5
atagtgagtcgtattagacggggcgaggcagtgggggggggggggtgtgggttgaggagggggtgggggggggggggggggggggggggggggggggagggggcgggggggggggggggggtgcgcggcggggtggggggggggggggggggggcgctgggggggggggggggggggtggggggtggggggggggtgggggggatgggggggggccgggggggggggggggggggggcggggtgggggggcgggggggggggtggggggggctggggcggggggggggcgggggggggggggggggggggggggggggggggggggctgggggtggggggggggggggggggggggggggggtggagggggggggggggggggggggggcggtgggcggtgggtgggcggcggggggggggggggcgggggggggggtgggggggggggggg

SEQ ID NO: 5644 - DNA, 419 bp, Zea mays
  Clone ID: LIB148-035-Q1-E1-B7
tcactactaggactcgtatgccactgctaatccctatactgagtcgtcatgtacacgcgtccgcagcgggccatcagctggtgacgcgccggcgtatggcgccagcgccagcggcccgactgctgatgctccggcgacggcggcggcggcggcgtcgtccgggccctctagcgcacccgcgccatcgtcgtctgagtcctccggcgcaccagggccgtcgtcgtctgatgggtcctccggcgccccggcgccatcgtcgtctgatgggtcctccagcgccccggcgccatcgtccggcgacgacggatcagcttgagcgtgagcgatgacgcggagtttgggtcatttcgtgcctactcagagacgacgatctcttcttccaattacaaattggccgtccgtttactcctcacaatgtg

SEQ ID NO: 5645 - DNA, 307 bp, Zea mays
  Clone ID: LIB148-035-Q1-E1-B8
tctctactaggtctcgtgggtcgttgcaaccctctatagtgagtcgtattaaaaaaaaaaaaacaataaaaaaaaaaaaaaaaaaaaaagaaaaaaacaaaaaaaaaaaaaaaaaaacagcaaaaaaagcaaagaaattcatggggggagacagagtgagatgggtgctcagctggccaggctcgcagcagccgcctgcgtcggacgggccgcgttgttcgccttcggcgcctcgctctgccggcgcgcgggccggagcgaccccggggggcaccgatggtcccgcgggtcctgccgcccgttccgt

SEQ ID NO: 5646 - DNA, 262 bp, Zea mays
  Clone ID: LIB148-035-Q1-E1-C12
atagtgagtcgtattaaaatgttcctcgcgccctcctcacgggcggtctccgtctgttctgtccaggcagcgcctcggtcgtctcccggccagatgcgtctcctgcagggttggggtgcgagtggcggcgcaggatgatgggtgggttcctctccacggtcggcctgctggccttgtggcgatgcctatcgtgcctatgcatgctacgggaccgttgaacgcgaggagcgcgcagagtgagcagctcagattgtggggtcag

SEQ ID NO: 5647 - DNA, 52 bp, Zea mays
  Clone ID: LIB148-035-Q1-E1-D1
tttacattactacaccatatagtgagtcgtattaaactatatgagtgactgt

SEQ ID NO: 5648 - DNA, 247 bp, Zea mays
  Clone ID: LIB148-035-Q1-E1-D2
tattacattacaacagcatatagtgagtcgtattaaaacagcagactcactagaaagccagcacatccaaataaaagcgacagacctcagccctcaggcaagccgaccgccgacgtaccaccgcgccaagccgagagaaagatggagatgatcaagaggatcgctcatcgccgcgctcctcgtagtcgccgtcgcggccaccggagtgctggcctcgcacgaggccgcggccgccggcgccgcagcc

SEQ ID NO: 5649 - DNA, 401 bp, Zea mays
  Clone ID: LIB148-035-Q1-E1-D5
ctaggactcgtgggtcgatacaaccccctacagtgagtcgtactaatcgcttgagttagtttgcagccaagatgaacgacgccgacgtcgggaagcaggtgcagcagatggtccggttcatcctgcaggaggccgacgagaaagccagcgagatcagtgttgccgccgaggaggagttcagcatcgagaagctgcagctggtggagtcggaaaaacggagggtgcggcaggagtacgagcgcaaggagaagcaggtggacgtccgcaggaagatcgagtactcgacggagctgaacgcggcgcgcatcaagctgctgcgggcgcaggacgacgtggtgaccgggatgaaggagagcgccggcgacgcgctgctccgcgtcaccaaggacgccaacgcctac

SEQ ID NO: 5650 - DNA, 387 bp, Zea mays
  Clone ID: LIB148-035-Q1-E1-E1
tgcaacaccctatagtgagtcgtagtacaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctcagttccg

SEQ ID NO: 5651 - DNA, 396 bp, Zea mays
  Clone ID: LIB148-035-Q1-E1-E10
ctcacgggtcgatgcacgcctctagagtgagtcgtatgaggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatttcaagcccggggctc

SEQ ID NO: 5652 - DNA, 368 bp, Zea mays
  Clone ID: LIB148-035-Q1-E1-E7
atagtgagtcgtattacaatctcccaattccacccaataactaataacatctcctcgaacgccaggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggccggtggtgcggctggccctagcgcaagcggcgccgccgccgccgccgtgcccgccgccggggcgctcgtcgcctccttcctcgccgacgagctccactgagcgacgacgctcggggcggcaacgttgggatcatcgtgtttg

SEQ ID NO: 5653 - DNA, 446 bp, Zea mays
  Clone ID: LIB148-035-Q1-E1-F1
tcatgggtcgttgcaaccctctatagtgagtcgtattagtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggaacaccaacaagaaggacttctgcaaggtggtcttggtg

SEQ ID NO: 5654 - DNA, 394 bp, Zea mays
  Clone ID: LIB148-035-Q1-E1-G10
atgcaacaccctagagtgagtcgtactatcttgggcgggcgccgcgcgtcgagggccagccaaagcttgccatggcggccgtccggtccgacagggtccaccaccaccaccgccgctccgaggcgtcgtgtccggcaacctccgcggccgtggcggcggcgagggccgatgacgccctgcgccagcgcccgcgggggctcgtgcaggtccgggagcgggaccagggcccgctgtcgacggggcaccagcacctgcaccaccatcaccaccagctgcggcggtcggcggcgttcccaccccgccgcccggggccggggcgccgccctcctcagcgctgcgaaagcgacctcaacatcagggagcaccgctcctgcagcgaggtggccggcggcac

SEQ ID NO: 5655 - DNA, 394 bp, Zea mays
  Clone ID: LIB148-035-Q1-E1-G2
tcgttgcaacaccctatactgagtcgtattactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagcc

SEQ ID NO: 5656 - DNA, 377 bp, Zea mays
  Clone ID: LIB148-035-Q1-E1-G3
aacaccctagagtgagtcgtattaaaccgtccaaggccgccccgcccgcgcaccaagtttcctcgtggtccgagcgcgttctcaaacggaaaacccgcactcccgtgtctcgtcgtcccgtgcgtgccgctgacttctcggcttggccgggcgggacacgcccacggcatcgcgatggctgcgcgcggccactgcacgcgcacacggcggcgtcccgcccggcggtttccccaggcccagggcatccacgaggagaggacaagcgcgcggcgcggtcgagctgttgaaacgccggccgaggttgattttctcgtgcgatggacacgacacggtgttgacgacgacacggtgttgacgtggccggcgccgttgacgcg

SEQ ID NO: 5657 - DNA, 421 bp, Zea mays
  Clone ID: LIB148-035-Q1-E1-H12
tcattggacgaccctatagtgaatcgtatgactccgcgtcgtgtcccttctcttcctcctcctcctcctcctctctccaacaccccatccatcagcgctgccctccgcattgctcttgatcccatccagtacatcgattctccccccaagatcaaaggccggaggaggaagaaaggttagggagtcggccatgggatgcttttcatgctgctgtgtggcagatgacgacaacgttggcaggaggaagaagcatgacgatccctatgttcctatccctgctcatgtttataattttggacctagccggttcccagccccaacccctgtcatctccactggcagagctcagccaattgcagtaccggccattcatctggaagagctgaaggaaattacaaaaaacttcagcagtgatgccctc

SEQ ID NO: 5658 - DNA, 303 bp, Zea mays
  Clone ID: LIB148-035-Q1-E1-H3
atagtgagtcgtattaaatcttgcgactcacttgtgggatccagagaaaattctacgactcaacattgcaacgggtgaagtgctcaaggaacatgcaatgcgtcgacgtgcaggacaacgatctcagtcgtgctgcgagtgcacctggacatgctggcaatgtgtgcagcgttatgacgtacgacgagctattgatctgacatcgacagcatgtcggcaagtcaagtgcagaacaccccaggatcagtcgtggatggatcggggaccgcaccctgtccagcatacgacatgacgaccgcggtc

SEQ ID NO: 5659 - DNA, 81 bp, Zea mays
  Clone ID: LIB148-035-Q1-E1-H5
atagtgagtcgtattaaaaagtacgactcactatagggagtcgtattaagttgtacgactcaatagtgggactcgtaagag

SEQ ID NO: 5660 - DNA, 71 bp, Zea mays
  Clone ID: LIB148-035-Q1-E1-H7
acaacaccctaaagtgagtcgtattaaaaaaaaaaaaaaaaaaaaaaaaaggaaaaaaaacaaaaagataa

SEQ ID NO: 5661 - DNA, 426 bp, Zea mays
  Clone ID: LIB148-036-Q1-E1-A10
aggacgttgcaccactctagagtgagtcgtattaccaagacacatcctgcgatcctcgaagcctccgccgagcatcgatcatgtcggcctactgcggcaagtacgcggatgagctcatcaagaatgctgcctacatcggcacccctggcaagggtatccttgctgctgatgagtcaactggcaccattggcaagcgcctttccagcatcaatgtcgagaacgtggaggagaaccggcgggctctccgtgagctcctgttctgctgccctggtgccctccagtacatcagcggtgtgatcctcttcgaggagaccctctaccagaagaccaaggatggcaagccttttgtcgatgtcctcaaggagggaagcgtcctccctggcatcaaggtcgacaagggcaccattgaggtttttggcaccgaca

SEQ ID NO: 5662 - DNA, 407 bp, Zea mays
  unsure at all n locations
  Clone ID: LIB148-036-Q1-E1-A11
ccctatcgtgagtcgtattatccatagcatcaatcagttctggtctttcgtggacaataatggcgcctctcctaccttcgatgctgctcgtcgggctcgccgcgggctccgaggaggaggaggacggcngcggcaaaaagaagccccacgtcaaccacggcaagtttaaggcggagccgtggacggacgggcacgcgacgtactacggcgggcgcgacgggttaactgacaccacggacagcggcgcgtgcggctacaagggcgagctggggaaagactacggcaccctgacggcggccgtgggcccgtcgctgtacaccaacggcaccgggtgccgcgcgtgctacgagctcaagggccccaagggcaccgtggtggtgacggccaccaacgaagccccgccgccg

SEQ ID NO: 5663 - DNA, 222 bp, Zea mays
  Clone ID: LIB148-036-Q1-E1-A12
ctctatactgagtcgtattacaatcattcaggtccaatactacatcatagtacctacacgctgccgtttcccctttggcatcagatattgccatgaggtatacccttactcagcggcacatgttacttcgtcgctataccggtctcagcagctgctaatataactgtcatgctggctaggaacctgtggcttcgatctcataatttttctgtcatctatgag

SEQ ID NO: 5664 - DNA, 206 bp, Zea mays
  Clone ID: LIB148-036-Q1-E1-C3
tacaccaccctaaagtgagtcgtattaactgcgccgtcctcgccgccgccgcctccgccaccgtggtcttcgccgccgaggccccggcgcccgcccccagcagcacctcctcggccgcgttcccgggggtcagcgccttgctgggcgcctcggtgctctccttcatcgccgagtaggtgcagtagaattaaaggaggatcggaagg

SEQ ID NO: 5665 - DNA, 378 bp, Zea mays
  Clone ID: LIB148-036-Q1-E1-D10
gtcgatgcacgcctctaaagtgagtcgtattataagaaaacaaagcaaaaaaaaaaaataaaaaataaaaaaaatcaaaaaaaaacagagacaaacaaaaacagtttaacgcataacaaacacataaaacggggcaaggaaaaccacaaacattgtaaaccaaatctacatcaaaaaagggggggccctcccaaaggttatcgcgctagatccccctgcttcacaacttaagccctcttccaaggtccccccaatttacatttccgggggctttttttaaacaccttgcccgggaaaaccccgggcttttccaaaattaatgcctttaaaaaaaacccccctttctccacggggtattttacgaaaaggggccccctc

SEQ ID NO: 5666 - DNA, 337 bp, Zea mays
  Clone ID: LIB148-036-Q1-E1-E10
ccacaccctagagtgagtcgtattagaaggaacagccggcaataagagccagccagagaaactaataaaactcgcagcgccgccatccgagagaacaagccaaccgaccccgtccccaaggcaatccgtcgccgacgtaccaccgccaccgcaggagcgagatggagatgaagaggatcctcttcgccgtcctcgtcgtcatcgccgcctcagacaccgcagtgctggcctccaccgaggccgccgccgccggcgccccaactgcctccgagtcgtccgccaaggctcccgctggcacgggtcccggcgccgccgctggcgccgccaccgcagggcc

SEQ ID NO: 5667 - DNA, 379 bp, Zea mays
  Clone ID: LIB148-036-Q1-E1-E12
tatactgagtcgtattagaccaacagttaagcctccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatccaaaaggag

SEQ ID NO: 5668 - DNA, 411 bp, Zea mays
  unsure at all n locations
  Clone ID: LIB148-036-Q1-E1-G1
gtcgatacaacaccctacagtgagtcgtgttaaggagacggagcaagaaccacctccggctccggcgccaccgccaccgccacagcagcggcggcaccatacgaggcggagaagcaggaggtgatcaagcagtgggcacaggtcgctgacgccttcagcgcctctgaagcttacaacagcaggttgaggcagacgcttgacgccaagcagctcaagactggaatgatgcacaaggggaaggtgaacagggtggacttctcagggccgctgctgtcgcagccccggcgcatcgacgagctcctgcacatccacgagcagcagatccggcaagctggtcgccggccatggttcatgaaaggcaccgaggangaggagcactgatggcagagacacggcatggacacaactaaa

SEQ ID NO: 5669 - DNA, 391 bp, Zea mays
  Clone ID: LIB148-036-Q1-E1-H10
ctatagtgaatcgtattatgcgtccgcccacgcgtccggagggagccaaggaaagctctcttctttcttcctcctcctcgtcctctcgaattccgtctcttgtctctgtcggcctcgctcggcttccccggttcttgagaggggaaataggaggcggagccgaggagagggatggggagggacgagaggttcccagtgtgggaggccgcgctcggcgctggggtcgccgccgccttcgccgctgggctcgtcggcgtgtacctttccatgccggactccgactacagcttcctcaagctgccacgtaatctccaggaactccaaatcctcactggccatcgtgagaactatactagcgactacaccctacaggtgtttgtatgctactgcg

SEQ ID NO: 5670 - DNA, 237 bp, Zea mays
  Clone ID: LIB148-037-Q1-E1-G2
atagtgagtcgtattaaagcacgccctcgcgctcaccggcgccccgcccctcccccacgctggccgcacccgcaatggggtgcgcggcgtcggccgccaacggggccgggccccggcggcgggggtgggcgcgggcgcggatacgggggtacagcgaggagtcgacctcgggtctgcagccgccgtcgccgccgccgcaagaggccagcgagtcgtcggacgggggcaagaggcgag

SEQ ID NO: 5671 - DNA, 153 bp, Zea mays
  Clone ID: LIB148-038-Q1-E1-A9
atagtgagtcgtattaaaacgtgtgacatagggcgatcccgatcgtcggccggcacgtcttgcgctagcgaccagttacgtgcaacctcgccgggcgttgcgtcactcgggtctgattaatgcgcatggtccattacggggtgtcggcacgcg

SEQ ID NO: 5672 - DNA, 80 bp, Zea mays
  Clone ID: LIB148-038-Q1-E1-C3
attcacgggtcgacccacgcgtccgaaaaaaaaaagataacaaggaaaaaaatgacagggctgacgctctagaggatcaa

SEQ ID NO: 5673 - DNA, 309 bp, Zea mays
  Clone ID: LIB148-039-Q1-E1-A1
gtgtgacgttgcaatactctaaagtgagtcgtattagagaaacgcgagcaaccagcgatcgccccatggccgccatggctcgttccgtctccctcgtcgtggcgccccttctcctcctctccctcctcgtctccgccgcggccagtgcgcggaccgtgggcgacaccgtgcaggacgcgtgcagcaagacccagttccccaagatctgcgtggacagcctcgccgccaagccggagagccagaaggcgacgccgcgcaagctggcggagctgttcgtgaacatcgcggccgagaagggatccgggatgg

SEQ ID NO: 5674 - DNA, 393 bp, Zea mays
  Clone ID: LIB148-039-Q1-E1-A11
gccggtcgatacaacaccctagattgagtcgtattaggagcatagggaggagggcaacgagggcgacgggttctacggcggcataaggaagctccgcggcaaggatgacatctccaagtggaggcagctgtggccaacagacgtcctggagtaagcaggagccgcatcccttctcacaccgagattgatccatcgctcaaatgacacgcctttctttcatcatattgaccaaattcgtcgtctctgtcgcgctgttgtaaacgggttagcagaagaacacacagggtgacaacaaatccttgttcggttatttctaatacatatggattggatgagattggaaaaaattaagaagaagtttaacttgtttgcgattcaaacacatccaatctc

SEQ ID NO: 5675 - DNA, 361 bp, Zea mays
  Clone ID: LIB148-039-Q1-E1-A5
gagtcgtagtagaacgcgacgctggccaggttctcgcagcagtacgcggagacgctcaagggcaactgccagcagatccactcgtcgtcgccgtaccgggagaacctgatggagggcaccccggggctgacctggaagatcaccgtggacggctggagcgatgagaagaagaactaccactagaactcatacacctgcgaccccggcaagatgtgcggccactagaaagccgtcgtctggaagaccaccaccagcgtcagctgcggacgcatcaagtgcaacagcggcgacaccatcatcatgtgcagctactggtcgtcggggaactacgacggcgttaagccatactagaatatatatc

SEQ ID NO: 5676 - DNA, 373 bp, Zea mays
  Clone ID: LIB148-039-Q1-E1-B4
aagactctagagtgagtcgtattagtgatattacctgtgatgatcggttgagttatgtcgccaataatcttgcgtgtcattcgtacatcctggtggcgatcgcgtccacgctccgtacggtgctcgcacaccacattaagtctctatggcgatgcagatggtcgcctgcgccgtactcaccgttggcgccactgccaccgctggtcgtcgcgaactatgccacggcgcccgaatcaagcagcttctctgcaggcgattacccggacttacgcaccttacttagctcctcattgcgcaccatcggcgcatattagtcgtgatatttctccaggacgctctgagggagatgctgcaggctgcaactggatgtatg

SEQ ID NO: 5677 - DNA, 377 bp, Zea mays
  Clone ID: LIB148-039-Q1-E1-B7
ctcgtcggacgatacaacactctagagtgagtcgtattagactacctgcttgaacagggcatgtaactactacgtaccagctggaatgcatgtcgacgacgatggtttcgagtttcgacttccaataatagtaacaacaaagcaaaggccttcctcccggcgtatttgctttggctcttctcctccacgccataagatatctagcaattggtgactcgccttaattagttcgctttgcttttgaggttgactcgaccattttgctgtagcgtgaattgcatggacatgcaacgctccaatggcctttggaatgtggaaattttttttcccgtttctgtatttttcctataaaatgaagtaatgaactggttcttata

SEQ ID NO: 5678 - DNA, 271 bp, Zea mays
  Clone ID: LIB148-039-Q1-E1-C10
atagtgagtcgtattagaaggcagtcgcggggatggcgccgctggacgcgctcagatgtctccgtgggagccttcggctctctttcccacagtgcatatgagccgtgggggcagcgcggctggcgggcagagttctcagggtcacctcgttggggtcagtaagccttcccacgtaagcagtgtgactggctctaagtggtcgagctgtagccgcaggtgatccaccagatgagggggagagtgtgacggcccctgacggcaccagtcacat

SEQ ID NO: 5679 - DNA, 374 bp, Zea mays
  Clone ID: LIB148-039-Q1-E1-D7
acaaccctctagagtgagtcgtatgtaactacgcgcggcacgagatggacgtggtgaaggaccacgacatgtggcagtgcccgagcgagtgcgccggggagatcaaagaggcgctcgaccacctgaacgacaccgagggcggcctcgacgacagcaagctccacgacgtgaacctgtgcctggacacggcggaggaggacacgtggtcctgcgacgtctgctgcaagcacgccccatccaggcccgtcaaaaccacgctgctcgccaggatcaaggacttcgacgcgctcatgcgcgtcacccacgcgctcatcaagcaggccactggtggcgccggtgacgcgccggcgccggcgcacgccgtccgcgccaag

SEQ ID NO: 5680 - DNA, 394 bp, Zea mays
  Clone ID: LIB148-039-Q1-E1-D8
gcgtgggacgatgcaagcgtctaaagtgagtcgtattatcaccgtcctcctcgcggacgagcacgtccgcggcctgcaggtccgccgcgccgccgccgacgactgggtcaacgtgcaggccgtccgcgacgccggcatcgtcaacgtcggcgaccaagtcgagagactgagcaacgccgtgtacaagagcatggagcaccgggtggtcgtgaacgccgacgaggagcgcagttccctcgcgcacttctacaagcccatgggcgacgtccccatcgcccccgcgccggagctggtggcggctgtgagcctgccggcgctctacctgatgaggatcgtcgacgagtacaggctctacgtcgagaagaatggcgccagcggcaacgaggacatcgag

SEQ ID NO: 5681 - DNA, 315 bp, Zea mays
  Clone ID: LIB148-039-Q1-E1-D9
acaatactctaaagtgagtcgtattaagaggagccattatctccagcctcgcgcccagtctctttctcgttatggtgccgtttcttcattaccatggacaaagttttctgtcggtctgtcggcagccgctttctcggactcaacaagactgtaatgtctactgttgctatgtaatgcttctcaattgtcattttggacacatgtgcgacgtatacagttttaatgagatgtctgatgaggctacttgcaacactacatgtggtgttctcaatgaataatatcaattgttgagctctcattaaagaaaaactgctc

SEQ ID NO: 5682 - DNA, 367 bp, Zea mays
  Clone ID: LIB148-039-Q1-E1-F12
tacaacaccctaaactgagtcgtattatcctcgaccacctcaacgagcttctgctccgacgacgacgacgtgccgccacatccacatggcggacgacgccgtcgccggcggagcggccgttcgctgcgcagggccggcgccggcctcgctgtcttctagcaggaagcagcagcagcagcccgacgacgccggctgcggcagcagcgacgaccactaccagcacgacgtgatcatgctgaggcggacgaggagcgggcgggcgttcccgccgccgatctccgtgatcggcaagggcgggcggccgtggctctgcctgcgggcgcaccgcgagggtggacgcctcgtgctgcggcagatgcgcctgccg

SEQ ID NO: 5683 - DNA, 374 bp, Zea mays
  Clone ID: LIB148-039-Q1-E1-G11
gttgcaactccctagagtgagtcgtctgagacgcggtcgcggtccctggcgcacagggcgcggggcccctgcacggcgaccaaccccatcgaccagtgctggcggtgccgccgcgactgggcccgcgaccgcaagcgcctggccaggtgcgccatgggcttcggccacaggaccaccggcgggctggccggcaagttctacgtggtgattgaccccagcgacgacgccgccgacctcgtcacccccaggaagggcacgctccggcacgccgtgacccgggcccgggcgctgtggatcaccttcgcgcgcgacatggtgatcgagctctgccaggagctcatcgtgagcagcgacaagaccatcgacgggcgccg

SEQ ID NO: 5684 - DNA, 360 bp, Zea mays
  Clone ID: LIB148-039-Q1-E1-G9
ttacaacaccctagagtgagtcgtattagaccactcaacttcacaggcccatgcaagggcgacgtgaccatccaggtgaatggcaatctgctggcgaccacggacctaagccagtacaaggatcatggtaattggatcgagattctacgcgtggacaaccttgtcatcaccggcaagggaaagctcgacgggcaggggccagccgtgtggagcaagaactcctgcgtcaagaagtacgactgcaagatccttcccaactcgctggtgatggacttcgtgaacaacggggaggtgtccgggatcacgctgctcaactccaagttcttccacatgaacatgtacaagtgcaaggacatgctg

SEQ ID NO: 5685 - DNA, 296 bp, Zea mays
  Clone ID: LIB148-039-Q1-E1-H11
gtgagtcgtattagaacgaccaacgccatcagcggccgccgccacgacggacgagtcgcgtgcggcaggatgcactgatcgtcgtggcgacggtcacctgcgccgtccgcggcgttgcgtccgtcaccgtcgggcgggtcgacgacgaccctcggtcgatctgggttcaatagccccttgtcagtcacaatcgtaagcgccacggtcgcagtggagtcgctcctcgtatattctattcagatgcccgccagagcaggagcatcaacgggccggagcagatgaaggtggacggagat

SEQ ID NO: 5686 - DNA, 209 bp, Zea mays
  Clone ID: LIB148-040-Q1-E1-A11
acaccctagagtgagtcgtattaacgacctctcctgctgtcgctgctggtcgccatgctagcggtggccgccgatgtcgccaacgccggccacgccaagcccctgacgcctggcgggcgcgtggtacacgacaaccacggcaagttcacggccgggccgtggaaaccagcccacgcgaccttctacggcgggcgggacgggtccggcac

SEQ ID NO: 5687 - DNA, 61 bp, Zea mays
  Clone ID: LIB148-040-Q1-E1-A9
aatagcgactcactagtgtatctgcgtattgtcttacaacaccctataagtgagtcgtatt

SEQ ID NO: 5688 - DNA, 209 bp, Zea mays
  Clone ID: LIB148-040-Q1-E1-B10
acaacactctaaagtgagtcgtattaaacatagcagcagcactcacaatagcaaaaaccaccatccgtcgtcgccaaccgtagcaaggagccaaggacatcaccaccgcccagcaataatggcgcagagcatgaggattgtggcgctggccttggtggccctgctggtggtggcggcggcggcgcccgtggccaccgcgtacggctgct

SEQ ID NO: 5689 - DNA, 235 bp, Zea mays
  Clone ID: LIB148-040-Q1-E1-B5
tgcaacactctatagtgagtcgtattaacgcgtgggcggtcgaagcccccgctggcgccgccggcgccggcgccggcaccgggagcgccgctgggccctccgccagcggcgccgcgcccgcgctcaccggcgcgccgggcgcgttcctggtcccgctacgcggcgactacctgcactaagcagatggacggatggacgctcgcatggcattggcatgcctggagtgttgaacatc

SEQ ID NO: 5690 - DNA, 202 bp, Zea mays
  Clone ID: LIB148-040-Q1-E1-C10
tacaacactctaaagtgagtcgtattaatccgccgccgccgccgctcgtctccctgagaggtgccgggaccgaggaactggccgagtactaggtagagaatcggtttttcttgtctcagcccggggtctgctgcgtctggtggtggtgaaggggagaaattcgtgagatctgttccggatcaggcgtgcgagctcgggaatc

SEQ ID NO: 5691 - DNA, 199 bp, Zea mays
  Clone ID: LIB148-040-Q1-E1-F11
acaacactctatagtgagtcgtattagccaccctttttttttttttttttttttttttttaggcccaattagaaaaggtggtttccatcaaagaacccggtggagggaaaataatgggagacatcgaaagttaatttgttacatggtgtggccggtcaagagtgtctctcccgacctattgcaaaacggtaaagaattc

SEQ ID NO: 5692 - DNA, 212 bp, Zea mays
  Clone ID: LIB148-040-Q1-E1-F12
ccttccaactccctaatgtgagtcgtattaacggcggaaagggagctcaaggcggcggaggaaggcgttcgccacagtcgctgatttccctggggaagagatgggtctctcctttgggaagctgttcagccgcctcttcgccaagaaggagatgaggattctcatggtcgggctcgatgccgccggtaagaccaccatcctctacaagctca

SEQ ID NO: 5693 - DNA, 179 bp, Zea mays
  Clone ID: LIB148-040-Q1-E1-F6
tagtgagtcgtattaaacggcgttgcgggcgaggcaccagggttggggccgggagcatgttcacgcgtgcctgttcgcgctaaggcgagtagacggatggcagtgtcgcagggagctgtcgtagtcgtgtttctcggcgtcgcagcggggtgggaacgatcgatgccagagtggggagt

SEQ ID NO: 5694 - DNA, 209 bp, Zea mays
  Clone ID: LIB148-040-Q1-E1-G11
tacaacactctatagtgagtcgtagtaagtcttctcacgtgtgaaaacattgcaaatgaagaaactaatcactgaaagtactgtctatgatgctcgtaccaggctgccatccattatgcccaatcttgaaactcttgtcataaactcatttgattgggttgttgatgcaccaatgctgcctaccaaattcctctgtcttaagcacctga

SEQ ID NO: 5695 - DNA, 366 bp, Zea mays
  Clone ID: LIB148-040-Q1-E1-G8
tacaacaccctatagtgacgtcgtattaaacctcctcgcctcctccattgaccaacaattaagcctccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaac

SEQ ID NO: 5696 - DNA, 75 bp, Zea mays
  Clone ID: LIB148-040-Q1-E1-G9
ctatactgagtcgtaataaatcgccgagagcgatcgagagataaataaagataaagaaagtggcatcatcgtcag

SEQ ID NO: 5697 - DNA, 399 bp, Zea mays
  Clone ID: LIB148-040-Q1-E1-H6
accctatagtgacgtcgtattaagcgtccgcgcgcgccttctctttctctcccggacgtcgatcgtgttcttcagcacgggctagctagctccctccctcccagccatggcgacgccggacaacaaggggcacgggcatccgctgcccaagtttggggagtgggacgtgaagaatccggccacgtccgagggcttcaccgtcatattccagaaggcccgcgacgacaagaagaccaccaccggccctggggctgggaacgcgcgcgcaggcattccgccggccttcaggaacggcggcggcgacggcgggtacaggcccgacttcggcgacggcaaccagtacacgccgcccaaacggaagaagtgggccttctgtggctgctgaatcgaagctcgctg

SEQ ID NO: 5698 - DNA, 401 bp, Zea mays
  Clone ID: LIB148-041-Q1-E1-B2
gtgtgtcgatccaagactctatagtgagtcgtattaccctcgccaagccacaggctccccgtgagctccgcgacgcgggcgcctcgcctccctcgtcctactccttcctcaccgcagtccgcaagagcaatggcgatggcatccatagcctcaccgtcgtcgaggaccctgatccctccgcgacaccacggcgccgcgccctccccgtccacctccggcgactcctcgctccgcctcctccgcgcacacccgcgccacggacggcgcggccgggcggtgtccgtctcgacgcccgcggcgcggagccggccgttcgtcttctccccgcgcgcggtgtccgactctaagagctcccagacctgcctcgaccacgatgccagcacgagtgttcttggaatcat

SEQ ID NO: 5699 - DNA, 395 bp, Zea mays
  Clone ID: LIB148-041-Q1-E1-E2
ccacgcgtccgaagcaagccatcgaaggctggagcctgggcactgctcatcgtcctcgcggctgccgtcgcggtcctggccgcgcggccggcgtctgcaggcgggggagccgcggcggtggcggagatctgcatgaagactccgtcccccgacctgtgcaccaggacggcggggaagcacgccaacaagtacaaggtggtggacgcggtgacggtgctagagatgcaggtggacgcgttcaagaagcgcgtgaaggcggcgcggaggctcgccaaggaggaggtcaagacggccgcgacgcccgaggcgcggagggcgctgaacctctgcaagacctactacctggacgccgccgacaacctcggcgcctgcaagcgcgccatcggcttccgcga

SEQ ID NO: 5700 - DNA, 421 bp, Zea mays
  Clone ID: LIB148-042-Q1-E1-A5
tctatactaggacgcgcgggtcgatacaactccctagagtgagtcgtattagctcgcggaccgcgcgcagcccgtggcggtgcgggaggtgatgcgcgcctccttcgaggcgttcctgatggtgctcctggcgggcggcaacgagcggagcttcgtgcgcgccgaccacgccacggtggaggaggacttccggagcctgaggcgcgccttctccacgtgcggggaagggctggtccccgaggacgtggtggcgcgggaggcagagacggccgaggccgtcgtggagctcatggcacgctccacggactacctcatcgacgcgttcagcgtcgccacgtgcgactccatcagcgaggacggccgcgccggcgcagggcggtgcacgccgctgccgcccaagacgcggacgtgggaccccgcc

SEQ ID NO: 5701 - DNA, 411 bp, Zea mays
  Clone ID: LIB148-042-Q1-E1-A7
atagtgagtcgtattacacggcgtcggcggggagcagcgcccggggcctggccaagccggagaacccgttcaacaagcggcggcgggtgctgcgctactgcgccacccgctggaggcccgcgcgtccgcctcgctcgccgccgccgccgccgccgacgtaggcagcggctgtggctagcactgaagaagacatgtacgcgcacgcagcgatgaagcaggcggacggacgaattgaaatgaaaacacaccagctagcaagcatgaagatggatcctctcctgttttgggaccccttctctcgtcttcatcagcatccgacggcgtcatgcatgcatggatatatacaccgtacctagtggtaaactgatatataggttatttcgttttttcttttttttgttgtgtgtggtt

SEQ ID NO: 5702 - DNA, 56 bp, Zea mays
  Clone ID: LIB148-042-Q1-E1-B1
tactctacactaaatcgtgttatggaaaaaagagaaaaaaaaaaaaaaaaagaaaa

SEQ ID NO: 5703 - DNA, 370 bp, Zea mays
  Clone ID: LIB148-042-Q1-E1-B5
cgcgcgggtcgttgctgcacgctatagtgagtcgctatctagcgccgacgagatgccgtggggcgcgtcgttgccgtaccaggtcggcccgccggccacgcccagcagcaccagttcggcgccctgccccgcttgcgcggctggcgcggccagcatcgccgccacgcccagcgccgcggcggcgcgacccagccagcggcgcaggccgccgactgccgaacggcgcgccggcaagcctgcatgcgccacgttcacgaagcgcttgccggcctcagacatggttcgtctgcggcagcacggtcaaggccaccagggccagcacgcgggcgcccatcaggatacagcgccggcgcgaaggccacgccggtgg

SEQ ID NO: 5704 - DNA, 414 bp, Zea mays
  Clone ID: LIB148-042-Q1-E1-D7
cgcgttggtcgttacaaccccctatagtgacgtcgtattaaaggacgtgaccgtgacggcgcccggggacagccccaacacggatggcatccacatgggcgactcatccgggatcacgatcaccaacaccgtcattggcgtcggtgacgactgcatctccatcggccccgggacctccaaggtgaacatcaccggcgtgacctgcggccctggccacggcatcagcatcggcagcctagggcggtacaaggacgagaaggacgtcacggacatcaacgtcaaggattgcactcttaagaagacgatgttcggcgtccgcatcaacgcgtacgaggacgccgcctccgtgctcaccgtctccaagatccactacgagaatatcaagatggaggactcaaccaacccccaccttca

SEQ ID NO: 5705 - DNA, 366 bp, Zea mays
  Clone ID: LIB148-042-Q1-E1-E5
agtgagtcgtattaacgcgacgattcctctcctccgcccgttcccaccgatctcacgctctctctcttcctccgtcgcgtcggcgtcgccatcgccggccatgggttgcggtggctccaaggaggccgtggccaccggcaacaccagcgccggcagcaaggtcctccggaggaagtcctcctccgtctccaccggcgcaagccacacctccaccacgtcgccgtcgtcctccggcgtcgtcgtcaaggacgtcgtgaatgatgcggcggctgccggcgaggtgatgacgcccgccgacgccgacaagcctatcgctgtccaacccaaggcagacgccatcgtggtgatggacgccaagagagagga

SEQ ID NO: 5706 - DNA, 208 bp, Zea mays
  Clone ID: LIB148-042-Q1-E1-F10
tcgtctgtcattacaatacactatagtgagtcgtattaggcaaggtctcgtgcgcagacatcctggccttcgcggcgcgcgacgccgccgtggccgcgggcctcccgatatacgaggtcgctgctgggcggcgcgaacgtatgcgctcgagcatggatgacgtcccgggcaacttctccgtgccgggcgagtaggtgccgcgcctcac

SEQ ID NO: 5707 - DNA, 216 bp, Zea mays
  Clone ID: LIB148-042-Q1-E1-F12
gcgccggacgatacaacacactatagtgagtcgtattaaaccaataatagcaagtgtgatcatccgttgatccatcttgctaataaccctgcgtgcccttcgttctcgtctcgatcccgacgacgctcccttcggctccggcaaaccacatcaagtcgcgatggagatgaagaaggtcgcctgcgccgtcctcgccgccgccgcctccgccaccgt

SEQ ID NO: 5708 - DNA, 109 bp, Zea mays
  Clone ID: LIB148-042-Q1-E1-H2
cctatagtgagtcgtattaagtggctatcgtagaggttgatgcgtgagggaggacgcgccatggaagtcggtatgcgagcacggagtggaggtggtacccatggggtgg

SEQ ID NO: 5709 - DNA, 170 bp, Zea mays
  Clone ID: LIB148-043-Q1-E1-C5
actaaagtgagtcgtattaagttgttgactgttcgcatggtcggtcatcgtgggtagatgaagcaatctgctactactggcagtggatcacaggaggcatgcaatgggggataggggtgtacccaggccagatcattcatctaaaggggttctttggtgccatagaaaat

SEQ ID NO: 5710 - DNA, 227 bp, Zea mays
  Clone ID: LIB148-043-Q1-E1-G3
ttcacgggtccacccacgcgtccgaccacgcatccgaaaaaaaaaaaaaaaaaaaaaaaaaaaaaaaaaaaaaaaaaaaaaaaaaaaaaaaaaacaaaaagatcaaaaaaaaaaataaaaaaaaaaaaaaaaaaaaaagaaaagggaggccgcccaaaaggttcaaagcttagttacccgtgaatgcaacttcaaaactcttcaaaagtgtcacctaaattaaatta

SEQ ID NO: 5711 - DNA, 400 bp, Zea mays
  Clone ID: LIB148-044-Q1-E1-C7
tacaacaccctatagtgacgtcgtattaggcgtccggcagagatgcttcccactgaatcactgatcgttgatcagtgttccaatattttggcaagtgcagctttgaataaattgaagagattggcctcgtggccattttcctgtatttagctgtagtcaggtccaattcttttctgttggtgagcgcaagttattcatagatgactcggtcatgggaatatttgtaatatgatgtcatgtatcgttaaatttcagttgttttgtttcagctgccagaactgttagcaagagtattctggagctggaagctctaacgcaactggttgtatctatatccttgaaggcctaataaaggacgggcaataaactgcatcgaaatatgtgctgtcagacattgttg

SEQ ID NO: 5712 - DNA, 437 bp, Zea mays
  Clone ID: LIB148-044-Q1-E1-G1
tcgatacacctctctagagtgagtcgtatcactcgatcgaccgcctccgtgtccgtgccctacagctggtcatgagcgcccgcccaaccatggcggcggcggcgcccgtgcgcgcctgcgtggtggcgctggcgctggtgctggcgtgcgcgctgctccagccgcggccgtccgacgccgcggcgcagcccgccccgcagtcgccggcgacggcggtgtcgtcgggcgccgccaagcccaagtgcgtggccggcgccaggaacgaccacgcgtgctgcgtcggcgccgtgcacgacccggacagccaggacgaggagggctccagcgtcaccatctacgcgcccgccgccgcgcccgacgacgtcagccacgacgacggcagcgactacaacgatcccgacgtgcccatcaacgaccagctcgtcgtcgtcgggcac

SEQ ID NO: 5713 - DNA, 404 bp, Zea mays
  Clone ID: LIB148-045-Q1-E1-B3
caatcctctaaagtgagtcgtattagctgcccttgttcttggtgaaatggattgtactgggccacatttacacactgtttatccacaccggtccactgatactcatccttttgccaccatgggctctggttctcttgctgcaatgtcagtgtttgaatctaagtacacagaaggccttactacggaagatggaatacagattgtgtgccaagcaatctgtgctggtattttcaatgacttgggtattgggagcaacgtggtcgtctgcgtgataaccaatgggaagacagaatacttgataaaccaccatttgcctaatcccaagacttatgctagttcaaatggatacattttcacaaatgggcagactgaagtactgtcttcaaaggtcacacttctaaagc

SEQ ID NO: 5714 - DNA, 215 bp, Zea mays
  Clone ID: LIB148-045-Q1-E1-C3
caatactctatagtgagtcgtattaagtgtcaggttacgagcaacaacgcagtgatgaggtcatccagcagcaatgtccagcatcgggcagtccttctacgctggcgacgccgaggcggagggcgagtaccacgtggagcacgcggtggagtgcgtcaacgacaccgccggagccgcggacgacatctcgcaggtgtagcagcaccgcgccacca

SEQ ID NO: 5715 - DNA, 71 bp, Zea mays
  Clone ID: LIB148-045-Q1-E1-D7
ccacgcgtatatagtgagtcgtattacgtcgggtggggttgctaaacctctcctgctgtcgctgctggtcg

SEQ ID NO: 5716 - DNA, 223 bp, Zea mays
  Clone ID: LIB148-045-Q1-E1-H8
tagtgagtcgtattagaagggagagcccaaccacgcgatcgttcaagaggaataccagcttaggagcaacagcaggagcaatcccacgcgttcgatgacatggcccgcgtcggtggcggcgccgtgttggcgctcctagtggcggtcggggcggtagccgcgttcgtcgcggtgctggtctcggggaggtctggggagctgagcgccatggggttgctggcgg

SEQ ID NO: 5717 - DNA, 225 bp, Zea mays
  Clone ID: LIB148-046-Q1-E1-A12
agtgagtcgtattaaacgatgcgacggagtaaggggagtcgtgtgcccaaggagcaggcagaggggagggcgcgtcgtcccgtcgatgcgcggctcgccgagcctcaggtaggactgcgagaagaagagggctgccgtggatacgatcgtggctgatgcgggcgacgccgatgacagcgtcgggatcagagtgacggcgcgacagctaagcaatgggagcgaagt

SEQ ID NO: 5718 - DNA, 295 bp, Zea mays
  Clone ID: LIB148-046-Q1-E1-B1
tctatactgagtcgtattacagggtcttccgcatcctcgtcgccgcggcgttcgcgccgctggtctccgcgcaactctctgcagatttctacaagcacgtcttgccgcgacgccgatccgattagcttgggcgtcgtcaagaagcggttcacggcggaccccggtagcgccgccgggatcatccgcatcatcgtccgcgactgcttcgcatgctgctgcgacccatcgagcgtgatcgagccgatgtcgaaccaggcctcctaaatcgaagcgggctcgcacatcatcctcgatg

SEQ ID NO: 5719 - DNA, 391 bp, Zea mays
  Clone ID: LIB148-046-Q1-E1-B2
aacactctatagtgagtcgtattaccgctccggtttaatttctcctcgaccggccagcgcaattctgtggctcgatcgatcgatcggtcgtaaggcaagtgagcaagctatatatatatataggagattattcgagcgagctaacgagatgggttccgccgtcctcttttactgcatctgcatcgccgtcgtcgtcgcattgtcgtcgtccatggtcgccgtcagggccgccgccccgggggaaccccccaagttcatctcggcgagcgcccttgagtgctccgctaacgtaacggtaatagcaaaggcgcgcaagctgatcgatgtccatggccacgggctgtgcccggtgcggttcgaccacacgcgcgggatcagcgcggtggccagc

SEQ ID NO: 5720 - DNA, 317 bp, Zea mays
  Clone ID: LIB148-046-Q1-E1-C12
tatagtgagtcgtattacaacgagggaggcggcatgcgcggggggcatcgtgcaatggcgcggcggtgcccgtgcaggctgctgctagccgtggcggcggcggccgtgcgcgtggccgctgcagcacacgcgcaggagacgtgctcggggaccgtccccgcgccgccgcgccgcggggcgcgggtgtccgtggccagcttcagcggcccgggcgatggacggagcctcggaacggcggcgtccgcgcgcgccgtgcccagcattcgagcgccgggccgcgccaggcggggggcgagctcggcgttttttttttgggt

SEQ ID NO: 5721 - DNA, 171 bp, Zea mays
  Clone ID: LIB148-046-Q1-E1-D11
gtgagtcgtattaaatttcgaggctaaggtcgcggatttcggacttgccaagctgacgacagacaccagacatgcacgtctcgacgcgtgtcatgggaagtttcgggtgggtggccccggagctcacgtcaagcggcagggtcacggaggagtcgtgggtgttctccttcg

SEQ ID NO: 5722 - DNA, 428 bp, Zea mays
  Clone ID: LIB148-046-Q1-E1-E12
attacaacaccctatagtgagtcgtactaagacttgatttagttatggacggattggtaggcctcttgaaagttcgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggaggtgttcgacaaggacaccttcagcagagacgaccccatgggagacgcggaggtggacgtggcgccactgatggaggcggtgagcatgaacccgcgggaggagagtctgaggaacggcgccatcatcaggtccgagcggccgagcgccaggaactgcctcgccgacgagagccac

SEQ ID NO: 5723 - DNA, 410 bp, Zea mays
  Clone ID: LIB148-046-Q1-E1-E9
tacaactcactaaagtgagtcgtattataatggctgagttgttgacactccatcctctctttcctggaaccagtgaagctgatgagattcacaagatatgcaatgtcatcggtagtccagatgagcaatcttggcctcaaggattgtcacttgcagaagcaatgaagtatcagttcccacagatcaaaggcagtcaactggccgaggtgatgacaacagccagtagcgatgcaattgatctcatctcatcactatgctcatgggatcctagcaagagaccaaaggccgcagaagtcctccagcataccttttttcagggttgtacatgtgttccacttcctgtccgtccaaaagcttcatcacttcctagaacacctccatgtgttggatcaaaaggaaattcagagaac

SEQ ID NO: 5724 - DNA, 431 bp, Zea mays
  Clone ID: LIB148-046-Q1-E1-F12
tacaactccctatactgagtcgtactattccgtcccgccctccaccgccgccgccgcattcagggatggagatgaagaagatcgcctgcgccgtcctcgtcgccgcctcggcggccaccgtggcgctcgccgcggaggctccggctccggcccccaccagcggctcctccgccgtcgcgcccgccgtcggcgccgccctcggggccgccgtcgcctccttcttcgcctactacattcagtgagccggccggggcgcccggaggccgaggaagagacgaaggggagagagagtgacatggctgcgcgcattccgatgcgtgggcatgttttttgattcgacacaccttttgtcctctttttctttgttccctctttctccttaatttaacgaattgatgcatgccgctgatgttcttcccctgagagaggga

SEQ ID NO: 5725 - DNA, 100 bp, Zea mays
  Clone ID: LIB148-046-Q1-E1-F2
aactccctatagagagtcgtattagctggtgcatctgcacgtagcctagacggctagagagcgtaaccatggttcgggctaggatcgtccttgtcattgc

SEQ ID NO: 5726 - DNA, 262 bp, Zea mays
  Clone ID: LIB148-046-Q1-E1-F7
acaaccctctatagtgagtcgaataatgtttggaccaggatggaaagaaagaagccatggattttacccttgggcgaccagcttattttgctggaggccccagatgaacaaggctaaatatatgatgttttcgtgtccaaaaaaaaaaaaaaaaaaaaaaaaaaaaaaaaaaaagaaaaaaaaaaaaaaaaaaaaaaaaaagaaaacagaaaaaaagagaaaaaaagtgagagattcaaaaacctacagagacatccaagca

SEQ ID NO: 5727 - DNA, 67 bp, Zea mays
  Clone ID: LIB148-046-Q1-E1-H11
aagtgagtcgtattaaacagtacgactcactatcgggacgcgtaggagcgtgggcgaaacaagggag

SEQ ID NO: 5728 - DNA, 384 bp, Zea mays
  Clone ID: LIB148-046-Q1-E1-H8
aagactctatagtgagtcgtactacgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccgggggcgccggcggcggggaggagctctcggtggaggagcgcaacctgctgtccgtcgcctacaagaacgtcatcggcgcccgcagggcctcgtggcggatcatctcctccatcgagcagaaggaggaaggccgcgggaacgaggcgcacgccgcatccatccgcgccta

SEQ ID NO: 5729 - DNA, 55 bp, Zea mays
  Clone ID: LIB148-047-Q1-E1-D6
ctatagtgagtcgtattatgagttctactctgtctaggcgtcaatctatctctca

SEQ ID NO: 5730 - DNA, 72 bp, Zea mays
  Clone ID: LIB148-047-Q1-E1-F5
caaaaggttcaaagcttagttagccgtgcatgcaacatcataccccttctatagtgtccccaaattccaatt

SEQ ID NO: 5731 - DNA, 348 bp, Zea mays
  Clone ID: LIB148-047-Q1-E1-G3
ctccctatagagagtcgtattacaggctaccgtcagtgagtacgtcagcgcgctgcatggcatcaaggaggtgcaggccagattctctgcgcgtaatagcgcgggcgtcaaaggcgtcatggtggacatctagttgtgcatcgtcgaacgcgacgggccatgccggtggagcttcgctgcctgcgctgatctcatggagatggtgtgcatggccgggctcaacgtccaggccgtcatgtccttccaccagtgcggcggcaacgtctgcgactccgtcagcatcacgctgccgcggtgggctgcgacggatatggacagggaccatgacctctgctacaccgatcagtg

SEQ ID NO: 5732 - DNA, 444 bp, Zea mays
  Clone ID: LIB148-048-Q1-E1-A10
gcgggtcgatacaagcctctatcgtgagtcgtattaacaccagggccgacgacgggcagatgtacttcggcgctcccggcgccccctgcgtggccaagctcgtgaaggtcgtcgcagcgcggccgtactctgtgtccatcatggagatcagcgagcccattttgccggccgcgttgccctcccccgtcgcggcgcccggccgccgcggcaagggtggtaagcgcaagatcaagccatcagcggcaacccatgaggattccaacatgatcccgcgcaagcccgtcgaagcagtggtggtgggtaagggtaaggtggccaaggataccgtgtccgagtcacctgctccaagccccgcccccgtctccgccccttagttgcgtgttgggcgccgctgcccgccggcccccggccaccatgcgtcgtgtctgcgcgcgcacgcacgca

SEQ ID NO: 5733 - DNA, 108 bp, Zea mays
  unsure at all n locations
  Clone ID: LIB148-048-Q1-E1-A3
tatagtgagtcgtattaaacacaactgcccagattcangttctgggtgtcaagtatcagagcaagcttctcgaggtgattgaagccagtgagttgccagaaaattttg

SEQ ID NO: 5734 - DNA, 344 bp, Zea mays
  Clone ID: LIB148-048-Q1-E1-B11
tacaataccctaaagtgagtcgtattacctgcgccgccgcgggttagcgccgtcgccgatcgggggctcccgcttccccctgagggcggcgcgcgcccggagattgaccgcggtgctggcggttgcgccagtcagaggaatgtcccatcgtcatctggatctagtaggagtgtcgtgcgctccgagagcaggcatggtcatgatctcgcaccgggttcattcggttctccgtctcggtcacccggggacaaatgacgtcactggctggcaagaggtgcgttctgctgctgatcgagtcgaccgtctcgacgatatcagatcacacaacggtgcaccaggcttgt

SEQ ID NO: 5735 - DNA, 212 bp, Zea mays
  Clone ID: LIB148-048-Q1-E1-B2
atagtgagtcgtattaaagctaacagccagcacatccagataaaaccgaggagactcagccctcaggcaagccgaccgccgacgtcagatcgcgccaacccgagagaacgacggagatgatcaagaggatgcacatcgccgcgctcctcgtagtcgccgtctcggccgccgcagtgccggccgccaatgaggccacagcgaccggagcgacg

SEQ ID NO: 5736 - DNA, 381 bp, Zea mays
  Clone ID: LIB148-048-Q1-E1-C5
atagtgagtcgtattacggtaggtgcattgcttcggtggtccaccatggcgcatcgagcggtggccacgatgacgactaataagcccctcctcctcctcgccctggcgtccgcgctccttggtgcggcgccggccgccgcgaacgcgcccggcggggcgttcagcaactgggtggcgatgaaccagcatagctacgcgctgtacgcgcagaactccgtcggggactggggcaaggagcccctggacaacaagctgtctgaggcggaaaagaagaaggtcacctacgtggtggaccctagcggcaagggcgactacacgatcatcagcgcggcgctggaggatatcccggtgagcagcagcaagcgcgtgaatctggatctc

SEQ ID NO: 5737 - DNA, 226 bp, Zea mays
  Clone ID: LIB148-048-Q1-E1-C7
tagtgagtcgtattaggaccccgccgacccgaacaccatcctccgggtgctgtgccaccgcgacgacgaggccgccaaccagttcttgaagcgcacgttccagctggccaggaggcggtgaggccacggccatagcttgacttgaaggagcacgaaagatccttacgcgtcccgcgccccgcggcccgattgatgaaatgatgtgcgtggtgtttcgcatttttct

SEQ ID NO: 5738 - DNA, 364 bp, Zea mays
  Clone ID: LIB148-048-Q1-E1-C8
atagtgagtcgtattaatcgtcggagcacacagagacttcctcgcctccatcgcatcacgccgacgacgtcgctacggtcgctaacaagccgccgcatccagggatggagatgaagaagatcggctgcgccgtcctcgtcgccgcctcggccaccgtggctctggacgcggaggtgccggctcagtcccacagcagcggctccgcggctgtcgcatccgacatcgtcggggccgccgtggtctccgtcgtcgggtacaacagatactgactcgccggaccatgagtcggactgccggacggaacaaaccaatggggggagagacttggatgcgctgtcctgctctgccgccctggcgcagtccc

SEQ ID NO: 5739 - DNA, 433 bp, Zea mays
  unsure at all n locations
  Clone ID: LIB148-048-Q1-E1-D4
gtcacaacaccctatagagagtcgtattaggccacaagagcttcatgatgaacatcaccaccaaggacacggccacgatggaggcgatcgggaacgggttcctgatgcgcgggatcggcgtgaagaacacggcgggagccaagaaccaccaggcggtggcgctgcgggtgcagagcgacatgtcggcgttctacgagtgccggttcgacgggtaccaggacacgctgtacacgcacacgagccgccagtactaccgcgactgcgtcatcacgggcaccatcgacttcatcttcggcaacgcgcaggtggtgttccagaactgcctcatccaggtgcgcaagtgcatggacaaccagcagaacatcgtcacggcgcagggccgcaaggagaggcngtcggtgggcggcaccgtcatccacaactgcaccgtcgc

SEQ ID NO: 5740 - DNA, 82 bp, Zea mays
  Clone ID: LIB148-048-Q1-E1-D8
cctatagtgagtcgtattatacaagtcgagtcagtagggggcgtccttttcaggtgggctccacatcggcgatcggtaacgg

SEQ ID NO: 5741 - DNA, 180 bp, Zea mays
  Clone ID: LIB148-048-Q1-E1-E5
atagtgagtcgtattataaccccagatttattgagattggcacagtgaagcatcaccagctatgccaaagagagcaagcagtcttcaacggtgcatatcagatcggagggatggtacggagtacgggttacacggagcttcgtcagcttcttgataagcaccaggcggaagtgtctggcc

SEQ ID NO: 5742 - DNA, 378 bp, Zea mays
  Clone ID: LIB148-048-Q1-E1-E6
atagtgagtcgtattagttcggcgggaggcaggggacgcacgggcaggcagccatgaacggcatcaaccccaacggcgggttcctgtcgtacgggaacatggagagctatgcgatgtgggtggcgaccggcgtggcgtcggccttcttcgcgtccctcgagcgctgctcctgcatccacctccacaccgcggaggacgactgcgacgaggatgaggacgacctcgaggaggcccgccgctccttctcccgcccgatccctgagtactactacgaccggtccggctcctccgcctccgtcgccacgatgtgacctgaccgaaccgcgcctccctccgcccatgaaatgcgtggtgatactatccgtttcttgatcgatt

SEQ ID NO: 5743 - DNA, 410 bp, Zea mays
  Clone ID: LIB148-048-Q1-E1-E7
ttcattacaactcctatagtgagtcgtattacgcccatggggctgtcgcaccacgtcggacgcgccctggagcgcggcgagctgcaggacatgctggaccccgccgtgcccgactggcccctggaggacgcgcagtgcctcgccgagatggcgctccggtgctgcgagctgcgccgcaaggaccggccggacctcggcgccgtcgtgctcccggagctcaaccggctgcacgcgctcggcgaggacaacatgcagtactgcggcgccatcagcaggggtggcggcagcggcggcggcatgcacagctcgtcgccgttccacagcaacatctcacggtcacacgccgagatgatgatccattctcagtacccaagatcagtgttcagctcaagagcggggaattcgcccag

SEQ ID NO: 5744 - DNA, 439 bp, Zea mays
  unsure at all n locations
  Clone ID: LIB148-048-Q1-E1-F5
cgcgcgggtcgatacaacaccctacagtgagtcgtatcaggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgtggctcccgaggagcaccccgtcctcctcaccgaggcgcccctgaaccccaaggctaacagggagaagatgacccagatcatgttcgagaccttcaacacccccgctatgtacgtcgccatccaggccgtgctctctctgtatgccagtggccgtaccacaggtatcgtgctcgactcgggagatggtgtgagccacaccgtcnccatctacgaaggatacgccctcncccacgccatccttcgccttga

SEQ ID NO: 5745 - DNA, 400 bp, Zea mays
  unsure at all n locations
  Clone ID: LIB148-048-Q1-E1-F6
atagtgagtcgtattagaatggggcagaaggacgccnacgtcggtgacgaggcgcagtccaagaggggtagcctgaccctcaagtaccccatcgagcacgggatcgtcagcaactgggacgacatggagaagatctggcatcacaccttctacaacgagctccgcgtggctcccgaggagcaccccgtcctcctcaccgaggcgcccctgaaccccaaggctaacagggagaagatgacccagatcatgttcgagaccttcaacacccccgctatgtacgtcgccatccaggccgtgctctctctgtatgccagtggccgtaccacaggtatcgtgctcgactcgggagatggtgtgagccacaccgtccccatctacgagggatacgccctcccccagg

SEQ ID NO: 5746 - DNA, 419 bp, Zea mays
  Clone ID: LIB148-048-Q1-E1-F7
tcgcaggtcattacaacactctatagtgagtcgtattatgagccatgtaagagaaaccgctggcttggtagaaggaactgagcgtctgagccaactaagacagacagctgaacggatgggccagctatccactcagccatatggtcaaaatcgaccaactcttgatgcattaatctgactgccacacattttttacaaagttgttttgccttcacgtacccttcgcaataacaccatgtgttgtcactggtttcttctgtaaccttaacattgggttttaaggctcaaacccaacgaaacatgagaacttggtggtctatggtttcgtctgtaaccttatcgttgggttttaaggctcaaacccagccgaaacatgagaacttggtggttttaacgataaatcaccaaacctctacagg

SEQ ID NO: 5747 - DNA, 421 bp, Zea mays
  Clone ID: LIB148-048-Q1-E1-G10
acaccctatactgagtcgtattactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgatgaggacatctgcgacgtggtcttggtggag

SEQ ID NO: 5748 - DNA, 237 bp, Zea mays
  Clone ID: LIB148-048-Q1-E1-G3
cctatagtgagtcgtattaatggacactactggcgcctctcctatcgtcgatgctgctcgtcgggctcgccgcgggctctgacgacgatgaggacggcggtcgtataaggaagccccatttcaactatggtaagtttaatgcggatccgtggaccgaagggcaggctacttcacaatgcgggcgtcactcgttaacacaacctactgagcgaggctcatggtgtgatgccgaccatc

SEQ ID NO: 5749 - DNA, 373 bp, Zea mays
  Clone ID: LIB148-048-Q1-E1-G5
acgcgcgggtcgttgcaactccctagagtgagtcgtactaggaccggcccccgcgcgcgtgccgtacgtgccagggacgacgccgggcggccgatggagttcacgtcgtcctacttccacgccttcgggagccccgacctcgcggcggtggtctccggcgacggcgggagcgcgcaggcccaacggccgcgccgctccaccgacggggcgaaggcggaggacggcaggaggtccaccaccacaacggcgaggcgcgcaccgtccatgttctgcgtccccgacacggcagcggaggacctcaacggattcctggaggagtgcaccttctgccgcaaggcgctctgcggcgagatcgtcatgtccagaggggaca

SEQ ID NO: 5750 - DNA, 72 bp, Zea mays
  Clone ID: LIB148-048-Q1-E1-G6
caaaaggatcaaaccttacttacccgtgaatgcaacttcaaaccccttcaaaagtgtcaccaaaattcaatt

SEQ ID NO: 5751 - DNA, 428 bp, Zea mays
  Clone ID: LIB148-048-Q1-E1-G9
ttacaacaccctagactgagtcgtattacatgtacgggctgttcggcgtcatgggctacgtcgcgttcggcgacgccacgcgggacatcatcaccaccaacctcggagccgggtggctgtcggccgccgtgcagctggggctctgcatcaacctcttcttcaccatgccggtgatgatgaaccccgtgtacgaggtcgccgagcgcctgctccacggcaagcggtactgctggtggcttaggtggctgctggtcgtcgtcgtcggactcgccgccatgtacgtgcccaacttcacggacttcctggcgctcgtcgggagcagtgtctgcgtcctcctcgggttcgtgctgccggcctcgttccacctcaaggtattcggcgccgagatggaatggcccggagtgctgtccgatgtcctgctggtcgtg

SEQ ID NO: 5752 - DNA, 398 bp, Zea mays
  Clone ID: LIB148-048-Q1-E1-H1
gtcgatacaacactctatagtgagtcgtactactcgcaagcggcagcggtgggcgacgcctacgacctcctcgtgcgggggctggacggcgccgacaatttcaatgggggtgtgagcggcccctctgcctatgtactgaagctcgaattgttggctgcaaaaaatttgatggcggctaacttaaatgggacatctgacccatatgcattgatcacttgtggtgcagagaagcgtttcagctccatggtccctggctcaagatacccaatgtggggagaggaattcaatttttttgttgatagtcttcctgtaaagataaatgtcacgatatatgactgggacattgtatggaaaagcacaatccttggctcttttactgttactgttgaatctgaggt

SEQ ID NO: 5753 - DNA, 397 bp, Zea mays
  Clone ID: LIB148-048-Q1-E1-H10
cctacagtgagtcgtattaagcgctcccgccccacgcacgccctcgcgctcaccggcgccccgcccctcccccacgctggccgcacccgacagggggtgcgcggcgtcggccgccaacggggccgggccccggcggcggcggtgggcgcgggcgcggatcccgcggtacagcgaggcgtccacctcgggtctgccgccgccgccgccgccgccgcacgaggcggcggagtcgtcgtctgggggcaagaggcgacggcgcaaggtggcgccggcgcccaaggaaccggctgaggaggggaccgccgcgctgcttccgatgcccggctcgcgcagcttcaggtactactggcagaagaagacggccgccgtcgacaggatcgtggacggagccgacgcc

SEQ ID NO: 5754 - DNA, 132 bp, Zea mays
  Clone ID: LIB148-048-Q1-E1-H12
atagtgagtcgtattaaacctcacgacgctccattgtgagttgcacgtacaggccccgtcccaattggccaaaactgttacgtcgcctcagttcattggcacgtcgaatcgcaagttcgggactgagaggtt

SEQ ID NO: 5755 - DNA, 404 bp, Zea mays
  Clone ID: LIB148-048-Q1-E1-H3
caacactctacagtgagtcgtatgtatggttactccgcgcgccttctctttctctcccggacgtcgatcgtgttcttcagcacgggctagctagctccctcgctctcagccatggcgacgccggacaacaatgggcacgggcatccgctgcacaagtttggggagtgggacgtgaagaatccggccacgtccgagggcttcaccgtcatattccagaaggcccgcgacgacaagaagaccaccaccggccctggggctgggaacgcgcgcgcaggcattccgccggccttcaagaacggcggcggcgactgcgggtacaggcccgacttcggcgacggcaaccagtacacgccgcccaaacggaagaagtgggccttctgtggctgctgaatcgaagctcgctg

SEQ ID NO: 5756 - DNA, 121 bp, Zea mays
  Clone ID: LIB148-048-Q1-E1-H5
attacaacaacctatagtgagtcgtattaaaacagacacgtcgtcacgtccggcccatcccgccgctgccgtccctaaggacgctctaacgaccacgcaccgagtgagggatattcagggg

SEQ ID NO: 5757 - DNA, 312 bp, Zea mays
  Clone ID: LIB148-049-Q1-E1-H7
aacaccctatagagagtcgtattaaatagcaagtgtgatcatccgttgatccatcttgctaataaccctgcgtgcccttcgttctcgtctcgatcccgacgacgctcccttcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgca

SEQ ID NO: 5758 - DNA, 237 bp, Zea mays
  Clone ID: LIB148-052-Q1-E1-A10
cgtattatgcgcagcaatcagtttcttcactctcgtggtaccatgtcaggatgaagtgcgcaatgagacgctttgcttcaaaagtacgtcgtgataaccacaaagagcttgattttaatcgtcggtaatgttcaaaggatcgcaaacgctcatcggatggatcaacacgagtgcgcaatcagacatcgattgaaccattgtcattgcagctttcatagcttcctgctgtgcgccatg

SEQ ID NO: 5759 - DNA, 295 bp, Zea mays
  unsure at all n locations
  Clone ID: LIB148-053-Q1-E1-A1
atagtgagtcgtattagnangagaactcgccgctcagctcggggaccaacgacgccgcctacatgcagctcaggaacatcgacacgtacatcatctacgcaacgacctgcgatgacgggaaagtcaagcccagaggatccaactgcatggacttggctgatccttgcgctcaatactacgtcgacgcttagctgaaccagccaaacgtgatgaagaccatccgtgccaacacaaggctcacgtacagatgggccagatgcaggggcacgttctagaagctgctcaagttcggtga

SEQ ID NO: 5760 - DNA, 371 bp, Zea mays
  Clone ID: LIB148-053-Q1-E1-B9
gatcgcagcaattcctctcgaagtcaaagctggagcccagcagcacagtcaggtgaaagaaccagcaatactggcgcgatggcacacaacatatgggatttcttcatgttcagcccaaagaacagcatttctgaaacaattataagctgcacgtgatgtttagacgcgaccttcttttccgtatgtacaagcaagtatcccgtatcctcctagacacagtacaaaaccatttaaaacttggcaacttgctgcggtgtcacatgtaaaagaagggttgtccaggaaggaaaatataggttggcaatggcaagagtctgctggtccaacaactccctgcttctatggacctccgtgggagccttactttgtac

SEQ ID NO: 5761 - DNA, 354 bp, Zea mays
  Clone ID: LIB148-056-Q1-E1-A11
ggtctagcattccaggccctaaagtgagtcatattagcgtcggctgaacgctgcgcagtagctcatgacggccgatgtctcgacggccgccatgctctgtgcaccgcgggcgccgtgcctcggcttcaggaatgacatgtatgctgtcctttcatcctattgcctagcgtcactgcatcatctaccgctatgctattaatattctttcaactatcaacaatgtgggtcaggactcacataactctgaagaggatttcaggaccgtcgtcttcaataaccccatgtacgatcatatcatgtcactcaccgtcatgttcgatatctacaacacgctctcaagcattatcccttacc

SEQ ID NO: 5762 - DNA, 134 bp, Zea mays
  unsure at all n locations
  Clone ID: LIB148-056-Q1-E1-C10
ctatagtgagtcatattagccngnggacgccgcaccatgtcgatctggggatcggagcgcgggcgacgggatgccacgcggcggctggcgcgcggcttcgtcgaacccgagggcgttcgggtcggattcggact

SEQ ID NO: 5763 - DNA, 298 bp, Zea mays
  Clone ID: LIB148-056-Q1-E1-G11
cgcgttagacgttacaacaccctaaagtgagtcgtattaaccgcggctacggccattccatcttcgagtgccccgcgatcgtcgctgaggcgtgaccggcagacagacatccgcggcgccatcaacgagcaggtgcggcaggaagatgacagcatcggcgtcgccgtcctcaaggggaatgtataatgtgtcgaggaagtatagccgtgactcgtcacagcgccggacgcgcacgtcatcatcgctgtgaccggagtctccagcacgatccagacggccggcggggcagcgatacgcc

SEQ ID NO: 5764 - DNA, 306 bp, Zea mays
  Clone ID: LIB148-057-Q1-E1-B12
ctctacagtgagtcgtatcatgaagagcacgggcaggtcagcggcagccacggctcagacgatgtcgtgccacagatacttccacaaccgactcatatgacgacgattaatggccatcacctgcactccgctcggaatagtcggccatgaaagacgccgtgtgggcccaaagcaacgcattcccaaagttcagaagacacgagatgatcaagatcactgaaggacttcgacgagccccggttccttgcacataacgggatcttcgtccgacccaccaactagatggtcatctcaacgcgaacccgg

SEQ ID NO: 5765 - DNA, 58 bp, Zea mays
  Clone ID: LIB148-057-Q1-E1-B5
aacaccctatagtgagtcgtattaagcagaacaatggccggccagaggcagccacggc

SEQ ID NO: 5766 - DNA, 108 bp, Zea mays
  Clone ID: LIB148-057-Q1-E1-B7
agtgagtcgtattaaagggcccggcacgtcagtccggtgcgcaccccgtcaggccatcgcccaggcctcgccagtcggcgctcccagcgtcgctgacaggaggagcaa

SEQ ID NO: 5767 - DNA, 121 bp, Zea mays
  Clone ID: LIB148-057-Q1-E1-C10
cacccaatagtgagtcgtattacgagtgtggcgccatgggtggctgccactctgctcatcgctggcacaacgctgaagattctgcgccgcggatgccggggtgacgctaccttcctcgccg

SEQ ID NO: 5768 - DNA, 202 bp, Zea mays
  Clone ID: LIB148-057-Q1-E1-C6
atagtgagtcgtattaagccgaggcatgcgtgccgagcgatgcgcacgcaggctgtgcgcgcctgcccacggagttcgagcacgcacccatcgccatggagatgagaccgtgtccacagggtgagacagatccatcgatgcatgatacgagagtcgagatccacatggaccacaccaactccgagatcgactgcgtgaaccc

SEQ ID NO: 5769 - DNA, 278 bp, Zea mays
  Clone ID: LIB148-057-Q1-E1-C7
acaactcctatagtgagtcgtattatgcagccacaggcaggcgtcggcaccatgtcgtctttcaccggcacgcaggacaagtgcgcggcgtgcgacaagtccgtcgacgtcagcgacctcctcacggccgatagcgatcatcgatcaaagcatatgcttcaagtgcagccactgcagagggatccgctcgatgtgcagctactcttccacggccagtgtgctgtgctgcaagaccgacatcgagcagctcttcaaggagaccgggagcttcaccaggg

SEQ ID NO: 5770 - DNA, 314 bp, Zea mays
  Clone ID: LIB148-057-Q1-E1-C9
atagtgagtcgtattaaacgcacaagcatgatcgacaggtcaggtcagcgaggcaaactctggtaatggatgtaggcacgggactcgcttcgatgacgacggtacttcacgcgcagaactaggtagccctgctcacactggatcgaacagtggatgtccatatgacttctgagagccagcatgctacatcagaggcaacaacatattgggaaaattcacgatgtacatcgtgacgaaactctcagagcagcattgaccgtatgaacagaatgctgaaccatcatggttcatccatgcatcattcagagaagctg

SEQ ID NO: 5771 - DNA, 330 bp, Zea mays
  Clone ID: LIB148-057-Q1-E1-D1
tgggccgatgcaactccctagagtgagtcgtattaagtacgtctcgctcggctgcgacgccatgcccgtcctcaagggacgcacgcccgtcgagtgctacaccgacttcatgcgcgcgttccgcgaccacttcgccgactacctcggcaacaccatcgtggaaatccaagtcggcatgggccccgccggcgagctgcgctacccgtcctacccggagagcaacggcacctggaagttcccaggcatcggcgccttccagtgcaacgacaggtacatgcgtagccgcctgaaagcggcagcggatgccgccggcaagccctgagtgggggc

SEQ ID NO: 5772 - DNA, 406 bp, Zea mays
  Clone ID: LIB148-057-Q1-E1-D5
atagtgagtcgtattaaagaggaagacgaagcggccgtgactggatcaacgcagcagcgggacgcgcttggtatgacatccacgagagcacgtgtatacctcagggtgacctccggtgagttaggaccacgtcgctgatcacatcatatcgatcgcgcacgttcacctgaacatgcacacagacgccacacgcagaggaaacaatgacgtaacggaaggcgacggctgtgcctcgatcgacatcctcgaccagatctaaggagaacagtgcgtgtaccctaccgtgcaagaggcacacacacgacacgttacgttacgtacgtacttggtccttagataacatttgcatgcatgcatgcacatgcatctactacggcgacttacacgggcactgtgcggttgttgt

SEQ ID NO: 5773 - DNA, 235 bp, Zea mays
  Clone ID: LIB148-057-Q1-E1-D9
tgcacgactctatagtgagtcgtattgaactgaggtgccgattacgaagctggcgtgccataggcctgtcagggagattgcgcatgatttcaagacggatctgcgcttccatagccatgccgtgcttgctctgcaggatgcaccagtggcctagctggttggtctcttccaaaataccaatctgtgcgcgatccatgccaagcgcgtgaccatgatgccaatggacgttcagctg

SEQ ID NO: 5774 - DNA, 281 bp, Zea mays
  Clone ID: LIB148-057-Q1-E1-E7
tagtgagtcgtattatcaacggcatctcccacagggaccccgagacccccgtgaagctcgctgaatacttcaacgtcaccgacggggtgttcagctacaaccagatgggcgacgtgccccccgccgtgaacggtcccctccatgtcatccccaatgtcatcaccgccgagttccgcaccttcatcgagatcgtcttcgagaaccccgagaagagcacaaactccctccacgtctatggctaggccttcttcggcgtcggcgatgggccccgggaagtggtc

SEQ ID NO: 5775 - DNA, 182 bp, Zea mays
  Clone ID: LIB148-057-Q1-E1-E9
cctatagtgagtcgtattaaaacgcagcacatccaagtgtcagcgatagacctcagccctcatgcattgccgatcgccgacgtaccatcgcgccaacgagagagagggatggagatgatgacgaggatcctcagcggtgcgcgccgcgctgtcggcatgtcgggaaccgcggtgggggcgtc

SEQ ID NO: 5776 - DNA, 283 bp, Zea mays
  Clone ID: LIB148-057-Q1-E1-F2
agtgagtcgtattagcgaccaactactgcgttgtctcgcctcatccaggttctcgaacacaattgcgtggagccggagcgcacaccgcgctcacccacctcacaaggagacgtatctagacattccggcggtcgatccatcttcccgtcgatggagagcaaggaatagtcgatgtacaggggagtgtgacgttaggatgaggaggagatgttgtgtccgtcgagcgcggcgcaggttgcctcgttgcgtcgcaggcggtgcggcgtgacagtggggaggaatg

SEQ ID NO: 5777 - DNA, 316 bp, Zea mays
  Clone ID: LIB148-057-Q1-E1-F9
tcctatagtgagtcgtattacgggacgcctccaagaaacacgtaaacgctgagccgctgctctcaacgaggaagtcacgacggccgccacgcccgaggcacggatggcgctgaacctctgcaagacctactacctggacgccgccgacaacctcggcgcctgcaagcgcgccatcggcttccgcgacgccgtcaccatccgcgccacgattagcatggtggcgcaggacacgcataactgcgacgaggagttcatgaacgccgtctccaagaaccgcatggaggaccacaacaggtcgctcatcgagatgtccgag

SEQ ID NO: 5778 - DNA, 133 bp, Zea mays
  Clone ID: LIB148-057-Q1-E1-G10
tagtgagtcgtattaagcgctaccgtcctcctcggcgccgcaaagacggtggcaatcgtcgtccctctgttccgcgccgacagtgtcggcctgcggcccatgctgcggacgagcgcggatggcattgccgcgt

SEQ ID NO: 5779 - DNA, 187 bp, Zea mays
  Clone ID: LIB148-057-Q1-E1-G2
tagtgagtcgtattaatcgccgactcctccatcccctcgtcgaacggcggcaagttcgccatcgacctgaccgccgcgcagccgctcagccggggcggcacgccggggtgcagcccgagaggcagcggtgacttgagcatgtggtccctggggaaagaccgcggcttcgtcatgtccgccgcggtcc

SEQ ID NO: 5780 - DNA, 428 bp, Zea mays
  unsure at all n locations
  Clone ID: LIB148-057-Q1-E1-G6
gtcaaggggccgaggccgacccaagcgtccacccacgcgtccgatacggtctgggagagctccctcaggcctttgcccgcctgagcgctgtttacggtggcacgtacatgctgaacaagccagaatgcaaggtcgagtttgatgagagtggaaaagcgtatggagtcacttctgaaggggagaccgccaagtgcaagaagatcgtctgcgatccttcgtatttgccagacaaggtgaagaaggttggaagggtggcccgcgcgatatgcatcatgaagcatccgatcccggacaccaaggactcgcactccgtgcagatcatcctcnccaagaagcagctaaagcgcaaatccgacatgtacgtgttctgctgctcctacgcncacaacgtcgcgcccaaaggcaagttcatcgccttcgtctccacg

SEQ ID NO: 5781 - DNA, 62 bp, Zea mays
  Clone ID: LIB148-057-Q1-E1-H5
attacaaatccctatactgagtcgtattaatgctgctggactgtgggtccgtggtgggaggc

SEQ ID NO: 5782 - DNA, 400 bp, Zea mays
  Clone ID: LIB148-058-Q1-E1-A10
gccgcgcgggtcgatgcacgcctctagagtgagtcgtattaacgcgtgggcggacgcgtgggcggacgcgtcgggtccgtggagagcggcaagttctggttcccagctcacgtctacaaccgcaagcattcgcatgttgggttcatgatgtcatgctatgatgcagcgctcatttaccatttcgatacggacacattccgtgcaaggtacccagcacacggtcgacgaaccgtggtgttggaggatggcgtgcaatgggacagggtgagggcaccgcctgttgacacccttgcgcatcacctgcacacctctgactgcctgcatgatctctggcccggcgaccacatcgagattcagtggagaacgaatagagaattcgcatacggtctggtggtatgga

SEQ ID NO: 5783 - DNA, 129 bp, Zea mays
  Clone ID: LIB148-058-Q1-E1-E11
ttctctatagtgagtcgtattagttatcgcttgcacgtacaatgcgatgagagccttgttcctcctgttcctcttctgcatcttgcatggtcataatgaagattcaggggtcatgggggcgaaagcttc

SEQ ID NO: 5784 - DNA, 195 bp, Zea mays
  Clone ID: LIB148-059-Q1-E1-C4
taaagggtcaccaaaattaaattcaatggccatctttttaaaaagtcgtgactggaaaaaccctggggttacccatcttaagccccttgaaaaaaacccccctttcgccacctgggttaataccaaagatgccagcacgattcgcccttccaaaaagttgcccaccctgaatggcaaatggaactccccctgtaa

SEQ ID NO: 5785 - DNA, 305 bp, Zea mays
  Clone ID: LIB148-059-Q1-E1-G1
tgcaagactctagagtgagtcgtattaacgcgcgttggacgtcggcggtagcaaggctgccgacggcatcagtgagggcgcacgctaagtggcgccggcaagccttgccgcgaggacatgtcagctgctccgcatgtcgacaccagctatcggtcatccggtgagctgaagtatctcagtcctgagacatcatctcttcatggcttcgcacccaaagactgagtctccgatagctcgcttaggcggcagtttcgcaagcacgtgcgcatgaatctcaaggcaggttccaaggtggccgggctcac

SEQ ID NO: 5786 - DNA, 429 bp, Zea mays
  Clone ID: LIB148-059-Q1-E1-G12
tcgttgttcattacaactccctatactgagtcgtattatacttggatctcaagcgcgacgagtgctctcgactctttcctgcagggcggatatactcgcaagcgttccaccttgcagggcagggtttcttcctctcggctcactgtaacatggagcagcaaagcgcgttctactgcttcgggctcttcctgtggatgcaagagaatggctccacgagtgtgacagtggactacgagttcgctgcaaggacgagaccatccggcgagtttgtgagcaagtacaagggtaactacacattcaccggtggaaaggctgttggatacatgaatctctttgcaatcccatggcagaagttcttggccgatgacagcctcttcttcgtggatgggatgctgcatctgagagccgagcttacgataaagcaaccct

SEQ ID NO: 5787 - DNA, 107 bp, Zea mays
  Clone ID: LIB148-060-Q1-E1-C7
ccacgcgtccaatttttttttttttttttttttttttttttttttttttttttttttttttttttttttttttttttttctaaatcgcgggcggccgctctagagga

SEQ ID NO: 5788 - DNA, 371 bp, Zea mays
  Clone ID: LIB148-061-Q1-E1-A1
atattacattacaacatcctatagtgagtcgtattaaacagattcagagcccgagcccgagccccagccccagaccaacgacgagaaaggacaatctgcggcggacctacccgaagtcggaggcagggcaaaaggcccgatcccccctccccgccggttgccgcgctcgtgccacggtgcgctagccccgtcgacgccggcggacagcgtgcactatgggttgctcctcctccgtgccagctacaaatactggagggctgaacactatcagcaacgatagctctccagccatcagttcaaaggacttgcgtgctaagttggtattgctgggagactcaggtgttgggaaaagttgcattgttcctcgtttt

SEQ ID NO: 5789 - DNA, 109 bp, Zea mays
  Clone ID: LIB148-061-Q1-E1-A7
acaactccctaaagtgagtcgtattaaggcaggtggtaaggtggaggttgccgacatgcgacactgtgatactcacgagtcgccaagtactccgtgggcggacagtcca

SEQ ID NO: 5790 - DNA, 389 bp, Zea mays
  Clone ID: LIB148-061-Q1-E1-D11
aacaaaatccaattatcgtaatgtcgtaattccaaaattctccttgtcaatagcaaatgacaaaacggttggatagagatccgcctcgttgatcagaggccgtccatcgcggaaccaacggtggatgctccttcacgcggttttgaacacttcagcccgacgaattgttcggttcgtcgacgacaacctccatttgttccacaatccacaattccccaccccccacggcccccgggcccacccaccctctccctcttcttcctcactcctctctccctctctctctctctctctctctctctcgtcctgcgccacacgccgcggccgtctccgggcaggaaggaagggggcgggaagatgatgatgacccggggcacgatggggcccat

SEQ ID NO: 5791 - DNA, 349 bp, Zea mays
  Clone ID: LIB148-061-Q1-E1-E12
atacaacaccctagagtgagtcgtatgatggcagatcgccaagccggagagcagcggcatctactacggcgagttcaagtgctttggccccggcgctgacgccaagaagaagaagagggtggggtgggcgctggacctcaccgaggcgcaggccaagccattcgtcggcacacactacgtcctcggcgacacgtggatccagccaccgcccaagtagcgacgcatgccacacgatatatctatttgagtacgaagcaaaagcgagagacacgaatctctaatctctttactgatgagatgttttgcttatatatatatatagacgagctaatgaaagctcagggttttc

SEQ ID NO: 5792 - DNA, 82 bp, Zea mays
  Clone ID: LIB148-061-Q1-E1-G7
ttactacaccctaaagtgagtcgtattaatgcgtcgatgggcggccgttggtgtcggggagactccagagtgtgtgaggaca

SEQ ID NO: 5793 - DNA, 406 bp, Zea mays
  Clone ID: LIB148-064-Q1-E1-A9
gggccccccacgcgtccgtaagatcatccgttgatccatcttgctaataagcctgcgtgcccttcgttcttcctcgtctcgatcccgacgacgctccgttcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggaggatcggagggagaggctgctggctgccattgcctgtaatcggttggactccctttatagataaaattacgtactttaatttgggtccgaa

SEQ ID NO: 5794 - DNA, 76 bp, Zea mays
  Clone ID: LIB148-066-Q2-E1-B2
ggtcctacattaccgggtccacgcacgcgtccgcacacgcgtccggttctagatcgcgagcggccgctctagagga

SEQ ID NO: 5795 - DNA, 359 bp, Zea mays
  Clone ID: LIB148-066-Q2-E1-H9
gggtcgaggccgcgtccaactggatgatgagacgggatctgcgccggctccggcaccggcgccggggccgacgaccagttgaagcgaggaaggtggccaaaactgagggcccggctactatcttttgctataactaaagatagggcgaagtttaatttctccaataaattctgtccgagcaaaaagtatgatggggtttttagtcgagatggtaaatgtatgacgcgcgtgtggaccaagaccaagagtcatggcttgctgtacttgtggtttctgagctgcaacactcaatcgactactaaactaaggtaataatatatatatatatgatatgcttaataagatcatacacaatgcac

SEQ ID NO: 5796 - DNA, 381 bp, Zea mays
  Clone ID: LIB148-017-Q1-E1-D6
aggttatttctaatacatatggattggatgagattggaaaaaattaagaagaagtttaacttgtttgcgattcaaacacatccaatctcattcaattcacatggattgagagctaaccgaacaagcctgtagttggacaagggtgtaacacttatttgtcaggcgtaccgggcacagaccgcttcctatttgttcgtggggatgtaactgtaagccttgtgacccctaagcagtctgcgtcttgtgcctgctgctgtagcggtagagcagagagagagatcaaatgtaaattacattttttagctcaaattcacgacaaattggttgtcctaaaaaaaaaagaaaaaaaagacaactacataggcaatcaagaattcaatt

SEQ ID NO: 5797 - DNA, 329 bp, Zea mays
  unsure at all n locations
  Clone ID: LIB148-058-Q1-E1-D8
aggtctctgtcgcgctgttgtaaacgggttagcagaagaacacacagggtgacaacaaatccttgttcggttatttctaatacatatggattggatgagattggaaaaaattaagaagaagtttaacttgtttgcgattcaaacacatccaatctcattcaattcacatggattgagagctaaccgaacaagcctgtagttggacaagggtgtaacacttatttgtcaggcgtaccgggcacagaccgcttcctatttgttcngtgggggaantggnntttaaaaaancccnnttgggnnnttttaaaaaaaaaaggggggcccccccc

SEQ ID NO: 5798 - DNA, 386 bp, Zea mays
  Clone ID: LIB148-009-Q1-E1-G2
agggacgtttgtgggggcaaccgtgcatccattccctaccggcgattgggcgtggaaggcggtgtggcgtgggcaattcttcgtcgaagatcgcgcttcgtcgtgaagccgctcacatccgcggtcggcgtccggtgctgcctaaattttggtatcttcggattcatggtaaaagcagatacaatgaggagcttgatcgtgacaagggttgtcgtcgctccgaagctgtgcgaaagggagcttcggctaaatcgcagaaaagggaaccgacttaaaagggaaaaggctgttcagtcctcatagatttttctataagccaatagtaaatgtaaagggcataattgtattttccataggctgtgtcctgtgcctataaatagatgaac

SEQ ID NO: 5799 - DNA, 415 bp, Zea mays
  Clone ID: LIB148-019-Q1-E1-H8
actggaatgggatctgatctctttgggtcatacgcagagtcttcttgtgctgcccttgttgttgcgtctatttcatctttcggaatcgaccatgatttcactgggatgtgctacccactccttgttagctctgttggtatcattgtctgcttgatcaccaccctttttgctactgatttctttgaagtcaaggctgtgaaagaaattgagcctgcacttaagaagcagctcatcatctccaccgtcctgatgacttttggtattgctctaatcagctggttggcccttccagctaagttcaccatctacaacttcggtactcagaaggaggtttccaactggggtttgttcttctgtgtttcaattggtctgtgggctggtttgattaatgggtttgtcacagaatactacacta

SEQ ID NO: 5800 - DNA, 429 bp, Zea mays
  Clone ID: LIB148-033-Q1-E1-A7
agtacatcgaggctggtgccagcgagcacgcgaggaccctcggtcccaagggatccgactgccacaaggccgctgtgatcggtgacaccattggtgaccccctgaaggacacctccggcccgtccctcaacatcctcatcaagctcatggccgtggagtccctcgtgtttgcccccttctttgccacccagggtggcctgctcttcaagtacctgtaaaagggacaacaccaagcacacagcagaagtatacgatctcccgaccgaccgtggacaatatcgaataactcctgccaaatcgccagttccttttgtgtactgtgcgctagccgccgcctagctgcactgctgtatttttgtttcaggattgctgctgctgttcgcattcaatctttgggcctcccggagccgccggaggcgcgttttactg

SEQ ID NO: 5801 - DNA, 436 bp, Zea mays
  Clone ID: LIB148-018-Q1-E1-B2
cagagaacagcgaacaaggtgataggtacatggagttggctcaccgagttgacgaagctttggggttcatgtcagctgctgggctccctttagatcaccctataatgacaacagcagaattttggacgtcacatgagtgtcttcttctaccttatgagcaagcgctcactcgtgaggattccaccacgggcctctattatgactgctctgcccacttcctatgggtcggagagcgcactcgccagcttgatggtgctcacgttgagttccttcgaggcattgccaaccctcttggtatcaaggttagtgacaagatggacccagcagaacttgtgcggttgattgatatattgaatcccgaaaacagggctgggagaataaccatcatcacaagaatgggacctgaaaacatgagggtgaaacttccacacctgat

SEQ ID NO: 5802 - DNA, 421 bp, Zea mays
  unsure at all n locations
  Clone ID: LIB148-006-Q1-E1-B8
agtgaagcggaaggagcatagggaggagggcaacgagggcgacgggttctacggcggcataaggaagctccgcggcaaggatgacatctccaagtggaggcagctgtggccaacagacgtcctgnagtaagcaggagccgcatcccttctcacaccgagattgatccatcgctcaaatgacacgcctttctttcatcatattgaccaaattcgtcgtctctgtcgcgctgttgtaaacgggttagcagaagaacacacagggtgacaacagatccttgttcggttatttctaatacatacggattggatgagattggaaaagattaagacgaagttaaacttgtttgcaattcagacacatccaatctcattcagttcacatggattgacagctaaccgatcaaccctgtagttggacaag

SEQ ID NO: 5803 - DNA, 422 bp, Zea mays
  Clone ID: LIB148-018-Q1-E1-D8
tacccacacttctgcgagacccgtccttgaggggcacgtcctagatcggtggcgcctgcctctcgccgccgatacggtgcctctcgcggtctcgctccccctcgcaggtcttttggtttttttagttcctccctttgcttcttggaggtgtttgttgccgtctcacccgcagttcttgagacatgcagagccagatagtgtgccacgggtgcaggacccttctgttctacccaagaggtgctccgagcgtgtgttgtgcggtatgccatgtggtcaccaatgtgccgcctccagcaatggagatggctcgacttagatgtggtggctgccagacattattgatgtatgctcgcagtgcaacaactgtaagatgctcatgttgtgacacagtcaatcttgtcagaccagttagtagcatagct

SEQ ID NO: 5804 - DNA, 404 bp, Zea mays
  unsure at all n locations
  Clone ID: LIB148-007-Q1-E1-E6
aacggacgcgtgggtgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaggaaagggttctaccgcaaggggatgaagtgcatgaacgtgtagaggtccttcgcgcaggagcactacgcgggggggggcggcaacgcgtgggttggcnngtgtggtngagcgggtgattgccggccccgtgggggctggggtgtgggaggggaaggacgtcgtgttgactggccgcaggatcattggggccaccaggccttgggaggcagcccccggtaccattcgtggggactacgccgtggaag

SEQ ID NO: 5805 - DNA, 343 bp, Zea mays
  Clone ID: LIB148-053-Q1-E1-E12
gttcaagaaggttgggagcttccttggtcgcttcaagtcgatacctagcattgttgagcttgacagcttgaaggtttccggtgatgtttggttcggttctggaattgtactgaaggggaaagtgaccatcactgcaaaacctggcgtcaagctagaaatcccagacggagcagtgattgggaataaggatatcagtggccctgaggacctttagataagaatcagcgaatcagcaaggaggctcacttcgccaagtggcggatcatttttcgtgttttttttcctgtatattcaaacaggttccatgatattatggagaatattaattgccagtataatccag

SEQ ID NO: 5806 - DNA, 335 bp, Zea mays
  Clone ID: LIB148-058-Q1-E1-F2
gtgacaagatggacccagcagaacttgtgcggttgattgatatattgaatcccgaaaacagggctgggagaataaccatcatcacaagaatgggacctgaaaacatgagggtgaaacttccacacctgatacgcgctgtccgtggggccggtcagatagtaacatgggttactgacccaatgcatgggaacactatgaaggccccttgcggactcaaaacccgctcgttcgataggattttgggtgaggtgcgtgcgttctttgatgttccaacggaaaacccaaaaaaaggggaaaaaaaagggggggggggggaaaaaaaggggccccccccc

SEQ ID NO: 5807 - DNA, 390 bp, Zea mays
  Clone ID: LIB148-064-Q1-E1-F6
acccacgcgtccgcccggcgctccctttgccgtggtgggggcgggccggccgcggtgcgctcgtccgcgcccgcgcccgcgccgtccgcgcggcgctacggcccccgagccagtggtccgtcgggagctggcggggccgcccggcgcagcagcagcccgagtacccggacaaggcggacctggaagacgtgctgcggacggtgggaacgttcccgcccatcgtcttcgccggcgaggcgcgcaccctcgaggagcgcctcgcggaggccgccgtcggccgggccttcctcctccagggcggcgactgcgccgagagcttcaaggagttcaacgccaacaacatcagggacaccttccgcgtcctcctgcaaatgtccgttgtgctcatgt

SEQ ID NO: 5808 - DNA, 196 bp, Zea mays
  Clone ID: LIB148-042-Q1-E1-D11
acaacaagggcctggccttctcggaggcggagcgcgacgcgcactacctgcggggcctgctgccgcccgcgctggcgtcgcaggagctgcaggagaagaagctcatgcacaacctgcggcagtacgagcggccgttgcaccgctacatcgccatgatggacctgcaggagcgcaacgagaggctcttctacaagct

SEQ ID NO: 5809 - DNA, 361 bp, Zea mays
  Clone ID: LIB148-034-Q1-E1-A6
aaggcgcagtacgcggtgcgcggggagctgtacctccgcgcctccgagctccagaaggagggcaagaagattatcttcaccaacgtcgggcaaccgcacgccctcggccagaagccgctcaccttcccgcgccaggtggtggcgctgtgccaggctccgttcctcctcgatgaccccaatgtcggcctcatgttcccgcccgatgccatcgtgcgggccaagcgctatctcgccatggcgccgggaggtctaagtgcgtacagtgatgcccgtggtatccccggaatcaggaaggaagttgctgacttcatccacaagcgtgatggatatccgagtgatccagaactcatttacctcacag

SEQ ID NO: 5810 - DNA, 404 bp, Zea mays
  Clone ID: LIB148-002-Q1-E1-B9
gaaagatggcattctgtgcccaattcctcagtaccccttgtactcggcctccatagctcttcatggtggagctcttgtcccctattaccttgatgaaaaaactgggtggggtttggagatctctgatcttaagaaacaactcgaagatgctcggtcaaaaggcattgatgttagggccttggtggttatcaatccaggaaatccgactgggcaggttcttgctgaagacaaccaatatgatatagtgaaattctgtaaaaatgagggccttgttcttctagctgatgaggtatatcaagagaacatctatgttgacaacaagaaatttaactctttcaagaagattgcaagatccatgggatacggcgaggatgatctccctctagtatcatttcagtctgtct

SEQ ID NO: 5811 - DNA, 411 bp, Zea mays
  Clone ID: LIB148-034-Q1-E1-F3
acgcccacctggagagctactcgcgcgtgctcgagagcctggcgtacagcgtcatgtcccgcatcgaggacgtgctgagcgcggacgcggcggcgcagaacctgacggcgagcgaggcggcgcggcgagcgctggagtcgacgtcggcggagctgcccgcggcgcggaagctggacgccaaggaggagctggagaagctgaacgaggccccggcgtcgatgacgctgttcgacttcatgggctggcacttcgaccaggacgagctgatgaagcgcagggaggacggcacactggacgcggacggggaggccatgctcctcaagaaggcgcctagcatggcccccaagaagttctcctacgtcgacagcctctcctccggcggcatgaggagcccctccgcgcgccactgat

SEQ ID NO: 5812 - DNA, 417 bp, Zea mays
  Clone ID: LIB148-032-Q1-E1-H8
ccacgcgtccgcgggtacgccctcctggagagctactcgcgcgtgctggagagcctggcgtacagcgtcatgtcccgcatcgaggacgtgctgagcgcggacgcggcggcacagaacctgacggcgaccgaggcggcgcggcgggtgctggagtcggcggacctgctcgcgccgcggaagctggacgccaaggaggagctggagaagctgaacgaggccccggcgtcgatgacgctcttcgacttcatgggctggcacttcgaccaggacgagctgatgaagcgcagggaggacggcacgctggacgccgacggcgaggccatgctcctcaagaaggcgcccagcgtggcgcccaagaagttctcctacgtcgacagcctctcctccggcggcatgaggagcccctctgcgcgccac

SEQ ID NO: 5813 - DNA, 415 bp, Zea mays
  Clone ID: LIB148-032-Q1-E1-A4
gttttgtttgttgtccgcctggcgcctggccccataactactctgccacaatccggggaagaatcaacctagcggtaagcggacatggcggcggcgaagatagcgccgtcgatgctctcgtcggactttgccaacctcgcttcggaggctgagcgcatggtccgcctaggcgccgactggctacatatggacatcatggatgggcacttcgttcctaacctgactattggggctccggtgatccagagcttgaggaaacataccaaagcatatttggactgccatcttatggtcacaaagccttcagattacgtagaaccatttggaaaggctggcgcttctggattcacattccatatagaagttgctagagacaactggcaagatctcatccaaagcattaaatcaaagggta

SEQ ID NO: 5814 - DNA, 408 bp, Zea mays
  Clone ID: LIB148-057-Q1-E1-H7
atcgtttaagaaattcgccgcttgatgtgtggatccgtcgcggctgccgtcaagcatagacaccaagaaccagacctcggggtggatcatcggggtcgcggaggtctactggatggggtcaagaagtatccgggcaagtcgtctctgggaaccctgcttattgctcgccggatgctagcgccgccgtggactgcgcggctccgagaagtcgaggtcgtcgcgacatatcccaggaaccttcggacttggaacgaagctgtccataatatggaaagcatgattgggacgaaggtcgaatcaattctgaagctatgcgcaaggaagcttcggctcagtagcagaaaaaggaaccgacctaaaaaggaaaaggctatttagtcctcgatagattgtccttaagtcaattgt

SEQ ID NO: 5815 - DNA, 398 bp, Zea mays
  unsure at all n locations
  Clone ID: LIB148-041-Q1-E1-A7
ggaggcgacagtgcgtgcgtgcagccacaggcaggcgtcggcaccatgtcttctttcaccggcacgcaggacaagtgcgcggagtgcgacaagaccgtccacttcatcgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgancaggggccccagcaagctatcatcctgcgtttctggtactcaggataagtgtgcagcttgccaganaacagtgttaccgctgga

SEQ ID NO: 5816 - DNA, 395 bp, Zea mays
  Clone ID: LIB148-043-Q1-E1-D6
aacgagagtgcgtgcgtgcagccacaggcaggcgtcggcaccatgtcttctttcaccggcacgcatgacaagtgcgcggagtgcgacaagaccgtccacttcatcgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaagggcccccagcaagctatcatctgcgttttctggtactcaggataagtgtgcagcttgccagaaaacagtgtacccgctgga

SEQ ID NO: 5817 - DNA, 364 bp, Zea mays
  Clone ID: LIB148-028-Q1-E1-F5
gtgcagccacagacaggcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcatgccagaaaac

SEQ ID NO: 5818 - DNA, 342 bp, Zea mays
  Clone ID: LIB148-028-Q1-E1-B8
gcgagagtgcgtgcgtgcagccacaggcaggcgtcggcaccatgtcttctttcaccggcacgcaggacaagtgcgcggagtgcgacaagaccgtccacttcatcgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaagggcccccagcaagctatcatctgcgtttt

SEQ ID NO: 5819 - DNA, 406 bp, Zea mays
  Clone ID: LIB148-016-Q1-E1-A11
actacgtgcgttcgtgcagccacagacaggcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcatgccagaaaacagtgtacccgctggagaagttaactctgg

SEQ ID NO: 5820 - DNA, 409 bp, Zea mays
  Clone ID: LIB148-048-Q1-E1-E4
acggcacgcaggacaagtgcgcggagtgcgacaagaccgtccacttcatcgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaagggcccccagcaagctatcatctgcgttttctggtactcaggataagtgtgcagcttgccagaaaacagtgtacccgctggagaagttaactctggaaggcgagtcctaccacaagagctgcttcaagtgctcgcacgggggctgcatcct

SEQ ID NO: 5821 - DNA, 417 bp, Zea mays
  Clone ID: LIB148-018-Q1-E1-D2
cgggattgtgggcgagtgcgtgcgttcgtgcagccacagacaggcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcatgccagaaaacagtgtacccgctggagaagttaactc

SEQ ID NO: 5822 - DNA, 388 bp, Zea mays
  Clone ID: LIB148-018-Q1-E1-B10
agggcgagagtgcgtgcgtgcagccacaggcaggcgtcggcaccatgtcttctttcaccggcacgcaggacaagtgcgcggagtgcgacaagaccgtccacttcatcgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaagggcccccagcaagctatcatctgcgttttctggtactcaggataagtgtgcagcttgccagaaaacagtgta

SEQ ID NO: 5823 - DNA, 382 bp, Zea mays
  Clone ID: LIB148-010-Q1-E1-E3
aggcgacagtgcgtgcgtgcagccacaggcaggcgtcggcaccatgtcttctttcaccggcacgcaagacaagtgcgcggagtgcgacaagaccgtccacttcatcgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaatggcccccagcaggctatcatctgcgtattctggtactcaggataagtgtgcagcttgccagaaaaca

SEQ ID NO: 5824 - DNA, 336 bp, Zea mays
  Clone ID: LIB148-052-Q1-E1-A5
cggacgcgtgggcccgaaggcaaatatgtggtggatatagataagagcattgatatcactaagatcacaccttcaacaagagttgctcttcggaatgacagctatatgctccatctgatcctaccaagcaaagttgatccattggtcaatctcatgaaagttgagaaggttccggattctacctatgatatgattggaggccttgaccagcaaattaaagagatcaaagaggtcattgagcttccaatcaaacatccggaactgtttgagagccttggaattgcgcaaccaaagggtgtccttctttatggacctccgggcacaggaaagacattg

SEQ ID NO: 5825 - DNA, 418 bp, Zea mays
  Clone ID: LIB148-065-Q1-E1-H11
caacgcgtccgcggacgcgtgggcgggaggcgagagtgcgtgcgtgcagccacaggcaggcgtcggcaccatgtcttctttcaccggcacgcaggacaagtgcgcggagtgcgacaagaccgtccacttcatcgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaagggccccagcaagctatcatctgcgttttctggtactcaggataagtgtgcagcttgccagaaaacagtgtacccgc

SEQ ID NO: 5826 - DNA, 408 bp, Zea mays
  Clone ID: LIB148-037-Q1-E1-B6
gggcgagtgcgtgcgttcgtgcagccacagacaggcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcatgccagaaaacagtgtaccccgctggagaagttaact

SEQ ID NO: 5827 - DNA, 424 bp, Zea mays
  Clone ID: LIB148-009-Q1-E1-D8
agcgtcaccgtcctggtgatcacgcccagatcaaatcctattcaaatttggagcgcaatatggctgaagagaagagccgtccgcggctgaacgagcggatcatgtcgtccctctcaaagcggtcggtcgctgcgcattcctggcatgaccttgagataggacctggagcccctgctgttttcaattgtgttgttgagatcacaaagggcagtaaagtgaaatatgagctagacaagaagaccggaatgatcaaggttgacagggtgctatactcatcagtggtctacccacacaactacggtttcattccacgaacattgtgtgaagacggagatccaatggatgtgctggtgttgatgcaggaaccggtgatacctggctgttttcttcgggcaagggccatcggccttatgcccatgattga

SEQ ID NO: 5828 - DNA, 451 bp, Zea mays
  Clone ID: LIB148-049-Q1-E1-D6
ccgtatatagtgtttgcagtgctgttggcgttctgccattatctcttcagtatggctttccaattgtccagaaatttttggagggagcttccagcattgacaaccacttctactcatcttcatttgagaaaaatatacctgtacttcttggtttgctgagtgtgtggaatgtttcatttcttggttatccagctagggcaatattgccatattctcaggcacttgagaagttggcaccacatatacagcagcttagcatggagagtaacgggaagggtgtttccattgatggcgcccaactttcctttgagacaggtgaaattgattttggtgaacctggaactaatggccagcacagcttctatcaattaatccatcaaggaagggttatcccttgcgactttattggtgttgttaaaagtcagcagcctgtttacttgaaaagggaaac

SEQ ID NO: 5829 - DNA, 419 bp, Zea mays
  Clone ID: LIB148-016-Q1-E1-G5
aaaatcaagcagttttcagagacttttagaagtggatcatgggttggagcaactggaaaaccgttgacaaatgttgtgtcagttggaataggtggtagctttcttggccctctatttgtgcatactgcactccagaccgatccagaagcagcagaatgtgcaaaaggccggcaactgagattccttgcaaatgttgatccagttgacgttgcacgaagcattaaagatttggatccagaaaccactctggtggtggttgtatcaaagacattcacaacagctgaaacaatgttaaatgctcgaactcttaaggagtggatcgtttcttctcttgggccacaggctgttgccaaacatatgattgctgtcagcactaatcttaagcttgtgaaggagtttggaattgacccaaacaatgc

SEQ ID NO: 5830 - DNA, 384 bp, Zea mays
  Clone ID: LIB148-057-Q1-E1-E6
agactaaagcatagtatcatcagcaagggggcccctttctgtaccagagcctcagatcgtgatttcgtcataagccacgctgaattttatgccgtttcagattcgtggataagtgcaagtatcctgaagatggttcaccgcctagatccctgagatatatcggtagtatggttgctgatgtccatcgcaccttactagacgggggcatatttttgtacccagcagaccagaagagtccagacgggaaactacgcgttctgtatgaagtcttcccgatgtcattcctgatggaacaagctggaggccaggctttcacaggcaaacaaagggtgtgtttcagtttcccgttctcagaccccaatccccaactgaaaaatcttgatg

SEQ ID NO: 5831 - DNA, 210 bp, Zea mays
  Clone ID: LIB148-051-Q1-E1-H11
aaaaaacgtgcctctgcctgacgacgtacaatgttcatgggatgactgggaacatcactgcaccagttagcacatcgtcatgtgagctgggcaccaatccatatgatgggggttgtgtcctaccaggacagtatgagtattaccactgtattggagtagttcgcagttggggatacactcatgtccacacacagcacagcatcatgtgcc

SEQ ID NO: 5832 - DNA, 400 bp, Zea mays
  Clone ID: LIB148-051-Q1-E1-H12
agagcagcaaaccatgtagacagaagaaaagctaaaggactacatgttgaagtagtaatagttactgcagtactgcatctgatttgacttgttgtatggtaaattgcccgtccacgcaggttctatactttgaagattttgtaccttgtcagatatcacagtcctcttttgatgtgttgatgagcacagaccggcaaagctatggtttcaagttaaaaagaggtttgctggatgatgaaggaaatgcttttcttgagtgggatagtatgacatttgctcgtattgaaggtggattttctgtcgatccttgattttctctagccaatgctatgcaagaacagcagggatctcaacaagaaagataccttgtgaggaaggcactcaagtctgctctatctca

SEQ ID NO: 5833 - DNA, 389 bp, Zea mays
  Clone ID: LIB148-051-Q1-E1-H2
cttcgcatgctcagggttggatttgacgccccaaaaatcattggaatatgagaccatagtgagtgaacaagaagagaattactggtgtcttttactcgttgttggtaccgatctagacaccaatctagccaggtgtaccgtcatcggtgctttctgctcaggcgtggatagtccgcgacctgtgacaggagcgggatcttgtctacgccgaagccggacggtccacgggtgcgcagaggcggtggcgttcgccaacagcacctggatctaacctcccgaaagggaccccatcacgaagaagagatcatagggtttatcttgggattaacataccacccaagacacctttagacgacgtgaagccgaagagaggtgaaaataaagatgag

SEQ ID NO: 5834 - DNA, 139 bp, Zea mays
  Clone ID: LIB148-051-Q1-E1-H3
cagggactcgctgtcgtcttcgcccaaagggcccgacgtcgagctgccgcacgcgaacttcaccgtggaccgcctcatccagatgttcggcgccaagggggtcacggttcaagagctggtggcgctgtccggggcccaa

SEQ ID NO: 5835 - DNA, 344 bp, Zea mays
  unsure at all n locations
  Clone ID: LIB148-051-Q1-E1-H4
atcagggtcgagcacacgtacacgacattatcgatcgaaaactcgccctcgtccgggaagggtaaatttggtcctccccgggccgggtgttcaatggaaaaacaaccaacggtggccaagttcggcacctgggacagcggcgatcccgggtacacggcctacttcgacaaggtgcgcgagaacaagggcgccacggcgccgccgctgcgccggccgcgcagccccaacgaccccgaccccgaccgcgagcccgagccagaggaggggccaatgangagagtcccccgccgtcgtcgtcaaggccggcgaccgcgggaggccaccgcgagccgccgccgccgggg

SEQ ID NO: 5836 - DNA, 332 bp, Zea mays
  Clone ID: LIB148-051-Q1-E1-H5
agcattcagctcctcgttttttctctctcctctcttcgtccccgcgtggagaaggagagagagaaacaggggagcgcccccccactcctcttcgctgccaagaaaccaccattcctaacggatttctacccagtcttctttaggatttccgattcggttctccggtgagagggtgggaattttattttcctccgctgcaaccggtgcaaacatttcgaatccctccattgcattcctctccgtgcaatcggccattcatatgttccttggctgcattgaggcatcggtacgcgaattttgatgtgagctgaccagacatggctgcgaaagac

SEQ ID NO: 5837 - DNA, 381 bp, Zea mays
  Clone ID: LIB148-051-Q1-E1-H6
acgcattcagctcctcgttttttctctctcctctcttcgtccccgcgtggataaggatagatagtcacaggggagcgctccaccactcctcttcgctgcgaggaaaccatcattcctaacggatttctacccagtcttctttaggatttccgattcggttctccggtgagagggtgggaatttgattttcctccgctgcaaccggtgcacacatttcgaatcgctccattgcattcctctccgtgcaatcgggcattcatatgttccttggctgcattgaggcatcggtacgcgaattttgatgtgagctgaccagacatggctgcgaaagacggctcgggatcacaggatctgggggggcacacgttctggcccatgctg

SEQ ID NO: 5838 - DNA, 150 bp, Zea mays
  Clone ID: LIB148-051-Q1-E1-H7
tcgcgctggcgtccggggttgctggtccaccatgaccggcgggcctcggtacccgattccgctggggcgcaaggactcgctgtcgccgtctcccacagggtccgaagtcgagctgacgcacgtcaacttcatcgtcggccggctcatcca

SEQ ID NO: 5839 - DNA, 217 bp, Zea mays
  Clone ID: LIB148-051-Q1-E1-H8
ggcccccgaaggtgccgcccgttcccaacatcaccaccaactacaacggaaagtggctcaccgccagggccacctgatacggtcagcccaacggtgccagcgctcctgacaacggcggtgcgtgcgggatcaagaacgtgaacctgccaccctacagcggcatgacggcatgcggcaacgtccccatcttcaaggacggcaagggctgcggctcatg

SEQ ID NO: 5840 - DNA, 422 bp, Zea mays
  unsure at all n locations
  Clone ID: LIB148-052-Q1-E1-A1
gtcgtcgtcgtggtggtgcttgcggcagctccggagtccaggcagcacgctagtcggggggcgcgggggaagagatatggatcggtcgtatctccccgtggcggcggcggccgtcgccctggtcctcgtgtgctgctccggcctctgccgcggcgagcggctcggggcgagggagtgcgaggacctggggttcaccggcctcgctctctgctccgactgcaacgcgctctccgagttcgtcaaggaccaagagctggtggaggattgccataaatgttgcaccgaggattcagatgattctatcagcaagctcacattttctggtgcaattattgaggtgtgcatgangaaactggtattttatccagaagttgttggcttcctcgaagaagataaagacgacttcccatatgtgggaaccc

SEQ ID NO: 5841 - DNA, 203 bp, Zea mays
  Clone ID: LIB148-052-Q1-E1-A11
cggccccgacgccgtgccctacctccagccgctcctggccttcctgtccgcggcgcggtccccgttcctcatcaactgctacccctacttcgcgtacaaggccgacccgggcaacgtgccgctcgagtacgtcctgttccagcccgacgccgccggggtcaccgacgccggcacggggctcaagtacgacaacatgctgtacg

SEQ ID NO: 5842 - DNA, 392 bp, Zea mays
  Clone ID: LIB148-052-Q1-E1-A12
aacaatccttgcacccctcccctgcgtcaccccaccatatccggccagcccaacgaaaatgtcgcgcgccacagctgcggtcctcttctacatcctcgccgtcgctgccctcagcgcggccgaggcaccggcagagtcaccgaaggcaggcagtcctgccaagggaacggccgagtcaccgaaggcaggcagtcctgcagctcctgccaaggcacccgagtctgctgccacgagaactgcccccgctaaggcacctcaagccgcctccacccccgccgctgccgctgccccatcgtcgtcgtcgtctaggaagtctggtccagctgccgcgccgaccaccgccgcctctacaccgtcttcttccacggacgaagagttgagcccttcgccgt

SEQ ID NO: 5843 - DNA, 410 bp, Zea mays
  unsure at all n locations
  Clone ID: LIB148-052-Q1-E1-A2
ctccaacatcctcctggacgcggacttcaacgccaagctctccgacttcggcctcgccaagctgggccccatgggcgaccagagccacgtcagcaccagagtcatgggcacctacggctactgcgcccccgagtacgccatgaccggcaagctcaccaagatgtcggacatctacagcttcggcgtcgtgctgctcgagctcatcaccggccgccgcgccatcgacatggccaggccgtccgaggagcaggtcctacttaactgggcttcgcctctgctgagagacaagaggaggttcgtgaagctggccgacccgttgctgggcaacanggtaccagtgaaggcgctgtaccaggcgctcgccgtcgcgtccatgtgcctgcagganggacgctgcagccggccgggga

SEQ ID NO: 5844 - DNA, 323 bp, Zea mays
  Clone ID: LIB148-052-Q1-E1-A3
acaccctcgtgtgcgcggacgtcaacaccaagctctccgacatcgggctcgccaagctgggccccatgggcgaccagagccacgtcaccaccaaagtcatgggcaactaccgctactgcgcccccgaatacgccatgaccggcaagctcaccaagatgtccgacatctacaacttcggcgtcctgctgctccaactcaacaacggccgccgcgccatcgacattggcaggccgtccgaggagcaggtcctacttaactgggcttcgcctctgctgagagacaagaggatgttcgtgaaactggccgacccgtttctgggcaac

SEQ ID NO: 5845 - DNA, 430 bp, Zea mays
  unsure at all n locations
  Clone ID: LIB148-052-Q1-E1-A4
gcgctgcaagaacgccgaggacaactcgccgctctgctcggggaccaaggacgccgcctacaaacaactccgcaacatcgacgccttcaacaaccaagccaacaactggcaagacaagaaagtcaagcccaaaaggttcaactgcaaggaccttggcgattccttggcccaataacacgttgaagggtaacctgaacaagcaaaaggtaataaagacaaccgtgccaacacagggctcaagtacagatggactagatgcaagggcacgttctacaacctgctcaagttcngtgactcgccgtcganatcgatgctgccctacgtcaaggccgtcgccgccgccggcgtccgcgtgtgggtcctcagtggcgacctggacgcaatggttcccgtgatcgcgaagaagcggtccatggagaagctcggcctc

SEQ ID NO: 5846 - DNA, 408 bp, Zea mays
  Clone ID: LIB148-052-Q1-E1-A6
acccacgcgtccggcgcacacacacgcaaccagatctcccccaaatccagccgtcggcacctccgcttcaagatgcagatctttgtgaaaaccctgactggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatcttcgtgaagaccctgaccggcaagactatcaccctcgaggtggagtcctccgaacacattggaaacgtccaaggcaaagatcaaggacaaggagggcat

SEQ ID NO: 5847 - DNA, 417 bp, Zea mays
  unsure at all n locations
  Clone ID: LIB148-052-Q1-E1-A7
accaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccganggtcacaaggcctgc

SEQ ID NO: 5848 - DNA, 393 bp, Zea mays
  unsure at all n locations
  Clone ID: LIB148-051-Q1-E1-H10
aataaaccatagcatcaatcatgtctggtcgttcgtggacaataatggcgcctctcctagcgtcgatgctgctcgtcgggctcgccgcgggctccgaggangangangacggcggcggcaaaaagaagccccacgtcaaccacggcaagtttaaggcggagccgtggacggacgggcacgcgacgtactacggcgggcgcgacgggttaactgacaccacggacagcggcgcgtgcggctacaagggcgagctggggaaagactacggcaccctgacggcggccgtgggcccgtcgctgtacaccaacggcaccgggtgcggcgcgtgctacgagctcaagggccccaagggcaccgtggtggtgacggccaccaacgaggccccgccgccgg

SEQ ID NO: 5849 - DNA, 353 bp, Zea mays
  Clone ID: LIB148-051-Q1-E1-F5
gtacgtcgaacaaacacccaaggcctgacgagacgagatccggacctccgtcctcccaactagggcgcgcgcgcgacctcggcaccggcggcctcgatccatcgttctctcggatccccgccagtgcatgccctggaacggacggacggaatggcagcgtcgccggaccacctcttcggcctgcgcaacagcttctacgtcggcgcataccacgccgtcatcaccagcagccagtccctccccgcgcacgcgctctcccccgacgacctcgtcgagcgcgacgccctcatgtaccgctcctacatcgccatcggctcctaccagctggtgatcggcgagatcgggcccagcgc

SEQ ID NO: 5850 - DNA, 328 bp, Zea mays
  Clone ID: LIB148-051-Q1-E1-F7
aacacataaggatgttctttcattcttcttttttgttcccttgttgcatcaaattgtgccttaaccacgtcgatgtgctgccaaattgtcaatccctgatacggtcaatcatggatggaccgactgcaatataaatatattataccacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgcccaaaaggttcaaaccttacttacccttgaatgcaacttcaaagcccttcaaaagtgtcaccaaaattcaatt

SEQ ID NO: 5851 - DNA, 408 bp, Zea mays
  unsure at all n locations
  Clone ID: LIB148-051-Q1-E1-F9
atcgatcacaacaagatggcatgtatagacaatgcaatgagagccttgttccttctagcgctcttctgcaccgtgcatggtgagaaggcaaagtcaaaggacaacgattcaaaagcgtccgggcccggtgggtccttcgacatcaccaagttgggcgcctctggcaatggcaagacggatagcacgaaggctgtgcangaggcgtgggcatcggcgtgcggcggcaccgggaagcagacgatcctcatccccaagggcgacttcctcgtcggaccactcaacttcacaggcccatgcaagggcgacgtgaccatccaggtgaatggcaatctgctggcgaccacggacctaagccagtacaaggatcatggtaattggatcgagattctacgcgtggacaaccttgtc

SEQ ID NO: 5852 - DNA, 404 bp, Zea mays
  Clone ID: LIB148-051-Q1-E1-G1
gcggcgacgagcgtcagcaaggggctctacgagttcagcccgttcctggtgcagctgcaggactgctccttcgtgcgagagacattcacgtccatcaccaactataactgccccggcctcgagcagtacagccgggacgtctacgtcggcctggtcgtcatctctgccggcgtcatgctgtccgtcgtcttctggatggttcacacacggcaccgacggcggcgcgccatgcgcaagcagctgtgactgagatcttgatggcgcgccaggccacgccacgattgagctttagctgttacaaccgtggtccacgcatccgtttcaaatttgtacaatactcactcggttctaaaattaatcgttgtcgtttaatttctaaaaaaaaaaaaaaaaaaaaagggggg

SEQ ID NO: 5853 - DNA, 415 bp, Zea mays
  Clone ID: LIB148-051-Q1-E1-G10
agaggtcaagagagcattcgaagcactcaatcaagcccagacatatatagaatgagaacgggcaatggattacctgcgttgaggcacccaatagtagatggaagtatagagaacgactcggcattgggagatttcgctgagcactcgccattcgggagcagcaattcgctgccagagttgggaccagatggcacacaagatctagccttctaccaaagaagcagccctgaacagcaatggagctggtccgggtctgttgcaacagaggattccgatgacttcgaggttgcaacgaattgctcgtcagatctggattgcgtgagaccatctagtgccccaaaagcttctggtttaacaaacggagggggctcagctgcaagaaagtcccaactgaagggtgcaaaaagttcagaca

SEQ ID NO: 5854 - DNA, 423 bp, Zea mays
  unsure at all n locations
  Clone ID: LIB148-051-Q1-E1-G11
aaaccatccctgcaaattaccgcgatggctcccaaggtcctagtcatccttgtgttcctcgccgtggcctcaccggctgctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttctcagttacttcgaccccatcaagctggacgagatgaagacacgcaccgccatcctccccacgctgctctccgtcancgacaaganactcggcgtcctcaactacaccagggccgacgacgggcaaatgtacttcggc

SEQ ID NO: 5855 - DNA, 432 bp, Zea mays
  Clone ID: LIB148-051-Q1-E1-G12
atcagaatttgtgctgcttgagtccaattcaacttttaccggcataaagaaggaccttcacttcaaggaaaaccgccaacggtttggctttgcagagtcacggttgacctatggcatgataggtggaaggtttgtgaagggagagaacccatttgtcgaggagtcgtatcaaagggttgctctcgaccagctcattaagattgcgggcatcacggatgacgacctgctgatcatgtctgatgttgatgagatcccaagtggacacaccatcgacctcttgagatggtgcgatgacgttccggagatactccatctccagctcaggaactacctctactcgttccaattcctacttgacgacaagagctggaaggcttcagtgcacagatacagagctgggaagacgaggtatgcaacattccggcagacgga

SEQ ID NO: 5856 - DNA, 383 bp, Zea mays
  Clone ID: LIB148-051-Q1-E1-G2
cgacacatgatcaaaccagtggcatttgagcttggcattcctcctgaaaacatcactgcaaaccaattgttatttggcacattgggggagtacgccggatttgatcccacagagcccacttcacgcagtgggggtaaagcaaaagcagtgcagcaaataaaacaggaccatggctacaagacagttgttatgattggtgatggcgcaactgatctggaggctcggcaacctggcggagcagacttgttcatctgttacgccggggttcagatgagagagccagtcgcagcacaagctgactgggtggtttttgattttcaagagctgatcactaagttgccatgaattcattacctaccgcaatttatgaacctttgcattgt

SEQ ID NO: 5857 - DNA, 400 bp, Zea mays
  Clone ID: LIB148-051-Q1-E1-G3
cacatgataaaaccagtggcatttgagcttggcattcctcctgaaaacatcactgcgaaccaattgttacttggcacattgggggagtacgccggatttgatcccacagagcccacttcacacagtgggggtaaagcaaaagcagtgcaccacatagcacaggaccatggctacatgacagttgttatgagtggcgatggcgcaactgatctggaagctcggcaacctggcggagcagacttgttcatctgttacgccggggttcagattagagagccagtcgcagcacaagctgactgggtggtttttgattttcaagagccgatcactaacttgccatcaattcattaactaacccaatttatgaaacctttgcatttgcccggcaaagaaattgcgg

SEQ ID NO: 5858 - DNA, 427 bp, Zea mays
  Clone ID: LIB148-051-Q1-E1-G4
cccacgcgtcagacgccgtctcccccgcgtccgccgactaccgccgcctcctcgcgcagctatcctccgcgggcctcttcgaacgcgtcagccccacccccaaggtccagctcgtcctgatggccgtcctcttctacgccgcgctgtacctcgtcctcgcatgcgccagcgcctgggcgcacctcctcgcggggggtctcattggcttcgtctggatccagtccggctggatgggccacgactcgggccaccaccgcatcaccggccatccggtcctcgaccgcgtcgtgcaggtgctctccgggaactgcctcaccggcctcagcatcgcctggtggaagtgtaaccacaacacgcaccacatcgcctgcaacagcctggaccatgacccggacctccagcacatgccgctctttgccgtctcccc

SEQ ID NO: 5859 - DNA, 326 bp, Zea mays
  Clone ID: LIB148-051-Q1-E1-G5
agtctgatgctcagaactcatcactcttcgtaaagattttggtgattgagatcttcggcagcgctctgggactgttcggtgtcattgtgggcatcattatgtcatctcaagcgacatggccagcaaaagcttgattttcaccatttgtagctctgtaaattattcagatggagtgtatccaaatgtgcatgtggtccaactgcattttcatgttccttttatgtggcgtcctttttggcaaaacacgaaatgcggcgcgcgtaacgccaacgattgtaaaattgccaatcctaatgccggagtactccaagtgtgttggagaacct

SEQ ID NO: 5860 - DNA, 335 bp, Zea mays
  Clone ID: LIB148-051-Q1-E1-G6
aatttcgagtaccacagttgagcgccacgatgggatccctcgctaataacatcatgggcgtggctgtcgtccttgcagcgctcgtcgccggcgggtcatgcgggcccccgaaggtgccgcccggtcccaacatcaccaccaactacaacggcaagtggctcaccgccagggccacctggtaaggtcagcccaacggtgccggggctcctgacatcggtggtgcgtgcgggatcaagagcgtgaacctgccaccctagagcgccatgacggcgtgcgggaacgtctccatcttcaaggaccgcaagggctgcggcgcatgcgacgacgtgatatgc

SEQ ID NO: 5861 - DNA, 393 bp, Zea mays
  unsure at all n locations
  Clone ID: LIB148-051-Q1-E1-G7
accacgcgtccgcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggttgacgacgggaacggcacgtacacgatcgagctcanggacagccacgaggaggacatctg

SEQ ID NO: 5862 - DNA, 379 bp, Zea mays
  Clone ID: LIB148-051-Q1-E1-G8
agttcaatagacatacattttattaaatatgcagggcatcgtagaagagaatggttctcccttccaaaaagcaaaacaaaagaaactcgtatagtcgatcgacgaccatgcatcacatttccttttcctcgatcttctcttatttccgcagaaaaacaacgaaggaaacccaaccaaggaaacgcatgctattgcttaagcatcgccggaggagctggtcgatcgctcgctcactcacgggcctgattgttccggtcacctgtcgtcgtcgtcgagctgagacacgctcctccagaagcccgtgccgtagaacctggcccacacctccttctcaagctcccccgtctcctccagctgcaaggcgggcttcaccggcagc

SEQ ID NO: 5863 - DNA, 430 bp, Zea mays
  unsure at all n locations
  Clone ID: LIB148-051-Q1-E1-G9
atcgtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcanggacagccacgaggaggacatctgcgaggtggtcttggtggaaagcccgcgcaaagactg

SEQ ID NO: 5864 - DNA, 350 bp, Zea mays
  Clone ID: LIB148-051-Q1-E1-H1
accacgcgtccgcccacgcgtccgccggcaccgtcgagctcggctgtggaaacagaacaaacccatcaaccatggcgaactcggcgtcggggatggccgtgagcgacgagtgcaagctcaagttccaggagctcaagtcgaagcgaagcttccggttcatcacgttcaagatcaacgagcagacgcagcaggtggtggtggacaggctggggcagccgggcgacacctacgacgacttcaccggctccatgcccgagagcgagtgccgctacgccgtcttcgatttcgacttcaccaccgacgagaactgccagaagagcaagatcttgttcatctcctggtccccggac

SEQ ID NO: 5865 - DNA, 419 bp, Zea mays
  unsure at all n locations
  Clone ID: LIB148-051-Q1-E1-F4
accacgcgtcagatcgcggcggcgccctttttttttttttttgccccgtaaagatggggattcattaacaaccggctactgcagtttcttactagtagtacanattatacatcactagtttacgcaagagcttgctcaaaaagagagtacatgggattactactcctccctatacatcgatcgatacaagtacaaggcgcgcgcgcagcggcgtgccatgccggttcaagcgcgcggccggccatgtgcgcgcgtgttgggcccgggcacatcaaaagctcggtacgacgccgtagccgaagtcgagcacatatgacatcggcacggcggcctcggcctcggcctcagcgtcgtcngcgtcggcgtcnccgtcgtggtcagcacgcttggcaaaccggcccttgatttcgcggcgctct

SEQ ID NO: 5866 - DNA, 429 bp, Zea mays
  unsure at all n locations
  Clone ID: LIB148-051-Q1-E1-E10
atcgtgagcagcgacaagaccatcgacgggcgcggagcgcaggtgcacatcgtgggcgcgcagatcacgctgcagaacgtgcgcaacgtgatcctccacaacctgcacgtccacgacgccgcggcgcacggcggcggcgcgatccgggactcgcagcaccactggggcgtgcgcggggagagcgacggcgacggcgtctccgtgatggggtccagcgatatctggatcgaccacctgtccatgagcagctgcgcggacgggctggtggacgcggtggacggctccaccgccatcaccgtctccaacggccacttcacgaggcacgaccacgttatgctgttcggggccagcgacgccgcgtccaaggacagggagatgcanggtcacgtcgccttcaancacttcggcaaagggctggtgcagcggatg

SEQ ID NO: 5867 - DNA, 416 bp, Zea mays
  Clone ID: LIB148-051-Q1-E1-E11
agggagggatgatgtggccgccgtcgacgacgccgtggctcccgttcctgtacccggcgccggcgtcggcgtacgtggcggcgatgtcggcggtgtcgttcgtgtccatggcgaacgcgggcctcgccgagctccgcggcgaccacatgccctactccaagttctggcacgccgtggcgggtgccgccggcggggacaccaggcagcggggcgggatgccgctcctgcgaagccgggacggcatgctgctggcctacgccccggcgctgctcgccgccgccgcgtccttcgcggtgccgggcgccgtcgagggcgcgcgcgccgagctgctcagcgccgcgctcgccgcgcacttcctcaagcgggtcctcgaggtgctgtgcgtgcaccggtacagcgggagcatgccgctgggc

SEQ ID NO: 5868 - DNA, 429 bp, Zea mays
  Clone ID: LIB148-051-Q1-E1-E12
gtttgatttccagaagtacatcaagcggtctctggaggatgacttcaaggtgatcgtggggatcagtcctcctctgtgggcttctgctctcatcttcctcttcctcaacgtcaatggatggcacaccatgctctggatctccatcatgccggtggtgatcatcctgtcggtggggacgaagctgcagggcatcatctgccgcatggcgatcgacatcacggagcgccacgccgtcatccagggcatcccgatggtgcaagtcagcgactcctacttctggttcgcacgccccaccttcgtgctcttcctcatccacttcaccctcttccagaatggcttccagatcatctacttcctctggattctgtatgagtacggcatggactcgtgcttcaacgactcggaagagttcgtccttgcacgactctg

SEQ ID NO: 5869 - DNA, 359 bp, Zea mays
  Clone ID: LIB148-051-Q1-E1-E2
acacacacacaaccagatctcccccaaatccacccgtcggcacctccgcttcaagatgcagatctttgtgaaaaccctgactggcaagactatcaccctcgaggtggagtcgtctgacaccattgacaacgttaaggccaagatccaggacaaggagggcatccccccagaccagcagcggctcatctttgctggcaaacagcttgaggacgggcgcacgcttgctgactacaacatccagaaggagagcaccctccaccttgtgctccgtctcaggggaggcatgcagatctttgtgaaaaccctgaccggcaagactatcaccctcgaggtggagtcctctgacaccattgacaacg

SEQ ID NO: 5870 - DNA, 391 bp, Zea mays
  Clone ID: LIB148-051-Q1-E1-E3
attcgtggatagcggtgccacaacctctcctgctgtcgctgctggtcgccgtgctagcggtggccgccgatgtcgccaacgccggccacgccaagcccctaacgcctggcgggcgcgtggtacacgacaaccacggcaagttcacggccgggccgtggaaacccgcccacgcaaccttctacggcgggcgtgacgggtccggcaccacggcgggcgcgtgcgggtacaaggacacgcgcacgcaggggtacggcgtgcagacggtggccgtgagcactgtgctgttcggtgacggcgcggcctgcggagggtgctacgaggtgcggtgcgtggacagccctagcgggtgcaagcccgacgcggcagcgctggtggtgacggtgaacgacct

SEQ ID NO: 5871 - DNA, 372 bp, Zea mays
  Clone ID: LIB148-051-Q1-E1-E4
ggtttgtgcaacacccgctcaccttccaggtcggtaagggatccaagcctggccacctgatcctcaccccgaacgttgccaccatatccgacgtggagatcaaagagcatggtggcgatgacttctcctttacgctgaaggagggcccgaccggcacctggacactcgacaccaaggccccgctcaagtaccccctttgcatccgctttgctgtcaagtctggtggctaccgcatcgccgacgacgtcatccccgccgatttcaaggctggcaccacttataagacgacactcagcatctaatcagcatctgaagatgaactatatttcaaaagagctcatctggcgcacgtgttagcaagacaattttttt

SEQ ID NO: 5872 - DNA, 345 bp, Zea mays
  Clone ID: LIB148-051-Q1-E1-E5
aagcgctcaccgtccttcggtaggtgcattgcttcggtggtccatcatggcgcagcgagcggtggccacgatgacgactaagaagctcctcctcgtcatcacgctggcgtccgcactccatggcacagcgccagacgccgcgaatgctcccggcggggcgttcagcaactgggtggcgatgaaccagcagacctacgcgctgtacgcgcataagtccgtcagggacggtcgcaaagagcccctggacaagaagctgtctgatgcggacaataagaacgtcacgtacgtggtggaccccagctgtaatggcgattacaccaatatcaccgtggcgctagatgatat

SEQ ID NO: 5873 - DNA, 173 bp, Zea mays
  Clone ID: LIB148-051-Q1-E1-E6
acgcgctcgccgtccttcggtaggtggattgcttcggtggtccaccatggctcagcgagcggtggccacgatgacgattgtgaagcccatcctcgtcctcacggtggcgtctgcgctccatggcacggcgccggccgcggcgaatgcgcccggcggggcgttcagcaactggg

SEQ ID NO: 5874 - DNA, 382 bp, Zea mays
  Clone ID: LIB148-051-Q1-E1-E7
agcgatatctggatcgaccacctgtccatgagcagctgcgcggacgggctggtggacgcggtggacggctccaccgccatcaccgtctccaacggccacttcacgaggcacgaccacgttatgctgttcggggccagcgacgccgcgtccaaggacagggagatgcaggtcaccgtcgccttcaaccacttcggcaaggggctggtgcagcggatgccgcgctgccgtcacggcttcttccacgtggtgaacaacgactacacgcactggctcatgtacgccatcggcggcagccggaaccccaccatcatcagccagggcaaccgcttccgcgccgtcgacgacagcaggttcaaggaggtgaccaagcgggagtacacgc

SEQ ID NO: 5875 - DNA, 378 bp, Zea mays
  Clone ID: LIB148-051-Q1-E1-E8
acccacgcgtccgcggacatcgacgaaagctagccagctagtaacaagaacaaaaaacaccatcatctcatccgcccgtctcaacgccaccctagccctgtgatatacaatggcggcccagagcacgaggatggtggcgctggccctggtggtcctcctggtggtggcgacggcgttggtgcccacggccaccgcgtacggctgctacgacgactgctacgagcggtgcgccaacggcaagaaggacgaccccgcctgcaccaagatgtgcaaccaggcgtgcggcagcaccgacaagggcgccgccgccggcgcgccggcttgatcgacccgggctttatcggcgcgcgggctcagctcgatatcatcatatacaat

SEQ ID NO: 5876 - DNA, 394 bp, Zea mays
  Clone ID: LIB148-051-Q1-E1-E9
aaatggcgttattgtatatctctctattcccgctaactgtacaaaactttgtatttgcacacagaatgtacacggaggtaaatattccccatacataccctggaacaaattgtactaattgtcacagattgactgcactcacaattacacagcattcttttggacatttggtgggtaaatatgaaatctctttgggaatatacctgtatatgcagtggtagagaatatcgctgttccttttatggtggatgcactggaaagggaagaattgtactctgaccagccacagcatctcttttgatcatgtccatattctgctgtcagtgaaaaaagagatttcattatgtcatttaacacggatcaccaattatgtgagcaggggtgtctgacattt

SEQ ID NO: 5877 - DNA, 390 bp, Zea mays
  unsure at all n locations
  Clone ID: LIB148-051-Q1-E1-F1
cccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggcaccggcgacctcagcgcgtaccaaaggaactggatcgagatcgagaacgtcgagaacctgtccatcaacggccacggcaccatcgacgggcaaggagccctggtgtggagcaagaaccagtgccagcattcttacaattgcaagatcctcccgaatagcttggtgctggattttgtgacgaacgtccagattcgcggcatcacgctgctcaacagcaagttcttccanctcaacat

SEQ ID NO: 5878 - DNA, 320 bp, Zea mays
  Clone ID: LIB148-051-Q1-E1-F10
atctacccaaaccttgaaaattgctttgtcagtcacacacatgtgttcgtgcctccagcaagatgatccgatcgtggtcgtgctagtgttcttgatggacggcactgtctcacggacgccgtaatatccttgtatctcctcatatcaccaccagttataacaatgactgcctggatgctaataccaaatcgcatgcaaaccttactgatgccgatcgcgacgaaacaggtgacggctacgaatgcagagacgtgcacagacaccgcttcaattccatgcgtacatccgactctatagttatctggattgagcgtcagcat

SEQ ID NO: 5879 - DNA, 422 bp, Zea mays
  unsure at all n locations
  Clone ID: LIB148-051-Q1-E1-F11
gtggatggcggcgccacgacctctcctattgccgctgctggtcgccatgctagcggtggtcgccgatgtcgccaacgccggccacgccaagcccctgacgcctggcgggcgcgtggtacacgacaaccacggcaagttcacggccgggccgtggaaacctgcccacgcgaccttctacggcgggcgggacgggtccggcaccacggcgggcgcgtgcgggtacaaggacacgcgcgagcaggggtacggcgtgcagacggtggctgtgagcacggtgttgtttggcgatggcgcggcctgcggcgggtgctacgaggtgcggtgcgtggacagccccagcgggtgcaagcccgacgcggcggcgctggtggtgacggcgaccgacctgtgcccgnccaaggacaagtggtgcaagccgccgc

SEQ ID NO: 5880 - DNA, 416 bp, Zea mays
  Clone ID: LIB148-051-Q1-E1-F12
atcctgcggaggctcggcgccgacatcgaccctgaccgcctaccgcaaatcctgtacgaagacgaggaccgggacaaggtggtgctcgcgtcggacgacgacctcgcggcggcggtggaacacgccaggctcgccggatggaagggtctgaagctgttcctggactactccggcaccaccgggcgcaggaaagcggtggccaccccacgtggcgccatggcggtgggcatgtccagccgggacgcgtgggcggcggcgtacagcggggtcgccgccggggctgccctcgtcactggcatcggcgtcatggcgtacctgcgaagatctgcctagctagtgtggtggcgcggcggcgcggcgcgcatattcgccaatgcaagagcaaggggtcctgtcctgcctttcgaatcacacag

SEQ ID NO: 5881 - DNA, 380 bp, Zea mays
  Clone ID: LIB148-051-Q1-E1-F2
acggccgtcgagcgagcagtctcccaattccacccaataactaataacatctcctcgaacgccaggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggccggtggtgcggctggccctagcgcaagcggcgccgccgccgccgccgtgcccgccgccggggcgctcgtcgcctccttcctcgcctactacctccactgagcgacgacgcgcggggcggcaacgttgggatgcatcgtgtttggttcatccgat

SEQ ID NO: 5882 - DNA, 367 bp, Zea mays
  Clone ID: LIB148-051-Q1-E1-E1
accacgcgtccacccacgcgtccgcccacgcgtccggctaccctcgtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcactttcgcaacggcaagctcgagcgctccat

SEQ ID NO: 5883 - DNA, 356 bp, Zea mays
  unsure at all n locations
  Clone ID: LIB148-051-Q1-E1-F3
atggtgatggacttcgtgaacaacggggaggtgtccggggtcacgctgctcaactccaagttcttccacatgaacatgtaccggtgcaaggacatgctgatcaaggacgtgaccgtgacggcgcccggggacagccccaacacggatggcatccacatgggcgactcatccgggatcacgatcaccaacaccgtcattggcgtcggtgacgactgcatctccatcggccccgggacctccaaggtgaacatcaccggcgtgacctgcggccctggccacggcatcagcatcggcagcctanggcggtacaaggacgagaaggacgtcacggacatcaacgtcaaggattgcactct

SEQ ID NO: 5884 - DNA, 429 bp, Zea mays
  unsure at all n locations
  Clone ID: LIB148-051-Q1-E1-C12
aacacgcgtccgcccgagggtgcccctcccactctcgcgtcggtcccgcgatgggcctgttctcatcggccgctaagagatgtagaaagtgcaagaagttcctccgcagcgcgggcgcgtgctgctgctcgccgtcggcctcctccgcccctgctggtggtgtgcgcggcaacgaagaggcgtcgacgtcggcgctggcttccgcgccagatggcaagaaaaagaagaggtggaggaagagaaagttctggagaaagaagaagaaggccaagaaggagagcgacgatggcagcggcgagctcgtggatctcgtcaacagcttctcggccaagtccgacgtgtgcaagaacgtgaatgcggccgaggagatcctacggggctgcaaccagaacatggccagcagggcgctgacgttcagcnagctgggcg

SEQ ID NO: 5885 - DNA, 355 bp, Zea mays
  Clone ID: LIB148-051-Q1-E1-C2
cagggcccagggccgagcaacctggtgctccgcccctcgccgttacagcggcgcctcggcctccggttccacagcgtctgcctgcctgcgcggccctgtgaccgtgaggcgacacgacgccgagagatcacccgccccccgcatcgtgtccgccccgcttgggattgtgaggtaaagcgtgatggcagcgccgccggcgagggctcgagccgactacgactacctaatcaaactgctcctcatcggagacagcggcgttggaaaaagttgcctcctgttacggttttcagatggatcattcaccactagcttcattaccactattggcattgacttcaagataagaactgttgag

SEQ ID NO: 5886 - DNA, 370 bp, Zea mays
  Clone ID: LIB148-051-Q1-E1-C3
ctcctcgcctcctccattgaccaacaattaagcctccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaacgtcat

SEQ ID NO: 5887 - DNA, 377 bp, Zea mays
  Clone ID: LIB148-051-Q1-E1-C5
gaaacaatccttgcacccctcccctccgtcaccccaccacatccggccagcccaacgaaaatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgcctccacccccgccgttgccgctgccccatcgtcgtcgtcgtctaggaagtctggtccagctgccgcgccgaccaccgccgcctctacaccgtcttcttccacggacgaaga

SEQ ID NO: 5888 - DNA, 258 bp, Zea mays
  Clone ID: LIB148-051-Q1-E1-C6
aacacactccttgcaagcctcgactcggtcagtccatcatatcgggacagcctgagagagtgatgtcgcgcgcgacagttgcagtcctcttctacgtcctcgcggtcactgccctcagcatggacgaggcatgagcagagtcaccgcatgcaagcagtcttgcaagtgcatgcggtcgatgtcaccattacgcaggcatgtcttataaggcctgccaaggcacccacagtctgcagcaaccataactgctaccgttaa

SEQ ID NO: 5889 - DNA, 364 bp, Zea mays
  Clone ID: LIB148-051-Q1-E1-C7
acagacacttgggttagccaccctcgtctcaccctccctccctcacacaaataataaggaaaggtcccgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcg

SEQ ID NO: 5890 - DNA, 320 bp, Zea mays
  Clone ID: LIB148-051-Q1-E1-C8
cccacgcgtccgggtgtcggccaagaacggcatgcacaagcgcgtcggcagcctgccccgcctgcgcgacttcctgcgcggctcgctcaacccgtccaactacgtggaggtgcgcaagaaccggtcggcgctgtggatccggcacagcgacgccgtgtcgtgcctgagcccgacggacccggcgcaggggctgctctactccgggtcgtgggaccgcaccttcaaggtgtggcgcatcagcgactccaagtgcctcgagtcggtggtggcgcacgacgacaacgtcaactccgtcgtggcggcgttcgacgggctggtgt

SEQ ID NO: 5891 - DNA, 107 bp, Zea mays
  Clone ID: LIB148-051-Q1-E1-D10
acaacaccctgaggtgagtcgtattaagtcttctgcactgtgcatggtgtcaacgcgcactcacaagataagaattctgaatcctcggcgcctggtgggtcattaga

SEQ ID NO: 5892 - DNA, 426 bp, Zea mays
  Clone ID: LIB148-051-Q1-E1-D11
atcagccggtcgggaacgatgaagaaagatgatgacctcgagtcggcgctgctggccgccaaagagccggcgccggcgcccgccaagggctacgcgtacgcgctcacctgcgcgctcctggcttccctcacctccatcatctacggctacaaccgcggggtgatgagcggggcgcagaagttcgtgcaggccgacctcggcgtcacggacgcgcagctggaggtgctcatcggcgccaccagcgtctactccctcgtcggctcgctggcggcgggctgggcgtgcgaccgcgcgggccggcgccgcaccatcgcgctgtcggcggccttgttcctcgccggctcagccgtcaccgccgccgccgacggctacgccgcgctcatggcgggccagttcgtcgccggcgtggcctgcggattcggcctc

SEQ ID NO: 5893 - DNA, 424 bp, Zea mays
  Clone ID: LIB148-051-Q1-E1-D12
aaaagggccatccgctgcggtcagtgtaggtttctgaatcatagcttggcgatgcctgaggctagacaaatactgagctagccttcagaaaaaaaaagaaaagaaagagattgagaagcagggagaaaaaatggcactggcccattgaggaagcttgagaaccagttaacaagaattgccaacatattcttggacaatcttgttaacagagttttaaggtttcccagcagagaagagcgcgtgcaaccaccacattcatataattaataagcaaggtttagagaagaggcaacatgggcacaaagatgaagaaggggatcctgaagccgttccgctatatctcaaccatcatggatggtaaggaggctgaaatgcaaattgggttcccgacggatgtaaaacacgtggcacacatcggttggga

SEQ ID NO: 5894 - DNA, 402 bp, Zea mays
  Clone ID: LIB148-051-Q1-E1-D2
gccgtcgccgatcggaggccctcgcttccgccggcgggcggcgcgagccgggagatggacggcggcgcgggtgccggtcggaggagcgtcccctcctcctccggattcaggaggagggtcccgcccgccgagaacgggcacggccatgacgccccgccgccctccaggcggtcctccgcctccctctcccgcggccactccacgccgctgactggcgagaggaccgtgaaaaggctgaggttgtccaaggcactgacgataccggatcacacgaccgtgcacgaggcttgtcggaggatggcatcacgcagggtagatgccgtgttactgaccgactccaatgctttgctctgtgggatccttaccgacaaggacataacccacaagagtgattgctcgtga

SEQ ID NO: 5895 - DNA, 389 bp, Zea mays
  Clone ID: LIB148-051-Q1-E1-D5
cggacgcgtgggcaacgaggccatcgccaccaccgaccacgacgggtgggtgctggaggagctcatgtggaccatgttctgcaacggcaagagggtgggctacgcggtgcggcgggaccccaccgaggaggacatcgccgtgctggagacgctgtgggccgtctccatgggcggcggcgtgctccccggcaggtcggacatggacggccccgacggcgagatggcgtacatgcgcgggagcttcgagcacaccgtcgggtcccgggactcggagtcgctctacatggtcggaccgcccggcggcgactgcccggagctcgccatcttcttcgttaggctatgaattgaaccgagcgaaccatacgaatcgaacaatacagtgtacacgt

SEQ ID NO: 5896 - DNA, 299 bp, Zea mays
  Clone ID: LIB148-051-Q1-E1-D6
aatccaggggtgcatgatctgtttactccttgctctcgggtggacagctgcttcaattgtcagaaaaggggttataaagaacatgaggcgcaacattgcagatggaaatagttttgcatttctttgtggcaacatagatgagcttgagcactctgttcacgagaatttacctagagtctctgtagtcatgcctttgaacggctttggcgaacataagttgcaaaattggagaagtcagattacatcactttatggtgggccactggaattcatgtttatcgtcaaaagcagagatgatc

SEQ ID NO: 5897 - DNA, 289 bp, Zea mays
  Clone ID: LIB148-051-Q1-E1-C11
cgtcctattagctcttctgcaccgtacatggtgataaggcaaactcaaaggacaaccattcaaaagcgtccgggccctgtgggtccttcgacatcaccaagttgggcgcctctgtcaatggcaacaccgttagcacgaaggctgtgcacgaggcgtgtgcatcggcgtgcggcggcaccgggaaccacacgatcctcatccccaaaggcgacttcctcgtcggactactcaacttcacacgcccatgcaaaggcgacgtgaccatccaggtgaatggcaatctgctggc

SEQ ID NO: 5898 - DNA, 330 bp, Zea mays
  Clone ID: LIB148-051-Q1-E1-D7
acggaaactctgaaaacgagaccggcggtcgacgagcacaaggcgaaggaggcgacgaccgtcgtcccagcaccgtcggcggaggaggagaagaccaccaccgacgaacaggccgctgccaactaactgattacaaggaggccaagacctagacgacttgcatccaccacaatccattttgtccaactgaattcggccgccggccgggcggtcccttttggtgtaccccacaccatggttcctttccctgatattggcccggtctggactcactcaataaaatgtgttctatctatagaccctttcgaaaaaaaaaaaaaaaaagggggg

SEQ ID NO: 5899 - DNA, 404 bp, Zea mays
  Clone ID: LIB148-051-Q1-E1-D8
cccacgcgtccgctgagccgttgatgagagcagcagtaccgttggtcgcagcggcgacggcgggcggccggcggacgcgatgtccgttgtggcggccgtggggcccgcggcggcggcgtcttacgggcagccgctgtgcggcggcggggcgaggaagaggaaggacgcgggcgtggtccaggaccaggaccaggaccaggatgcagggtcgtcgttgcggggtggtaagaacgccgcgctgttcgtgctggaaacggtggaggaagaggcggacgcggacactgagaggtcgtccatcggcgcggcgtccgaggacggcgacgacgaggacgaggaggaggtggctagccgcgggacgaatggcgccggggccccgctcgcctgcatggacatggggcccctcc

SEQ ID NO: 5900 - DNA, 409 bp, Zea mays
  Clone ID: LIB148-051-Q1-E1-D9
aaagatgactgttgtgagtatcatgtggtcgttagtgcaggtgcaggtgctggtggcggtggcattagcatttctggtaggcggtgcctggtgtggtcctcccaaggttcccccgggtaagaacatcacagccaaatatggtagtgattggctagatgccaaggcgacatggtatggcaagccgacaggtgctggccccgacgacaatggtggcggctgcgggtacaaggacgtgaataaggcccctttcaatagcatgggcgcgtgtggcaacgtccccatcttcaaggacggtctaggttgtggatcctgcttcgagatcaagtgtgacaagccagcggagtgctctggcaagcccgtggtggtgtacattacggacatgaactacgagcccatttgcggcatacac

SEQ ID NO: 5901 - DNA, 380 bp, Zea mays
  Clone ID: LIB148-051-Q1-E1-A7
agaaaacagtgggatcgagttgtttcactgcacgagcacatcctccggcgaccaccggcctccctctccgtcctctagcgaccgaccaacgcgccgagcgaagatgtcgtggcagacgtacgtggacgagcacctgatgtgcgagatcgagggccaccacctcacgtcggcggccatcgtcggccacgacggcgccacctgggctcagagcaccgcattccccgagttcaagcccgaggagatggctgccatcatgaaggatttcgacgagccggggcacctcgccccgaccggcctgatactgggaggcaccaagtacatggtcatccaaggcgaacctggagctgtcatccgtggcaagaagggatcgggggcatcac

SEQ ID NO: 5902 - DNA, 391 bp, Zea mays
  Clone ID: LIB148-051-Q1-E1-A8
aggaaaaaaggaacgggaagagagggtctgtttggttgagaggtagatgtgaaaaaagttgtttgtgaattgtaaactgtggaaaaagttgttgtgggctgtgagctgttaaaaaactacaaaatgtttggtggaaactactaaaagtcgttaaaagttcttcgatatatgttttcacagttccatctaaaagcaggtacataggtgctttgaggtcaaagtgggttgagtcgggggcgacgccgttctctcaattttttgggatcacgcctccaccaaaaactactccgggttttacctcgtccctacgtgaatctcatccaaacactattggaattgtggccgccctattccatccctccatatacatccaaccaaacattattgtgtc

SEQ ID NO: 5903 - DNA, 377 bp, Zea mays
  Clone ID: LIB148-051-Q1-E1-A9
agctctttctctcccggacgtcgatcgtgttcttcagcacgggctagctagctccctccctcccagccatggcgacgccggacaacaaggggcacgggcatccgctgcccaagtttggggagtgggacgtgaagaatccggccacgtccgagggcttcaccgtcatattccagaaggcccgcgacgacaagaagaccaccaccggccctggggctgggaacgcgcgcgcaggcattccgccggccttcaggaacggcggcggcgacggcgggtacaggcccgacttcggcgacggcaaccagtacacgccgcccaaacggaagaagtgggccttctgtggctgctgaatcgaagctcgctgtgctgctgtgctgact

SEQ ID NO: 5904 - DNA, 368 bp, Zea mays
  unsure at all n locations
  Clone ID: LIB148-051-Q1-E1-B1
gtgaggcgacgagancccagccagtcgatcgttcaagaaaaataccagcttaccaacaacagcagcagcaagcccacccgttcgacgacatggcccgcctcggcgccggcgccgtgttggcgctcctagtggcggtcgcggcggtggccgcgttcctcgcggtgccggcctcggcgaagtccggggagctgagcgcgatggggttgctggcggcgaaaggcggcagcggcgcggccccgcagagttgctcgggcgcggtgggcgagtgcgacgtggacgaggcggaggaactcgggctgagcggcggcggcctcggctccgacgacgcggtgcggcggacgctggcgcagcgggaaccgaccaaccgg

SEQ ID NO: 5905 - DNA, 387 bp, Zea mays
  Clone ID: LIB148-051-Q1-E1-B10
catccctgcaaattaccgcgatggctcccaagatcctaatcatccttgtgttcctcgccgtggcctcaccggcggttctggccgccttcgatgtgatatagatgctggccgacaagcccacgtactccacgttcctgaagctcctgcaggacaccaaggtcgcgggcgaggcgaatcagctcaggtcggcgacgctactggtcgtccccgacaaacttgccaagcctctggcgtctctgcccgccgattatgtgcggtcggcagtggagaaccacgtccttctcagttacttcgaccccatcaagctggacgagatgaacatacgcaccgtcatcctccccacgctgctctccgtcaccgacaagaaactcggcgtcctcaactaca

SEQ ID NO: 5906 - DNA, 430 bp, Zea mays
  Clone ID: LIB148-051-Q1-E1-B11
accacgcgtccgcccacgcgtccgagcatcgatcacgacaagatggcgtgcacagacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaacatggtaattggatcgagattctacgcgtggataacc

SEQ ID NO: 5907 - DNA, 373 bp, Zea mays
  Clone ID: LIB148-051-Q1-E1-B12
cccacgcgtccgctcccctagccgccgccgccgccgctcgtctccctgagaggtgccgggaccgaggaactggccgagtactaggtagagaatcggtttttcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaggcgtgaagaagttcagtctgctgcttactccaactgcg

SEQ ID NO: 5908 - DNA, 429 bp, Zea mays
  Clone ID: LIB148-051-Q1-E1-B2
attataatctcacagaataataaacatcatggggcaagcctcacggctcgtcctcctcgccgtcgtggcgctgctgtccgccggcctcctcccgcaggcgctgggtaagggtaggggaggcaggggacacggtggcgccgtcaacccgcaggtcgccggcatctgctctcgcaccccgttcccggaggtgtgcacgtccaccgccgggcggcacgcgtccaagtacccggtcatcgacaacctggccgtgctgaacatgcaggtggacgcgttcgccaagcgcaccgcgcaggcgcgcaagcacgtcgcgaggtcggcccgcaccatcccgccgcagcagacgcaggcgctcacgttctgcgacaccatgtacatgaacacgcaagacaccatcggggccgcgcagccgggcatcacgttcaaggacac

SEQ ID NO: 5909 - DNA, 398 bp, Zea mays
  Clone ID: LIB148-051-Q1-E1-B5
agcaatcatgtctggtcgttcgtggacaataatggcgcctctccaagcgtcaaggcggtcctccggctcgccgcgggctccgaggaggaggaggacggcggcggcaaaaagaagccccacgtcaaccacggcaagtttaaggcggagccgtggacggacgggcacgcgacgtactacggcgggcgcgacgggttaactgacaccacggacagcggcgcgtgcggctacaagggcgagctggggaaagactacggcaccctgacggcggccgtgggcccgtcgctgtacaccaacggcaccgggtgcggcgcgtgctacgagctcaagggccccaagggcaccgtggtggtgacggccaccaacgaggccccgccggccggttaaccggcagaaagggc

SEQ ID NO: 5910 - DNA, 402 bp, Zea mays
  Clone ID: LIB148-051-Q1-E1-B7
gtaccatgacgtgatcctcccgccgccgtcgcaggcacggttcggcttcgagatcaaggaggtgggcatgaccagccgctacgcgtccgctgaggatctgcaccagatggacagcgaccaggaagagggtgctgagggtggcgatgacggtgacagcagttgcccacacgccatcgacatgcaggcggaggagttcatcaccaagttctatgagcagttcaagtcagaatcgttcaacggccgtgcctccgagtgatccattgatccatccgcttgcggcatgtatgtaatcgttctgatcttaaccgaaattgcattcgtgtcagagacgactctacccaatatggatcaggaagaaatgtatcagtgatcgcatcgataaacacagtttgtctgaactct

SEQ ID NO: 5911 - DNA, 412 bp, Zea mays
  unsure at all n locations
  Clone ID: LIB148-051-Q1-E1-B8
attctcgtttggagaggccgacattgacagcacagtgaaaacagcaaagaagaaagggtccagcaacttgtctactgatctgaacggcaagaccatgcccaagaaggattcagcgtctgcagagaaacagcctccgaaccgtgcgaggccgaaaggaatgagtggcagcagcaattttgcagacgggaaggcctcaacctcaacaaccggagatcatgaaggccgtcgtacccggcagcctcctggcggcgacagcagcattttgctgggctagcgtgcatatgaatcttgccctatgccgccgccgcacgggtggttggtccgtcagtctgtggtcttgttttcgtggtcaggccatgtgtcncatctccggtccttcagatgatctggttcgcatctgtcttgtgtatgg

SEQ ID NO: 5912 - DNA, 288 bp, Zea mays
  Clone ID: LIB148-051-Q1-E1-B9
aggcctcccagggagccatcaatatcccaccataggttaagttacccagatgtcacaggaaggacagctggcttccgaactcaatacacacagggtgtctatgatcccaggctccggacgtgccatatgcacaacgagaaggacaagagccaacaaggaccatactcatgtagctaccctgtggcgctgctggaagcagcggccgcacgttcgagatcacgaatctctgcgcgaccatccaacgtaataccgcctccacaaaggcactccaatacacttcaacgtcag

SEQ ID NO: 5913 - DNA, 405 bp, Zea mays
  Clone ID: LIB148-051-Q1-E1-C1
agccgagttccgcaccttcatcgagatcgtcttcgagaaccccgagaagagcatagactccctccacgtcgatggctacgccttcttcggcgtcgggatgggccccgggaagtggtcgccggaggtgaggaagacgtacaacctgctggacacggtgagccggcacacgatccaggtgtacccgcggtcatggacggcaatcatgctgacgttcgacaacgcgggcatgtggagcgtgcattccaacatctgggagcggtactacctcggggagcagttctacatcagcgtcgtctcgccggcgcgatcactgcgcgacgagtacaacatgcccgacaacgccctccgctgcggcaatgtcgtggggctgccgctgccgccgtcctacgccccgcgcgctaagac

SEQ ID NO: 5914 - DNA, 400 bp, Zea mays
  Clone ID: LIB148-051-Q1-E1-C10
acagccagctgtacccgttcgagggcctccagaactacacctccggcatcatccaccacgtccgcctccagggcctggagcctgggaccaggtacttgtaccggtgcggcgacccggccatcccggacgccatgagcggcgtgcacgcgttccgcacgatgccggccgtcgggccggggagctacccggggcggatcgccgtggtcggggacctcgggctcacctacaacaccacctcgacggtggaccacttggtgcgcaaccgccccgacctggtgctcctcctcggcgacgtctgctacgccaacctgtacctgaccaacggcaccggggcggactgctactcctgcgccttcgccaagtccacgcccatccacgagacgtaccagccgcgctggga

SEQ ID NO: 5915 - DNA, 350 bp, Zea mays
  Clone ID: LIB148-051-Q1-E1-A6
accacgcgtccgcgcacctcgcctcctcaccgcgtttcctccgttaatccggtagaaaatggccgatgccgaggatatccagcccctcgtctgcgacaacggaactggcatggtcaaggctgggttcgctggcgacgacgccccgagggccgtcttccccagcatcgtggggcgcccgcgccacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcg

SEQ ID NO: 5916 - DNA, 355 bp, Zea mays
  unsure at all n locations
  Clone ID: LIB148-050-Q1-E1-G9
aagcttgcaaaaacttcctcggtcaatcagggcattgctagagcttagatgcctttgtctctatggaacttccctaagctatgtaccaaagggtgttggtaaattgaagcatctcaatcatctagatggtctaatcattggtcatgacaacaatgcgcctgaagggttgtgaacttagatgaccttaaagcattgtcagaactaaggcaccttcatatanagagtttggatagggctacttccggtgcgtctgcactcgcaaacaagccattcctagaggatctgtacctctctgagcaagcaccagcaatagaaaatcaggaggatctggaggacaaagatgaaacagaaaaag

SEQ ID NO: 5917 - DNA, 415 bp, Zea mays
  Clone ID: LIB148-050-Q1-E1-H1
acacgcgtccgctcgcctcctccattgaccaacaattaagcctccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatcgagaaggagaagccatcagcagtccatgcagaagaa

SEQ ID NO: 5918 - DNA, 385 bp, Zea mays
  Clone ID: LIB148-050-Q1-E1-H10
actcccccgccggccaacaactcagccgccgcaaccgccacatcagccatgggcgcctgcgcaaccaagcccaagacgcttgaggggcaggccccagctgaggccgccgtcgccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagatgcggccgtcgccgagcccgatcacaaggaggaggaagccgtggagaagaccgtcgtcgaggaggagaagccagcggcagccgccaatgcagaggaaaaggtcgccaccgccgccgagaccacgacga

SEQ ID NO: 5919 - DNA, 369 bp, Zea mays
  Clone ID: LIB148-050-Q1-E1-H2
gggtcgagcccgcgtccggagaaacgcgagcaaccagcgatcgccccatggccgccatggctcgttccgtctccctcgtcgtgggcgccctgctcctcctctccctcctcgtctccgccgcggccagcgcgcggaccgtgggcgacaccgtgcaggacgcgtgcagcaagacccagttccccaagatctgcgtggacagcctcgccggcaagccggagagccagaaagcgacgccgcgcaagctgggggagctgttcgtgaacatcgcgggcgaaaagggggtcgggaatggcaccttcgtgcaacgcaggttcagcgacaaggaggacagcgacatgtccaggtgctacgacagctgctccgacgacg

SEQ ID NO: 5920 - DNA, 434 bp, Zea mays
  Clone ID: LIB148-050-Q1-E1-H3
ttcgcggggccacccacgcgatccgatccaggacaaggagggcattcccccagaccagcagcggctcatctttgctggaaagcagcttgaggacgggcgcacgcttgccgactacaacatccagaaggagagcaccctccacttggtgctgcgcctcaggggaggcatgcagatcttcgtgaagaccctgaccggcaagactatcaccctcgaggtggagtcttcagacaccatcgacaatgtcaaggccaagatccaggacaaggagggcatcccaccggaccagcagcgtttgatcttcgctggcaagcagctggaggatggccgcacccttgcggattacaacatccagaaggagagcaccctccacctggtgctccgtctcaagggtggtatgcagatctttgtgaagacactcactggcaagacaatca

SEQ ID NO: 5921 - DNA, 370 bp, Zea mays
  Clone ID: LIB148-050-Q1-E1-H6
aagtcatctcctccatcaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaaatgcaccgagcagaagggcatcacggcgccggccatgaaggtctg

SEQ ID NO: 5922 - DNA, 246 bp, Zea mays
  Clone ID: LIB148-050-Q1-E1-H8
aacaattatgtggtgtcgacaagacattatcgtgcaccagaagttatccttggtcttgggtggaactatccatgcgacttgtggagtgtgggttgcattttagttgagctttgttcgggggaagctctctttcaaacacatgaaaacttggagcatttggctatgatggagaaggtcttaaggcctctcccaaagcatatgattgtcagagctgatcggcgtgctgaaaaatacttcaagcgcgga

SEQ ID NO: 5923 - DNA, 276 bp, Zea mays
  Clone ID: LIB148-050-Q1-E1-H9
tggggttcaaaaacacggccggcgcggaaaagcaccaggcggttgcgctgctggtgcagtcggacaagtcaatcttcctcaactgcaagatggaggggttccaggacacgctgtacgcgcactccaaggcgcagttctaccgcaactgcatcatctccggcacggtggacttcatcttcggcgacgcggcggcggtgttccagaactgcatcctggtgctgcggcggcccatggacaaccagcagaacatcgtgacggcgcatggccgcgcggacg

SEQ ID NO: 5924 - DNA, 316 bp, Zea mays
  Clone ID: LIB148-051-Q1-E1-A1
aatttgcgaccctcgtctcagcctcgctcactcatacaaataataatgaaaggtctcgcccttttcctccgacatccacatgggggaggggaaaacacgtgcattcagccggcggcaataatggtctcggttccagctccggcgacgacgaccgccgccgtaatcctatgcctatgcgtcgtcctctcctgtgccgcggctgacgaccccaacctccccgactacgtcatccagggccgcgtgtactgcgacacctgccgcgccaggttcgtgaccaacgtcaccgagtacatcgcgggcgccaaagtgaagctgg

SEQ ID NO: 5925 - DNA, 427 bp, Zea mays
  Clone ID: LIB148-051-Q1-E1-A10
agtcggtgctccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaacaaagtcacgtacgtggtggaccccagcggcaaagggcgactacaccaacatcaccgcggcgctggaggatatcccggtgagcatcaccaagcgcgtgatcctggatctcaagcccggcgctcagttccgccagaagctgttcctgaacatcagcaaccggttcatcacgttccggtcggacccc

SEQ ID NO: 5926 - DNA, 430 bp, Zea mays
  Clone ID: LIB148-051-Q1-E1-A11
atcctcgaccacctcaacgagcttctgctccgacgacgacgacgtgccgccacatccacatggcggacgacgccgtcgccggcggagcggccgttcgctgcgcagggccggcgccggcctcgctgtcttctagcaggaagcagcagcagcagcccgacgacgccggctgcggcagcagcgacgaccactaccagcacgacgtgatcatgctgaggcggacgaggagcgggcgggcgttcccgccgccgatctccgtgatcggcaagggcgggcggccgtggctctgcctgcgggcgcaccgcgagggtggacgcctcgtgctgcggcagatgcgcctgccgtcgcaggagctgctgcagccctgcaaggaacggcaagggaatgatagctagcgctcctaattgatcagctgatcagatgatctgccgcc

SEQ ID NO: 5927 - DNA, 417 bp, Zea mays
  Clone ID: LIB148-051-Q1-E1-A12
gtggggaccaccaccaccagcaccaccacctccatccgtgcgcctctcgctctcgctggtggtgctcctcctcctccacctgctcccggggcgggcggcctccttttccacctcctgctggtgccagggccgggagggcgtcgcggaggtggcgcgcatggggctcgccggggacgggtcggcggacaccgcccacctcagtaataatgaaaatgggcggttcatttatggagttgcgagttctcctggtaaaagagcatcgatggaggacttctatgaggcaagaatagacgacgttgatggagagaaaattggaatgttcggtgtatatgatggtcatggaggagtccgagcagctgagtatgttaagcagcaccttttcagcaatttaatcaaacacccaaagttcatcactga

SEQ ID NO: 5928 - DNA, 387 bp, Zea mays
  Clone ID: LIB148-051-Q1-E1-A2
atccctatcacgcctcatcgaatcctcaggtctaagttttttttggttttgtgagttatccaaagttggaccgcaaagatgagtactgctaatcactatcagcacatcaagtcaaccaagcctgttgtagatctactaatattggagtgtttctttgcttaaaatgtggagatgttcatagggcacttggacctgacatttcaaaggttttatctgtaactttggatgattggtctgacagtgatatcgactccatggttgaggttggtggaaactcatatgcaaattcaatttatgaggcttttcttccaaaagatcacccaaaacccaaaccagattcaacgatggaatataggacgaaatttataagagctaagtatgagacac

SEQ ID NO: 5929 - DNA, 364 bp, Zea mays
  unsure at all n locations
  Clone ID: LIB148-051-Q1-E1-A3
ggaacccttcaacccacccatgtacaacgttggtcgcccgcacgacgtaccggttccgcatgtgcaacgtgggcatcaaggcgtccttcaacgtccgcatccaggaccacatcatgaagctggtggagatggaggggtcncacaccatgcagaacgactacgactcgctggacctccacatcgggcagtgcctgtcgttcctggtgaccgcggaccagaagcccggcgactacctgctggtggcgtccacccggttcatcaaggagaagagcagcaccacggccgtgatccgctacaagggctccagcgccccgccgccggccaagctgccggagggccccagcgggtgggcgtggtccatcaa

SEQ ID NO: 5930 - DNA, 347 bp, Zea mays
  Clone ID: LIB148-051-Q1-E1-A4
attctatatacatatatagacctaataagaacagagacgtacgataacctgcttattttgcgacacatcccgttcccacgcaaaggcgccgagcgtgatctccgtccgtgccgccatggcctcgcaccgggcgctgctgctgcagctcctcgccgcagcgctcgtcgctgcgctggcctctgtcgcatccgccgacgacgccaacgccatgcccaccatcctgacccccgtggcgcataccccgctggggtccttcgacggcgacaagccggcctctgacgatgacgccgtcgacgacgacgatgacgccgcccctgtcggcgcgcccaacggggccaccatgactg

SEQ ID NO: 5931 - DNA, 361 bp, Zea mays
  Clone ID: LIB148-051-Q1-E1-A5
acgcagccccgcagccgcttcttcgcccgcgcgctcggaatactccgcaccaatcctagctgcgggcaggggttccagccgcttcttcgcccacacgcccgctcgctcggaatactccgcaccaatccgtgtcggaccggtacgtgtgcgagatctgcgggcaggggttccagcgcgaccagaacctgcagatgcaccggcggcggcacaaggtgccgtggaagctgctgaagcgggaggccggggaggcggcgcggaagcgcgtgttcctgtgcccggagccgagctgcctgcaccacgacccctcgcacgcgctgggcgacctcgtcggcatcaagaagcacttccgccgcaagcacag

SEQ ID NO: 5932 - DNA, 366 bp, Zea mays
  unsure at all n locations
  Clone ID: LIB148-050-Q1-E1-G6
accacgcgtccggccgatgcccctgtggctgacgcgccggccgatggacctagcgggccggctgctgcacctggcccccagggtgtcgaaggcctgtcaggcaatgaggatgacgatgatgactccaccaactgaggccacacatgtcggcccggttaaatttggaacaagacatggaagaaaaatgagagcaatgtctttaaaaccatgaatccataataatgtgtggtcatccatggatacatccttgctctccctctttttctttctgtttgattttcaatgtgttatcatgttgttagttaactgtatcnactcatggtatcaaggtctaaaaaattatcgtcgttcttgtgttcttgagcc

SEQ ID NO: 5933 - DNA, 411 bp, Zea mays
  Clone ID: LIB148-050-Q1-E1-E5
accacgcgtccggcattctcttcccttccctgagcaaagagaagtagccacaagcatgtctggcatcatcgacaagatccaggagacgctccacatcgggggcgaccacaaggaggagcacgagcacaagaagggcgaggagcaccacaagaagggcgaggagcaccacaagaaggacgacggggagcacaaggagggcatcgtggagaagatcaaggacaagatcaccggcgagcacggcgacaagtccggcgaccacaaggacaaagaccataaggagaagaaagataagaagaagaagaaagagaagaagcacggcgagggccatgaccatggtgatggtgacggcggccacagcagcagcagcagcgacagcgactgatctcgcctcgccgagccccgtgcgcacat

SEQ ID NO: 5934 - DNA, 116 bp, Zea mays
  Clone ID: LIB148-050-Q1-E1-E6
ccacgcgaccgacacgaccgccggcgacgatcgaggatggaggaatcagatacccggcggcggcgatcgatcgctccgcgcagctcatcggcggcgacgtgcctgtggttcgctct

SEQ ID NO: 5935 - DNA, 399 bp, Zea mays
  Clone ID: LIB148-050-Q1-E1-E7
cgcacgcgtacgagtcatggcgccgtcgtcgtccctgccgcggagcgcgagcgagctacccgacccgccgtcaccgttcagctccaacacggggcaccaccccgtctccgtgcccaccacacctaggttgtccttatcgtgctcgtcgttcggccacatggtgaccccgcccaccgacacaccgccgatcacgcccaccaagaagcaggacgacaagccgaagccgacgccggaggccgccaccgcggcgaactacgcgtcgttgtggtcgcccaagcgcctcatgcagcgcgctgcccgcgctttccgccgcagcaggtcgcgcgcccgcgtcaggacggtcaaggacctcgccgaggaacgggcctcagtgctcgccgccagcaacaaggtctccga

SEQ ID NO: 5936 - DNA, 388 bp, Zea mays
  Clone ID: LIB148-050-Q1-E1-E8
cccacgcgatccgaacagagctagctagccagccagccagcagccagcttgctcgccgcgcccgtccttcttcctcgcctccgttccattccgtcccgccctccaccgccgccgccgcattcagggatggagatgaagaagatcgcctgcgccgtcctcgtcgccgcctcggcggccaccgtggcgctcgccgcggaggctccggctccggcccccaccagcggctcctccgccgtcgcgcccgccgtcggcgccgccctcggggccgccgtcgcctccttcttcgcctactacattcagtgatccggccggggcgctcggatgccgacgaagagacgacggggagagagagtgacatggctggcgcgattccgatgcgtgggcatgt

SEQ ID NO: 5937 - DNA, 334 bp, Zea mays
  Clone ID: LIB148-050-Q1-E1-F1
cccggcacggactgcaactaggtccacgcgctcacggatcacgccggcgtcctgctcacaaggaatgttggtatctacgacagccagcttgtcgctaacccgctcggctatctcacagacgtggagctcgccgtctgagacaccgctggcatcaagcagcatggaactcagcacgacgacaacgagcagtagactatagcacgggcgagtcccggacatgctgcacaatactacaccgatacacagcgaacgcatggcatggatagcactatctaccgcaagaagtcgcacacaaggatcatgacagatgtatcacactgcttgattcacttgc

SEQ ID NO: 5938 - DNA, 269 bp, Zea mays
  Clone ID: LIB148-050-Q1-E1-F10
cagaggagaccccagccagtcgatcgttcaagacaaataccagcttaccaacagcagcagcagcaagcccacccgttcgacgacatggcccgcctcggagccggcgccgtgggggcactcctagtggcagtcgccgctgtatccgcgttcctcgcggtgccggcctcggctaagtccggggaactgagcacgatagggttgctggcagcgaaaggcagcagaggcaccggcacgcagaaatgcacgggagccctgtgctactgctacgt

SEQ ID NO: 5939 - DNA, 422 bp, Zea mays
  Clone ID: LIB148-050-Q1-E1-F12
gtacggtgatgtccgggtgactcacgcgtccgagacaagacgcgcatcaatgcctgctgataaggaggaggttctgcaggctgctgtctcccgcgttagtgcactggaagaggagcttgcagctacaaagaagaccttgcaggagactcttgagcgtcagttggagatcgttgcatacattgagaagaagaagaaaagcaagcgtttctttcgttggtagaagcaaacagcagtgaattgttcacgcccacgagaaaaaaggttttgcgtgtgatggaagcgagctggtgcttgcgtatgccagcaagctgcgattctgagtgtaacacataaggatgttctttcattcttcttttttgttcccttgttgcatcaaattgtgccttaaccacgtcgatgtgctgccaaattgtcaatccctg

SEQ ID NO: 5940 - DNA, 415 bp, Zea mays
  Clone ID: LIB148-050-Q1-E1-F2
acgcgtccgactggatggagtcgtgcagaccgacccccgctgcctctgcatggtcctggacggcaccgccacgtccttcggcatcgccatcaaccagaccagggcactggagctccccggcgtctgcaaggtcaaggcgccgccgctcagccagtgcacaggcgtccctgcggcacctgcaccgacgcctcccgacgaaccagcagcggcagcggaggaagaagccgacacagctgcagatgcgccttcagcaaatgggagcctcaagcctcacagactcaaagaatgcagcgagcttactgcttctcatctgcgcattgctgtatgccttctaataagtggtgatacaacttcgctggccatgtcaccgtgcaggaattaggtctttccctgagtcctgactatgtacttaccc

SEQ ID NO: 5941 - DNA, 372 bp, Zea mays
  Clone ID: LIB148-050-Q1-E1-F3
tcgtctcaccctccctccctcacacaaataatacggaaaggtcgcgcccttttcctccgacatccacagcgggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgcccggttcgtgaccaacgtcaccgagtacatcgcgggcgccaaggtgaggctggagtgcaagcacttcggcaccggcaagctccagcgcgccatcgacggggtcaccgacgcgaccggcac

SEQ ID NO: 5942 - DNA, 294 bp, Zea mays
  Clone ID: LIB148-050-Q1-E1-F4
gggtccagccacgcgtccgaccaaacgtccgcccacgcgtccgatattgatgccacgccgcatgcaggtctttccaaggcgtacgtactatatcaaattattttaatttccttacatgtatatgtatgtgctgctgttggatacgtacgtatatatatatgttctagggtttccggttccggccttgttacatgcatgaagagaagaaacacaatgaataaggcttttattgattgtgtttcttctcttcatgcatgtaacacaatcaataaaagccttattcatttattatgt

SEQ ID NO: 5943 - DNA, 424 bp, Zea mays
  Clone ID: LIB148-050-Q1-E1-F5
atcgtcgttatcgtcgtcgtcgtgggccttcatttctcctagaaggtagaaggtcgagaggagaagaaggcgagacgtgcagtccgtcgggcaccgatcgagaacagggaagcaagaggctgctagagatcgagctcatcaaccaaccaagtcgtacgtcgtcagcatcacgaccggatggcgcgtgccgcgtccagctatgtatccaggagggggctctccgcagcgatgacggtggcggaggagtccgtgaagaaggtggaggacaaggcggtgaagctgggaactgtggccaaggacatcgccagcgccatggccaccacgacggaggagaagacggcgttctgggaacctgaccccgagaccggatactaccgtccggtcaccggcacgaaggaggtggacgccgccgacctgcgcgccg

SEQ ID NO: 5944 - DNA, 378 bp, Zea mays
  Clone ID: LIB148-050-Q1-E1-F6
aaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaa

SEQ ID NO: 5945 - DNA, 434 bp, Zea mays
  Clone ID: LIB148-050-Q1-E1-F8
aagcaaatgcaccgagcagaagggcatcacggcgccggccatgaaggtctgccaggaggagtgcgacaaggcgtacttggtgaaggcggccgaggtcacaaaggcctgaaggttcacttgcgcaaaggagaagaacccgcgcttcagcaaaaattgcaaaaggtcttgcacccctcctcctcctgaagccaaaccccttgaaatgaatgaaccccatgcatgcatgcatgcatgtatgcatgcgccggggtgacgtggcgttcagctcaggcgctgagcgagtctatacgtacgtcgtcaccggctggccacgcatgcgataaccatctgatatggacggaactatatattgtattcctattaatctggcattttctaagctaattgttttttttccaaataatacgtctcatgaactcaaaatttaatgtcac

SEQ ID NO: 5946 - DNA, 257 bp, Zea mays
  Clone ID: LIB148-050-Q1-E1-F9
tcaaccagcccaccgccacctccgacctcttcggcgacaaccattgctatcgccagctgtccgagctcgcacaatcatgcggtcaaagctcgccgaagtggccaagctcaaggagctgcacacactcaagggacacgtccagtccgtcgtcaatctcaagggcctccacattgacaccattcagcagagctacaccgtgtaaactcgactcaatttttttaattgctttttttttcatacacatacaaaccacacac

SEQ ID NO: 5947 - DNA, 226 bp, Zea mays
  Clone ID: LIB148-050-Q1-E1-G1
aataggcatccggataataacggggatcgtgacgccgttccgctatatctcagccatcatgggtgcaaatgatgctgaaatgcacactgggttcccgactgatctaactcaagtagtacatactggatgagatcgacctcgatccacgaacaacaccaacactaacaacaccaagaccactactggacagacacctaactggatgaaagattaccactcggcaccg

SEQ ID NO: 5948 - DNA, 331 bp, Zea mays
  Clone ID: LIB148-050-Q1-E1-G11
aagacgcgtgggcggacgcgtgggggacgacgcaccgcacactacccgacggtggaactcctcgcccgcgtcgctgctccggtctccgcgctgctagccgccgactgtaggggctgtgtgcttctgaagagagatttcgttgaacaggatgaatgcattggcagcaaccagcaggaacttcaagcaggcagctaagctgctgggcctcgactccaagctggagaagagcttgctcattccattcagggagattaaggtttaatgcacaatcccaaaagatgatggaactttgggatcctatgttggatttatggttcaacatgataaatgc

SEQ ID NO: 5949 - DNA, 324 bp, Zea mays
  Clone ID: LIB148-050-Q1-E1-G12
agatatatccatcccgatggaagaagcggttcatgaacctgttaaaccggcggaagctgtcgacgaagctgggctcaatatatatgtctgctgttcaccatctcagccaagggaagccgttggtcagaacgagctcaatgaggctgctgtcgtcggtgaaacgacgactgaaccgaaggagggctaggatcaagccaagataataaagcaagtcgactgcgaaactgcatcaaaagaagttgctagtactggggccgattcaatggacgatgccgctactatggaacgctagccgctggtatcatcagcatcagcaccacaaga

SEQ ID NO: 5950 - DNA, 318 bp, Zea mays
  unsure at all n locations
  Clone ID: LIB148-050-Q1-E1-G2
gggcccgcccgcgtccggactcactcaccccgccttcacgcctccctcaccaaataaggtcncgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaagtgaggctggagtgcaagcactttcggaacgggaa

SEQ ID NO: 5951 - DNA, 418 bp, Zea mays
  Clone ID: LIB148-050-Q1-E1-E4
ggggccagcacgcgtccgaccctgacgatcgggaaacagcagaaaatgtctgccttcatgagcttccagcaaagcgtgcaagctgcagggctgccaggcagccagcccaaccagacgacggagctggaccttttccaagacctgcagttgcctcaggccggggcgcagagcacaaacccattctctgatgagagcgttcagggatacccacagtacatgaacgggcccaacggcgacaacgcacagccaggccaggacttccaacagcagtctctgaagctaccggcggcgagcccgtacgacaatttcctaagggctgctggctgttaggagtccagttacatgaacgacaaccacctcacctcaagatagtcccaacggaagatcctgcaatttttccataatttgcagggaaaga

SEQ ID NO: 5952 - DNA, 412 bp, Zea mays
  Clone ID: LIB148-050-Q1-E1-D12
atagcacatgccgcgatctccattgtggagagcagtggcggcggcggcgacggcagcgcggggagcgacgaggcggcatcgtccatgttccagaggttctgggactccgccatggccttgggccccctggacgacgagacggacacccagtcccagatgagcgaggcgtcgaggtcgcagatgatgatgtccgatgtccaccaccaccaccaccaccacgactccgcgggcggcggcagcgaggcggggttctcgctgtcgtccttctccttcaagctccaggacaggcgaaggcggatgcaccgcttcagctgtgaggttcagagcttgacgcctctggtgacctgcatcctgcggaggctcggcgccgacatcgaccctgaccgcctaccgcaaatcctgtacgaagacg

SEQ ID NO: 5953 - DNA, 284 bp, Zea mays
  Clone ID: LIB148-050-Q1-E1-D2
tacaacactctaacctgagtcgtatgacatcgccctcggctccgccaagggcttggcttacctgcacgaagattgccaccccaggatcatccaccgcgacatcaaggcagccaacatccttcgggacgagaatttcgaggctaaggtcgcggatttcggacttgccaagctgaccacagacaccaacacgcacgtctccacgcgtgtcatgggaactttcgggtatttggccccggagtacgcgtcgagcggcaagctcaccgacaagtccgacgtgttccccc

SEQ ID NO: 5954 - DNA, 381 bp, Zea mays
  Clone ID: LIB148-050-Q1-E1-D3
acatctctggatgttacagcgatggatcgcatcatgctacttatccttgtgtgcatcggcctggactgattcggcgtcctggacgccgtcgatgtgagaacgggctctggccttggttccatcctcctaaagctcctgtctgttgtgtacggcaacaaggccacgcttgaggtcaatgagtacccgtcccgccaagtttcgacttctgtagttgaaccatacaagactgtagtgtccactgactccctcttcgagcagactgatgttgctaaacagcttgatcataatgccatctacgacattagcctgcgatcccttgacattggaaccgcaacctacaccaggctcaacacgcttgtgtcccaggttatcgcatccctt

SEQ ID NO: 5955 - DNA, 392 bp, Zea mays
  Clone ID: LIB148-050-Q1-E1-D4
cgggtccagccacgcgtccgcacgattacaaccccaccctgcactcaaggagtgctttggactatcatgagcaaggtagcagatgcatccaaggaggagatccactccatcgagtcggtgaaggaggcaaatgcacggccggctcagaaaatcaacagccgcgttgttcgctactacaaagcagcaggagccacagaagcgccggcgccggcgccggcgccagaagcaacctgatcgaggagaacgtgagccttgaagacgtaccacgatgcttctttgttcggcttcctagatatactcgaaagctcgtgtgctgagtattgacagtttcgttggtgaaacaggttagaacagtagctcaccctcccgagagtatgggttgaaaatctttg

SEQ ID NO: 5956 - DNA, 421 bp, Zea mays
  Clone ID: LIB148-050-Q1-E1-D5
gcgtccgaagagatgcgctgcgtggacagccctagcgggtgcaagcccagcgcggcgacactggtggtgacggcgaccgacctgtgcccgcccaacgaccagcagtccgcggacagcggcgggtggtgcaacccgccgcgggagcacttcgacctcagcatgcccgcgttcctccagatcgcacaggagaaggccggcatcgtgcccatctcctaccgcagggtggcgtgcacgaagcagggtggcatccggtacaccatcaccgggaacaagtacttcaacatggtgacgatcaccaacgtaggcggcgccggcgacatcgcggcggtgtcggtgaaggggagcaagcgcgttaagtggacggagatgaagcgcaactgggggcaagtgtggcagaccggggacgaactcaactgcgagt

SEQ ID NO: 5957 - DNA, 442 bp, Zea mays
  Clone ID: LIB148-050-Q1-E1-D6
cccacgcgaccgacggcgtgcggcggggacgaccagcagccgccgtccatggccgcgatgccggcgtcgctgcgcgccatccaggccaggaggaagcacgaggcggcgcagcgcggggtgcggcgggcgacggccacgagcgcggccgggtgcgccgtggcggccctcgtcaaggccgtggaggccgtccagggcgcggcggccgggggcgccgcggaggccgcgcgcggcgccggggacgccgtggcgtgggtgttcagcaaggtccacctccagtcgcccgacctccccgtcgggctgctcgggatggtcgcctgttgcctcggcacgatcgtggaggcggcgaggtgccgcgtggacgcgaggaagcccgaaggcggccccggcgggcacgccggggggcgaacgccccggaggggaacggggcccccgcggaggaacc

SEQ ID NO: 5958 - DNA, 406 bp, Zea mays
  Clone ID: LIB148-050-Q1-E1-D7
aggacgcgtggggccgccgccactaggggcggttccagccaccgtcgccatggcgtacccttcggtcaattcctggcggcatttcgcggcggcgcacggatccggcctgcgcggctccgcggcggtgccagcacgcgaccccgcggcggcgggcgggcacggccttggcgcgtgccccccacgcatcctggcgcccccgacggccagggcgcggcccactggcgcgtggccggccatggcggcccctggcggcgcggtcccgcacgggtgcgtcgcccgacggcctgcgcgctgccgtcgctcggctcagacgggcctcggtcagcgcgggcaggcacgacgagcgcgtgcgggcggcctcctccggccaaggcggcgcgtctcgtggcccaggccatgggcgccc

SEQ ID NO: 5959 - DNA, 422 bp, Zea mays
  Clone ID: LIB148-050-Q1-E1-D8
acgcatccgacaccaccggccccagtaagctcacctcctccagttgtcacccctgccccgccgaagaaagaagagcagtcattaccaccaccagcagaatcccaacccccaccatcattcaatgacatcatccttccacctatcatggccaacaagtacgcatctccgcctccccctcagttccaagggtattaagcgccacagagacatggttgatgaagcatgaatggaacagtctataaggtcacatgcgcagacaaactgctacatgtaaaacactgcaagcgtgtgtgaaattgtttttttcttttgcacgtgcacgcgtgagtaaattcttattcgtacatatgtccggacgtgtgtatgtgtgaactagctgcactacatgacgctgcaacgtgtaagaaagtgtgatttgtgtg

SEQ ID NO: 5960 - DNA, 436 bp, Zea mays
  unsure at all n locations
  Clone ID: LIB148-050-Q1-E1-D9
cacgcgtctgcatagatggctgcgacacgacctctcctgttgtcgctgctggtcgccatgctagcggtggccgccgatgtcgccaacgccggccacgccaagcccctgacgcctggcgggcgcgtggtacacgacaaccacggcaagttcacggccgggccgtggaaaccagcccacgcgaccttctacggcgggcgggacgggtccggcaccacggagggcgcgtgcgggtacaaagacacgcgcgcgcaaggggtacagcgtgcagacggtggccgtgagcacggtgttgtttgggcaagggctctgcctgcggcggggtgctacgatgtgcggtgcgttgacagtcccagcgggtgcaagcccgacgcggcggcgctggtggtgacggcgaccgacctgtgcccnacgcaagacaagtggtgcaagccgccgc

SEQ ID NO: 5961 - DNA, 413 bp, Zea mays
  Clone ID: LIB148-050-Q1-E1-E1
agctcactccacctcgctcatgtccgctcaccggggcgggctcagcatcctttcgaagaagtaacacttctccgtgaggcctgagcccctcgccgcggtgagccaagccggcgcacgtcgccccggggctcacgctcaccaccgagccccaaccaattaataatatatatatatagctaggatcgatcgtcagtaaaatggcaggctccgccgtcctgaggagccccctgtccgtcctcctctacatcctcgccgccgtgcccgccaccgccgcggcgacgccgaccgacgccgccatcgacgaggcgtacgcgcatctcgtcaacctcaccgctaaccaggagtactgggcggagcgcgcggaggcggcgcacgcgtacaaccgcgcggcgtaccagaccgacccgtggccg

SEQ ID NO: 5962 - DNA, 385 bp, Zea mays
  Clone ID: LIB148-050-Q1-E1-E10
tcccgggggcacccacgcgtccgaaaacgcgtccgtagaaaatcaggaggatctggaggacaaagatgaaacagaaaaagaagagaaggaacgacaggaaagaagcaatggccaatgcagaggagatgagtcagggaaagctagtgaaaagatatggaatgagctcaacccaccccagagcatcaagaagctggtaatcaagaactacaaaggcgtaaagtttccaaaatggataaaaggtcccaagctaggagactccttccccagccttgtgtttttggatcttgaaaactgcatgtcatgtactaaactgccttcacttggcctcctgagtcaactccagtcgctgcaaatctcagatgcagactcagtcatcaccatcggt

SEQ ID NO: 5963 - DNA, 432 bp, Zea mays
  Clone ID: LIB148-050-Q1-E1-E11
acgcgtccggacgtcgtggccacgatccgccagcggcgttgcttcgtcctggtgctcggaacggccattgtcgtcgccttctccgccttattcggcacgacgtccggcgccgcgctagtgggtgactcgtgcagagcgtcatcgtccacctcggacggaggcagctgcggcaaggggcttcgttgcaccacctgcgtgcctccaccggggacaggtccggccgcgtgcgcgcggaccacgcccgtggacccaaagacacacggcacgggtctccccttcaacaggtactcatggctgacgacgcacaactcgtttgctgtggtaagcaccaagtccccgctgggggtctgccatcatctctccgcccaaccatgaggactcggtgaccgaccacctgaagaacggcctgcggggcctgatcctggatgccta

SEQ ID NO: 5964 - DNA, 381 bp, Zea mays
  unsure at all n locations
  Clone ID: LIB148-050-Q1-E1-E12
cacacgcgtccgcgcaagattcgggggcccgcaaaaggattgcccggtgctgccctacaacacgtgccagagccccagcaaggcanagtcgtgcagctacttccagaagacgcaggacggcacggtgacgatcggcatctaagggcaaggagaaggcgacggtgacggtgtcggacgggcggatggccaagctccccggtctcatcctgggctgctccgtcctggaagccggccgcagcgtggacgcccacgacggcgtgctgtcgctggggaacggcgacatgtccttcgccgtccacgccgccaagcgcttcgggcagcgcttctccttctgcctgctcagcgccaacagctcccgcgacgcctccagctacctcacct

SEQ ID NO: 5965 - DNA, 352 bp, Zea mays
  Clone ID: LIB148-050-Q1-E1-E2
cgtccgagatgaagccatctgccattgccattgtgtgagggagacgacgtgaaagaagaccaagggccacgagatggctctgcgcggcaacctgcccgtgctgctccttttgttcgccgcggcggccaccgcgagcggtaagtcggcgaggctcgaccttttcccagcagcacccggagcatccgctagcgcgcgggcgaagggcgaccggcgccggcaagcgtacatctccgcccacctcccgtcgcgccgggggggaaggcagaaggttgccgcggaagtggcatcgtcgtccgccgtccccttgcctatgtcgtcgggggcctacccatgcacaaggcagtactttgtg

SEQ ID NO: 5966 - DNA, 425 bp, Zea mays
  Clone ID: LIB148-050-Q1-E1-E3
ggggccagccacgcgtccgagcgagtggcatctacgacagtgaagcagcgaagcaggctcagcagcgccacaactccacgtcgctggcgatgagtggcagagtggctggcatggtctctggagccgctccgtcgttgaagtgcgagggcgccgtctgcttcttcctctcatcgctgatcatgtccgggttctgcatcatcgcttttggcttgagcttgatcctggtctaccgcacaaagatcgtgtacacaagtctatacgggaaaccgcgtacttgaaggatcaaccctaaatggacacagggttatcaaagcatacgtcaatttttaagttattagtctggtaccccatgcctgtagaggtacagtgtcggtcttcccgttgttgtgcacaggttctcaagcagcatttcaagttttcaagtt

SEQ ID NO: 5967 - DNA, 426 bp, Zea mays
  unsure at all n locations
  Clone ID: LIB148-050-Q1-E1-D11
tccgggtgcancacgcgtccggagctggatttcggaatggtggcgaaccagaacggtggagtgctcgactgggtgaagaaactccaccaagaaaagcagctaggcacgatggtggacaaggacctgtgcagcagctacgacagggtggagctggaggagatggtccaagtgtccttgctgtgcacgcagtaccacccgtcccaccggcccaggatgtccgaagtgatcaggatgctggacggggacgggctcgcggatagatgggacgcgtctcagaacgtggacacgccggagtccgtctcgtcggagctcctgctccagaagtacatggacttcgcagcggacgagtgctcgctcggcctgcaagccatggagctctccggcccgacgtgaccaaccggcttgttgaccggacccggcgggcat

SEQ ID NO: 5968 - DNA, 74 bp, Zea mays
  Clone ID: LIB148-050-Q1-E1-B5
agtcccatatcatcttctggcttgttcgtgttggtctcaatccatgtggattgggtgggactggatgggtttca

SEQ ID NO: 5969 - DNA, 393 bp, Zea mays
  Clone ID: LIB148-050-Q1-E1-B6
aaaaaacagccgagcgatctcctctccctctccctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatgggcatccaaggccagcctggtgccgtcatccgtggcaagaacggatcaggaggcatcaccgtgaagaaagacaggcaggcactcgtgg

SEQ ID NO: 5970 - DNA, 163 bp, Zea mays
  Clone ID: LIB148-050-Q1-E1-B7
catcatctttcaccatttcgtgccaagcataaacaccctccacctcgacagcaaggccatcggctgccttcgcatggagcgcgcgacggggtcggcagatatgatgaagacgtactccctactggacacggtgcgcaggcacaccatcgagttgaacccccgg

SEQ ID NO: 5971 - DNA, 373 bp, Zea mays
  Clone ID: LIB148-050-Q1-E1-B8
atcccctgttcctcgaccacctcaacgagcttctgctccgacgacgacgacgcgccgccacagccacatggcggacgacgccgtcgccgccggagcggccgtttgctgcgcagggccggcctcgctgtcttctagcaggaagcagcagcagcagcccgacgacgccggctgcggcagcagcagcagcgacgaccactaccagcacgacgtgatcatgctgaggcggacgaggagcgggcgggcattcccgccgccgatctccgtgatcggcaagggcgggcggccgtggctctgcctgcgggcgcaccgcgagggtggacgcctcgtgctgcgggagatgcgcctgccgtcgcacgagctgctggagccctgc

SEQ ID NO: 5972 - DNA, 355 bp, Zea mays
  Clone ID: LIB148-050-Q1-E1-B9
ctctccacatcgaaggcctcgtgccttctcttcctccctgtcatggaggaaatagctgtttcgcctatgatcgttgccgccgtagtgctggacaacaatggcgctgacgctgtctcctgcactgccatcccctaccgtaacaataagcctagatgagaaagacaatatcaatggggatgttcccacgatcacctcggccgcaagcaacgacgatgatgcgttgttcagtgtcggagaatccaccaaggacgatggccatcgcttgacgatggaatgctccactcacgtctcctccagtagcccttccactcgcaagaagcgcggggcgttcagcctcttcaaggctatgttcctg

SEQ ID NO: 5973 - DNA, 414 bp, Zea mays
  Clone ID: LIB148-050-Q1-E1-C10
agaagacagagactgaaggcgaggcggaggcagaggtcgaggccgaggtggaggtcgaggtggaggcggaggccggtgcatcgtctgcgaagaagaaccgtatccaggtgtggaccaacaagaagccgctctatttctacgtcaatctcgccaagaggtacatgcagaactacgacgaggttgagctctccgctctggggatggccattggtaccgtggtgaccgtcgctgagatcctcaagaacaatggcctcgccactgaaaagaagatcctcacatcaaccatcggcaccaaggatgaggcgaatggccggcttgtccgtaaagccaagatcgagatcctgctgtgcaaatcagaaaacttcaacagcatcatgtcgagcaagaagtccgagcgcccgaagccgcccgccg

SEQ ID NO: 5974 - DNA, 415 bp, Zea mays
  Clone ID: LIB148-050-Q1-E1-C11
aacagatcccgctcctgtcgccgctcgtcgtgtcgcccatggtgccggtctgggaggcggaccagacggggggcgccaggaaggagggaggaggggaccaggccgagggcaggagcggtgccgagcagcagcagcgcggcgccgccgctcggcatggcagcagtggggagcaccaggtgcacgacgtgacaccgaggccgtcggcgcccgcgctcggcatggggtggcggcacccagcgatgtcgacgcccgtggcggagccggcgtcccttgtgcccttattccagtcgcagtgcgcgttggaggtgcgcaacgcgcagcagtgagggggaatcatttgctcaaccaagcagccatgcccatagtgcgctcgagctcgtgctcacgacaggcgccgctacgatgtgagaagacg

SEQ ID NO: 5975 - DNA, 426 bp, Zea mays
  unsure at all n locations
  Clone ID: LIB148-050-Q1-E1-C12
accacttcagtgcttgcgatcgcgtcggccacgatctcttgcgaaaaagcttaccctgtgtctgtctgtccgaccgtcagtccgtctaacaatcgatttccatgacgacgtcgccgcgcgtgtggctgctcgccatggcactggcgctcgcctgcgtgctgctcgtgaggtccgccgacgctgctgccgaggcgtcnccgactccaggcggctccacctacgggtgcaacccggccacggacaagtcgtgcaagcccgagggcgtgggggtggtgctgccgggcggcggcatcgacctcgacggcgacggtgacgaagacgagctgccgcagttccagccccacctcatgatcctcggccatggccactgatgagtgtaaatggttggttggttggtcgtcctcagccgatctactggacgacacg

SEQ ID NO: 5976 - DNA, 318 bp, Zea mays
  Clone ID: LIB148-050-Q1-E1-C2
ggggccacacacgcgtccgaccacacgtccgcctccctccctcacacagataataaggaaaggtcccgcccttttcctccgacatccacaacgggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccacggccgcgtgtactgcgacacctgccgccccgggttcgttaccaacgtcacccagttaatcccgggcgccaagg

SEQ ID NO: 5977 - DNA, 373 bp, Zea mays
  Clone ID: LIB148-050-Q1-E1-C3
acggttcccagccccaacccctgtcatctccactggcagagctcagccaattgcagtaccggccattcatctggaagagctgaaggaaattacaaaaaacttcagcagtgatgccctcattggcgagggctcgtatgccagagtctattttggtgtgctgaaagatgggacgaaatctgcagtgaagaagcttgactccagcaaacagcctgatcaagaattccttgtgcaggtttcagctgtctcaagattgaagcatgagaatgttgtccaactcgtcggatactgcgccgaagggagcacccgcgtccttgcttatgagtatgcaactacgggatcattgcatgatatcctccatggtaaaaaaggtgtc

SEQ ID NO: 5978 - DNA, 300 bp, Zea mays
  Clone ID: LIB148-050-Q1-E1-C4
acacgcctctaaagggattcctgctacgcttccctgcgtctcccctccaccgcgtcgcgtgggccctctgcgctacgagggcttcaaatggccctctgcgccgtcccttccgtctagcgccctgccataatgcacacccagccatcttctgatcctcctgacacctcgaacatgaacgtcaagctggagatccctaggcagcacgccatgccgtcgtcgcggtccctgccgcggagcgcaagcgagctgcccgacccgccgtcgccgttcagctccaagtcgggccaccacccagtctcc

SEQ ID NO: 5979 - DNA, 379 bp, Zea mays
  Clone ID: LIB148-050-Q1-E1-C5
gggcaatgagtttttggatcatcagacctcatgccgaatggtaatggccacctgcgctgagcagaactgtttggcctgtgagctccctgtacattcggttgcgatgtgagctccctgcacgttcggtcgaggtctatcgtgaccccactatccgagattgatgtggatcattgggttgacatgtcagacagtatacagccggtggcagaggaattcctgtttgctgtgggtaaagcttatcttctgctttcgtgttttttcttgcttctttcgattatggtgtatgaatgtggtcattatgtattagctgattaccctttccctgctaattggactttagtacgcttcattaagtttggctgattactgtttaacgggg

SEQ ID NO: 5980 - DNA, 340 bp, Zea mays
  Clone ID: LIB148-050-Q1-E1-C6
accacgcgtccggtggagggtgcacatagcctaactgaaatcaaggacctgccaaaactatctgacgagctccatctcaaagataataaggtgctacagaggatctccaagctgcccatgcttcgttccctcattatcgatgactgctcaaagttgaagcatgtggcaggtcttgatgcgctgcagcacctcagacttgtctttcctccgtccaccgagacattttatttcgaagagctagtaattttctggagcgttgccttcccacggtggctggagctactgattcagaagtgcaaaggcctgcgacggtttgagttgcagtgtcgtctgtcattgc

SEQ ID NO: 5981 - DNA, 387 bp, Zea mays
  Clone ID: LIB148-050-Q1-E1-C7
acgcgtccgaatcacttcctcctcctcctcctcctctctccaacaccccatccatcagcgctgccctccgcattgctcttgatcccatccagtacatcgattctccccccaagatcaaaggccggaggaggaagaaaggttagggagtcggccatgggatgcttttcatgctgctgtgtggcagatgacgacaacgttggcaggaggaagaagcatgacgatccctatgttcctatccctgctcatgtttataattttggacctagccggttcccagccccaacccctgtcatctccactggcacagctcagccaattgcagtaccggccagtcatctggaagagctgaaggaaattacgaaaagacttcagcagtgatgccctcat

SEQ ID NO: 5982 - DNA, 351 bp, Zea mays
  Clone ID: LIB148-050-Q1-E1-C8
ccggtacgatcctagattcgccggtccacccacgcgaccgacctcgaagtacttggccgcctcctggggcggcctgcactgggagcggcagatccgtgcgtccgccgcgccgaggcggccccccgggtccgccgctggcgctgggatgtgggtgctggtcacgggcgccgcgggcttcgtcggtacccactgctccctcgcgctccgcaagcgtggcgacggagtcgtcggcgtcgacagcttcaacgcctactaccatccgtcgctcacgaacgcgcgcatggcgctgctggcctcccatggtgtcttcgtcgtcgagggcgacatcaaggacggccgtttcttgtgcaa

SEQ ID NO: 5983 - DNA, 341 bp, Zea mays
  Clone ID: LIB148-050-Q1-E1-C9
catataagctcaacaacagccagctcgcgaaaataatgaatagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaataaggggacggacctggtcgtgtgcaaagagtcctgcgcgctctcccagcagtccaacctggtgctgtacggcaggatccagtgcaagggcaaatgcaccgagcagaagggcatcacggcgccggccatg

SEQ ID NO: 5984 - DNA, 251 bp, Zea mays
  Clone ID: LIB148-050-Q1-E1-D1
aaacccaacacagaaacacagactagaaaaagaaaaaaaaactataaccacaaaataaaaaaaaaatccaaagacagcagcagaaaggggcaaccccccaagggatcacatccatctcaacatgtccgtgttcgctaacactccttcaatcttgtcccctaaattcacttcacgggccttcgtttaaaactttcgtgctggggaaaactctgtagttccccaatttagtccctttggagaacacccccttt

SEQ ID NO: 5985 - DNA, 399 bp, Zea mays
  Clone ID: LIB148-050-Q1-E1-D10
agaatctgccatcctctccaacacgaagatggcgttcatcagcaatatcgcagtgaaggcggcggccgtggccgcgctgctgctggtcgcagcggtgtcgcctgccgcgcgcgcggcggcggtggcggtggcgggaggggcgccgtcggtgccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggcaccggcgacctcagcgcgtaccaaaggaactg

SEQ ID NO: 5986 - DNA, 266 bp, Zea mays
  Clone ID: LIB148-050-Q1-E1-B4
gcgtccgacacgagtccggaggaggtggccaaccccatcgtcatcgaccagtacttctgcccgcagaaggtatgccctggcaagcggagcaactcctcgcatgtctccgtcaaggacgtcacgttccgcaacatcaccggcacgtcatccacgcccgaggccatcagcctgctctgctcggagacgcagccatgcagcggcgtctccctcatcgatgtcaacgtggactacgccggcaagaacaacaaagccatggccgtctgcag

SEQ ID NO: 5987 - DNA, 479 bp, Zea mays
  Clone ID: LIB148-049-Q1-E1-H2
cgcagacgctggcatcctcgactcaaccaacgagggcaagtgcatcccgttgtcgacgcaggtgcgctacttcaacggcaccaaggcgaagatggtcgccaagaagggcgccgccgcggtgagcaagctgctggccgactccgtcatcctcatgggcatcgccaacaacgacctgttcgtgttcgctgccgccgagctgttgcggggcaggtcggccgcggagcagaagagcgacgccgccgcgttcctcaccgacctgctgtccaactactcggccgccatcacggatctgcactccatcggcgcgaggaagttcgccatcatcaacgtggggctggtggggtgcgtgccggtggtgcgggtgctggacgcggacggcgggtgcgccgaggggctcaacaagctggctgaagccttcgacgtcgcgctggggccgctcctcgccggcctcgccgacaagctgccggggctgacctact

SEQ ID NO: 5988 - DNA, 458 bp, Zea mays
  Clone ID: LIB148-049-Q1-E1-H4
tcgtggctggctgcgccacgacctctcctgctgtcgctgctggtcgccgtgctagcggtggccgccgatgtcgccaacgccggccacgccaagcccctgacgcctggcgggcgtgtggtacacgacaaccacggcaagttcacggccgggccgtggaaacccgcccacgcgaccttctacggcgggcgggacgggtccggcaccacggcgggcgcgtgcgggtacaaggacacgcgcacgcaggggtacggcgtgcagacggtggccgtgagcacggtgctgttcggtgacggcacggcctgcggcgggtgctacgaggtgcggtgcgtggacagccctagcgggtgcaagcccgacgcggcggcactggtggtgacggtgaccgacctgtgcccgcccaaggaccagtggtgcaagccaacgcgggagcacttcgacctcagcatgcccgcgttcct

SEQ ID NO: 5989 - DNA, 436 bp, Zea mays
  Clone ID: LIB148-049-Q1-E1-H9
gcgcagaagcattctgaagcagccaatgctgtggagtgttgggatagcagtgtacctgcagatcatccaaatgagaagacttttgtggtgggtattgaggaagtccatgaatcagatggttcgccaggctcgcatggacaatctacaaaggacagcgccccttctgcgaacggtggtggggcagcaaagagcaactacatatcgcccgcaccaacacgcatcgctgtcgaccgcaacggcagtgtgaagaatgcttccgtcgctagggccaacttgacatctcctcggccatcagagatcatctctgccagggacagcaattccacgacccagcaagaagtgaaagcgctcctctctcagatgtcatctgtgcggggcctcgatggttcttccagtgaaggatctcctagccccgggtacagcgctccgaacgaag

SEQ ID NO: 5990 - DNA, 351 bp, Zea mays
  Clone ID: LIB148-050-Q1-E1-A1
atccgacgaaacacgcgtcgacctagtcgtcgtcgccctcctcggcctcgttttcgcaggcatgggttcagaactcgtcattgttgtaccatcagacacggtgtagatagcatcaacgtggatgctggtactaatcatgaattcatcacttgtcttaatcaagatcacacctgtgggaattctgacatctatacatatcctgatgcgtgttatcgcccaaaatcttcctcctgagtccactacactcgagaacgtcatcactcagtgtcctcaatgtgcctcggtatacactccaattcttgatgctcttcacacagtgcatgatgggaaatttttacatttgactgttct

SEQ ID NO: 5991 - DNA, 320 bp, Zea mays
  Clone ID: LIB148-050-Q1-E1-A12
ctggaaacccgatgccgtctacacttccaacgtccaattctactagactttgaattcccttcgattcatccggcacagcgggctatggaccttcagcagcaagctaattaagttggcagcatgcaccgctaaccttatatactactgagacttccaaattctagtatatgtaatccttttgttcgggttcatgatcgaattccaaagagtggaaaacaagcaaaaggttaaatatacatgccatttttggaggcatttttttcatgagggcatgtttcgatatatggaccactaaatatacatatcatttactttcctac

SEQ ID NO: 5992 - DNA, 391 bp, Zea mays
  Clone ID: LIB148-050-Q1-E1-A3
acacgtatccctgttcctcgagcatctcaacgagcttctgctccgacgactacgacgcgccgccacagccacatggcggacgacgccgtcgccgccggtgcggccgtttgctgcgcagggccgggctcgctgtcttctatcacgaagcagcagcagcagcccgacgacgccggctgcggcagcagcagcagcgacgaccactaccagcacgacgtgatcatgctgaggcggactaggagcgggcgggcattcccgccgccgatctccgtgatcggcaagggcgggcggccgtggctctgcctgcgggcgcaccgcgagggtggacgcctcgtgctgcggcagatgcgcctgccgtcgcaggagctgctgcatccctgcaaggacgacggca

SEQ ID NO: 5993 - DNA, 186 bp, Zea mays
  Clone ID: LIB148-050-Q1-E1-A5
acgcgtccgcctgctcctcctcgccatcttcatcccggctatcaccacccccgtcgaggcccacattctcgcccaggtgtttggcgacgaccaattccaacgggcagggcaaccagctgcacctcacgaacatctcccaggccttgccgatgctcccgagggtgacaacgccgcgcgaactgctgc

SEQ ID NO: 5994 - DNA, 282 bp, Zea mays
  Clone ID: LIB148-050-Q1-E1-A6
acgcgtccgcacacgcgtccgcccacgcgtccgcaagaacgcaatggccgctctttacaatgagcttgaggaagaacggagcgcttcggcggtcgcggctagccagacgatggccatgatcaatatgctgcacgatgagaaggctgcaatgcagatggaggctctgcagtacctgaggatgatggaacagcatgctgaccaccaccacctggcgattcaggacctgcacgatttgcttaccgagagggagaaagagttgcttgactttggcgctgagctcgc

SEQ ID NO: 5995 - DNA, 411 bp, Zea mays
  Clone ID: LIB148-050-Q1-E1-A8
cggtccacccacgcatccgagtaggtctgccatcaatggaaagccgggaactcataatgcggcgacttctgtcaaaggagaaagttgatgaaaggctgaacttcaaggagctagcaaccatgacagaaggatatagtggaactgatctcaagaacctgtgcacgacggcagcatatcgccctgtgagggagctaatccagaacgaaagaaagaaggagctggagaagctgaagcgtgaaaaaggagaaactccatcggatcttccgaagaatgaagagaccatcaccctaatgccgctgagcacggcagatctgaatgaatcaaacaaccaggtggatccatgccttaccaagtgcaatttgccacgatgcggatgcaaattaacacttttcaacttgagaaataggttaa

SEQ ID NO: 5996 - DNA, 245 bp, Zea mays
  Clone ID: LIB148-050-Q1-E1-A9
ctgcaaataggtccatgcaccccctcctccttcttgacacaaatcccctttgtaatgaattaaccatgcatgcatgcatgcatgtatgcatgccccggtggttacgtgtcattcagctcacgcgctgaccgagtctatacatacgtcgtcaccggctggccacgcatgcgataaccatctgatattgaccggactatataatgtattcctaataatcctgcattttccaagctaattgttttttt

SEQ ID NO: 5997 - DNA, 391 bp, Zea mays
  Clone ID: LIB148-050-Q1-E1-B11
gagagccaaccccatcatcatcgaccagtacttctgcccccagaaggtctgccccggcaagcgaagcaactcctcgcatgtctccatcaagaacgtcaccttccgcaacagcggccggcacgtcgtccacgcccgaagccgtcagcctgctctgctccgagacgcagccgtgcagcggcgtctcgctcatcgatgtcaacgtcgagtacgccggcaagaacaacaagaccatggctgtgtgcagcaacgccaagggaaccgccaagggaagcctccaggccctggattgcctcgtctgatcgatgaccttgcatttgcatgcattcttcttccgtttcacttttccatattctattgcgttccagccaagcatcttgtttcttttagatat

SEQ ID NO: 5998 - DNA, 386 bp, Zea mays
  Clone ID: LIB148-050-Q1-E1-B12
atgatagtgatgcaccgcgacgtgaaggcggagaacatgctgctggaccggaagcggacgctgaagatcgccgacttcggcgtggcgcgcgtggaggcgcagagctgcgaggtgacggggcagacgggcacgctgggctacatggcgccggaggtgctgcaggggaagccgtacgaccacaagtgcgacgtgtacagcttcggcatcctgctctgggagacctactgctgcgccatggcctaccccaactacagcctcgccgacatctcctaccacgtcgtcaagctgggcatccggccggacatcccgaggtgctgcccgcgggcgctggtggagatcatgacgcggtgttgggaccggaacccggacaaccgggcggagatgtc

SEQ ID NO: 5999 - DNA, 275 bp, Zea mays
  Clone ID: LIB148-050-Q1-E1-B3
gggtccatccacgcgtctaaagaaaatcgaatcaacaaaaacaatgaataacaacaaacacagaaattaaaagatgacgaattcagacacagaataacgcaaaagggggcggccgtactataagatcaaaacttaggtcaccatgcatacaatctcatacatcttcgaaaaggtccccgcaaatccaatccactggacgtctattataatcctccagcacgggaaaaccctgctctcacctaacttacgcgctttgcaccatacccccctttcac

SEQ ID NO: 6000 - DNA, 309 bp, Zea mays
  Clone ID: LIB148-049-Q1-E1-H12
gtcgtatagagccgcctcggcgactccgtcagcatcccgctgccgccgcgggccgcgtccgagatggcgagggaccaggaccgctgatacagcgaccactggggccgccgcgcctacgactcggtctcgctcagcagcgactccatgcccgtcctcacgggacgcacgcccgtcgagtgctacagctccttcattcgcgcgttccgccaccacttcgccacgcacctcgccagcacgatctcggcgatctaggtcggcatgggccccgcctgcgacctgcgctacccgtcgttctcggcgagcaacggc

SEQ ID NO: 6001 - DNA, 462 bp, Zea mays
  Clone ID: LIB148-049-Q1-E1-G10
cacaacttgagacctgcgttgtcacccacccatcaaggttggggccgccagcaggttcagccgttcctgttcttgctaaaacgagagaaggatggcagtgtctcagggagctgtcctattcttgtttctcctcgtcgcagcagaggtgggaaccatcgatgccaaaatgggagtagccatgcccatgcatgccttgataatggagaaagcgaaacagcaggagacggagaagaaggaggagaaaagcacggagaaggaagagagtcaatgcttatcgccgagtctccagttcgagggcttctgcttcaacagcgacagatgcgccgatgtgtgcatgaaggagagctttcccggtggcgagtgcaagcaggtcgtggccacgcgcaagtgcttctgcaagaagccttgctagttcatcggtcttgctaattgttgatgggtgcttcattaatttgatttgat

SEQ ID NO: 6002 - DNA, 456 bp, Zea mays
  Clone ID: LIB148-049-Q1-E1-G11
cgaaactacgcgctgcaccgaccgaccaaaccctaggcgttcggcgggcgtcaccacggcggcgaagaaagggtgcctcgcgtcgccttggtgtccccgaagtcgtcgacggtgcagctcgatccgcctcgtcgagcatgtcgaggagggtcccttgcaaattcttcttgcatggagcttgcttcaaaggagattactgtgaattctcccatgactgcaatgatcaaccagataatgtttgcactttctaccagaaagggacgtgcacctttggtagccgttgcagaaatgaacatgttgaagttcattgtaactgcccccaaccagcaaccactgtagcgcgtgcatcctccaattcttctcagctagttgcttcttccagagatccccattgcagcgaatgccaaacggatttatgtgaccaaacacagcagatttgcaagtcaacagcagcac

SEQ ID NO: 6003 - DNA, 444 bp, Zea mays
  Clone ID: LIB148-049-Q1-E1-G12
tccggaaacaatgggtgatattgagaatcataataatccaattcaattcaatgaccgcccctggatagagtcccctaactcgtggagatcactatgtgttgtcacgcaatcagactgtcatgctctgtcacacaatgctgacatttgcaaccttcttgagagaaaaaaggtctcaaagtctcttgagagtgacttcagcaataaaatgaaccagctgttgctaacagctctgcaaaaacaaaggcaacaacggatgatggatgactttggaggatactatgatgaacgcatgtactggagacaaaatgatgaaattcgtgatgctgataaggaggcatctgctccatgttcattagcccctgtcgcacatcttggagctcatcagcaagagagttggcagcattcttcatttggaagtcaacatcaacaccacgataaacaaaa

SEQ ID NO: 6004 - DNA, 466 bp, Zea mays
  Clone ID: LIB148-049-Q1-E1-G2
gtatactgcgaaataggtcgttttctttgtggataagaagcttacagaacttcctgatcgatcagtgggatccacatcagtacttcctgtgagtgcaagggataaagataccaagttgaaagaagaaaataccagattgctgaatggtaactctatggattcagctgatcggaggccacggacacaaatgaatggaaagcaaattgagaatgaaagccatgttgatagtgaaactgtgaaaacatgatcaactatcaaggaggggattttgttagctaagagacgtttcagacgactaaagaaatatgggatgccatccgctttggtgcctactgcctagctccttgacgacttcatgaaatatagctacgaaggaaatagttttacatctcgctgttctaggcagcagaagttttgtttgcaaaactgtacatcttcctcggctctctcatttgtaacccttttt

SEQ ID NO: 6005 - DNA, 453 bp, Zea mays
  unsure at all n locations
  Clone ID: LIB148-049-Q1-E1-G4
gcgtgaccggccgcaagagcttcgccgacggcatcaccaccatgaagaccgccaccttctccgtcgaggcgtccgggttcatctgcaagaacatggggttccacaacacggccggcgcggagcggcaccaggcggtggcgctccgggtgcagggggacctcgcggcgttctacaactgccggttcgacgcgttccaggacacgctgtacgtgcacgcgcggcggcagttcttccgcaactgcgtggtctccggcaccatcgacttcatcttcggcaactcggcggcggtgttccagaactgcctcatcatcacgcggcggcccatggacaaccagcagaactcggtgacggcgcacgggcgcaccgaccccaacatgaagtccgggctcgtcatccagaactgccgccntggtgcccgacagaagctgttcccggaccgcttcaagatccctc

SEQ ID NO: 6006 - DNA, 384 bp, Zea mays
  Clone ID: LIB148-049-Q1-E1-G5
gatggacctcggcatgttcagcaaggactcgcgccgccgactgctgtcgtcggagcaggatgagaagggctggcccgtgtggatgcggtcgccggagaggaagctgctggcgtcgggcaaccagcccaagccgaacgcgatcgtggccaaggacggcagcgggcagttcaagagcatccagcaggccgtggacgccgtgcccaagggccatcaggggaggtacgtcatctacgtgaaggccggcctctacgacgagatcgtcatggtccccaaggacaaggtcaacatcttcatgtacggcgacgggcctaagcaaagccgcgtgaccggccgcaagagcttcgccgacggcatcaccaccatgaagaccgccaccttctccgt

SEQ ID NO: 6007 - DNA, 476 bp, Zea mays
  Clone ID: LIB148-049-Q1-E1-G6
gtgcaagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgcatgtatgcatgcgccggggtga

SEQ ID NO: 6008 - DNA, 474 bp, Zea mays
  unsure at all n locations
  Clone ID: LIB148-049-Q1-E1-G7
aaagaaacaggcacacaagaacaaatacctcgccaccaacaatggcctccaggtcctccatcctacttgcaacggcgatgctggttgcgctgtttgcggttggtttgtgcaccaccccgctcaccttccaggttggcaagggatccaagcctggccacctgatcctcacccccaatgttgcaaccatatctgacgtggagatcaaagagcacgggggcgatgacttctcctttacgcctcaaggngggcccgacgggcacttgaaccctcaacacaaaggcccccctcagttaccccctttgcatcggctttgcggtcaattccggtggcaacggcatcgccaacaacttcatccccgccaatttcaaggccggaacaacttacagaacaacactcaccatctaatcagcctctgatgatgaattatatttcaaaagagctcacctgccgctcacgtaagcaagacaatatttt

SEQ ID NO: 6009 - DNA, 479 bp, Zea mays
  Clone ID: LIB148-049-Q1-E1-G8
cccaagcgtccgcggtcgcgtggggaatcatgagaatgttgtccaactcgtcggatactgcgccgaagggagcacccacgtccttgcttatgagtatgcaactaggggatcattgcatgatatcctccatggtaataagggtgtcaaacgagcccatccagggccagtcctgtcatggatgcatcgagctaggattgccgtatgtgctgctcggggtctcgagttcctccactagaacgccgatcctcatgtggtccaccgcgacatcaattcaagcagcatactgctctttgaccatgatgttgcgaacatcggggacttcgacatctcaaaccagtcccctgacatggctgcgcgcctccactctactcgcgttcttggcacctttggctatcatgcaccagaatatgccatgactggacagcttagcacgaccagtgatgtctacagctttggagttgtgctgctggagcttttaa

SEQ ID NO: 6010 - DNA, 85 bp, Zea mays
  Clone ID: LIB148-049-Q1-E1-G9
cgggtcgaccacgagtccgggaaaaacagcagcctcgaataagagccagccagagagtctaatagatctctcaccgcctgccatc

SEQ ID NO: 6011 - DNA, 485 bp, Zea mays
  Clone ID: LIB148-049-Q1-E1-H1
cccaagcgtccgcccatttcctccttcgtccgcatcagggacacactgcctccgcatgcggcaagatcctccctcattccccaaacatgagaggagcagaggaggagagatctggcgccgccactgatgcgggaggagaggaggagaaacgggagaggagcgtcggcctgatggccggcctcatggacaaggccaagggcttcgtggtggagaaggtgacgcaaatccccaagcccgaggctgcgctggatcacgtctccttccagagcatcagccgcgagggcgtcgagctgcatagccacgtcgacatcagcaacccctactcgcaccgcatccccatctgcgagatcacctacacgttcaagagcgccggcaaggtgatagcgtcgggcacgatgcccgaccccgggtggatcgcggcgagcggcagcaccaagctagacctgccggtgaaggtgccgtacgacttcatcgtgtcgctgatg

SEQ ID NO: 6012 - DNA, 475 bp, Zea mays
  Clone ID: LIB148-049-Q1-E1-H10
ccgcaggcgggcggcgccctgaagccggacttcgatagccagtcgtgcccgcgcgcggagcggatcattgcggaggtgatgcacacgaagcagatggcgaacccgacgacggccgcgggcctgctccgcgtcatcatccacgactgcttcgtcagcgggtgcgacgcgtcggtgctgatcgcgtccacccagttccagaagtcggagcacgacgcggagatcaaccacgccctccccggggacgccttcgacgccgtggtgcgcgccaagctggccctggagctggagtgccccggggtggtgtcctgcgccgacatcgtcgcactggcgtcgggcgtgctgatcaccatgaccggcgggccccggtacccggtcccgctggggcgcacggactcgctgtcgtcgtcgcccacggcgcccgacgtggagctgccgcacgccaacttcaccgtggaccgcctcatccagatgttcg

SEQ ID NO: 6013 - DNA, 276 bp, Zea mays
  Clone ID: LIB148-049-Q1-E1-H11
cttcaaccagtgcggcggcaacgtcggcgactccgtcagcatcccgctgccgcggtgggccgcggaggagatggagagggaccaggacctctgctacaccgaccagtggggccgccgcaactacgagtacgtctcgctcggctgcgacgccatgcccgtcctcaagggacgcaagcccgtcgagtgctacaacgacttcatgcccccgttccgcgaacactttgccgactacctccgcaacaccatcctggaaatccaagtccgcatgggccccgc

SEQ ID NO: 6014 - DNA, 399 bp, Zea mays
  unsure at all n locations
  Clone ID: LIB148-049-Q1-E1-F8
aagactctaaacaaagtcctatagccggccaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagaggcggccgtcgccgagcccgatcacaaggaggaggaagccgtggagaagaccgtcgtcgangacgagaagccagcggcagccgccaatgcagaggaaaaggtcgccaccgccgccgaaaacacgacg

SEQ ID NO: 6015 - DNA, 345 bp, Zea mays
  Clone ID: LIB148-049-Q1-E1-E12
tcgtataacagtacccagagagccatggcgggtcgtcctcctcgccgtcacggactttgactccttctcgctgcgcaaagaacgcgaggtccagctgcagcgcggcgcaaccgggacgtggcggataaggcttgatgaacggcgagcctgacacaggacctcggaatgcaacagtgtccatgaccggcgacgttcgtgccgatggacaactgccccaatgagagcatccagttttccagatgcaatgccagagtaaagttcagtagtggtaactgcacggatgacctcggcgagatcaggagcctgtcgctgaataaagttccggagtagctgtcgcttgcatgc

SEQ ID NO: 6016 - DNA, 422 bp, Zea mays
  Clone ID: LIB148-049-Q1-E1-E2
caaaacatggctgtgaatgtgagaaccatgtggtcgtcgatgcgggcacatgttgcgatggctgtggcgttggtgttcttggtgagcggcgcatggtgcggtcctcccaaagtccccccaggcaagaacatcacggccacctatggcaaggactggttggacgctaaagcgacatggtatggcaagccgacgggtgccggtcccgacgacaacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgcggcgtaccacttcgattt

SEQ ID NO: 6017 - DNA, 488 bp, Zea mays
  Clone ID: LIB148-049-Q1-E1-E3
agagacaccaagcgttgaactcgcctaagcagctatcaaccaaccctagaaagctagacaccgtacccatggctcgcgctagcgtcgtctttgtcattgccgctctcctcttcgtcgccatggtcgtagcaccgatggccgaggcaaagtccgccgatgcccctgtggctgacgcgccagccgatggacctagcgggccggctgctgcacctggcccccagggtgtcgaaggcctgtcaggcaatgaggatgacgatgatgactccaccaattgaggccacacacgtcggcccggttaaatttggaacaagacatggaagaaaattgagagcaatgtcttaaaaacaatgataaggtgtggtcatcaactcatcaatggatacatccttgctctccctcttttcctttcggtttgatttccaatgtgtaaccatgttgtaagttaacggtatcgactcatggtatcaggatctaaaaaattatcgttc

SEQ ID NO: 6018 - DNA, 162 bp, Zea mays
  Clone ID: LIB148-049-Q1-E1-E6
cacaatctggttctcagtgacacactctgcatctgaaaggaccgatgcacatgtaaagatgaaggtatgtgctcatgctgtgctagtgaaagccttaaattcagtgttctgttgtctctctggtggcgtactgtcactgttgactggcctacggatctgagt

SEQ ID NO: 6019 - DNA, 372 bp, Zea mays
  Clone ID: LIB148-049-Q1-E1-E8
gtcgatacgagaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgattgcgacatcggcgaagtgtttg

SEQ ID NO: 6020 - DNA, 470 bp, Zea mays
  Clone ID: LIB148-049-Q1-E1-E9
agaatatatggattctatgatgaatgcaagcgtcgatttaatgtgcggctatggaaggtcttcacagaatgttttaacactctacctgtggctgctcttatcgatgataaaatattatgtatgcacggcggactctctcctgatctagcacacttggatgagataaagaacttgcagcgtccaactgatgtaccagatcaaggtctactgtgtgacttgctttggtcagatccaggaaaagatgctcaagggtggggcatgaatgatagaggggtctcatatacctttggtgctgacaaggtttcagaattcttgcaaaagcatgatcttgatcttatctgtcgtgctcaccaggttgtcgaggatgggtatgaattttttgctgacagacagcttgtcaccatattctcggcccccaattattgtggtgaatttgataatgctggtgcaatgatgagtgtccatgaaac

SEQ ID NO: 6021 - DNA, 447 bp, Zea mays
  Clone ID: LIB148-049-Q1-E1-F1
agccgaaggcctcgtgccttctcttcctccctggcatggaggaagtagctgtttcgcctatgatcgttgccgccgtagtgctggacaacaatggcgctgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgctccactcccgtctcctccagtagcccttccactcgcaagaagcgcggggcgttcagcctcttcagggcgatgttcctgtccttcggccggagcgacgacagcatgaagaagacagacgacgacaacacgagccccaagaagagagccatcgcggctgctgatgacgattgcaagcctg

SEQ ID NO: 6022 - DNA, 468 bp, Zea mays
  Clone ID: LIB148-049-Q1-E1-F10
gtgaagtccacagcattggagttgtgctgctggagcttttaaccggtcgcaagccagttgaccacacactgccccgtggccagcagagccttgtgacatgggctacaccgaggcttagtgaagacaaggtgaggcaatgcgtcgatccaaggctcggagacgaataccctccaaaggctgtagccaagatggctgctgtggccgccctctgcgtgcaatacgagggtgaattccgtcccaacatgagcatcgtcgtcaaggctctgaaccccttgctgcacagccggtctggcaaccgccctactgcctcgtcggcctcccacgctgccgagcgatccggactgtgatttctcatcgctgcgacaactttgggttcacgaaaaaggaccgtcttgtggagcgttggtgttgctgtgtcgtgactgccaaagccttggcgcagagaagagctttgccatgcagctgtgt

SEQ ID NO: 6023 - DNA, 138 bp, Zea mays
  Clone ID: LIB148-049-Q1-E1-F11
tgaaataagtcgtattaataaaaaataaaaaaaaaaaaaaaaaaaaagaaaaaaaaaaaaaaagataaaaaaaaaaaaaaataataaaaaaaaaaatagggggggtcgtactaagggttcaagttttttttcaggggg

SEQ ID NO: 6024 - DNA, 428 bp, Zea mays
  Clone ID: LIB148-049-Q1-E1-F12
gcaagacgtaccgcctccgcgtgtgcaacaccgggatcaaggcgtcgctcaacttccgcatccagggccacgacatgaagctcgtggagctggagggctcacataccctgcaggacgtgtacgactcgctggacgtgcacgtcggccactgcctctccgtgctggtcgacgccgaccaggcgcccggcgactactacatggtggcctccacgcggttcatccacgacgccaagtccgcctccgccgtcatccgctacgccggctccagcggcgccccgccggcgcccaacatgaccgagccaccggccggctgggcctggtccatcaaccaggccaggtcgttccgctggaacctgacggccagcgccgcgcgccccaacccgcagggctcctaccactacggccagattaacatcacccgcaccatc

SEQ ID NO: 6025 - DNA, 402 bp, Zea mays
  unsure at all n locations
  Clone ID: LIB148-049-Q1-E1-F2
cccaagcgtccgctcctcctcccccgccggccaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagaggcggccgtcgccgagcccgatcacaaggaggangaagccgtggagaagaccgtcgtcgaggangagaagccagcggcagccgccaatgcagangaaaaggtcgccaccgccgccgagaacacgacga

SEQ ID NO: 6026 - DNA, 473 bp, Zea mays
  Clone ID: LIB148-049-Q1-E1-F3
agcgacccagccgacgccagggccctcagtggcgtgtgggcgtcctgtcccggtggatagggcacgaacccaagctccggctcaccggtgggtggcccggccaggcgcggtggccgggcgggtgcggcctcctgccccgacctcggctcggcgcgcgcaggcgcctggcagcccccagcctcggcctcggccaggcgcgcgcgacccccagccccggctcgccggctcgccggtcatggtggctccgatccgggctcctccggcatgggcaggcgcgggttcccccggctagcagcctctcctggtgggcacggcctgccccggcggctcaggaaggcgcggcggccccggcgtgcacagccgtggtccagccatggcggcgcgggcacgcagcctcggctccccggcgggcatccatggcgcagtacgggcgcgcagcccggcggctagtctgctcggcggggcaccggcct

SEQ ID NO: 6027 - DNA, 458 bp, Zea mays
  unsure at all n locations
  Clone ID: LIB148-049-Q1-E1-F4
cccacgcgtccgcaacgctaccgtcgtcatggtgttcgacgccatggacagcgatgccgaccgggctgcgatcctggagtggctggaggtgcagatctcggaggccaaggacctggagttcaaccggaaggacgtgctggagaagatggacaggtggcaggcggcgctggaggaggagtcctggctcgaggagtacagcagaaacgagaacagatacaacgttggcaaagggacgcatctcgtgctcaagcgcgccgagaaagcccgcgccctggtcagcaaaatgccggtgatggcggaagctctgatggcgaaggtagtcgcgtgggagaaggagagaggcgccaagttcgagtacgacggtgaggtgctgctggacgtgctggatgactacggaaacgcgaggaaggagaaggagcangagcggaagcggcagcgggaccagcggcggctgctgc

SEQ ID NO: 6028 - DNA, 291 bp, Zea mays
  Clone ID: LIB148-049-Q1-E1-F5
cggaagcgtgggaagaagcaggacgacgccctcgacgacctcagcggcgtgctgggccagctcaagggcatggccgtcgacatgggctccgagcttgacaggcaaaacgaagcgctggatcatctgcaaggcgacgtggaggagctcaactccagggtgaagggagcaaaccagcgtgcgcgcaagctcgtcgccaaataggccgcctagctcgaacgtgggagcttgcgcattcctgggtctggtttgcgccacgattcagcctcgccggttgattgcttgctgtagcat

SEQ ID NO: 6029 - DNA, 442 bp, Zea mays
  Clone ID: LIB148-049-Q1-E1-F6
gccgtgacggcgtcacccaaggcgcggacggtgctggacctgtgcaacaacctgtacctggacgtggaggacaacctgggagcctgccgccgcgccatcggcttcaaggacgccgtcaccatccgcgccaccatgggcatggcggcgcaggacatgcagaactgcgacgagcagttcaggcagatcggcgagaagaaccccatggagcagttcgacgcgtcgctcgtcgagatgtccgagaactgccgctcgctctccaacatgatctgatcgatctccttctccacggacgacaacagagagccgggcgttttgggccctcgcatcgtttgtcgccgctgctaacgttcgcatgcccatgcccgcgagcgcgctctcgcgcgacaataactgatgagttaagtttgttttgctttgaccatctcacatcgttaattcctgg

SEQ ID NO: 6030 - DNA, 483 bp, Zea mays
  Clone ID: LIB148-049-Q1-E1-F7
gtcgatggctacgccttcttcggcgtcgggatgggccccgggaagtggtcgccggaggtgaggaagacgtacaacctgctggacacggtgagccggcacacgatccaggtgtacccgcggtcatggacggcaatcatgctgacgttcgacaacgcgggcatgtggagcgtgcattccaacatctgggagcggtactacctcggggagcagttctacatcagcgtcgtctcgccggcgcgatcactgcgcgacgagtacaacatgcccgacaacgccctccgctgcggcaaggtcgtggggctgccgctgccgccgtcctacgcccccgcgcgctaagacgacgaaggcctcgttttctcctcgtggtctgaccatccaatccaaactcaaaagaacaaatacgaaagaagcgtagtgaaggggaacaaatgaatggatatatgtaatcttgagatgcatgccctctcaaatcactgtactggg

SEQ ID NO: 6031 - DNA, 454 bp, Zea mays
  unsure at all n locations
  Clone ID: LIB148-049-Q1-E1-E11
cccaagcgtccgggacaatcttgttaacagagttttaaggtttcccagcagagaagagcgcgtgcaaccaccacattcatataattaataagcaaggtttagagaagaggcaacatgggcacaaagatgaagaaggggatcctgaagccgttccgctatatctcaaccatcatggatggtaaggaggctgaaatgcaaattgggttcccgacggatgtaaaacacgtggcacatattggttgggatggtcctggctccacgaacaacaacaacaataacaacagcaacaacaatagtggcggagcacctagctggatgaaggattaccactcggcaccgcttgactcgtcctcttttaggagtgagagtgggggcacggctgctgcaaatcnctgggcttctcaagagatagtcatggatggagcaagcgtcggagaaacctccttcaaggaca

SEQ ID NO: 6032 - DNA, 190 bp, Zea mays
  Clone ID: LIB148-049-Q1-E1-C2
aaaaaaaaaaaaaaaaaaaaaaaaaaaaaaaaaaaagaaaaaaaaaaaaaaaggaaaaaaacaaagggaggccgccctaaaagttccaatctaagctacacgtgcatcgcacgttcaatactcttcaaaagtgtctccaaacttcatttcagtgaccgtcgttttataacatcgtgacgtgggaaatccc

SEQ ID NO: 6033 - DNA, 478 bp, Zea mays
  Clone ID: LIB148-049-Q1-E1-C3
cccacgcgtccgagtggccgtaccacaggtatcgtgctcgactcgggagatggtgtgagccacaccgtccccatctacgagggatacgccctcccccacgccatccttcgccttgatctggccggtcgcgacctcaccgactacctgatgaagatcctgactgagcgcggctactccttcaccaccaccgctgagcgggaaatcgtgagggacatgaaggagaagctcgcctacatcgccctggactacgaccaggagatggagaccgccaagaccagctcttccgtggagaagagctacgagctccccgacggacaggtcatcaccatcggcgccgagcgcttccgctgccccgaggtcctcttccagccatccttcatcgggatggaagctgccggcatccacgagaccacctacaactccatcatgaagtgcgacgtggatattaggaaggacctgtacggcaacatcgtcctct

SEQ ID NO: 6034 - DNA, 313 bp, Zea mays
  Clone ID: LIB148-049-Q1-E1-C4
accacgcgtacgccctagcgtccgaatggacgtgtcagacgtatcgtgctcgactcgggacatggtgtcagccataccgtccccatctaccagggatacgccctcccccacgccatccttcgccttgatctggccggtcgcgacctcaccgactacctgattacgatcctgactgagcgcggctactccttcatcaccagcgctgagcgggaaatcgtgagggacatgactgagaagctcgcctacatcgccctgcactacgaccaggagatggagaccgcgaagaccagctcttccgtggagaagagctacg

SEQ ID NO: 6035 - DNA, 120 bp, Zea mays
  Clone ID: LIB148-049-Q1-E1-C6
cggacgcgtgggcgacggcgtctccgtgatggggtccagcgatatctggatcgaccacctgtccatgagcagctgcgcggacgggctggtggacgcggtggagtgctccaccgcttgtct

SEQ ID NO: 6036 - DNA, 489 bp, Zea mays
  unsure at all n locations
  Clone ID: LIB148-049-Q1-E1-C7
caaacgtgtgccttttggagacgcgatgtcgtccggcaacaagatcagcgtggccttgctgagcgtggccctagtgggcctgctcctctgccacctcgccaccaccgcctccgcccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggcgccggggccgtcgtccggttgaactgagaagcgtgcgtccagccaagcaaggtggtcaaaaccgagaactaattaagggctcgatcgtgtgtcaggctactactgttcttgccataattatatatagatacgcanagtgtggccaagcctacccacatgcatgctattgcatgcctccgaatatatattatccgactcgatcctgccaaattgtntcgtcgacntcatgatatatat

SEQ ID NO: 6037 - DNA, 191 bp, Zea mays
  unsure at all n locations
  Clone ID: LIB148-049-Q1-E1-C8
cggaagcgtggtgcgtgcctagcatgcatgcatgtgacgacctctcctcctcgctgtctctctgtatctgcaactgcaagcaaggaaattaattaaaagaagatcggcgccatggcggcaacgacgacggggatgcagatgatgcaggtgcagcaagcngcggcgttgctgctgtgcttggttgtgtttgc

SEQ ID NO: 6038 - DNA, 448 bp, Zea mays
  unsure at all n locations
  Clone ID: LIB148-049-Q1-E1-C9
gcggaaggggaagtcatgcaagggctgcctctactactcgtcagtgctcaagtcccgcggttacaacccaatctgcgttgggatcccccgctccatcccccaagttcctaactacgtggtggatgaacctaaggaggaggcgacggcgcaggggcatgacctcaggcggttcaggtacgggtgcgcgggttactccatgttcgtggacaacagggacggccagggtggtgagagcgagggcaagacgttgttgccatattgcaggggcctcgagttattggtggacagcagattggtcgagagaaagccatcggcaactgaacaagctccagcacatgttgcaaaggatgcagcagctaccatccgctctcaccaacaaggacaacagagacctcagaacttgtcgaggcangaattcttggacaggtttaagangagcgctggactg

SEQ ID NO: 6039 - DNA, 337 bp, Zea mays
  unsure at all n locations
  Clone ID: LIB148-049-Q1-E1-D1
cggacaagttcgtggcggtggtgaaggaggcgatcaagaagccggagatggacgagaaggaggtggcgatgcggagattcctgngcagccgggtgaagacagcgatggagccgcggtcagagtcggagcagccgcggcgccgggaggtggctcggagcaacgacgtgatcgaggcggcacgcaccaagctgatgcagaagcgccagtgcagcaaggtcaaggcgctcgtcggcgccttcgagactgtcatagacaccaagaaggacgccgccgccggcaggcaaaacacatctacgcaaattaacttaaaacatactgcggccggcgggacgcatcg

SEQ ID NO: 6040 - DNA, 455 bp, Zea mays
  Clone ID: LIB148-049-Q1-E1-D11
ctcgaggagaagtcgcccgagtacgtggccgtcaagaaggcgtcgtcgacaccgcagaagagctcctcgtggctcgggaggagggcagggtcgtcgcttggtgggcttggacacagacgggccgcttctgccgcgaaggtggacgatctaagcagcagatccgcgggggatctggtcatggtgaacgaaagcaagggcgtctttgggctcacggacctcatgaaggcggcggccgaggtgatcgggagcggtgggctcgggtcggcatacaaggcggtgatggccaacggcgtggccgtcgtggtcaagcgctcccgcgacatgaaccgggcgaccaaggacgcgttcgaatccgagatgaagcggctcggcgccaatgcggatgccaaactgctgccgccgctggcctaacactaccgcaaagacgagaagctcctggtctacgagtacatccc

SEQ ID NO: 6041 - DNA, 384 bp, Zea mays
  Clone ID: LIB148-049-Q1-E1-D12
taagggacaggcgcaccagaccccggcgacgcagacgaagctgttcctggaccccgcgatgcccttctacggcgtgaaggtcgacgccgtccacgtggccggccaggccctcgacatccccgccgaggtgtgggaccccaagagcggcggcgtgatcctcgactccggcacgaccctcacggtcctcgccaccccggcgtacaaggccgtggtcgccgcgctgaccaagctcctggccggggtccccaaagtggacttccccccgttcgagcactgctacaactggacggcaccgcgaccgggagcgccggagatcccaaagctggcggtgcagttcaccgggtgcgcgcggctggagccaccggcgaagagctacgtgatcga

SEQ ID NO: 6042 - DNA, 474 bp, Zea mays
  Clone ID: LIB148-049-Q1-E1-D3
ctcgactccactgcgtccgctgcacggaccgtgggcgacaccgtgcaggacgcgtgcagcaagacacaattccccaagatctgcgtggacagcctcaccgcaaagccagagagccagaaggcgaccccgcgccggctggcggagctgttcgtgaacatcgcggccgagaagggatccgggatggccacgttcgtgcacgggaagtacaacaacgccaaggacagcaccgtgttcaagtgctacgacagctgctcggacgacgtcgaggaggccgtcgcccacctcaacggcctcgtccgggagcccaccgacgccaagttcctggagctcaagtcgtggctctcctccacgctcggcggcacctccacctgcgaggacgcctgcaaggacctgcccaagaacggcgacaaggacgacgtcgtcaacttcagcctcgacttcgagaagctgcagcgcgtcacgctggacctcatc

SEQ ID NO: 6043 - DNA, 183 bp, Zea mays
  Clone ID: LIB148-049-Q1-E1-D4
tgcacggaccgtgggcgacaccgtgcaagacgcgtgcagcaagacacaattctccaggatctgcgtggacagcctcagcgcacagccagagagccagaaggcgaacccgcgccggctggcggagctgttcgtgaacatcggggcccagaagggatccgggatggccacgttcgtgcacgggaa

SEQ ID NO: 6044 - DNA, 251 bp, Zea mays
  Clone ID: LIB148-049-Q1-E1-D5
actccctatagaacgtcgtattatggaggcgatgtctaggccggagatggtcgacaaggaggtggggatgcagtcattcctgtgcagccgggtgaatgacagcgatcggtccgcggtcatggtcgctgcagcggcggcgccgtcaggtgggtcggagcagcgacgttatgtacgcgccactcaccaggctgatgcgcgagcgccaggtgcagcagggtcaaggcgctctgtctgtgcgttcgagactgtca

SEQ ID NO: 6045 - DNA, 414 bp, Zea mays
  Clone ID: LIB148-049-Q1-E1-D7
cggacgcgtgggtggaggccgccatcacccgctccgattccatcatcaccgcctaccgcgaccactgtacctacctcgcccgcggaggggacctcgtctccgccttctccgagctgatgggccgcgagggcggctgctcccgcgggaagggcggatccatgcatttctataagaaggatgccaatttctacggcgggcacggcatcgtcggcgcgcaggtgcccctcggatgcggcctcgccttcgctcagaagtacaagaaggaggagacggccacgtttgccctctatggtgacggtgcggctaaccagggacagccctttaggctcctcacatttcggcctcctggaagctgcccgcaaaattggtttgcaagaacaaccattatggtatgggaacaccggaatggagggc

SEQ ID NO: 6046 - DNA, 431 bp, Zea mays
  Clone ID: LIB148-049-Q1-E1-D8
gcgcagcgcgcagcgcagcccacctatcaataaccgacgagcgaggcgcgagaaccgacttgccaccggctgctcgccgtctctctctctccctcggggcgcgcgcgcgggagacaggccaaccgatcgtcaggcggccagccatgggcaagcacgggcacggcaagtgccacgacgtggaggcgtgctacccgccgggggcagcgggcggcggcaagtacccgtacatgacggagaacccgcagctgcggtgggccttcatccgcaaggtgtacgtgatcgtgtgcctgcagctgctgctgacggtggccgtcgccgcgacggtgaacctggtgcgcgccatcggggacttcttcctctcccgcaacatgggcgccatgttcgccatcatcggcgtcatcgtcgcccccatcctcgtgatgattccgatg

SEQ ID NO: 6047 - DNA, 336 bp, Zea mays
  Clone ID: LIB148-049-Q1-E1-D9
gaaatacctgaaaaaggtacaagaaaagaaaccttaaacgtgccatggaacacacctacccaatgggttattcttaccatttgaacatacacgaccattttctacacaccacttttgagtgaagatttacaggacaaaggtggtagacgactgacatgttctcagatatggtaccaggctagtgggttgagtacaggatgagtgcaaccggtagtttgtattgtattgtatctcacgttctttgtactcaagaattttgttggctgtacaggcagaaggcggtgcgggtagcatgccttgcgtacataattatttgaatacaagttgaattgaaca

SEQ ID NO: 6048 - DNA, 335 bp, Zea mays
  Clone ID: LIB148-049-Q1-E1-E1
gggtggcggccgccatcaccggctccgattccatcatcaccgcctaccgcgagcactgtacctacctcgcccacggaggggacctcgtctccgcgttctccgagctgatgggccgctagggcggttgctcccgcaggaatggcgggtccatgcatttcgataggaaggatgccaatttctacggcaggcacggcatcgtctgcgcgcatgtgcccgtcggatgcggcctcgccttcacccagaagtacaggaaggatgagacggccacgtttgccctcgatcgtgacgggtgcggtgtaagcagggacagctcttttatgctctcaagatttcgg

SEQ ID NO: 6049 - DNA, 423 bp, Zea mays
  Clone ID: LIB148-049-Q1-E1-E10
gaaagttttgagcatggctcctggccttgagaggctcaacatccttcctttcaaggtggctgcgtatgacacaaagcaaaagaaaatggatttctttgatccatcaaggaaagatgatttcctgttcatctctggcacaaagatgcgcactcttgccaagaaccgagagagtcctccagatggttttatgtgcccgggtggctggaaggtactcgttgaatactatgacagcttggtgccatctgagggcagcagcaagctgcgtgaaccaattgcagcctaaaatctggaaaatccttcatataaggaatgctactatatcttagcaagcggttctttgcgacatagaaccgatgctatatgattgtatactggctgtaagactttaaaacactaggcttgattcggatgttaatggtgtgc

SEQ ID NO: 6050 - DNA, 385 bp, Zea mays
  Clone ID: LIB148-049-Q1-E1-C11
ggttagtccagtgaaggatcacctacccccggttcgagcgctgctaagcaagagagcacgcctgcggcaacgaggactaggctgtacctctagaggaactacacagtgctggaaccttcataatggagcaagctcgcttacaagctataatgggagacttctcgctagacaatctcactacggccagcactacgcacgtctgcactcgcgtcatgggcaccttcggttacctaacaccggagtacgcctccagcggcaagctcacggacaagtcggatgtcttctccttcggcgtcatgctgctggagctgctcactgggcgccgtcccatcgataccattaacttcattgaggacagtctcttggactgggcgcgcccgctgct

SEQ ID NO: 6051 - DNA, 80 bp, Zea mays
  Clone ID: LIB148-049-Q1-E1-A6
gaaaatcctcgcctcctccattgaccaacaattaagcctccccgaccgccacatctattaagtgcagcaatggttgcctg

SEQ ID NO: 6052 - DNA, 463 bp, Zea mays
  unsure at all n locations
  Clone ID: LIB148-049-Q1-E1-A7
cccaagcgtccgattcctgttgttgaaggaaggcctgttagaatccgtcctcttccatgttgtggccttggcatggggtggtttctgtttataattgggttcttctttgctgccattccatggtatcttggagcttttgtgctgatttgtgtccgagtacgtgattacagggagaaaccaggatatgttgcttgcactattgctgcctcgcttgctgcaattgctgtgctgcttggcgccacaaaaggagcggaggtgtggtgagcattatgccttcaattaccagcagtccggttaatgtaaatgtccgttgctcggctactttgttacctgtgttgtacatgtgttgtgcgtacaaaggatanggtgtaacgaaaatgatgtatgctcctatttgtagttggacatatacatttgacaaacggagtancatgaatgcacaccctcattaatcatttgatgt

SEQ ID NO: 6053 - DNA, 170 bp, Zea mays
  Clone ID: LIB148-049-Q1-E1-A8
cgaaaaggtgcaagagacatgtctggggcgtcatttgtatggctttaattttttttattatatatagataaggaaatattttccttaaaaatggagtacaagggattgttgagaactgcttttgttcatgatattaatatatatgatgaatatttcttgcaatttccttt

SEQ ID NO: 6054 - DNA, 469 bp, Zea mays
  Clone ID: LIB148-049-Q1-E1-A9
ccgctcaacaaagatagcatagcagcagcactcacaatagcaaaaaccaccatccgtcgtcgccaaccgtagcaaggagccaaggacatcaccaccgcccagcaataatggcgcagagcatgaggattgtggcgctggccttggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggaccagggcgccggtgccgccggcgccgcgccggcttgatcgcccagcgcattcatcgcttcagctcgatataatcgctgctccgtcagcaacccacatatgattcgatcaatcttcctcctctaatttctcgaccccgtcgaatttttttcctttctattcttctactatactactattatctgttt

SEQ ID NO: 6055 - DNA, 502 bp, Zea mays
  Clone ID: LIB148-049-Q1-E1-B1
ggtccggtagtcccacgcgtccgcccaagcgtccgcgaagccgaaggcctcgtgccttctcttcctccctggcatggaggaagtagctgtttcgcctatgatcgttgccgccgtagtgctggacaacaatggcgctgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgctccactcccgtctcctccagtagcccttccactcgcaagaagcgcggggcgttcagcctcttcagggcgatgttcctgtccttcggccggagcgacgacagcatgaagaagacagacgacgacaccacgagccccaagaagagagccatcgcggctgctgatgacgattgcaagcctgccggtgacgagtcaacg

SEQ ID NO: 6056 - DNA, 475 bp, Zea mays
  Clone ID: LIB148-049-Q1-E1-B10
gttaacctcctcttgcattgcattgcaggtcgtagttgagcagcagcaaccactgcacaggatgtcgtggcagacgtacgtcgatgagcacctcatgtgcgagatcgagggccaccacctgagctctgccgccatagtcggccacgacggcgccgtttgggcccagagcaccgcattcccacagttcaagccagaggagatgaccaacatcattaaggacttcgacgagcctgggtttctggccccgatcggcctcttccttggccccaccaagtacatggtcatccaaggcgagcccggcgctgtcatccgcgggaagaagggatctggaggcataactgtgaagaagaccggacaggcgctggtgatcggcatctacgacgagcccatgacccctggacagtgcaacatggtggttgagaggctcggtgactacctcgtaaagcaaggcctgtgaatgcatccaaacaacgac

SEQ ID NO: 6057 - DNA, 430 bp, Zea mays
  Clone ID: LIB148-049-Q1-E1-B11
gggtggaccacacgtccggttaacctcctcttgcattgcattgcaggtcgtagttgagcagcagcaaccactgcacaggatgtcgtggcagacgtacgtcgatgagcacctcatgtgcgagatcgagggccaccacctgagctctgccgccatagtcggccacgacggcgccgtttgggcccagagcaccgcattcccacagttcaggccacaggagatgaccaacatcattaaggacttcgacgagcctgggtttctggccccgatcggcctcttccttggccccaccaagtacatggtcatccaaggcgaccccggcgctgtcatccgcgggaagaagggatctggatgcatgactgtcaagaagaccggacaggcgctggtgatcggcatctacgacgagcccatgagcccgggacagtgcaccatg

SEQ ID NO: 6058 - DNA, 341 bp, Zea mays
  Clone ID: LIB148-049-Q1-E1-B12
tccggttaacctcctcttgcagtgcattgcaggtcgtagttgagcagcagcaaccactgcacaggatgtcgtggcagacgtacgtcgatgagcacctcatgtgcgagatcgagggccaccacctgagctctgccgccatagtcagccacgacggcgccgtttgggcccagagcaccgcattcccacagttcaggccagaggagatgaccagcatcattaaggacttcgacgagcctgggtttctggccccgatcggcctcttccttggccccaccaagtacatggtcatccagcgcgagcccggcgctgtcatccgcgggaagaagggatctggaggcata

SEQ ID NO: 6059 - DNA, 324 bp, Zea mays
  Clone ID: LIB148-049-Q1-E1-B3
ggcaagtgtggcagaccggggaggacctcacatgcgagtcgctgacgttccgggtgatgaccagcgaccaccgcaaggccacctcatggcacgttctccctgctgactggaagttcggcgtcacgtaccaggcgtccaagaacttctaagtagccactttccctcctcttcttcaacctgcatgcccgcaagcagccatgcagatgataacatgcatcatgcatgcatattcattctttcgctcatgcactccgatacggtgccggagttaaaaaaatataaatcaatgtgcaaattcaaatgacatcttaaccagttgtgatc

SEQ ID NO: 6060 - DNA, 180 bp, Zea mays
  unsure at all n locations
  Clone ID: LIB148-049-Q1-E1-B4
cacaagaacaaatacctcgccaccaacaatggcctccaagtcctccatcctactttgcacggcgatgctggttgcgctgtttgcggttggtttgtgcaccancccgctcaccttccangttggcaagggattcaagcctggccacctgatcctcacccccaatgttgcaaccatatctga

SEQ ID NO: 6061 - DNA, 376 bp, Zea mays
  Clone ID: LIB148-049-Q1-E1-B5
aagaccgtcgtcgaggaggagaagccagcggcagcagcccatgcagaggaaaaggtcgccaccgccgccgagaccacgacgacggtggaggcgaagaagaacgccgaggaggccgggaaggagaagctggcgcagcaaagctgatcgactgtccgtgcatgcgtgccaattaatataattggctgatgatgcctgatgttcagtgtgtgatactgtgatcaagcaaggagacgacacttgaattctctacagtttggcataggtcgggagagacactctcgaccggccacaccatgtaacaaactaaccttcgatgtctcccattattttcctccacggagttcttctgatgaaacaacatgttctaattgggctt

SEQ ID NO: 6062 - DNA, 253 bp, Zea mays
  Clone ID: LIB148-049-Q1-E1-B6
tctagatcgcgagcggccccctttttttttttttttgaaaaagaaaatatgaccgttttcaattttacacggtaatgtatcaccgaaacaagtatacaacattggccaactggtaatttccttaccatgtaccaacgtatctcctctcacccacacacatctacacaatgagggggcacagccaaaccttgcatctcaggggccgaagacacctcgctgcaaagaaggaatccccagggggaacgcatgacac

SEQ ID NO: 6063 - DNA, 487 bp, Zea mays
  Clone ID: LIB148-049-Q1-E1-B7
cccacgcgtccgcccacgcgtccgatctgcctgtcgtggagaatggcgaggtcattgcaattctggacatagccaagtgcctatatgatgctattgcacggatggaaagggcggcggagaaaggaaaagcaattgccgctgccgtcgagggcgttgaaaagcattggggagcagctgtgcctggtcctaacaattttattgagacgcttcgagaacggatgtttaggccatcgctgtctactattatctctgagaatccaaaagttgtcactgttgcaccatcagacatggtgttgacagcatcaaagaagatgctggaattaaaagtgagttcagcagttgtagcaattgaaaacaaacctggaggaattctgacatctagagatatattgatgcgtgttatcgcccaaaatcttcctcctgagtccaccacggtcgagaaggtcatgactcagagtcctgaatgtgccacagtggacaccccaat

SEQ ID NO: 6064 - DNA, 334 bp, Zea mays
  unsure at all n locations
  Clone ID: LIB148-049-Q1-E1-B8
cccacgcgtccgcccacgcgtccggcgaagatcatgctgcagctcgccgtccaggactttgactcgtgtgaccgtcccttcacccatgccggcggtgtccccaaccccatgggtaagttcgataaggagctcagccagatggccaacaactgcatggcgcttgcaaacatgatatgaatcatatatatgcggccggggacagtttggcatgtgcttacactcctgcgctagcgtgaggtggcggcgcgccgcatgcaagggaatgcttggacatgaggagcacttggttttcatttaagaaatcanntgaatataattacaattaagttgaacc

SEQ ID NO: 6065 - DNA, 466 bp, Zea mays
  Clone ID: LIB148-049-Q1-E1-B9
gagctgtccacgttaagcaatgggtcagcggcggcgtgggaaatccggggaagaagccagtggccgagagacaacagaccgcgtgaggcagcgacagtacgaggcacgccacctagcctgcagagagggtcatctgcacaccaacagggtttgcgacaatgtctagaccttcattctaacagatgcaaccttaaagagtgctgagattcaagaaacactgagcaagatgggtctcgatgccgtggtggccgcctgctacgtctttctagtacttgtctctgtgctcacagttcgcttcttctacgtactgtggcacagtggccaaccagagtcaaggttgtgcaccaccagattgcgttgtctcaatgtccttggctccgaaaaggtccagattaccagctccgggtgatgctgatgagctatctgtcattgaagaccaaattgcatggattgttcacataattac

SEQ ID NO: 6066 - DNA, 482 bp, Zea mays
  Clone ID: LIB148-049-Q1-E1-C1
gaacgtcgtacgagaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaggtgtttgtgcccatcgacgacctcctggccggcgccgacaagggtggcgatccgaggcccgtgagctaccaggtgcgcaggccgcactctggccgcgcccacggcgtcctctac

SEQ ID NO: 6067 - DNA, 396 bp, Zea mays
  unsure at all n locations
  Clone ID: LIB148-049-Q1-E1-C10
gcccagtcatggactggagcacccgcatgaagatcgcgctcggctccgccaagggcctcgcctacctccacgaggactgccatcctcggatcatccaccgcgacatcaaggccgccaacatcctgctggacaacaacttcgaggccatggtggcggacttcgggctggccaagctcacgacggacaccaacacgcacgtctccacgcgcgtcatgggcaccttcggctacctggcgccggagtacgcgtccagcggcaagctcacggacaggtcggacgtcntctccttcggcgtcatgctgctggagctgctcacggggcgccgccccatcgattacaccaactacatggaggacagcctcgtggactgggcgcgcccgctgctgagcgccgcgc

SEQ ID NO: 6068 - DNA, 448 bp, Zea mays
  Clone ID: LIB148-049-Q1-E1-A5
cccacgcgtccgcggacgcgtgggttcagggacatcgtcggcagcgcctactacatcgcgccggaggtgctgaagcggagctacgggcccgaggccgacatatggagcgtcggcgtcatagtctacatcctgctctccggcgttccgcccttctgggcagagtcggagcacggcatcttcaacgccatcctgagggggcaggtcgacttcaccagcgacccatggccgcgcatctcgcagggcgccaaggacctcgtcaggaagatgctcaaccctgaccccaagcagcggatttctgcatacgacgtcctcaaccatccgtggatcaaggaggacggcgaggcgccggacacgccgctggacaacgcggtcctcggccggctgaagcagttcaaggccatgaaccagttcaagaaggcggcgctgcgggtcatcgcggggtgcctgt

SEQ ID NO: 6069 - DNA, 398 bp, Zea mays
  Clone ID: LIB148-048-Q1-E1-H2
gtcggcccacgcgtccacaatgacacgcgcacgcaggggtacggcgtgcagacggtggccgtgagcacggtgctgttcggtgacggcacggcctgcggcgggtgctacgacgtgcggtgcgtggacagccctagcgggtgcaagcccgacgcggcggcactggtggtgacggtgaccgacctgtgcccgcccaaggaccagtggtgcaagccaccgcgggagcacttcgacctcagcatgcccgcgttcctccagatcgcgcaagagaaggccggcatcgtgccgatctcctaccgcagggtggcgtgcgtgaagcagggcggcatccggtacaccatcaccgggaacaagtacttcaacatggtgacgatcaccaatgtgggcggcgctggcgacat

SEQ ID NO: 6070 - DNA, 434 bp, Zea mays
  Clone ID: LIB148-048-Q1-E1-H4
cgggccaagcctctagttcaaggcgcatgaggtctacaagatctgcgtgctggacatacggctcgccaacgccgatcgccacgccggaaacatactcgtccgcaagcacgacggcggcggaggcggaggcatgtcgctggttcccatcgaccatggatactgtctgccggagagcttcgaggactgcactttcgagtggctctactggcctcagtgcctggagcgcttcagcgacaagactgttgtatacgtgctgaccacactgtctgaggaggacgtgactatgctgaggctccacgggtgggacgtgtcgcgcgagtgcgcgcgcacgctgcgcgtcgccaccatgctgctgaaaaagggtgtggagaagggcctcacgccttccacatcgggagcatcatgtgcagagagaccctggacaaggggtcccc

SEQ ID NO: 6071 - DNA, 323 bp, Zea mays
  Clone ID: LIB148-048-Q1-E1-H6
cgcgggccgatacacgagtctacacagacgttctgggataccgtatcgccgatgatgtcatccccgccgatttcaaggccggcaccacctacaagaccactctcagcatctgatgagcctgtgatgagtgatgacgaataatatttccagtccacgtgtcaacgagccaatatttaatttttttcctatgtttattttgtggcacaacaccatctcttcatgtgccttgttgtgttggattgattttattacatgaattgaatacactgtttatttaagattcttttgggtgaaatatagtgttcgggtctattttcaaaagg

SEQ ID NO: 6072 - DNA, 412 bp, Zea mays
  Clone ID: LIB148-048-Q1-E1-H7
gacacacgcatctacgatatcttctgccagacgtcgtacctgcagcagcacctgcaccggatcgcggtgccgctgctggtgctgcacggcgccgacgacctggtgaccgaccccaggggctcgcgggcgctgtacgagcgggcctcgtccgcggacaagtccctcaagctttacgacgggctgctgcacgacctcctgatcgagcccgagaaggacagggtgatggacgacatcgtcgcgtggctgagccccagggtctgacgccgccggcgcgttgcggtgctggccgtaggacgcgagcggcttttcgaccatctgcaggccaaggacgcctcgcctccggatggtgggtgatgacgcggtctggtctggtaggctgcgggccgacggagagcgggtgtggcttctcgcc

SEQ ID NO: 6073 - DNA, 416 bp, Zea mays
  Clone ID: LIB148-048-Q1-E1-H8
aggaggcatcaccgtgaagaagacagggcaggcactcgtggttggcatctacgacgagccgatgacgcctgggcagtgcaacatggtggtggaaaggctgggcgactacctgcttgaacagggcatgtaactactacgtaccagctggaatgcatgtcgacgacgatggtttcgagtttcgacttccaataatagtaacaacaaagcaaaggccttcctcccggcgtatttgctttggctcttctcctccacgccataagatatctagcaattggtgactcgccttaattagttcgctttgcttttgaggttgactcgaccattttgctgtagcgtgaattgcatggacatgcaacgctccaatggcctttggaatgtggaatttttttcccgtttctgtaattttcctataaaat

SEQ ID NO: 6074 - DNA, 488 bp, Zea mays
  unsure at all n locations
  Clone ID: LIB148-049-Q1-E1-A1
ctctagagacattcattgacaccgtcgccatgggctgctccccgccgtgaaactcgcgggtcgccgtgggctccttcttccccgccccactccgaaccgtgtcccatcgactgcgtagggtaatcgaatcgtggcaccatggcgggcatagctgggactgcacaccgaagaagaatgccgccgccgtggattcacgacctggatgtcgctccggtctcggcttgcggttgggaaccttcgtcagggtgctctggtgctcgtggtttcctcggcgggcgcgattggtgtccagatccctgcgaatttctcgccagagtccaactccgcagtggagccgcagctcaccgtggacagctcccctggcgccatctctgtcttggcgcgtggacacgtgtcatctgaaaagcaagttggtacctggaatctcaagtgccaggagaagagcaggtggttcaagangagccacaaagcgaggagtatgatctgat

SEQ ID NO: 6075 - DNA, 454 bp, Zea mays
  Clone ID: LIB148-049-Q1-E1-A10
atcagggatcacgatcaccaacaccgtcattggcgtcggtgacgactgcatctccatcggccccgggacctccaaggtgaacatcaccggcgtgacctgcggccctggccacggcatcagcatcggcagcctagggcggtacaaggacgagaaggacgtcacggacatcaacgtcaaggattgcactcttaagaagacgatgttcggcgtccgcatcaaggcgtacgaggacgccgcctccgtgctcaccgtctccaagatccactacgagaatatcaagatggaggactcagccaaccccatcttcatcgacatgaagtactgccccaacaagttgtgtactgccaacggcgcctccaaggtcaccgtcaaggatgtcaccttcaagaacatcaccggcacctcctccaccccggaagccgttagcctgctctgcactgccaaagtcccatgc

SEQ ID NO: 6076 - DNA, 474 bp, Zea mays
  Clone ID: LIB148-049-Q1-E1-A11
cgttacataggatcatcccggggttcatgatccagggaggcgacttcaccaacggcaacggcacggggggcgagtccatctacggcagcaccatcttctccgacgagaacttcaagcacacccacgctaaagccggtacgctgtccatggctaactacgggcccgactccaatggctcccagttcttcatcaccaccgtagacgaaaaccggttgcccaagaagctggacgggcgccacgtggtgttcggcaaggtggtgaaagggatggacgtcgtgcgcaagatcgaagccgagggccagctcaccggcgtgcccaaggccaaggtcgtcatagccaacagcggccagctgccagcgcccgccgccgccggccatcgtgacctctgatcgatgacgaggagaacgactcacgatccatcaatccggtcgatctgtcttgttcgttaagaaaccaaacgtgtgcatggttaat

SEQ ID NO: 6077 - DNA, 320 bp, Zea mays
  Clone ID: LIB148-049-Q1-E1-A12
acaccctatagaacgtcgtattacctccaataagagccagccagagaaactaataaaactctcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaagccgccgccgcgggcgccccaactgcctccgagtcagccgccgaggctcccgctgtcgcgcgcgctatcgctgccgctggcgcggccgccgcg

SEQ ID NO: 6078 - DNA, 505 bp, Zea mays
  unsure at all n locations
  Clone ID: LIB148-049-Q1-E1-A3
gtcgacccacacatccgcctacactgcggtcgtccacatccttttctctcctcctcgccggcccaacctgattgttcttcaaccaagaggaagaaaggaaggaagggaccggaagcatcagccatgtcgaactcggcgtcgggaatggccgtctgtgatgaatgcaagctcaagttccaggagctcaaggcaaagaggagcttccgcttcatcgtgttcaagatcaacgagaacgtgcagcaggtggtggtggacaggctgggggggccaggagagagctacgacgccttcacggcctgcttccccgccaacgagtgccgctacgccgtgttcgattttgacttcgtcactgacgagaactgccagaagagcaagatcttctttatctcttgggccccggatacatcgagggtgagaagcaagatgctgtacgcgagctccaanggacggttcaaganggagctggatggcattcaggtggagctacaagcaaccgacccgagcg

SEQ ID NO: 6079 - DNA, 247 bp, Zea mays
  Clone ID: LIB148-049-Q1-E1-A4
gtccacatcaaggcatacgaggacgccgcctccgtgctcaccgtctccaagatccactacgagaatatcaagatggaagactcagccaaccccatcttcatcgacatgaagtactgccccaacaagttgtgtaccgccaacggcgcctccaaggtcaccgtcaaggacgtcaccttcaagaacatcaccggcacctcctccaccccggaggccgttagcctgctctgcactgccaaggtcccatgca

SEQ ID NO: 6080 - DNA, 414 bp, Zea mays
  Clone ID: LIB148-048-Q1-E1-F3
gccgacccaagcctctacacagacgtcgtagtagagagtgcgtgcgtgcagccacaggcaggcgtcggcaccatgtcttctttcaccggcacgcaggacaagtgcgcggagtgcgacaagaccgtccacttcatcgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaagggcccccagcaagctatcatctgcgttttctggtactcaggataagtgtgcagcttgccagaaaacagtg

SEQ ID NO: 6081 - DNA, 446 bp, Zea mays
  Clone ID: LIB148-048-Q1-E1-F9
gcgcgggtcgatacaacaacctaaactgacgtcgtgagtagagcgatctcctctccctctccctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccactacggtgccgcctgagcgcagagcacggcgttccccgagttcaagaccgacgacatggccaacatcatgaaggacttcaacgagccagggcacctcgcgccgacatgcctgttcctcgggcctaccaagtacatggtcatccatggcgagcctggtgccgtcatccgtggcaagaagggatcaggaggcatcaccgtgaagaagacagggcaggcactcgtggttggcatctaccacgacccgatga

SEQ ID NO: 6082 - DNA, 398 bp, Zea mays
  Clone ID: LIB148-048-Q1-E1-G1
acaagcacctcctcctcccccgccggccaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagaggcggccgtcgccgagcccgatcacaaggaggaggaagccgtggagaagaccgtcgtcgaggaggagaagccagcggcagccgccaatgcagaggaaaaggtcgccaccgccgccgagaccacgacga

SEQ ID NO: 6083 - DNA, 436 bp, Zea mays
  Clone ID: LIB148-048-Q1-E1-G11
gcgggtcgttacaatactctacagtgagtcgtactaccatcaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggattcagtgcaagggcaagtgcaccgagcagaagggcatcacggcgccggccatgaaggtctgccaagaagagttccacaaaggcttccttgttaaaggcggcca

SEQ ID NO: 6084 - DNA, 423 bp, Zea mays
  Clone ID: LIB148-048-Q1-E1-G12
acggcgatgcagcgggagagagaggagcgtggcggagacgaccggagcaacgacgagaaagcatccatggctgcctgtgtgggttccctgtgtgcgcgtccgccggcgccgccatggcggcgtccgccttctccttcgtgggcatggactccattctccatccccatgattcccttcctcgcctgctgttgaagatcattcctgccacaacgccagaggagaacaggaggaggaatccacagcccaggtatgctagaaatcccccagactagctgccgctggatccggtcgatggcccctcgccctccacctccaggctgcatgcgcgtgttcatcgcctgttgtctcaagtgtaaaagtgtgcccttccttcattgtcgcgatccccttccccacacgatccacttccccaatccctgcgcc

SEQ ID NO: 6085 - DNA, 400 bp, Zea mays
  Clone ID: LIB148-048-Q1-E1-G2
atcctaccccacccgccacccgtcgacgccggcctctctcctcacccgctcggagagtcggagcccggcggccggagggcgacgtcgtccctaataaatactaataatttatcactatacataaccaatatataagccatgggcaagcgcagcgtccctcggtaccctgaggacgaggacaaaggcggctgctgcggctgcctgtgctggtgctgctgcttcctgttgttcatcgtggcggcgctggccggcacggccgcctacttcttcttcgtgtacaagcccaaggcgccgtcctactccgtgagcaacatgtccgtctcgcagttcgacttcagcacctccgacctgacgctgtacgtcaagctcaccgcctccgtgcgcgccgagaaccccaacg

SEQ ID NO: 6086 - DNA, 422 bp, Zea mays
  Clone ID: LIB148-048-Q1-E1-G4
agggtgcgccgagatcgaggagttccgcgaccgcgcccgcgtcccgctcacctccaacaacggcatcaagcagcagggcgtccgctacgccaaccccatcgccttcttccgcaaggacccgctcaaggagtgcggcgccctcctcgagaagtacgatctcaaggacgcctccgagacgccatgatcgtcctccgtcctgtgcatgcctgcatccattgctgccctgcccgctcgcccaagaattgaagatggtagctgccttccgcgttttttgtattgtgtatgtctatgcactgcattcgagggcagcgataatgggcctggcctcgtaagcaaacgttcgatccgcttcttttgatgggcctaaatctgcatgcatgcagatgtactgctacttctgctcttttatattgctttttttt

SEQ ID NO: 6087 - DNA, 406 bp, Zea mays
  Clone ID: LIB148-048-Q1-E1-G7
acggacgcgtgggcggacgcgtgggttcggatctcgcattcagcgcagcgcaggtgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaggacaagatcagacctctttggaggcattacttccagaacacccagtgtcttatctttgttgtggacagcaatgaccgtgaccgtgttgttgaagccagagatgagctccaca

SEQ ID NO: 6088 - DNA, 412 bp, Zea mays
  Clone ID: LIB148-048-Q1-E1-G8
agccagctggtttaactccaagtcaggaaagaagattcctttgaaatcagtcacttcaatcgtcgatgggctaaagaaatcgtacattgagaagttgaggcccttggaaaaaacctatcagttccatgacttcgtgtctcccttgctgactagcagcgatttcgatgcgaagccaatggtcatgctgttgggtcaatactccacggggaaaacaacattcataaagcatttactaaaaacaagttatccaggcgctcatattgggccagagcctacaacggacaggtttgttgtcatcacttctggaccagacgaaagatgcattcctggaaacaccatcgccgtccaagctgacatgccatacagtggcctgtcatcgttcggaacagcatttttgtccaagttcgaatgt

SEQ ID NO: 6089 - DNA, 350 bp, Zea mays
  Clone ID: LIB148-048-Q1-E1-F2
cgcgtctgcccacgcttcctgggtacgtaagaagtcgtctaattcttggatcgaattacacgacttcttcgtccctctcttcattaggaggctaacttgtcatctgcaggatctgtggggtgacttgatttagttatggacttactggtacgcgtcttgaaagttcttctggttcggcgtatatgacttgcccaccgcgaggcacgagggtgcgatccgtatctcgtcctgttgcttcacatcatctgtcggcacatgtgagttgagaagcgatgcgtgtgatccttatcgcaggatgcaggagcatctgactgtcatagatcgcagcttaccatgtgaatctggaggtg

SEQ ID NO: 6090 - DNA, 415 bp, Zea mays
  unsure at all n locations
  Clone ID: LIB148-048-Q1-E1-D5
acaatactctaaattgaatcgtatcagctggtatccacgagaccacctacaactccatcatgaagtgcgacgtggatattaggaaggatctgtatggcaacatcgtcctctccggtggtaccactatgttccctggcattgctgacaggatgagcaaggaaatcaccgccctggctcctagcagcatgaagatcaaggtggttgctcctccagaaaggaagtcaccgccctggctcctagcagcatgaagatcaaggtggttgctcctccagaaaggaagtacagtgtctggattggaggatccatcctggcatcgctcagcaccttccagcagatgtggattgccaaggctgagtacgacgagtctggcccgtccatcgtgcacangaaatgcttctaattctttgggcccaag

SEQ ID NO: 6091 - DNA, 402 bp, Zea mays
  Clone ID: LIB148-048-Q1-E1-D9
tacaattacttataccagttcctaccatgcactttattctgctttccggttctcaacgtcttggacatcgccggcgagcacagtctcctcggcaacttcttctactgctaactcgggtgcaaggcaaggaaactcggtatcgtcagagatatcttgatctaatggtaaaccatgaagtgaggcatatcttcaagacacgatctaaagttgtctcgtttatccggaagtttcttgatgaccgtgaatttttggaggtggagactccgatgatgaacatgattgctggtggagcagctgcaaggccttttattacacatcacaatgaattaaatatgaggctttttatgcacattgctcctgaattatatctgaaggaattggttgttggtggattggaccgtg

SEQ ID NO: 6092 - DNA, 437 bp, Zea mays
  Clone ID: LIB148-048-Q1-E1-E10
ccgggccgatacacgactctagatcgagatctcgaatggccgcccttttttttttttttttaatctgatcgcggtggcgcggacccgtccgccagtgtagtgttcactagtaaacacggtacagcatgcatacaccaggacttgctggtgtaaataaatgttaagataaaagtatatataactcccattacaatgattgttttttaaaccccattacagtgatttgagagggcatctcaagattacatcaatagatatatccgtgcgttctcatttggctcacccccacccaacgtcccttctcccttccctaagcttccttcgtctttgttctttttgatgattttatttcgccgagcagcacaggaatggattagttagactggatggtcagaacacgatgtgaaaacggcgccttcgtcgtctttagcgcgcgg

SEQ ID NO: 6093 - DNA, 420 bp, Zea mays
  Clone ID: LIB148-048-Q1-E1-E12
agaacagcccccgcgtcgtcctccgctcgggcgacacgggaggccccccagccctagcgccgccactctctcctcctctatttcccccctcgccgtcgccagaggagactgccgaaggccggcgcgacctccaaagatggcggctacggggcgtttctccggcatttctccttcgtttggtcttccgatgctcagatctgagcgggttctgtgccgggcggttcaagttccagccgcggggttgctggggcgggcgtcgtcccccacgccgtcgtcttccttgtccccggcgtcgtcggggggctgtgctcggtggttcaacatctggtcctgcaggtgcatccaggtgatggattggcggcatctactggtggtggcggggctgcgccgtttcggcggcggacacatggcgtggtgggc

SEQ ID NO: 6094 - DNA, 122 bp, Zea mays
  Clone ID: LIB148-048-Q1-E1-E2
gctccaccgcctccgcggccgacgacgcgctgctgctccttttccgccactcccaatccatccccgatctccaagttattcctgttctctttcagaattcgttgcatcaaccaaagcaagat

SEQ ID NO: 6095 - DNA, 412 bp, Zea mays
  Clone ID: LIB148-048-Q1-E1-E8
ctcgcgggtcgatacaagcctctagagtgaatcgtcacaaatcttgctggggataggcgtaggaccgttatgaggccaccacaagttcttagggagggaacaaagaagacagtttttgttaactttatggatttgtgtaaaacgatgcataggcaacctgagcatgtgatgatgtttttacttgctgaaatgggaacaagcgggtcacttgatgggcagcaaaggttggtgatcaaaggaagatttgcccccaaaaactttgaagcaatcctgaggagatacatcaatgagtacgtcatctgcaatggatgcaagagccctgataccattctgtccaaggaaaatcgtctgttcttccttcgctgcgaacagtgtggatcttcaaggtccgttgctccaatcaaagctggat

SEQ ID NO: 6096 - DNA, 438 bp, Zea mays
  Clone ID: LIB148-048-Q1-E1-E9
tcgcgggtcgatacacgcctctagactacgtcgcggtaccacgaagtggcctagggacgacgataaacccatttggtgcgtaccatgtagtgtcttctgctgcctcttacctgcactcccgggccacggccatgggcgttatgccatttggtcccgggaatggcgtcaaggacgatcatccagcagccgtcacgtcgctcgtgagcggcgcgagcggtgacggattgagcgtggacgaggcttcgttcgtggccacgacgagttcggtgacctccatggtcgcggcgaaggaggagacgcggcaagccgttgcggatgatctcaactcttcgagatcttgcccttgcgagtggttcgtctgtgaggatgatcagaacagcacgatatacttcgtggttcagggctcagaatcaattgcttcctggcagggcaaccttt

SEQ ID NO: 6097 - DNA, 390 bp, Zea mays
  Clone ID: LIB148-048-Q1-E1-F10
tacaacaccctaaactgacgtcgtattaagcgtccggccaccctcgtctcaccctccctccctcacacaaataataaggaaaggtcccgcccttttcctccgacatccacaggggggaggggaaaacacgtgcattcacccggcggtaataatggcctcggttccggctccggcgacgacgaccgccgccgtaatcctatgcctatgcgtcatcctctcctgtgccgcggctgacgaccccaacctccccgactacgtcatccacggccgcgtgtactgcgacacctgccgcgccgggttcgtgaccaacgtcaccgagtacatcgcgggcgccaaggtgatgctggagtgcatgcacttcggcaccggcaagctccaacgccccatcga

SEQ ID NO: 6098 - DNA, 418 bp, Zea mays
  Clone ID: LIB148-048-Q1-E1-F11
gcgcgggtcgatacaagactctaaaatgagtcgtattaaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaggtgtttgtgcccatcgacgacctcct

SEQ ID NO: 6099 - DNA, 425 bp, Zea mays
  Clone ID: LIB148-048-Q1-E1-D3
ggtcgacccaagcctctaaattgagtcatatgagaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaagcagtgctaaacaagatcgctcgatcgttcgccatgcatcgacaacctattcttaataacgttcattatctcgttcttatttatgacgaatgtcatgtatgttctggtgactgtcatgt

SEQ ID NO: 6100 - DNA, 399 bp, Zea mays
  Clone ID: LIB148-048-Q1-E1-B7
gcccgggccgacacacgactctagatcgactcgaagtacatgtaccggtgcaaggacatgctgatcaacgacgtgaccgtgacggcgcccggggacagccccaacacggatggcatccacatgggcgactcatccgggatcacgatcaccaacaccgtcattggcgtcggcgacgactgcatctccatcggccccgggacctccaaggtgaacatcaccggcgtgacctgcggccctggccacggcatcagcatcggcagcctagggcggtacaaggacgagaaggacgtcacggacatcaacgtcaaggattgcactcttaagaagacgatgttcggcgtccgcatcaaagcgtacgaggacaccgcctccgtgctcaccgtctccaagatccactac

SEQ ID NO: 6101 - DNA, 397 bp, Zea mays
  Clone ID: LIB148-048-Q1-E1-B8
tgaggaagacatccgcaacgggaacgtcgtccgcaacgtccgccccggcggcacgggaaactgcctcgccgacgaaagccacatcatctgggacaaaggccacgtcctgcaagacctcctcctcaaggtccggaacgtccactccggcgtcgtccaactgcaactcagatgggtcgccaccccacctgaagcagactgaactggaggagacgaactgcagtatgtacgtgctctcgctccatatccccatgggaagaacgtacggattcgctcgcgtgacgatgatactatgcgatgcatgcatgctcaagagtcaagatgtcactgtcttctgtgtattttagtacagccacgtacattgtcgccatccatcatcactatgcatggactttttttt

SEQ ID NO: 6102 - DNA, 441 bp, Zea mays
  Clone ID: LIB148-048-Q1-E1-B9
gcgggtcgttacaacactctagactgagtcgcaataccgaaggcctcgtgccttctcttcctccctggcatggaggaagtagctgtttcgcctatgatcgttgccgccgtagtgctggacaacaatggcgccgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgcaccactcccgtctcctccagtagcccttccactcgcaagaagcgcggggcgttcagcctcttcagggcgatgttcctgtccttcggccggagcgacgacagcatgaagaagacagacgacgacaccacgagccccaag

SEQ ID NO: 6103 - DNA, 389 bp, Zea mays
  Clone ID: LIB148-048-Q1-E1-C1
aaagaactttcaaggtggagcatcttcaaacaagaacgaccaggcaaaggctccaagcaagctatcatctgcattctctggaactcaagataaatgcgcggcctgccagaaaacagtgtatccattggagaagatgactctggaaggcgaatcctaccacaagagctgcttcaaatgctcgcacgggggctgcatcctcaccacgtcctcctacgccgcgctcaacggggtcctctactgcaagatccatttctcgcagctgttcaaggagaagggcagctacaaccacctcatcgagacggcgcagaccaagaagaacgaggccgcggaggccggaccggagccaccggcggacgcaggcgctgctgagccggaagcacccgcgcaat

SEQ ID NO: 6104 - DNA, 391 bp, Zea mays
  Clone ID: LIB148-048-Q1-E1-C10
tcgcgggtcgttacaaccctctagaatgattcgtactacgatgcgggcacaggttgcgatggttgtggcgttggtgttcttggtgagaggcgcatggtgcggtcctcccaaagtccccccaggcaagaacatcacggccacctatggcaaggactggctggacgctaaagcgacatggtatggcaagccgacgggtgccggtcccgacgataacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaac

SEQ ID NO: 6105 - DNA, 396 bp, Zea mays
  Clone ID: LIB148-048-Q1-E1-C11
tagggaaacaccttgaagacgggcgcacgcttgccgactacaacatccagaaggagagcaccctccacttggtgctgcgcctcaggggaggcatgcagatcttcgtgaagaccctgaccggcaagactatcacccttgaggtggagtcttcagacaccatcgacaacgtcaaggccaagatccaggacaaggagggcatcccaccggaccagcagcgtttgatcttcgctggcaagcagctggaggatggccgcacccttgcggattacaacatccagaaggagagcaccctccacctggtgctccgtctcaggggtggcatgcagatctttgtgaagacactcactggcaagacaatcacccttgaggtggagtcttcggataccattgacaatg

SEQ ID NO: 6106 - DNA, 400 bp, Zea mays
  Clone ID: LIB148-048-Q1-E1-C12
tacacacgcgcctggcagaggcgcagagacaggcgtcttcgtactcgcctatctccgcgactcaaagcttcttccatttcctaccgccgccgctgcagctccaccccattccgtcgacaccatgagggagtgcatctcgatccacatcggccaagccggtatccaggtcggaaacgcgtgctgggagctctactgcctcgagcatggcattcaggctgatggtcagatgcccggtgacaagaccattgggggtggtgatgatgctttcaacaccttcttcagtgagactggtgctgggaagcacgtccctcgtgctgtttttgttgaccttgaaccaactgtcatcgatgaggtgaggactggcacctaccgccagctctttcaccctgagcagcttatc

SEQ ID NO: 6107 - DNA, 414 bp, Zea mays
  Clone ID: LIB148-048-Q1-E1-C4
acttttcatcacatgatattagaagtgtaatctatggagaacaaccaagaaataggttggatttgtacatacccaaagataatagcaaatcaagtccagttgtggcattcgtaactggtggagcttggatcattggttacaaggcttggggtgctctccttggaaggcggttagcagagagaggaattatagtagcttgtattgattacagaaatttccctcaaggaacaataagcgacatggtcagtgatgcttctgaggcgatatcattcatttgtaacaatgttgttagctttggaggggatcctaataaaatctacttgatgggccaatcagcaggagcacatatcgcggcctgcgctctcttagagcaagcaattaaggaatctaagggagagaatacctattggaatg

SEQ ID NO: 6108 - DNA, 421 bp, Zea mays
  Clone ID: LIB148-048-Q1-E1-C9
gggtcgacacacgactctacatcgctgcctgccagggagaggggaagtcagaggcacggagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctcgtccgccaccccaacgtcgtgcagctgcacgaggtgatggccagcaagagcaagatatacttcgccatggagtacgtccggggc

SEQ ID NO: 6109 - DNA, 347 bp, Zea mays
  Clone ID: LIB148-048-Q1-E1-D1
tccctagagtatgtcgtgttacgtcctcgtcgccgcctcggcggccaccgtggcgctcgccgcggaggctccggctccgggccccaccagcggctcctccgccgtcgcgcccgccgtcggcgccgccctcggggccgctgtcgcctcgttcttcaacgactacattcactgagcctcgtcgcggccggtcgctcggaggccgtgcgcgctacgaaacgggatatagagtctcatcgctgcacgcattccgatacgtgggcagctcttcgattcgagacatcttgtgtccgcattggcggattcagcccggtatccctcagtaacctccatcatgcatggcttgtcat

SEQ ID NO: 6110 - DNA, 417 bp, Zea mays
  Clone ID: LIB148-048-Q1-E1-D10
gacacacgcctctacagtgactcgtgctagtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaatgacagccacgaggaggacat

SEQ ID NO: 6111 - DNA, 419 bp, Zea mays
  Clone ID: LIB148-048-Q1-E1-D11
aatctccgccgctgaactgcaggaggtgctcaagaagctcggcctccccgaggccagcagcatggccaacgtccgggagatgatctgcaacgtcgaccgcgacagcgacggccgcgtcgacttcaacgagttcaagtgcatgatgcaggggatcaccgtctggggcgcctgactgacctcatcgtcgtaccgcgtacgttctgacttctgagtgtgtggcaactggcatgatggtccccgcatttcgtcgagacagtcctgcgtctgcgtctctaattgaattctttagtatcgtccttcacatcactggtctagtggtgatgagaatgccctgtcctgtgtgtgtgtgtcacataaccatggtatgtaatgtcatactgggaattaggtatatgatgatgacagctgataagaaaatg

SEQ ID NO: 6112 - DNA, 337 bp, Zea mays
  Clone ID: LIB148-048-Q1-E1-D2
caagggcaaaaaaaaaacaaccccggcgggaatttttgcaaaaggttctaatccggcaaaactaaattttgttgataataatggcaagtgcttcctggagatgagttactactttgagattagaaaggagtggccaggaactcaatgatgtgtggacggaccagcatggctgactcgtcggagtatgttagagctcatagctaagccaagcacaagatgtggactcatcttcaagaatgattcattcgctacttcatcgttaatcgcattttaatttgttttgaattgtcattgtacgtcgtttatgacataaaactgtttattcatcacatatata

SEQ ID NO: 6113 - DNA, 429 bp, Zea mays
  Clone ID: LIB148-048-Q1-E1-B6
tcgcgggtcgatacaaccctctacagtgcctcgtgatagccccaacacggatggcatccacatgggcgactcatccgggatcaccatcaccaacaccgtcattggcgtcggcgacgactgcatctccatcggccccgggacctccaaggtgaacatcaccggcgtgacctgcggccctggccacggcatcagcatcggaagcctagggcggtacaaggacgagaaggacgtcacggacatcaacgtcaaggattgcactcttaagaagacgatgttcggcgtccgcatcaaggcgtacgaggacgccgcctccgtgctcaccgtctccaagatccactacgagaatatcaagatggaggactcagccaaccccatcttcatcgacatgaagtactgccccaacaagttgtgtactgccaacggcgcctc

SEQ ID NO: 6114 - DNA, 435 bp, Zea mays
  Clone ID: LIB148-048-Q1-E1-A11
tacacgactctaaacacactcctggtacgacaaggacacgttcagcagggacgacccgatgggggacgcggagatcgacgtggcgccgctggtggaggcggcgaacgcgagcccggaggcgagcctgaggaacggcgccatcatcctgtcggtgcggccgagcgccacgaactgcctcgccgacgagagccacgtgtgctggaggaacggcaagttcgcgcaggacatgatcctccgcctcaggaacgtggagagcggggagattcagctgcagctgcagtgggtcagcatccctcctgctgcagccagcaggtgaaggaaggaagaacaggcgacacgaagcaatcgcattttcacctcttgtgaatgtcggattgtaaacttaatggggtctgggtcagtcagggtagttcatgtgttgcctattaatgtaca

SEQ ID NO: 6115 - DNA, 426 bp, Zea mays
  Clone ID: LIB148-048-Q1-E1-A12
acaaccctctatattgagtcgttcacttggtggccacactaggcatgtctctcacaattccaatagcaatggttgctgatatgatcatccacggccgtcactattcagcagtatatattcttggttctgtccaggtattttcaggctttgttatcgcgaaccttgcagatcgcttttctcgttctctagggctatcatagtctcataaaacagaacaggcccttattagtgcgtgcatcaggaatctcgaaggtcgggttggttaggccaatacttcagataacctggatcgggagatgccagaaattattttccctttgcttctttaaacatagtggaggtgaattttgccgtggtgaatagtgaaaggcagcagatgaagaagatcacatatgttatagcaaccctttgcaactgtaaattctc

SEQ ID NO: 6116 - DNA, 226 bp, Zea mays
  Clone ID: LIB148-048-Q1-E1-A4
cgggtcgacccaagactctagagagtgtcgtattatcagctggtggcaccactgcagctcctgtaatggtttaccgtgtacattgcataggttcatgtatatatatgctaggtccttggtacatgcctacaaggtacagttccattctgttcgagagatgtacttatgcacacgggtctctgtaacatcgatgcaataatggccgggtgactgtaagtgcacatac

SEQ ID NO: 6117 - DNA, 399 bp, Zea mays
  Clone ID: LIB148-048-Q1-E1-A6
tagactgagacatcctcaggcacgggctgaacagggacctcagcttcggagcagaggaccgcgccgagaacatccgcagagtaggggaagtagcgaagctgttcgccgacgctggcctcgtctgcatcgccagcctcatatcgccctacagaagcgaccgaagcgcgtgtcgcgatctgctgcccaagcactcgtttatcgaggtgttcctggacgtgccgcttcaagtgtgcgaagccagggaccccaaaggcctctacaagctcgcacgcgccggcaaaatcaaagggttcaccggcatcgacgatccttacgaaccgccgtcggactgtgagatagtgatccagtgtaaagtcggcgactgcccttcgcctgaatcgatggctggtcacgttgtgt

SEQ ID NO: 6118 - DNA, 246 bp, Zea mays
  Clone ID: LIB148-048-Q1-E1-A7
cctggaaggaagacagctcttcgatgtcagtgtgggtgtcggtcgtagtctgcctgaagaccggtgatggttcaccttagaagcatgggatgctcatcatcacactaaaaacctgtgctgttgtgttgctgtgtctatcccagtaatagttcagttggtaccttatgttcgaggtttgttgtaagtagactgataaatcacaattgcaggacccagtctgctcattaaagctcgtggggaagaatg

SEQ ID NO: 6119 - DNA, 428 bp, Zea mays
  Clone ID: LIB148-048-Q1-E1-A8
gcgcgggccgatacaagcctctacattgactcctactaacattacaggtcatagctaagcaggtctgacaggatgtcgtggcagacatacgtcgatgagcacctcatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttcctggccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggccagtgcaacatggtggt

SEQ ID NO: 6120 - DNA, 418 bp, Zea mays
  Clone ID: LIB148-048-Q1-E1-A9
cacgactctaccgtgactcgtagtaatcaagcagtgggcacaggtcgctgacgccttcagcgcctctgaagcttacaacagcaggttgaggcagacgcttgacgccaagcagctcaagactggaatgatgcacaaggggaaggtgaacagggtggacttctcagggccgctgctgtcgcagccccggcgcatcgacgagctcctgcacatccacgagcagcagatccggcaagctggtcgccggccatggttcatgaaaggcaccgaggaggaggagcactgatggcagagacacggcatggacacaactaaacgcccatcagatttgcacgtacttaccacagagcaagagaagatgctggaaacatatcaaaggagttggaccgtgagctagctctcctgatgagcaagtgttttt

SEQ ID NO: 6121 - DNA, 381 bp, Zea mays
  Clone ID: LIB148-048-Q1-E1-B1
ggtgggggttgttcattgccaccaagtgatttggcctggcagcaggagggctcttcggaataagaatggatgtggctgtaactctgcttctagaccggtgatggttcagcttagaagcaggggatcttcatcatcagaataaaaacgtgtgctgttgtgttgctgtgtctacgccactagtatttctgttgttaacttatgttctagctttgttgtaggtaaactgcgaacccagagttgcagaacccgtactgctcgtttaagctcatggtgaactacgagctaaaaggctgttgccagagtcgatgtcagtatgtcacttgtcactggaggtccccggttcagttcagatgttgctttggcacgtgctattcttttgga

SEQ ID NO: 6122 - DNA, 447 bp, Zea mays
  unsure at all n locations
  Clone ID: LIB148-048-Q1-E1-B10
ctcgcgggtcgatacaagcctctaaacagacgtcctggtagacgcctgatgacgtgatatacaagtacgagatagtggaagtcgctgatgatttcactgaggagcgagggctgactgtcatcccgttgctgaaggttgccggattcaaagccgtcttccacagacacgtggatcccgaggaggtgaggaggataccaaaggaagagctgttccggttctcgcaccgggttccttctcgtctcctgacgggcgaagagggcagcaatgccccgaaaggctgccatgagctggactctgctgccactccagtggaccttctcaaggttatcacggagcacaaggaagacgcggtggcgcagagtcctaaataggagtgagcgactccgataacagcgaagataacgtanctggatgtctgagtgaccagatccccacttggttaatgac

SEQ ID NO: 6123 - DNA, 433 bp, Zea mays
  unsure at all n locations
  Clone ID: LIB148-048-Q1-E1-B12
tacaagactctaaactgacgtcgtgattaacgcgtccgggaggaaccagatacccggcggcggcgatcgatggctccgcgcagctcatcggcggcgacgtgcctgtgcctcgctctcgccgcggccacgctggcgctggcccacggggcgcaaggaggaggaccatcggcatcggcggcggacctggacaaggtcacggccgagaccttcttggacatcgagatcgacggcaagcctgcaggccggatcgtgctgggactgtttggggacaccgttcctaaaacagcagagaacttccgagcactttgcacaggggagaaaggaattgccaagtccggcaagcctctgtggtacaaggggtcgacgttccacaggatcatcccggggttcatgatccanggaggcgacttcaccaacggcaacggcacggggg

SEQ ID NO: 6124 - DNA, 424 bp, Zea mays
  unsure at all n locations
  Clone ID: LIB148-048-Q1-E1-B4
gcgggccgatccaagactctaaattaagtcgtagtaaccgcctgagaggaaatacagtgtctggataggaggatccatccttgcctccctgagcaccttccaacagatgtggatctcaaaggctgagtatgacgagtcaggacctgggattgttcatcggaagtgcttctaagctctgggtcccccttcggctccattttatttattccttgagtgtttttcatataagctactatgtttgggattgcatgcctttgagcaggcaatgttgttgaatttatattttgggatttatattttgtggctcactacaatgcatacattgctccagctcctttccatgccaaatttgttgctagtggtgaaaacatcaaccacanaaaagagaggatggaaattaataaagtacctaggatcatattat

SEQ ID NO: 6125 - DNA, 382 bp, Zea mays
  Clone ID: LIB148-047-Q1-E1-G6
acgacgcgcgccatggtgacgccggcgcaggcgtcgacgaagtcgccgtcgatgaagtcggtggagaagacctggagcttgtcgccgaggcccttggcgaagacctcggcgatgaacatccgcgcgtagccgtggatccgcctcgtcacgggccacacgcacaccaccgggttgtcgggcctgggcgtcaccgtgttctccacccggtacaagaacccgcggcccgccaccggcggctgctgccccaggaacttgaggttgctctcgaacttggtctccggcaggtccgtgtcgatccagttgtccctgaggtacccggcgctccacaggggctccccgggcccgggcgccggcgacctgcgcggcttccacacgcagatga

SEQ ID NO: 6126 - DNA, 181 bp, Zea mays
  Clone ID: LIB148-047-Q1-E1-G7
attataggtcatcatctcgtgggggtcatcagatctggcgggttggtggtgtgttgtaatttgtaaagagatcgattaggggtgatgcggtggaggggatactacacactaacaaaaccgagttgtatactgtactactaaactagagatggtaatggtgacgtgattcccgatttcctgg

SEQ ID NO: 6127 - DNA, 409 bp, Zea mays
  Clone ID: LIB148-047-Q1-E1-G8
gggccgacccacgcatccaacctcctcgcctcctccattgaccaacaattaagcctccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatcgagaaggagaagccatc

SEQ ID NO: 6128 - DNA, 396 bp, Zea mays
  Clone ID: LIB148-047-Q1-E1-G9
agcccacctcaacggcctcgtccgggagcccaccgacgccaagttcctcgagctcaagtcgtggctctcctccacgctcggcggcacctccacctgcgaggacgcctgcaaggacctgcccaagaccagcgacaaggacgacgtcgtcaacttcagcctcgacttcgagaagctgcagcgcgtcacgctcgacctcatcaccgaggcgtccggcaccatgtccgcaggcatcgccctgccaccctccaacgccggagcgccctcctacggcgcggcggcgccttccgggggctccgccgatgcccccgccggcgcctccgagggccctgcgagcgccagcggcccgtctggtgacgacgcgccggcgtccggtgctggtgccagcgcgtcggctgc

SEQ ID NO: 6129 - DNA, 358 bp, Zea mays
  Clone ID: LIB148-047-Q1-E1-H1
aagcctctagagtcagtcgtaatatcatctggacaacgacaccaccaccggtggcgccgatgacgtggcacgcctgtccgcgcaacggctcgcactgccggatgaaatccgggtgcaagaaccagctgcggtggtcattagagttggcagactgttgaaggccgaggctgaaagccgatgacagggaagatcaggacgacggtgaccaagcggtttctggagatcgcctggatcatatctatggaggacttctcgatcacggaacgggaagcctcgctggcgcacgtgccgtctcattggactgctaagctaaccgctgactatgacgctgcagcttcagtcatgactctcttctagg

SEQ ID NO: 6130 - DNA, 408 bp, Zea mays
  Clone ID: LIB148-047-Q1-E1-H10
tgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaggacaagatcagacctctttggaggcattacttccagaacacccagggtcttatctttgttgtggacagcaatgaccgtgaccgtgttgttgaagccagagatgagctccacaggatgctgaacgaggatgagctacgtgatgctgtgctgcttgtttttgccaacaag

SEQ ID NO: 6131 - DNA, 411 bp, Zea mays
  unsure at all n locations
  Clone ID: LIB148-047-Q1-E1-H11
aaaaattcgcatgatgtgggcacgggaccaagatgaacaaggcgttcacgctcgagaagcccatggacctgaagaagggcgtgaaccacgtcgccgtcttggcatcgtcgatgggaatgacggacagtggcgcttacatggagcaccgtctggccggcgtggacagggtgcagatcacgggcctgaacgcgggcacgctggacctgacgaataacggctggggccacatcgtcggcctcgtcggcgagaagaagcagatctacaccgacaagggcatgggcagcgtcacctggaagccggccgtgaacgacaggccgctcacctggtacaagaggcacttcgacatgccgtcgggagagngaccggtcgtgctggacatgagcacgatgggcaagggcatgatgttcgtca

SEQ ID NO: 6132 - DNA, 418 bp, Zea mays
  Clone ID: LIB148-047-Q1-E1-H12
ccctaaagcgagtcgtatgaaggcccgacctcctgcccttgtacaacgcacgcacggtccccgtcccaatggcccagactctgtccgccgcctcggagctggccaccctgaagcgcccgttcggcaacgacgggttcggcgatggcagcaacaacggcagcgcgaccggcgagaagcccaaggcgcggcggcgggaggcggacccggcggcggcgatggccgcggcgcggcacgagttcggcgagcacggcggcgtgaacatgtccatcgaggcgtcggcgacgttcacggtgatggagccggacacgatgcggcggctgttcgcgggcgagctgggccccgaccgcggagacatgtacatctacagccggcacttcaaaccgacggtgctggcgctggggcggcagatggcggcgct

SEQ ID NO: 6133 - DNA, 405 bp, Zea mays
  unsure at all n locations
  Clone ID: LIB148-047-Q1-E1-H2
gcgcgggccaatcctccaaccaagcgtccggatgatttcgttagcggtggaggtgacctcaccggcgctggtggcggcggcgaacttaacagtggtgaaggaggtggtgatttcactgacgatggaggtgacctcaccggcaccggtggtggcggtgatttaatcatcggtggaggtgatggtggtgaaggagatttcaccgttggaggcggttcactcacatatgctggagatggaggtgattttactagtggtggtgagctaaccgaaaccggtggaggagggaatttggtangtgggggaggcgagctaataggtgctggtgggggtggagatttcattgatggcggtggtgaactaatcggtgatggtggtggcggtggtggtgacctcaccggtactggt

SEQ ID NO: 6134 - DNA, 381 bp, Zea mays
  unsure at all n locations
  Clone ID: LIB148-047-Q1-E1-H3
agacgacgccggctgcggcagcagcgacgaccactaccagcacgacgtgatcatgctgacgcggacgaggaccgggcgggcgttcccgccgccgatctccgtgatcggcaagggcgggcggccgtggctctgcctgcgggcgcaccgcgacggtggacgcctcgtgctgcggcagatgcgcctgccgtcgcangagctgctgcagccctgcaaggatgacggcaggttcaagctcctcatgcacccggaggcccgcgcgcggccgtgcgggggcggcacactgcaagaacggcaagggaatgatagctagcgctcttaattgatcagctgatcagatgatctgccgccacgcacacgtcgtcttgtatgggctggctgcta

SEQ ID NO: 6135 - DNA, 364 bp, Zea mays
  Clone ID: LIB148-047-Q1-E1-H4
gaatgtgagaacaatgtggtcaccaatgcgggctcaggttgcaatggttgtggagtgggtgtccttggggaccggcgataggggtggtcctccaagattccccgaagtcaatctaatcacgggcaactatgcgaaggactggctggacgctaaagcgacatggtatggcaagccgacgggtgccggtctcgacgataacagtagcggctgctggtacaaggacgtgaacaagcgccccttcaatagcatgggcgcatgcggcaacatccccatcttcaaggatggtctgggttgtgggtccagcttcgagatcaagtgcgataagcctgtggagtgctccggcaagcccgtggtggtgcacatc

SEQ ID NO: 6136 - DNA, 382 bp, Zea mays
  Clone ID: LIB148-047-Q1-E1-H5
accagcgaaaggcaagggacgtaagaagtcgtctaattcttggatcgaattagacgacttcttcgtcactctcttcattaccacgctaacttgtaatctgcaggatctaagcagagacttgatttagttatggacggattggtaggcctcttgaaagttcgcgtggtccggggtatcaaccttgcctaccgcgacgcaagaggcagcgatccgtatgtcgtcctacggcttggcaagaagaaactgaagacaagcgtgaagaagagatccgtgaagcccatatggcaagaggagctaactctgaccgtcacagattccagccatccactgatgctggatgtgttcgacaaggacaccttcaccagagacgacgccatgggag

SEQ ID NO: 6137 - DNA, 403 bp, Zea mays
  unsure at all n locations
  Clone ID: LIB148-047-Q1-E1-H6
atacacgactctagcgtcagtcctcgcaccccgttcccggaggtgtgcacgtccaccgccgggcggcacgcgtccaagtacccggtcatcgacaacctggccgtgctgaacatgcaggtggacgcgttcgccaagcgcaccgcgcaggcgcgcaagcacgtcgcgaggtcggcccgcaccatcccgccgcagcagacgcatgcgctcacgttctgcgacaccaggtacatgaacacgcaggacaccatcggcgcggcgcaacgggccatcacgttcaatgacaccggcaccgctaagatgatgctgcagctcgccgtccaggacttcgactcgtgcgaccgccccttcacacaggccggcgtcnccaaccccatggggaagtttgacaaggagctcacacaga

SEQ ID NO: 6138 - DNA, 393 bp, Zea mays
  Clone ID: LIB148-047-Q1-E1-H7
aggctcgtgtcgctcggcaggtacctggtgatgaagctggagcctgggcaggacgacacgttgctctcggaagcgatcactgacgccgtcctcgacctgttcgacgcgtggagcgagagcgtcgagaggcctttggtgcgacgggcgaaggagatctcttcttggttcctgcaggaaggaagagaagacacacctcctcctgttccgccgtctacgcgtccttgtgcggccgaagatgcagatgtgttttattccttagagaattgacagagcagcttgaagcaagagatcgagacattatgaaactacgtcggtagagttcatttacctaacgatgtcaggaagctgaaggcaaaggtctccacggctttgtacctgagatttgagtgagag

SEQ ID NO: 6139 - DNA, 417 bp, Zea mays
  Clone ID: LIB148-047-Q1-E1-H8
cgcgggccgatacacgcctctagtctaagtcatactaccctcctcctgcagctcgccgcgctggacgccatctccagcgcgcgtgccccctctctgctcagatccgatggccgtcgagcactacacccgcagcgcgctcctcgacccccgagatacctccttcctcgctaaccatcgccaaccaatttcggggagaagtgtgggggaatcgggtcgccagctctgatcgtgcgccaccgtaagctgtccatctccgtggagaattccctgcgtagcacataattcgcgcgaggacacgtgtcatctgaaaagcaagttggtacctggaatctcaagtgccaggagaagagcaggtggttctggaggagccacaaggcgaggagtatgatctgatctaggtggcgtttctcagatgac

SEQ ID NO: 6140 - DNA, 416 bp, Zea mays
  Clone ID: LIB148-047-Q1-E1-H9
aaaccgcttcatgatgcagatctttgtgaaaaccctgactggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatcttcgtgaagaccctgaccggcaagactatcaccctcgaggtggagtcctccgacaccattgacaacgtcaaggccaagatccaggacaaggagggcatccctccagaccagcagcggctcatctttgctgggaagcagcttgaggacgggcgcacgcttgccgact

SEQ ID NO: 6141 - DNA, 143 bp, Zea mays
  Clone ID: LIB148-048-Q1-E1-A1
acccacgcgtccgcccacgcgtccggccggttcccagcccacaaccctgtcatctccactggcagagctcacccaattgcagtaacgggcattcatctggaagagctgaaagaaattacaagagacttcaacagtgatgccct

SEQ ID NO: 6142 - DNA, 403 bp, Zea mays
  Clone ID: LIB148-047-Q1-E1-G5
agggatggggagggacgagaggttcccagtgtgggaggccgcgctcggcgctggggtcgccgccgccttcgccgctgggctcgtcggggtttacctttccatgccggactccgactacagcttcctcaagctgccacgtaatctccaggaactccaaatcctcactggccatcttgagaactatactagcgactacaccctacaggtgttggtaggctactgcgccgtgtacatcttcatgcagaccttcatgatcccaggaacgatattcatgtcactgcttgctggtgctctgtttgggcagctccggggcgtggccctggtagtcttcgccgccactgctggcgcttcttcgtgctatttcctgtcgaagatgattgggaagccactggtgttcacgctg

SEQ ID NO: 6143 - DNA, 378 bp, Zea mays
  Clone ID: LIB148-047-Q1-E1-F1
acgagcctctaaagcactcctggggcgccatctggaggaaggacagcgacaagccgatcaagggacccatcaccgtccaactcaccaccgagggaggcactaagaccgtctacgacgatgtcatccccgccggctggaagcccaacactgcctacaccgccaaataaactaaccaaataataataagtatcaaatggcacacttgatagacctttattttttattttttatttaataaaaggatataaggagtgtgacaaacaacaacacgaatattgtattgtctatgtatctcctatatatgcaatcccaattttatcatggccacattttaaaatggaatatatgatatatatatgtacatatggattctacatg

SEQ ID NO: 6144 - DNA, 367 bp, Zea mays
  Clone ID: LIB148-047-Q1-E1-F11
agctgacttctcggattggccgggcgggacacgcccacggcatcgcgatggctgcgcgcggccacgcgcacacggcggcgtcccggccggcggtttccccaggcccagggcatccacgaggagaggacaagcgcgcggcgcggtcgagctgttgaaacgccggccgaggttgattttctcgtgcgatggacacgacacggtgttgacgacgacacggtgttgacgtggccggcgccgttgacgcgttgcgattgcgcggaggaaagagatcgcgcgctagctagctctgaaaagtcactagcgttcaggagtaccaggcaggtcttgttcttttacacacaatccaacactggattaacacggtttg

SEQ ID NO: 6145 - DNA, 437 bp, Zea mays
  unsure at all n locations
  Clone ID: LIB148-047-Q1-E1-F12
cgtcgagacacgcgtctaaagtcactcgggcggacgcgtgggacttgctagggagatctacaatgatgacaggatgactgaaaatttccccatttgtgtgtgggttgacatgtccaagaatttatcggagctagatttccttaaaacgatcatcangggtgctggtgccaatgttggggttacagaaaacaatgaggaactcctcatcctcctcgcttctgccctttccaaaaggttcctccttgtcctggatgacttggagagcccgagcatatgggacaatctgctcaaagattcattgggagatggtgttgtcagaggaagaatactgatcacaactcggaacgaggaagtggcaacaagcatgaaggcaactatccaccatgttgacaaaatggaccctgagagtgcctgngcattattgtgcaatcaagttg

SEQ ID NO: 6146 - DNA, 392 bp, Zea mays
  unsure at all n locations
  Clone ID: LIB148-047-Q1-E1-F2
acccacgcgtccgcagctcactaccaccacctgtaaaatcacctcctccaccggctccagttagctcaccaccgcctcctgtgaaatactcttcaccacctactccagtcaactcaccgccaccacctgtaaaattacctcctccactagctccaatggtttcaccatcgtctcccatgaaatcccctccaccaacggcacccgtcagctcgccgccaccgcctgtaaaatcacctcctccaccggctcctgtgatttcaccatcacctccggtgaaaatcctcccaccaccggcaccagttagctcacctcccccgccaattcgcgtgagctcagcacccccatttgcaaaatccccaccgccacagttcanatcacctgcaccaccaact

SEQ ID NO: 6147 - DNA, 370 bp, Zea mays
  Clone ID: LIB148-047-Q1-E1-F3
agctcctatcccacccgccacccgtcgacgccggcctctctcctcacccgctcggagagtcggagcccggcggccggagggcgacgtcgtccctaataaatactaataatttatcactatacataaccaatatataagccatgggcaagcgcagcgtccctcggtaccctgaggacgaggacaaaggcggctgctgcggctgcctgtgctggtgctgctgcttcctgttgttcatcgtggcggcgctggccggcacggccgcctacttcttcttcgtgtacaagcccaaggcgccgtcctactccgtgagcaacatgtccgtctcgcagttcgacttcagcacctccgacctgacgctgtacgtcaagct

SEQ ID NO: 6148 - DNA, 367 bp, Zea mays
  Clone ID: LIB148-047-Q1-E1-F4
agctacccgtccttcggtaggtgcattgcttcggtggtcaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtga

SEQ ID NO: 6149 - DNA, 387 bp, Zea mays
  Clone ID: LIB148-047-Q1-E1-F6
acaggcaggcccgacctcctgcccttgtacaacgcacgcacggtccccgtcccaatggcccagactctgtccgccgcctcggagctggccaccctgaagcgcccgttcggcaacgacgggttcggcgatggcagcaacaacggcagcgcgaccggcgagaagcccaaggcgcggcggcgggaggcggacccggcggcggcgatggccgcggcgcggcacgagttcggcgagcacggcggcgtgaacatgtccatcgaggcgtcggcgacgttcacggtgatggagccggacacgatgcggcggctgttcgcgggcgagctgggccccgaccgcggcgacatgtacatctacagccggcacttcaacccgacggtgctggcgctgggg

SEQ ID NO: 6150 - DNA, 404 bp, Zea mays
  Clone ID: LIB148-047-Q1-E1-F8
ctcgcgggccgatacacgcctctaaaataagtcatggcagtgaatgtgagaaccatgtggtcgtcgatgcgggcacaggttgcgatggttgtggcgttggtgttcttggtgagcggcgcatggtgcggtcctcccaaagtccccccaggcaagaacatcacggccacctatggcaaggactggctggacgctaaagcgacatggtatggcaagccgacgggtgccggtcccgatgacaacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacat

SEQ ID NO: 6151 - DNA, 425 bp, Zea mays
  Clone ID: LIB148-047-Q1-E1-F9
aaccggagtcggcgtgcctagctcgatcttgaaccatagctagccagcatggcgcccagcagcagcatagcagtactgctgctcctcgtcgtcgccgtcgtcctctccaacgtcccctcctcgggcgccctggcctcctcgtcgtcgtctctgctgcaccagtcgtctccgtctgagagtgagactgagaccgacagtagcagcggagaatcttcttcgtcgtcgtcgtcggaagaggccggcgagaaggagaaggagaaggagcaggagatggagaaggcggtcgcggcggagaaggctgcccagcaggagctgctcaagtacgccaaggagaagggcatcgtgtcaccgaccaacggcacggggcggtacaagggcatcgcccgggagttcgtggacgcccacaacgagctccgcgcgcgcta

SEQ ID NO: 6152 - DNA, 381 bp, Zea mays
  Clone ID: LIB148-047-Q1-E1-G1
cccacgcgtccgaagagctacgcaaacgcacagcgatgcacaagcacgagataccagccaccatgcgcctgtccctcctcctcgtcgtcgtggccgccctctcggcgcgcaccgcggcgcagctgccgctggcgggcggcggcggcggcgccctgaagccggacttctatagccagtcgtgcccgcgcgcggagcggatcattgcggaggtgatgcagacgaagcagatggcgaacccgacgacggccgcgggcctgctccgcgtcttcttccacgactgcttcgtcagcgggtgcgacgcgtcggtgctgatcgcgtccacccagttccagaagtcggagcacgacgcggagatcaaccactccctccccggggacgcct

SEQ ID NO: 6153 - DNA, 387 bp, Zea mays
  unsure at all n locations
  Clone ID: LIB148-047-Q1-E1-G10
aattctagatcgcgaacggccgccctttttttttttttttttaaattttgcgacaacaatcagaatcgctttgccaatgtccacaataagttacagctcagatacaatacatagaacgcgcgaatgccgccacacaacgacaatatgtcactccaatatcncatcagctgcccacccgcttggttctcacaggactgactcggttacccccttacaaaaccttcaacaaatttacaggacgggaacagcgcaggtctctggtagccaggttcttacaaggacaatgcaaaaataacacgaggccatctttttggtgatgtgaggtataaattaaaatgaaaaatggcatgggagtgaatgcctcatgagttaggtttgtacagcgaa

SEQ ID NO: 6154 - DNA, 413 bp, Zea mays
  Clone ID: LIB148-047-Q1-E1-G11
aacacacgtccggcaagccctcgcgctagtggcggccaccgccccacaggtagcggaggcaaagaagaagagagcggcggagagcggcgaagcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaacgtctgccaagaggagtgcgacaacgcgtacgtggtgaaggcggccgaggtcaccaatgcctgcagcgtcacctgcgccaatgagaagaacccgcgcctcagcgagaactgcaagaggtcctgcacccctcctc

SEQ ID NO: 6155 - DNA, 434 bp, Zea mays
  Clone ID: LIB148-047-Q1-E1-G12
cacgcgtctgaacaagctggtggtaggcgtctcactatccaccaccgcgccgctccggtttaatttctcctcgaccggccagcgcaattctgtggctcgatcgatcggtcggtcgtaaggcaagtgagcaagctatatatatatataggagattcttcgagcgagctagtagcgagatgggttccgccgtcctcttttactgcatctgcatcgccgtcgtcgtcgcattgtcgtcgtccatggtcgccgtcggggccgccgccccgggggaaacccccaagttcatctcggggctgtgcccggtgcggttcgaccacacgcgcgggattagcgcggtggccagcagctgcaaggaccgcccgctgccgtcgccggagcgctgctgcggggcgctcaaggcctacgcgtgcccctacagcgagctcatcaacgaa

SEQ ID NO: 6156 - DNA, 392 bp, Zea mays
  Clone ID: LIB148-047-Q1-E1-G2
attcgtcatgatgccgctggacaccgtcaaggagtgcggcaccgcgctgcaccgccgcaaggcggtgcaggccagcctctccgcgctcaagagcgcgggcgtcgagggcgtcatggtggacgtgtggtggggcatcgccgagcgcgacggcccgggccggtacaacttcgcgggctacgcggagctcatggagatggcgcgcaaggccgggctcaaggtccaggccgtcatgtccttccaccagtgcggcggcaacgtcggcgactccgtcagcatcccgctgccgcggtgggccgcggaggagatggagagggaccaggacctctgctacaccgaccagtggggccgccgcaactacgagtacgtctcgctcggctgcgacgccatgcccg

SEQ ID NO: 6157 - DNA, 391 bp, Zea mays
  unsure at all n locations
  Clone ID: LIB148-047-Q1-E1-G4
cgggtcgacgctgaccgcgatggacgagctgctgcagtcgggctgcacaacgtcaaccgttaccatacaccaccgaacgaaccggcccaagacacaacgggccgccagcggttcggaagcccttcaaccgagccgcngcgcaatgagcgtcggccagcgcgacggcgggctgccgcccgattcggtggtcgagcgcgaacccgacatcctgcgcgacgcgcagcgcctgatcgagacctatcacgacgaaggccgctacgcgatgctgcgcgtggtcgtcgcgccgtgctcgccgttttcggtgagccgcgaactgatgcgcgacgcggccgtgctcgcgcgcgagtacggcgtgtcgctgcatacgcacctggcggaaaacgtcaacgac

SEQ ID NO: 6158 - DNA, 250 bp, Zea mays
  Clone ID: LIB148-047-Q1-E1-E9
tcctcaacgctcggcggcacctccacctgcaaggacgcctgcaacgacctgcccaagaccatcgacaaggacgacgtcatcaacttcagcctcgacttcgagaaactgcagcgcgtcacgctcgatctcatcaccgaggcgtccggcaccatgtccgcatgcatcgccctgccaccctccaacgccggaacgccctcctactgcgcggccgcgccttccgggggctccgccgatgcccccgccggcgcct

SEQ ID NO: 6159 - DNA, 401 bp, Zea mays
  Clone ID: LIB148-047-Q1-E1-D12
acggcatccgatccatcttgggcgggcgccgcgcgtcgagggccagccaaagcttgccatggcggccgtccggtccgacagggtccaccaccaccaccgccgctccgaggcgtcgtgtccggcaacctccgcggccgtggcggcggcgagggccgatgacgccctgcgccagcgcccgcgggggctcgtgcaggtccgggagcgggaccagggcccgctgtcgacggggcaccagcacctgcaccaccatcaccaccagctgcggcggtcggcggcgttcccaccccgccgcccggggccggggcgccgccctcctcagcgctgcgaaagcgacctcaacatcagggagcaccgctcctgcagcgaggtggccggcggcaccgcggccggctgcgccgctg

SEQ ID NO: 6160 - DNA, 369 bp, Zea mays
  Clone ID: LIB148-047-Q1-E1-D2
aaatcattgcacccctcccctccgtcaccccaccacatccggccagcccaacgaaaatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgcctccacccccgccgttgccgctgccccatcgtcgtcgtcgtctaggaagtctggtccagctgccgcgccgaccaccgccgcctctacaccgtcttcttccacggacg

SEQ ID NO: 6161 - DNA, 366 bp, Zea mays
  Clone ID: LIB148-047-Q1-E1-D3
cccacgcgtccggaagaagaagaaaaagaagggcgccaggaagggcaggaaacgcgcctccatcctgggcgacgccggcaccttcgacccggacttctcgcggcggtaccggctcggcgcggagctcgggcgcggcgagttcggcgtcacgaggcggtgcgaggacgccgccacgggggaggccctggcgtgcaagacgatccggcggaagcggctgctcctgcgcctcgccgggcccgacgcgaccgacgtgcagcgcgaggtggagatcacgcggcgcatgtcggaggtgagcgggggcagggtcgcgtgcctgcgcgaggcgtgcgaggacgacgacggtgtgcacctcgtcatggagctctg

SEQ ID NO: 6162 - DNA, 367 bp, Zea mays
  Clone ID: LIB148-047-Q1-E1-D4
agcaagatctaagcaaagacttgatttagttatggacggattggtaggcctcttgaaagttcgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggaggtgttcgacaaggacaccttcagcagagacgaccccatgggagacgcggaggtggacgtggcgccactgatggaggcggtgagcatgaacccgcgggaggagagtctgaggaacggcgccatcatc

SEQ ID NO: 6163 - DNA, 386 bp, Zea mays
  Clone ID: LIB148-047-Q1-E1-D5
ttcgcggtccgacccacgcatccatgcgctgcaagcaacaaagttctactctgtccacccgtccatctagctctcaagaaccaacccgtaccagcgctatccggccggccatggcggcggcgcgccggctctccctgcccctcgtcctgctggtcgtcctggccgtcgccgggcgcgcggtggcgcaggactacgacttcttctacctcgtgctgcagtggccgggggcctactgcgacaccaagcatagctgctgctaccccaagtccggcaagccggcagtggacttcgggatccacagtctctggcctaaccgcgaccaccgcacgttcccgcagaactgcattcccgaccacgcattcaatccgtctattgtgagcgatcta

SEQ ID NO: 6164 - DNA, 358 bp, Zea mays
  Clone ID: LIB148-047-Q1-E1-D7
aaaacaatccttgcacccctcccctccgtcaccccaccacatccggccagcccaacgaaaatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgcctccacccccgccgttgccgctgccccatcgtcgtcgtcgtctacgaagtctggtccagctgccgcgccgaccatcgccgcctctacaccgt

SEQ ID NO: 6165 - DNA, 303 bp, Zea mays
  Clone ID: LIB148-047-Q1-E1-D8
cccacgcgtccgcccacgcgtccgcaacaagatggcatgtatagacaatgcaatgagagccttgttccttctagcgctcttctgcaccgtgcatggtgagaaggcaaagtcaaaggacaacgattcaaaagcgtccgggcccggtgggtccttcgacatcaccaagttgggcgcctctggcaatggcaagacggatagcacgaaggctgtgcaagaagcgtgggcatccgcgtgcggcggcaccgggaagcaaacgattctcatccccaagggcgaattcctcgtcggaccaatcaacttcaa

SEQ ID NO: 6166 - DNA, 410 bp, Zea mays
  Clone ID: LIB148-047-Q1-E1-D9
cgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatcaccggca

SEQ ID NO: 6167 - DNA, 395 bp, Zea mays
  Clone ID: LIB148-047-Q1-E1-E1
atttgtacatatgaggctgaatacatatcacgactctaaaccatccatttggttatgatctttttttaagaaagagcatatagttttttgaccaagaaaataagcatgtagttatgactaccaattgttcgttttagattaaagatgattgtttgaattgctgcagttgtaatctacatagacaaaaaacaatgtaaaagcaataaaatccggtacaaacattgcaatggtccacctagcattcttaattctttgatcctttcataccgcgttcacgttaacggacggcagcagcgggcgggccggccggccggctcacgtgaacaacgcccacgaaacagcgctggctgttgcaaaagcaaccgtttccagtttcctcggcaagtgcaccccct

SEQ ID NO: 6168 - DNA, 421 bp, Zea mays
  Clone ID: LIB148-047-Q1-E1-E10
accacacgtccggccagagcctacaacggacaggtttgttgtcatcacttctggaccagacgaaagatgcattcctggaaacaccatcgccgtccaagctgacatgccatacagtggcctgtcatcgttcggaacagcatttttgtccaagttcgaatgttctcagatgccacatccactgttagagcacgtgaccttcgtggacactccaggagttttatcaggggagaagcagcggacgcagcgcagctacgatttcaccggagtcacgtcgtggtttgcggccaagtgcgacctcatccttctcctgtttgatccgcataagcttgacatcagcgatgagttcaagcgtgtgatcgggtctctccgcgggcatgatgacaagatacgcatagttctcaacaacgccgaacaagttgat

SEQ ID NO: 6169 - DNA, 369 bp, Zea mays
  Clone ID: LIB148-047-Q1-E1-E11
atgacatccttgtcggaggcgcacaacttggaggttcgatgacatcagttcctgatgaggtcattcgatgtaatcatgtatgcacaatcgcggtccgagctgacatgccagagagtggcctgtcagcgttcggaacagcatttttgtcgacgttcaaatgttctcagatgccacatccactgttagagcacgtgaccttcgtggacactccaggagttttatcaggggagaagcatcggactcagcgcagctacgatttcaccggagtcacatcgtggtttgcggccaagtgcgagctcagccttctcctgtttgatccgcataagcttgacatcagcgatgagttcaaacttgtgatcgggtctctcc

SEQ ID NO: 6170 - DNA, 369 bp, Zea mays
  unsure at all n locations
  Clone ID: LIB148-047-Q1-E1-E2
agccgccatcatagaaccgccgccccgtccgaggccggactgtgccctggctggggccggtagccgcgaccaggcaaggggcgaccgcgccctcgccgggatccaggcgctcgccatgcgccgtggtccgcgaccgccttggagagccgccacggcctccgtcgggccgcccgcagtctgctccatccggcgccaggagcagcagcgcctgngcgtcctcgtcatgcgtgccggtgtcagccaaccccgcaccaggaggcggccacgccgaactccgcgagaagccgaccgcgcccgacgttgccggatccgcaccggcggtcggtgtggcagggacgtgccgcttgcgcagagatgcagagcacccgt

SEQ ID NO: 6171 - DNA, 158 bp, Zea mays
  Clone ID: LIB148-047-Q1-E1-E3
tagtaagaatcatgggagttgaaagtgcgacacaccagagaacgtttctgtgtatactgtgtaaaggtcctaaaggaaagagaagatgcacatattcaaagcctcggaactaattgctctgttgtccactatgttatccaagtatatatttgttcttc

SEQ ID NO: 6172 - DNA, 407 bp, Zea mays
  Clone ID: LIB148-047-Q1-E1-E5
ttcgccggccgacccacgcatccatcgacgccgagtacatcacgacggcgccatacgcgtgcgagccggagagcctgcccaagtacgcgcccaacaaggagatggacgctaagctccgagaagaatctagaaggaggagcaaccttccgagccaaggcggcgaggcggataagggtctgtcgagggggcacaagagcatgcggctgcaggacacgaaccagagccacgtgcacgccgaggaatcgctgcccgttgtggccgaaaacggggtgacaatggcggggaacgacggcgactcgcggctgttcgtcgacctggagcccgttccggccatcagcaagcggcacggcggcagcgtcggcggcgaccacgcggcgccgtgcgccagggctaggaccatgttcaac

SEQ ID NO: 6173 - DNA, 392 bp, Zea mays
  Clone ID: LIB148-047-Q1-E1-E6
acaaggacctggaggccgccgcgcccatgctcaccttcgaggcgggcaagacgtaccgcctccgcgtgtgcaacaccgggatcaaggcgtcgctcaacttccgcatccagggccacgacatgaagctcgtggagctggagggctcacataccctgcaggacgtgtacgactcgctggacgtgcacgtcggccactgcctctccgtgctggtcgacgccgaccaggcgcccggcgactactacatggtggcctccacgcggttcatccacgacgccaagtccgcctccgccgtcatccgctacgccggctccagcggcgccccgccggcgcccaacatgaccgagccaccggccggctgggcctggtccatcaaccaggccaggtcgttccgc

SEQ ID NO: 6174 - DNA, 393 bp, Zea mays
  Clone ID: LIB148-047-Q1-E1-E7
aatcgatcacgacaaaatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacg

SEQ ID NO: 6175 - DNA, 401 bp, Zea mays
  Clone ID: LIB148-047-Q1-E1-D11
aggacacgtgggcggacgcgtggggtgaccctcttaggtgacggctccaaaaattccatcgtcaccggcaaaaaaagcttcgccgacgggatcacaactttcaagacagcaaccttcactgcgcaaggcgacgggttcatggcgatcgggatggggttccagaacacggccggcgcggagaagcaccaggcggttgcgctgctggtgcagtcggacaagtccatcttcctcaactgcaagatggacgggttccaggacactctgtacgcgcactccaaggcgcagttctaccgcaactgcatcatctccggcacggtggacttcatcttcggcgacgcggcggcggtgttccagaactgcatcctggtgctgcggcggcccatggacaaccagcagaacat

SEQ ID NO: 6176 - DNA, 377 bp, Zea mays
  Clone ID: LIB148-047-Q1-E1-B7
acaagcctctagaatgagtcgtaatagcgtgcgttcgtgcagccacagacaggcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggat

SEQ ID NO: 6177 - DNA, 379 bp, Zea mays
  Clone ID: LIB148-047-Q1-E1-B8
gaccccagccagtcgatcgttcaagaaaaataccagcttaccaacaacagcagcagcaagcccacccgttcgacgacatggcccgcctcggcgccggcgccgtgttggcgctcctagtggcggtcgcggcggtggccgcgttcctcgcggtgccggcctcggcgaagtccggggagctgagcgcgatggggttgctggcggcgaagggcggcagcggcgcgggcccgcagaagtgctcgggcgcggtgggcgagtgcgacgtggacgaggcggaggagctcgggctgagcggcggcggcctcggctccgacgacgcggtgcggcggacgctggcgcagcggaagccgaccaaccggtacatcagctacgcggcgctgcg

SEQ ID NO: 6178 - DNA, 375 bp, Zea mays
  Clone ID: LIB148-047-Q1-E1-B9
cgcgtgggttccgcggcatccgatccatcttgggcgggcgccgcgcgtcgagggccagccaaagcttgccatggcggccgtccggtccgacagggtccaccaccaccaccgccgctccgaggcgtcgtgtccggcaacctccgcggccgtggcggcggcgagggccgatgacgccctgcgccagcgcccgcgggggctcgtgcaggtccgggagcgggaccagggcccgctgtcgacggggcaccagcacctgcaccaccatcaccaccagctgcggcggtcggcggcgttcccaccccgccgcccggggccggggcgccgccctcctcagcgctgcgaaagcgacctcaacatcagggagcaccgctcctgcag

SEQ ID NO: 6179 - DNA, 362 bp, Zea mays
  Clone ID: LIB148-047-Q1-E1-C1
cgggtcgagcacgcgtccggggacgtaagaagtcgtctaattcttggatcgaattagacgacttcttcgtccctctcttcattagcacgctaacttgtaatctgcaggatctaagcaaagacttgatttagttatggacggattggtacgcctcttgaaagttcgcgtggtccggggtatcaaccttgcctaccgcgacgcaagaggcagcgatccgtatgtcgtcctacggcttggcaagaataaactgaagacaagcgtaaagaagagatccgtgaaacccatatggcaagaggagctatctctgaacgtcatagatcccagccaaccactgaagctggaagtgttcgacaatggcacct

SEQ ID NO: 6180 - DNA, 314 bp, Zea mays
  Clone ID: LIB148-047-Q1-E1-C10
aaattatactatatgtaatccttttgttcgggttcatgatcgaattccaaagagtggaaaacaagcaaaaggttaaatatacatgccatttttggaggcatttttttcatgagggcatgtttcgatatatggaccactaaatatacatatcatttactttcctaaaaaaaaaaaaataaaaaaaaaaaaaaaaaaaagataagaaaaaaataaaaaaaacacaaacaaaacaaaaaaaaaataaacagaacacataaataaaaaaaaaaaaaagggggggccgccctaaaggttcaatcctaacgttatcttaa

SEQ ID NO: 6181 - DNA, 389 bp, Zea mays
  Clone ID: LIB148-047-Q1-E1-C11
aaacaaagtcgtgttcctggccatcagcgtccaggatctacccgtcaccatcatagcaaccgtggacgacgatacgttcaggatcgccgtagagcacagggtcagggtcgagtacatgaattagcagatcgcgaaggagcagcaccaggaggcgcgcatagacgatcagatgctcgtgcgctagggctaggatctctacaaccggcagcttatcaaggatgtctgcaagggcaactatgatgtcatacacttgctgcatccgcgctccctcgacgagggcaacaagtcatttcggaagacgtagttaccgctacggtgttacaacgtcaagatcaaccacatatgcagcggccataccgtcatgatccatgacaagctctacgaagcgc

SEQ ID NO: 6182 - DNA, 415 bp, Zea mays
  Clone ID: LIB148-047-Q1-E1-C12
atccggcgcgcgacgctcgccgccgcgcctcccctcccctcctccgaacgacgtggctgccgtgcgcccgaccggccggtgacggacacggcagctgctacgagaggaggaggatatatactagtatatagctagagcaattattagctggtcgtaagcatgaatcgacgattggacatgatagacaacatcgacggccgtcgggtaaccaagaacaaggcgcgcatccaagttggcgactcctcttcgtcggacgaaagcgacagggagaaggaggaagatgaagaagaagcacatgaggaagtggtcaaagcgcccccgctgggttggaatcatcacattcaccacgaagcggccggcggcattggcagcaacagcaacatgacgcggcttctgtcgaagcagctgtccatga

SEQ ID NO: 6183 - DNA, 387 bp, Zea mays
  Clone ID: LIB148-047-Q1-E1-C2
atgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgccggcgacgacgccccgagggccgtcttccccagcatcgtggggcgcccgcgccacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgtggctcccgaggagcaacccg

SEQ ID NO: 6184 - DNA, 363 bp, Zea mays
  Clone ID: LIB148-047-Q1-E1-C3
acccacgcgtccgcccacgcgtccgcccacgcgtccgcccacgcgtccgcgccgacatcgaccctgaccgcctaccgcaaatcctgtacgaagacgaggaccgggacaaggtggtgctcgcgtcggacgacgacctcgcggcggcggtggaacacgccaggctcgccggatggaagggtctgaagctgttcctggactactccggcaccaccgggcgcaggaaagcggtggccaccccacgtggcgccatggcggtgggcatgtccagccgggacgcgtgggcggcggcgtacagcggggtcgccgccggggctgccctcgtcactggcatcggcgtcatggcgtacctgcgaagatctgcct

SEQ ID NO: 6185 - DNA, 417 bp, Zea mays
  Clone ID: LIB148-047-Q1-E1-C4
aacagggagaagatgacccagatcatgttcgagaccttcaacacccccgctatgtacgtcgccatccaggccgtgctctctctgtatgccagtggccgtaccacaggtatcgtgctcgactcgggagatggtgtgagccacaccgtccccatctacgagggatacgccctcccccacgccatccttcgccttgatctggccggtcgcgacctcaccgactacctgatgaaggtcctgactgagcgcggctactccttcaccaccaccgctgagcgggaaatcatgagggacatgaaggagaagctcgcctacatcgccctggactacgaccaggagatggagaccgccaagaccagctcttccgtggagaagagctacgagctccccgacggacaggtcatcaccatcggggccgag

SEQ ID NO: 6186 - DNA, 386 bp, Zea mays
  Clone ID: LIB148-047-Q1-E1-C5
acgacgttgagaacacggacggcgtccacgtcggaggctcctccaagatcagcatcctcaactcgaccatcggcaccggcgacgactgcgtctcgattgggcccgggtgcaacggcgtcttggtggacagcatcacctgcggccccgggcagggcatcagcgtcggctgcctaggccgctacaaggacgagaaggacgtgagcgacatcacggtgcggaactgcgtgctcaagaacaccaccaacggcgtgcgcatcaagtcgtacgtggacgccgagtccgtgctgacggcctcccatctcaccttcgagaacatcacgatggaggaggtggccaaccccatcgtcatcgatcagtacttctgcccgcagaaggtatgccctggc

SEQ ID NO: 6187 - DNA, 339 bp, Zea mays
  Clone ID: LIB148-047-Q1-E1-C6
atccgaaatgagtcgtatataagaaaagaataaaaataaaaagaacaaaaaaaaataaaaataatcaaaacaaaaagggaggacgagcgacaagtgtcgtctcgtttgtgcccgggtgtgcaagtagtcttggtgttcagtatcgtctgcggcttcgggttcagggtcagtgtcttttgcctatgccgcttgtaagacccctgggatttgagcgatatcacggtttggaactgcttgctctttagcatcaggaacgtgcgtgcgcatcaggtcgtacgtggtcgccttgtcattgctgacggactctcatctcaccttcgagaccatcatgatggcgga

SEQ ID NO: 6188 - DNA, 399 bp, Zea mays
  Clone ID: LIB148-047-Q1-E1-C7
actcaccgagtgcttcagcgacaatgtgctgtttgaccacctcaagggaaacctgcattcacggcggtattctgaggccaaggttacgctgtttgggcccatgccatggccgtttaatgatggtgtgctcttcttcaacaactcacgcgagaaggatccgctcctgctggactcaagctcacagagcaccagagagcttgccctggttccagagcctgaggtttcagggaatgatactgaggtgacatcaaggctgagagatggttcaacctcctctaatggtgtgaaaggtgcacgctatggtgcaaaaggccgtgctaatggtagaactgctgctgtatctgaagatcacatgctttcaaaccatggaactgatggtcctgttgttattcctggtgt

SEQ ID NO: 6189 - DNA, 348 bp, Zea mays
  Clone ID: LIB148-047-Q1-E1-C8
cccacgcgtccgcatcgccgtcgtctcctcctccgcctccctgtcggtccgctccgcacctcgcctaaaacacccctccgggcattgccgcaccgagctccccttcctcaaattgccccaagcccggacgcctcgacgcccagctccgtgctcgagttgctagcggcgtcctccatcgctccgcctccctatgtcaccgcccggccgctggctcctccgccgactcaggccggggccacggcgcggttatgatgcgtgattctaggacgcgcgttgctgctctgctgctgggacgatctagccggagagagtgattatctgtcacaatggcctccacagatcacactg

SEQ ID NO: 6190 - DNA, 417 bp, Zea mays
  unsure at all n locations
  Clone ID: LIB148-047-Q1-E1-C9
agaggacaagaactacagctacagcctcgaggtcggcgccaacgggaggaagatggtgtgggagggcaccccaaggagcgtccgcgacagccaccgcaaggtgagggacagccacgacggcctcatcatccagaggaacatggcgctcttcttctccggcggggaccggaaggagctcaagctcaggatcaccggacggatctggaaagagcagcagacaccagacggcgcatgtactccaaatctgtgcagctaattaagcaatcttcaaacacacaccttgcctgtccttctttctctttctaattaatcgtggtggtggtgctcaaagggattatttattactaattattaggaggacgtangatgctcgtgtaaatgaaactgtgtatattatatggatggcatggcatccct

SEQ ID NO: 6191 - DNA, 421 bp, Zea mays
  Clone ID: LIB148-047-Q1-E1-D1
acccacgcgtccggcaaggacatgctgatcaaggacgtgaccgtgacggcgcccggggacagccccaacacggatggcatccacatgggcgactcatccgggatcaccatcaccaacaccgtcattggcgtcggcgacgactgcatctccatcggccccgggacctccaaggtgaacatcaccggcgtgacctgcggccctggccacggcatcagcatcggaagcctagggcggtacaaggacgagaaggacgtcacggacatcaacgtcaaggattgcactcttaagaagacgatgttcggcgtccgcatcaaggcgtacgaggacgccgcctccgtgctcaccgtctccaagatccactacgagaatatcaagatggaggactcagccaacccaaccttcatcgacatgaagtactgcc

SEQ ID NO: 6192 - DNA, 99 bp, Zea mays
  Clone ID: LIB148-047-Q1-E1-D10
agtcgtattaaagtagacggcgattgacacgcgtcttcgtcctcgcctacttccgcaactcggagcttcttcgatttcccatccccggtgctgcatact

SEQ ID NO: 6193 - DNA, 368 bp, Zea mays
  Clone ID: LIB148-047-Q1-E1-B6
cacgcctctacacagacgtcctgggatcaccggtgggtggcccggccaggcgcggtggccgggcgggtgcggcctcctgccccgacctcggctcggcgcgcgcaggcgcctggcagcccccagcctcggcctcggccaggcgcgcgcgacccccagccccggctcgccggctcgccggtcatggtggctccgatccgggctcctccggcatgggcaggcgcgggttcccccggctagcagcctctcctggtgggcacggcctgccccggcggctcaggaaggcgcggcggccccggcgtgcacagccgtggtccagccatggcggcgcgggcacgcagcctcggctccccggcgggcatccatggcgc

SEQ ID NO: 6194 - DNA, 399 bp, Zea mays
  Clone ID: LIB148-047-Q1-E1-A2
cgggtcggtccacgcgtccgacaacgccgagcgcgacggcccgggccggtacaacttcgcgggctacgcggagctcatggagatggcgcgcaaggccgggctcaaggtccaggccgtcatgtccttccaccagtgcggcggcaacgtcggcgactccgtcagcatcccgctgccgcggtgggccgcggaggagatggagaaggaccaggacctctgctacaccgaccagtggggccgacgcaactacgagtacgtctcgctcggctgcgacgccctgcccgtcctcaagggacgcacgcccgtcgagtgctacaccgacttcatgcgcgcgttccgcgaccacttcgccgactacctcggcaacaccatcgtggaaatccaagtcggcatgggcccccc

SEQ ID NO: 6195 - DNA, 373 bp, Zea mays
  Clone ID: LIB148-047-Q1-E1-A3
aaccctctatactaagtcctaataagaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacat

SEQ ID NO: 6196 - DNA, 371 bp, Zea mays
  Clone ID: LIB148-047-Q1-E1-A4
aatcgcgatcgccgcacttttttttttttttttttgttcaatagacatacattttattaaatatgcagggcatcgtagaaaagaatggttctcccttccaaaaagcaaaagaaaagaaactcgtatagtcgatcgacgaccatgcatcacatttccttttcctcgatcttctcttatttccgcagaaaaacaacgaaggaaacccaaccaaggaaacgcatgctattgcttaagcatcgccggaggagctggtcgatcgctcgctcactcacgggcctgattgttccggtcacctgtcgtcgtcgtcgagctgagacacgctcctccagaagcccgtgccgtagaacctggcccatacctccttctcaagc

SEQ ID NO: 6197 - DNA, 373 bp, Zea mays
  Clone ID: LIB148-047-Q1-E1-A5
gacccacgcatccacggacgcgtgggcggacgcgtggggtcgacgtccagcagatcgagagcggcctggtgcccatgccggtctacggcgccggggccggggccggctcgttcaccctgcagtgggacggctgctacggccccgcggactcgaggcacaacggctaccgcttcggaagcggaggctgcgggatgcggcaccacggtcgcaccccggagcaggaccggaagaagggcgtgccgtggacggaggaggagcacaggctgttcctcttaggcctgaagaaatacggcaagggggactggaggaacatatcgcgcaactacgtccatacgcggacgcccacgcaggtggccagccacgcgcagaagta

SEQ ID NO: 6198 - DNA, 426 bp, Zea mays
  Clone ID: LIB148-047-Q1-E1-A6
tcgcgggccgacccacgcgatccacggacgctcgggcgaaaatccgacatgtacgtgttctgctgctcctacgcccacaacgtcgcgcccaaaggcaagttcatcgccttcgtctccaccgaggccgagaccgacaagcctgagatcgagctcaagcccgggatcgacctgcttggccctgtagaggagaccttcttcgacatctacgacagatatgaacccgtcaacaacccggaggaggactgctgtttcctcacaaatagctatgactccaccacccattttgagacgacggtcaaggatgtgctcgccttgtacaacaagatcactggaaaggagcttgatctctcagtcgatttgaacgctgctagtgctactgagcaagaagctgcttgaacacccggcggcctcttttttttgcagctc

SEQ ID NO: 6199 - DNA, 399 bp, Zea mays
  Clone ID: LIB148-047-Q1-E1-A7
atactctacactgtgtcgtattaccacgcccgcaggccgggaccggcggggtcgcgcgccgggtaggaggacgagaagaggaatggcggtatggcggcgccgccggcgagggcccgggccgactacgactaccttatcaagctgctcctcattggagacagcggtgttggcaagagttgcctcctgttgcggttctctgatggttccttcactacaagctttattaccacaattggtattgactttaagatacgaccaatagaattggatggcaaacgtataaagctacagatttgggatacagcgggctaagaacgcttccggactattaccaccgcgtactaccgacgagctatgggcatcttgctggtttatgatgtcacccatgaatcctccttt

SEQ ID NO: 6200 - DNA, 391 bp, Zea mays
  Clone ID: LIB148-047-Q1-E1-A8
atccaagctctctcctcatcacccacccagcgcgacgaaaccggggggctatcgctccagctccgccgcaccaacgacctcaccccccgaggacccgccggcggtacaccgcctccctatcacgcctcatcgattcctcaggtctacgttttttttggttttgtgatttatccaaatttggaccgcaagcatgactacggcgaatcattatcagcacatcatttcacccaagcctgttgtgggcaaagcatgaaaattgaaggatctcatgataaaatgtgataataggatatgtgctgactgtggtgcacctgatcccatatgggcatctactaatattggagtgtttctttgcttaaaatgtggacatgttcatagggcacttggacct

SEQ ID NO: 6201 - DNA, 443 bp, Zea mays
  unsure at all n locations
  Clone ID: LIB148-047-Q1-E1-A9
ctcgcgggtcgatgcacgcctctagccgcagtgccagcagagcctcgtcgtcgagctggcgctgcagacgcacgcgctgctgcgcgagctcggcaaccccgcgggcgcgcgcatcgtcctcgaaaccgagcgccgcgcggcactggaggccgccccctcagccgccgccgcccgagacggaggacgcggggcgtcgcgggctaataataagcgcggagtccgcgcgccgccgccgccgctgctggacgagccgtcgtggaccatgttctgcaacggcaagaagaccgggtacgcggtgcgaaggcaggccacggacgacgacctcgctgtgatggagacgctgcgggcggtctccatgggcgccggcgtgctccccgggagggccgccccttcgtcggcgcccgacgcggctgcngcggcggcagcggacgacgaggtgccct

SEQ ID NO: 6202 - DNA, 364 bp, Zea mays
  Clone ID: LIB148-047-Q1-E1-B1
acggacgcgtgggcgaattcccaggcaggcaggtcggcgaggagggcaggaagaccgaagaccgagccgtgcgggggctcgggacgggaacgggacaggaccccaaaatctcagatccttcctgcccgcccgcccgtgcccgtcgacgcgtcgttcttgccggccgcgcctcacctccgccctctcctcctccagggggatcggatacgccacaggctgcgcgatggtgctgtgggtcttcggctacggctccctcatctggaaccccggcttcgacttcgacgacaaaatcctcggcttcatcaagggctacaagcgcacctttaatctcgcttgcattgaccacagaggcacaccggagcat

SEQ ID NO: 6203 - DNA, 430 bp, Zea mays
  Clone ID: LIB148-047-Q1-E1-B10
ggtcgagacaagcctctaaaatgagtcgtagtaggtgctggagtcggcggacctgctcgcgccgcggaagctggacgccaaggaggagctggagaagctgaacgaggccccggcgtcgatgacgctcttcgacttcatgggctggcacttcgaccaggacgagctgatgaagcgcagggaggacggcacgctggacgccgacggcgatgccatgctcctcaagaaggcgcccagcgtggcgcccaagaagttctcctacgtcgacagcctctcctccggcggcatgaggagcccctctgcgcgccactgataataatatatgatcgtcgtcgcgccactgaactaacagcagctcagtcatcgtctacgatccaacagcaccatggatcgtcgatcgtccactcacgagaaggagagacgtccattggga

SEQ ID NO: 6204 - DNA, 438 bp, Zea mays
  Clone ID: LIB148-047-Q1-E1-B11
cgggtcgaggcaagcgtctagaataaatcattataaaatggaattttagtgtaaaaataaaaggctagaacttgtttatttcatagaaaattcatatgaactccaaatcacttcatttcagttcctaaaattttgtaattttattctctatcacttagagtctctggtttgtcatgaaaacagtaataaaatttatttatcacttaattctatttaaaacacacgaaacctttgaaaattcataacttaaaatctataactccaaaaattatgattcatgttcctaggattctattttaatatgtagattattactgtgtattttgtttatatgtttcatgtgatgttcattttgtctataccatgtttgtctgtattgctacgtttagcagtgaggacacgtgtcatctgaagagcaagttggtacctggaatctca

SEQ ID NO: 6205 - DNA, 387 bp, Zea mays
  Clone ID: LIB148-047-Q1-E1-B12
tcctcatcccccgcagggcaacaactcagccgccgcaaccgccacatcagccatgggcgcctgcgcaaccaagcccaagacgcttgaggggcacgccccagctgaggccgccgtctccacacccaacgttgcgcccgaggccactccaatctccgttgaggttgcggctgatgaacaggtagctgagaatgtggtggtggaggagccggctgctgcggccgacgttgagcatcagaaggctaatgaggtgctcgctccagatgcggccgtcgccgagcccgaccacaaggaggaggaagccgtggagaagaccgtcgtcgaggaggagaagccagcggcagcagcccatgcagacgaaaatgtcgccaccgccgccgagaccacgac

SEQ ID NO: 6206 - DNA, 355 bp, Zea mays
  Clone ID: LIB148-047-Q1-E1-B3
agagagtcgtattataagagcggcaggcaggtccgcgaggagggcacgcagaccgacgatcgagccgtgcgggggctcgggacgggaacgggacaggaccccaaaatctcagatccttcctgcccgcccgcccgtgcccgtcgacgcgtcgttcttgccggccgcgcctcacctccgcccgcgcctcctccagggggatcggatacgccacaggctgcgcgatggtgctgtgggtcttcggctacggctccctcatctggaaccccggcttcgacttcgacgacagaatcctcggcttcatcaagggctacaagcgcacctttagtctcgcttgcattgaccacagaggcacacc

SEQ ID NO: 6207 - DNA, 366 bp, Zea mays
  Clone ID: LIB148-047-Q1-E1-B4
aaccagcgcctcgccaggcccgacgcgaccgacgtgcagcgcgaggtggagatcacgcggcgcatgtcggaggtgagcgggggcagggtcgcgtgcctgcgcgaggcgtgcgaggacgacgacggtgtgcacctcgtcatggagctctgcgagggcggcgagctcttcgaccgcatcttcgagcggaagcactactccgagcgcgccgccgccaagctcgcccgcaccatcgtcgaggtcgtgcagctgtgccacgagaacggagtgatgcacagggacctgaagccggagaacttcctgttcgtgaacaagtcggaggagtcacctctcaaggccatcgacttcggcctctccgtgttcttcaag

SEQ ID NO: 6208 - DNA, 356 bp, Zea mays
  Clone ID: LIB148-047-Q1-E1-B5
aatccacccacgcgtccgcttcaccttgttcttcgccttcgcggtggcatcattgaaccttccctccaggcgctcgcccgcaagtacaaccaggacaagatgatctgccgcaagtgctatgcacgcctgcaccccagggctgttaactgccgcaagaagaagtgtggccacagcaaccagctgagggcaaagaagaagatcaagaactgaagcttgccaaatcggttccttgcatggtttgcgtcaacaagacgtacaagtttcaaagcttttgtatgccataggctgctgcaacgtttttaagtcggaactcatgtgttcctgttcagggtcttcagcatgacataaatcgtttc

SEQ ID NO: 6209 - DNA, 393 bp, Zea mays
  Clone ID: LIB148-047-Q1-E1-A12
gggcgaatacggaacagtgatcttccgaggggataagcactatgtgcctagccgttctgtctccattcttgctgggtgcaagaacgtagtttacaataccaagagagtgtttgtacaacacagtgaaaggtcattccatacctcagatgtaacaagcaagaataaccagtgggagatgttctcagaaacgatcccaaagtatcgtgatactaaagtcaggacaaaggaacccctagagcaatataaccaaaccaaggacgatactgactacttatggtacaccacaagctttcgcttggagtcggacgatttgccctttagaaatgacatccggcctgtgcttcaggtcaaaagtagtgcacacgcaatgatgggatttgctaatgatgcttt

SEQ ID NO: 6210 - DNA, 385 bp, Zea mays
  Clone ID: LIB148-046-Q1-E1-G6
caagggacgtaagaagtcgtctaattcttggatcgaattagacgacttcttcgtccctctcttcattagcacgctaacttgtaatctgcaggatctaagcaaagacttgatttagttatggacggattggtaggcctcttgaaagttcgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggaggtgttcgacaaggacaccttcagcagagacgaccccatgggagacgcggaagtggacg

SEQ ID NO: 6211 - DNA, 392 bp, Zea mays
  Clone ID: LIB148-046-Q1-E1-G7
acaagcctctacagtgcgtctcatgatggttactccgcgcgccttctctttctctcccggacgtcgatcgtgttcttcagcacgggctagctagctccctccctcccagccatggcgacgccggacaacaaggggcacgggcatccgctgcccaagtttggggagtgggacgtgaagaatccggccacgtccgagggcttcaccgtcatattccagaaggcccgcgacgacaagaagaccaccaccggccctggggctgggaacgcgcgcgcaggcattccgccggccttcaggaacggcggcggcgacggcgggtacaggcccgacttcggcgacggcaaccagtacacgccgcccaaacggaagaagtgggccttctgtggctgctgaat

SEQ ID NO: 6212 - DNA, 236 bp, Zea mays
  Clone ID: LIB148-046-Q1-E1-G8
aagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaac

SEQ ID NO: 6213 - DNA, 280 bp, Zea mays
  Clone ID: LIB148-046-Q1-E1-G9
aggatagggcgatcacatcttccaataaagcaagtagctccagctttaagaagctgccgcctgttcttgtcacatgatgaatcaacgggatggttcttgtggatatttctgcttaacgtggcattagtggtggatatgaatcttactccatggttgatggggatgaaactctcatatggagtctgcagactgcaagtaatgagggtgagcatttgatggttgatgttcccaggaagcagggccagcgttgccagtttttttggcacgaaagagtaaatgg

SEQ ID NO: 6214 - DNA, 369 bp, Zea mays
  Clone ID: LIB148-046-Q1-E1-H1
tagagccactcgcacgccgaggaatcgctgcccgttgtggccgaaaacggggtgacaatggcggggaacgacggcgactcgcggctgttcgtcgacctggagcccgttccggccatcagcaagcggcacggcggcagcgtcggcggcgaccacgcggcgccgtgcgccagggctaggaccatgtccaccagcttcaaggagccgccttgtgtcgccgaacacctccctctctctggccccgtgcagctcgcggcgtccaccggcttctcctgggccaagaagccccggcccgacgccacgacggcggcggtaactgtgacgatgcggagcggctccatggggccagggaccaacaggaacaacaacagc

SEQ ID NO: 6215 - DNA, 374 bp, Zea mays
  Clone ID: LIB148-046-Q1-E1-H10
acaacccactaaactgactcttactagtaaaagctggagcttttctgagcgtgtaggtgcgttggtggaacttgggcccccagtcccccacccaagatctcacctatctgcactgggctggccggctgggcccgccgccaaccaccgtgcttccgccattgcgtcgccgcataaccttggctaagcgtgaactttgtcacaacaaccacgtttggcgtttccatgcttgtcctgggttcctggcaatccctgtattaatccgtctgccattgcattatcttgcactgactgatcttttccaaccgaaggatgtggtggtcggtagagctaaaagttaagttggacccaaaaaaagaaaagaaaaaaaaacaaaa

SEQ ID NO: 6216 - DNA, 415 bp, Zea mays
  unsure at all n locations
  Clone ID: LIB148-046-Q1-E1-H12
tgagtcgtttacctaagcagctaccaaccaaccctataaagctagacaccgtacccatggctcgcgctagcgtcgtctttgtcattgctgctctcctcttcgtcgccatggtcgtagcaccgatggccgaggcaaagtctgccgatgcccctgtggctgacgcgccggccgatggacctagcgggccggctgctgcacctggcccccagggtgtcgaaggcctgtcaggcaatgaggatgacgatgatgactccaccaactgaggccacacatgtcggcccggttaaatttggaacaagacatggaagaaaaatgagagcaatgtctttaaaaccatgaatccataataatgtgtggtcatccatggatacatccttgctctccctctttttctttnggtttgattttcaatgtg

SEQ ID NO: 6217 - DNA, 368 bp, Zea mays
  Clone ID: LIB148-046-Q1-E1-H2
ctctatagaaagtcgtagtagatcccacgaactacatggaggacagcctggtcgactgggccaggcccctcttggcgcgcgcgctgtccgaagacaacttcgacgagctgctcgacccgcggctggagaacagggtcgaccggctggagctggagcggatgtgctcctctgccgcggcggccgtccgccactcagccaagcggcggcccaagatgaaacagatcgtccgtgctctggaaggggacgcgtcgctggacgacctgaacgacggggtgaagccagggcagagcatgatgttcagctccggatcggagtacgactccggggccaactacgcggccaacatcagcaagttcaggaaggtggcc

SEQ ID NO: 6218 - DNA, 383 bp, Zea mays
  unsure at all n locations
  Clone ID: LIB148-046-Q1-E1-H3
taagcctccccgaccgccacatctattaggtgcagccatgggtgcctgtgcaacgaatcctaagacccttgaggggaaagccccagctgaggccaccatctccacacccaacgttgcacctcagaccactaccatccacattgaggttgcggcaaaacatgcagtacttgagaaggtggaggaggacaaggaggacgcactaacactggcggcgaaacaacagccagcagccaccattgagcctcagcagattgctantgaggtgaccacttcggaagtggcggtcgtcgttgtcgagcctgagaacacagaggacgacgacattgtggagaagaccgtcatcgagaacgagaacccatcagcagtccatgcataggaaaata

SEQ ID NO: 6219 - DNA, 414 bp, Zea mays
  Clone ID: LIB148-046-Q1-E1-H4
gaaccccacccacagcaaacgactggagatctactaaacctggaagcagaggtgaatccttcggctctggaactcgaacaaagcaatgcattggcactcgctattgtagcaccaggtgactacaagccgccagcatctcaaagtatgtttgatgtcaattcgtctgggtgggagctggcactggtcaatgctccaagcacccatacaagccaagcagttgagaccaacttggctggaggctttgacaagctgctacttgacagcctctacgaagacgaggccaggaggcagcagatcgccggcgcgacctacaccggtagcctaggagcagccaaccctttctgcaccaatgccagcgattcggttcacatgtccagcagatttgcacaaccggctaatgtgcagttggcactg

SEQ ID NO: 6220 - DNA, 382 bp, Zea mays
  Clone ID: LIB148-046-Q1-E1-H6
acaagactcaagactgactcggactagccgtgtggagcaagaactcctgcaccaagaagtacgactgcaagatccttcccaactcgctggtgatggacttcgtgaacaacggggaggtgtccggggtcacgctgctcaactccaagttcttccacatgaacatgtaccggtgcaaggacatgctgatcaaggacgtgaccgtgacggcgcccggggacagccccaacacggatggcatccacatgggcgactcatccgggatcaccatcaccaacaccgtcattggcgtcggcgacgactgcatctccatcggccccgggacctccaaggtgaacatcaccggcgtgacctgcggccctggccacggcatcagcatcggaag

SEQ ID NO: 6221 - DNA, 383 bp, Zea mays
  Clone ID: LIB148-046-Q1-E1-H7
cacgcctctacagtgagtcgttttagagccataaagcgtgaagttggagtaattggtgctaggcaaaggccagctgatagtgcagcaatatacacatctacttctaatggcttattcaaagtggtatcagcaccaaaggttagcccacatttggaatggaagcccacatcagtaagccccagcactgctgcacctcctggtgctccatcacctgttgatgatggaagtaaaacagaagtgtctgctttgtctaagaagctttcacatgctaatgtatcacatgaacatgtcattataccggatcacatcaggataccagattctgaaagaactcatttcatcttcggttcttttgaatctgaaatttatccaaatgcttcttt

SEQ ID NO: 6222 - DNA, 353 bp, Zea mays
  Clone ID: LIB148-046-Q1-E1-H9
gtcgtattatccgcgacgacatcaacgaacttccgctcggatgacgaagacgtgcagcgacatccacatggcggacgacgccgtcgccagcggagcggacgttcgccgcgcaggggcagcaccggcatcacgtcatctaccagggagcagcagcagcagcacgacgacgctggctgcggcggcagctaccaccacgacaaggactacatcatcatgcagacgcaggcgaggagcgggctggcgtgccagccgacgatctccgtgatgggcaagggcggacagccgtgacgctgcctgcgggcgcatcgcaacggtagacaccacgtgctgagggagatcgccctgccgtcgca

SEQ ID NO: 6223 - DNA, 354 bp, Zea mays
  Clone ID: LIB148-047-Q1-E1-A1
acccacgcgtccggctctctcttcctctcctccatctctcaacgcctgaagctcaccgcacctcccctcctcgccgcggatcccccactactccggtagaaaatggctgacgctgaggatatccagcccctcgtctgcgacaacggaactggcatggtcaaggctgggttcgccggcgacgacgctccgagggccgtcttccccagcatcgttgggcgcccgcgccacaccggtgtgatggtggggatggggcagaaggatgcctacgtcggcgacgaggcgcagtccaagaggggtatcctgaccctcaagtaccccatcgagcacggaatcgtcagcaactgggacgacatg

SEQ ID NO: 6224 - DNA, 436 bp, Zea mays
  Clone ID: LIB148-047-Q1-E1-A10
gggtcgagacacgcgtctagaataactatatttaaaacagttaagaattcatatataagagtgcatatatatatataatcctgccaagacaaaggtaatggagtcgtcacgcatgttccagccggccatcatcctgcttctcctgctcattgtgaccaccgatgtggcgcaagcggcgagggaatgcgagaaggacagcgagcgattccttggggcatgcatggcgtcggacaactgcgccaacgtgtgccgcggtgagggcttctccggcggcaggtgcagcaccttccgccgccgctgcatctgcactaagccgtgctaaattaacctactcccggcagttcgatggtggacgtttattctatttattggcttacttgattttttcccccctaacaataagaaaacgcacgtgctggcatgtacgttgtgttgt

SEQ ID NO: 6225 - DNA, 379 bp, Zea mays
  Clone ID: LIB148-046-Q1-E1-G5
ctcgcgggtcgacacacgcatccacagtcacttgggcgagcggtgcggcacgcagcctggaacaccttggatttgctgttccctatcggtcgttacccgaggcacgtgatcagcctgttcttccggctgctgtatccgtggtactggccttcctcttgctggaacttcgtgatgacctgtgccatgaccgtgtactactacatcctgaacctgctggtgtcgtgttgggagaacctgacgcggcccagtcaccggagaacgcacggtgaatgaagacgcggcagcccatccagtggcaccttgtgttgttgttgttgttcatttttctttcgtttgcgcgagtggtgtactagttagtagcagcggcttatgtgttcgt

SEQ ID NO: 6226 - DNA, 427 bp, Zea mays
  Clone ID: LIB148-047-Q1-E1-A11
ccactacactaactcgtactaaaggcctcgtgccttctcttcctccctggcatggaggaagtagctgtttcgcctatgatggttgccgccgtactgctggacaacaatggcgccgacgcggtctcctgcactgccatccctagcgtaacaataagcctagaggagaaagaaaatatcaatggggatgttcccacgatcacctcagccgcaagcaacgaggaggaggcgttgttcagtgtcggagaatccatcaaggacgatggccatcgcttgacgatggaatgcaccactcgcgtctcctccagtagcccttccactcgcaagaagcgcggggcgttcagcctcatcacggcgatgttcctgtccttcggccggagcgacgacagcatgaagaagacagacgacgacatcacgatccccaagaaga

SEQ ID NO: 6227 - DNA, 394 bp, Zea mays
  Clone ID: LIB148-046-Q1-E1-F1
cgggccgacccacgcgtctacccagactcctgctcgacggggcagctgcacgtggccgtgttcaagccggcggacgacgagcccatggccgccaacaacccgcgcggcctccccgtgtcgtccaccggcgaaggcctgaagaaagggacgcgcgtcggggagggggcgctgagggaggtcgcggcctacatcctcgaccacccacccaggagcgggaccgcggatgatgggttcgccggtgtgccgccgaccgcgctcgtccggtgcacgcacggagccttcaggcacggcggagccggatccggagccggagcgagggcgccggtgcccaagctggggtccatgcaggccttcgttagtaactgcggcagctgcgaggacatgggacccagcg

SEQ ID NO: 6228 - DNA, 433 bp, Zea mays
  Clone ID: LIB148-046-Q1-E1-F10
acaagccactagactcactcgtcttagccctgcggaccgtagagctcctggagcaagccgggttcggccccgtgaagcaggaccacagccgcgggctcgaccacggcgcctgggtgccgctgatgctcatgtacccggacgccagcatccccgtgtgccagctctcggtgcagaccgaccgcgacggcacgtaccactacaacctcggcaaggcgctggcgcccctgcgggaggaaggcatcctcatcctcggctccggtagcgccacgcacaacctgcgcaagattagcccgtccgacgcgcccgtgccgcagtgggccgccgagttcgacacctggctcaaggactcgctcctcaacggaaggtacgaggacgtgaagcggtacgaggagaaggcgccgcacgcgagggtggcgcacccgtggccggacca

SEQ ID NO: 6229 - DNA, 442 bp, Zea mays
  Clone ID: LIB148-046-Q1-E1-F11
tcgtcggtcgacacacgccactaaaatgatccgctccacctccattgaccaacaattaagcctccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaaggagttgtggagaagaccgtcatcgagaaggagaagccatcagcagtccatgcagaggaaaaatatg

SEQ ID NO: 6230 - DNA, 402 bp, Zea mays
  Clone ID: LIB148-046-Q1-E1-F3
agtcaccgagccatgacgatgacaatagccgccgtgctctgcctgctcctcttctctggccgtctcgccgcggcggagaagactttccgcggaggcggaggcggaggctacagcgggttggaggccggtggcggaggcggcggcggcggctactccaccccgagcgaggcagcgccatccacgcctgccgctggggagacgacgaccccttcgtcaggcggcggttactccacccctagcgaggcagcgccatccacgcctgccgctgaggagacgacgacgactccttcgtcaggcggcgggggttaccgcggtgcaaccggcaaggcttcctcaggcggcggcgggctggaccccgacggcgacccagaggttgggctgaacgggaaagcgatcgaagag

SEQ ID NO: 6231 - DNA, 249 bp, Zea mays
  Clone ID: LIB148-046-Q1-E1-F4
cgggccgaccacgcgtccagccacgcgtccgcccgacgcgacgattcctctcctccgcccgttcccaccgatctcacgctctctctcttcctccgtcgcgtcggcgtcgccatcgccggccatgggttgcggtggctccaaggaggccgtggccaccggcaacaccagcgccggcaccaaggtcatccggaggaagtcctcctcggtctcaaccggcgcaggcaacacctcaacaacgtcgccgtcgtc

SEQ ID NO: 6232 - DNA, 414 bp, Zea mays
  Clone ID: LIB148-046-Q1-E1-F5
acacgcctctacacagacgttctgactacgcgtccggttttgacagaaacagccgtagataccagtagatcctgcaaaagcctagcagtagagcttcctgtaccctaattttcagccaccacgacggttttaggtccaatttgtgaaggtctcaagaattcccggatgtatggttttctgaaagccaatggcccaaggaaacgttgccactttatttccttcgacggagctttcacgtgatcatacggcttttgggtagtcatctgattgtcttcgtcgaacttgttgtacccagaggtctgagccctagaccctcgattcattagagaacccgtgatctggtcattgtccaagctactttgttctgattgcaggaaatctttaggtgccaaaagcaactgtacattttttttt

SEQ ID NO: 6233 - DNA, 412 bp, Zea mays
  Clone ID: LIB148-046-Q1-E1-F6
ctcgcgggccgacccacgcgtcaactggatctcaagccaggcgctcagttccgcgagaagctgttcctgaacatcagcaagccgttcatcacgttccggtcggaccccaagaagcccgccgtcgtggtctggaacgacactgcggccacgaacggcaaggacggcaagccggtgggcacggtggggagcgccacgctggcggtggagtcggactacttcacggcgtacggcgtggtgttccggaacgacgcgccgctggccaagcccggcgccaagggcggccaggcggtggcggtgcggctgttcgggaccaagacgcagatctacaactgcaccatcgacggcggacaggacacgctgtacgaccacaagggcctgcactacttcaagggctgcctcatccggggcagcg

SEQ ID NO: 6234 - DNA, 201 bp, Zea mays
  Clone ID: LIB148-046-Q1-E1-F8
ctcgcgggccgatacacgcatctaggatgagtacgtacacctgcaccatcaaagacgagcggtcagtcccaggtccgggtagacgccccaagcagcagcacttacaatggatgggatgtgcccgggacaagctccagtcaaagttcaacgaaaccccaacaaacccaaaccaaccctccaatcctgaatccacaaggagca

SEQ ID NO: 6235 - DNA, 386 bp, Zea mays
  unsure at all n locations
  Clone ID: LIB148-046-Q1-E1-F9
gcaagcgatcgtcggagcagagagagacttcctcgcctccatcccatcccgccgccgccgtctctacggtcgctaataagccgccgcatccagggatggagatgaagaagatcgcctgcgccgtcctcgtcgccgcctcggccaccgtggcgctggccgcggaggcgccggctccgtcccccaccagcggctcctccgcggtcgcacccgccatcgtcggggccgccgtggcctccttcttcgcgtactacattcactgagccgccggacgaggagccggactgccggagggaagagaacaagggggggagagacttggctgcgctgcgctgctctgctgctcncgcgcattcccgatgcgtgggtgggtgtgctctgattgggca

SEQ ID NO: 6236 - DNA, 393 bp, Zea mays
  Clone ID: LIB148-046-Q1-E1-G1
gggtcgacccaagcctctacacagactcctgataggcaacacggacgcggcggaactcttggcggagcacggcgtgcagtcggcgcgcgccatcagccccggcggcggcggcgggggcggcaacaagcaggcgcgcgagctgaagcagcaggtgagcgacatcaagcacgaggtgcactcgcagctggagcagacgcggcagacgcgcgtgcgcatgcagggcatcgccaagcgcatcaacaagctgcacgaggaagggctcaacaacgccatcaactccacgacggtggtggccgtgctgatcgccacggtggcgttcgcggccatcttcacggtgcccggggagtacgtgcaggacccgggcagcctggcgcccgggcacgatctgggcga

SEQ ID NO: 6237 - DNA, 422 bp, Zea mays
  unsure at all n locations
  Clone ID: LIB148-046-Q1-E1-G10
atctgagtacgtactaatccttacagatacagagcagctgtactgatggacgagggcaaggaggaggaggcgatcgcggagctgtcaggagccatagctttcaagccggacctccagctgctccacctccgcgcggcgttcttcgactccatgggcgagcgcgagagcgccctgcgggactgcgaggccgcgctctgcctggacccgacccacgccgacacattggagctgtacagcaaagcctccaccaccaaggccgaaccccagagctaggcagccagccggccggcaggccgccgctctcctcgtcgtcgattcagctgcggtttttgcgaggcangatgatgagacgatctcttctctactctcatggggtggaagctgcagatcagtgaggcangagcaccggaacatgcacatat

SEQ ID NO: 6238 - DNA, 444 bp, Zea mays
  Clone ID: LIB148-046-Q1-E1-G11
tcgccggtcgacacacgcctccaaaccaactccatccatgcgcctctcgctctcgctggtggtgctcctcctcctccacctgctcccggggcgggcggcctccttttccacctcctgctggtgccagggccgggagggcgtcgcggaggtggcgcgcatggggctcgccggggacgggtcggcggacaccgcccacctcagtaataatgaaaatgggcggttcatttatggagttgcgagttctcctggtaaaagagcatcgatggaggacttctatgaggcaagaatagacgacgttgatggagagaaaattggaatgttcggtgtatatgatggtcatggaggagtccgagcagctgagtatgttaagcagcaccttttcagcaatttaatcaaacacccaaagttcatcactgataccaaggctgctatcgccgaaactta

SEQ ID NO: 6239 - DNA, 403 bp, Zea mays
  Clone ID: LIB148-046-Q1-E1-G2
gggccgacccacgcgtctacccacacgtccgctaacgcgtccggtccggggacgacatttggcggcatcaaccacacagcacaggcacagcgcagcaccatgacgatggagggggcggtttccgacaacaccaagggcctggcgctcgccgtcgcctccagcgccttcatcggcgccagcttcatcctcaagaagatcggcctcctgcgagcagccaagtgcggcgaccgcgcacgtggcggaggacacacttacctctccgagcctctatggtgggcgggaatgaccacaatgctgcttgatgaggtcgcaaacttcattgcttacatatttgcgccggctgtactcgtgactccacttggggcgttaagcataatcgtaagttcagtgttggcgcactttg

SEQ ID NO: 6240 - DNA, 389 bp, Zea mays
  Clone ID: LIB148-046-Q1-E1-G3
taccgatgctacagcacacgtggcagcagcttgccatggcgctgccggccccctccgccccgccgcaggtcaccgcaagacggcgctgcggagtgcctggggtgcgcacgggttgttttggcgaccccgagatgaagcggccagcgcgggtggcgggctacaatgcgtacgcggtggggggcaatgtgaaggcgtccctccgccggggcctcaggtggttcaagcgcaaatgctcacgcatcttgaatatctgaccaccgtgcgagtgcgcgcggcggcgttctcccactcgtcatggatcgcaaggccgctcttttaccgcaacaattatggcatgcactctgcggtgcattgccaatttatgcattgatcaagaactcgcgtgattg

SEQ ID NO: 6241 - DNA, 236 bp, Zea mays
  Clone ID: LIB148-046-Q1-E1-D12
tacaacacactagagtgagtcgtactactgcgcgcatctctctacacttctactgcttcatactctcgtagagagatccccgcggcccaataaaaacccgactcgctagctgcactacacactcgcagatggccggcctcaggatgaagttcgtcgccgtcgccgccatggccgccgcgctcgtggcgtccgccgcagccgccgaggcccccgccccggcccccgcctccgacgcc

SEQ ID NO: 6242 - DNA, 374 bp, Zea mays
  Clone ID: LIB148-046-Q1-E1-D2
tcgagagatccgccgattccgatgcatctgcgtatttcgacaaggaagagcagaaatccggcgattctgacgccgccacgtctgttgagaagcagaagaagcagaagaaggagaaatccggtgattatttcgacaaggaaaaggaggagaaccccgaggaggacgctgcgcccgtcgacgtctccgcggacggcgtgtatgtgcctcccaaggaggagaaatccggcgaagacgccacgccggtcgacgtctccaccaccaccggcaaatacgtatcttcttcttccaaggcaaacggcaagcccacgggaggtcagcccgcagagagctccaccaccgccaccgccaccgcggatgcgtacgcgtctcaaagc

SEQ ID NO: 6243 - DNA, 411 bp, Zea mays
  Clone ID: LIB148-046-Q1-E1-D3
agctacctcgaaatggaggcgacgagcaaggcgatggcttcaggcctcctcgttctgctgcttctcatcaacacaggctttgtcctgcccgtccattccgaggactgctgggccgacacccgcgtcatctgcaccaagacgcacaactgccgggacgacacttgcgcggggcgcggcatgccggacggccgctgccactgggagttccccaacctggtgcccttctgccagtgcctgcgccccaactgccactagtccgggcgcctcggattggctcacttcgccggcgatgatggatggtgcccaactgcgactgcccagtctgctccattcgttgttgtttaaggcataatatataaactgccaaattcacatgtattttgggatatttgttatcatactatgaaatga

SEQ ID NO: 6244 - DNA, 405 bp, Zea mays
  unsure at all n locations
  Clone ID: LIB148-046-Q1-E1-D4
taccatgacgtctgctaacgcgtccgcctctctcccttcgtcaccatcacatccagccagccaacaaaaatgtcgcgcgtcacagctgcggtgctcttctacatcctcgccgttgctgccctcagcgcggccgaggccccggcagagtcaccgaaggaaggcagtgctgccaaggcacctgagtctgccaagagaactgctgcccccgctgaagcacccgaagccgcatccacccccgtcgccgccgctgccccatcgccgtcgtctaggaagtctggtccagctaccgcgccagccaccgcctctacacccccttcttccacggacgaggagttgagcccttccccgccagcatccaccgccgcggcgtcncctgcggctgagggaccggctgctgatgactcg

SEQ ID NO: 6245 - DNA, 394 bp, Zea mays
  Clone ID: LIB148-046-Q1-E1-D6
ctcgcgggtcgacacacgcatctaaagcgattctgaacagctccgctagctaaagcagggcaaggcggccggaaggcaggaaatccgtacgcacgccgaggtcgaggtcgaggtctcagcagggaggatggaaacggagcagcagggcgtggttgcgggggtgaagccgacgctggccaaggggacgccgtcggcgtcgttccggctccgcaacgggagcctaaacgcggtgcgcctccgccgcgtgttcgacctgttcgaccgcaacggggacggcgagatcacggtggacgagctggcgcaggcgctggacgcgctgggcctcgacgcggaccgcggcgggctggccgccaccgttggcacctacgtgcccgacggcgccgcgggcctccgc

SEQ ID NO: 6246 - DNA, 409 bp, Zea mays
  Clone ID: LIB148-046-Q1-E1-D7
acaagcctctattctgagtcgtgtcacggagcccagggagcggaggcgggcgggccggcgggcggccatggacgtggactgcgtctcgctgcccgacgccccggcgggcgacgtggatggcggcgccgcccggccgtggcccaaggccgtgaccaacggcggcgtccacgagctgctggagtgccccgtgtgcaccaactccatgttcccgccgatccaccagtgccccaatggacacacgctgtgttccacatgcaaggccagagtacacaaccgttgccctacctgcaggcaagagctgggcgacatcaggtgcctggcgctggagaaagtcgccgagtcgctggagctcccctgcaggtactactcgctggggtgccccgagatcatgccttactacagcaagata

SEQ ID NO: 6247 - DNA, 400 bp, Zea mays
  Clone ID: LIB148-046-Q1-E1-D8
acaagcctcaagtatgagtctttataaataaacagggttccatggtctctctcactcaaagaacagtgatttgaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgcttgccatgcatcgaca

SEQ ID NO: 6248 - DNA, 412 bp, Zea mays
  Clone ID: LIB148-046-Q1-E1-D9
gattcgccacagctcgttatcctcctcttgcattgcattgcaggtcgtagttgagcagcagcaaccactgcacaggatgtcgtggcagacgtacgtcgatgagcacctcatgtgcgagatcgagggccaccacctgagctctgccgccatagtcggccacgacggcgccgtttgggcccagagcaccgcattcccacagttcaagccagaggagatgaccaacatcattaaggacttcgacgagcctgggtttctggccccgatcggcctcttccttggccccaccaagtacatggtcatccaaggcgagcccggcgctgtcatccgcgggaagaagggatctggaggcataactgtgaagaagaccggacaggcgctggtgatcggcatctacgacgagcccatgacccct

SEQ ID NO: 6249 - DNA, 404 bp, Zea mays
  Clone ID: LIB148-046-Q1-E1-E1
aagactctacacagagtcgcactatttctccttcccccttcaggctccccgatccgacgaccccagcggcggcgatgggcggcaaggacctgacagaggagcagatcgcctcgatgcgggaggccttcacgctgttcgacacggacggggacggccgcatcgctcccacggagctgggcgtcctcatgcgctccctcggcgggaacccaacccaggcgcagctccgggacatcgccgcgcaggagaagctcacggcgcccttcgacttcgcacgcttcctcggcctcatgcgcgcccacctcaggcccgatcccttcgaccgcccgctccgcgacgccttccgcgtcctcgacaaggacggctccggcaccgtcgccgtcgccgacctccgccacgtcctcacg

SEQ ID NO: 6250 - DNA, 357 bp, Zea mays
  unsure at all n locations
  Clone ID: LIB148-046-Q1-E1-E10
aggaagctggagcccatggccccggacagaaaggggaggtggaagagagaagtgggctggcttctgtccgtcgctgaccacatcgtcgagttcgtcgccaagaaacaagtcctggacaacggcaccgaaatggaggtgatgggcacgcagcagagacgggatctccaggccaacattccagcattgcgtaaactggacacgatgcttctcgactacctggataacttcaaggaacgcaacgagttctggtacgtgaagcgcgactcgtgctcagagagcgagaacgaggagaggtccgacgagaaatggtggatcccgatcgtcaanggtgcccccggcgggctttccaagaactct

SEQ ID NO: 6251 - DNA, 343 bp, Zea mays
  unsure at all n locations
  Clone ID: LIB148-046-Q1-E1-E11
aaaaagaacttccagacctcttcagtacttatacactcattggttagggctctcatgccatagtctaatttggagtactaaagcattgcacgaggcctgcacatcagaatcctgacgcaatgagacacactgattcctcattccctgtggaggtttcagtgtccgcaagatcaacttcatacgatcttgtaaaggtcatctgatcatccanctgaatggaaatccgcttccgatgcctatgagtatgcaactaagggatcattgcattatatcttcaaattctaaacatggtgtcacctgatcatcaccagcgccagatcactgtcaacgggtacaggccaca

SEQ ID NO: 6252 - DNA, 302 bp, Zea mays
  Clone ID: LIB148-046-Q1-E1-E2
acgcgtctacggagactcgcgcgatgacggggctgtacgacatgctcaagactacgtgggcccgggagaacggcagcgtcggcacggagcagcgcaagatcctggtcggccccatccccggcggcgtcagcccgtccgtcagcgacggggacgacctcgccacggtcaggatgcaggccgacggcatcctctccctcgccgagaacccgaactacgcccacctccgggacatcaccgcgcaggagacgctcagagagcgcttcgacatcccacgcgtcccggcctcatgcacgtccacctca

SEQ ID NO: 6253 - DNA, 292 bp, Zea mays
  Clone ID: LIB148-046-Q1-E1-E3
agcacgcctacggccttatccgcgacgtcgacaggtacgtgcgttcgcatcctccctgggatgtacgaaatagcattttctcctaggatcgtatccgccatagtgctggaaaagacttgcgcttacgcggtcgcctgcactaccatcacgaccgtatgaataagcatacaggagaaaggatgtatcaattgggatgttcgcacgatgatctcggccacaagcaacgaggaggaggcgttgttcagtgtcagttaatccaccaatgactatggatatcacatgacgatgggat

SEQ ID NO: 6254 - DNA, 381 bp, Zea mays
  Clone ID: LIB148-046-Q1-E1-E6
cttcggtacgtgcattgcttcggtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctc

SEQ ID NO: 6255 - DNA, 68 bp, Zea mays
  Clone ID: LIB148-046-Q1-E1-E7
tctcgttgtctgatacacgcctctagctccattcgtattaatttaaggttatttaaatgtttgcatgc

SEQ ID NO: 6256 - DNA, 421 bp, Zea mays
  Clone ID: LIB148-046-Q1-E1-E8
acacacgcgtctacccacacgtctgcccacgcgtccgaaccaaccctagaaagctagacaccgtacccatggctcgcgctagcgtcgtctttgtcattgccgctctcctcttcgtcgccatggtcgtagcaccgatggccgaggcaaagtccgccgatgcccctgtggctgacgcgccagccgatggacctagcgggccggctgctgcacctggcccccagggtgtcgaaggcctgtcaggcaatgaggatgacgatgatgactccaccaattgaggccacacacgtcggcccggttaaatttggaacaagacatggaagaaaaatgagagcaatgtctttaaaaccatgataatgtgtggtcatccactcatccatggatacatccttgctctccctctttttccttccggtttgaattt

SEQ ID NO: 6257 - DNA, 408 bp, Zea mays
  Clone ID: LIB148-046-Q1-E1-D10
tctggtcgaaaatttcgaggctaaggtcgcggatttcggacttgccaagctgaccacagacaccaacacgcacgtctccacgcgtgtcatgggaactttcgggtatttggccccggagtacgcgtcgagcggcaagctcaccgacaagtcggacgtgttctccttcggcgtcatgctcctggagctcatcaccggcaggagaccggttgatcccacgaactacatggaggacagcctggtcgactgggccagacccctcttggcgcgcgcgctgtccgaagacaacttcgacgagctgctcgacccgcggctggagaacagggtcgaccggctggagctggagcggatgtgctcctctgccgcggcggccgtccgccactcagccaagcggcggcccaagatgaaaca

SEQ ID NO: 6258 - DNA, 385 bp, Zea mays
  Clone ID: LIB148-046-Q1-E1-B4
tgggatccctcgctaataacatcatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaagtgagatgcaaggaaaaacctgagtgctcgggcaatccagtcacggtgtacatcactgacatgaactacgagcctatcgctccctaaca

SEQ ID NO: 6259 - DNA, 128 bp, Zea mays
  Clone ID: LIB148-046-Q1-E1-B5
agcctgcatctgaaccaattgactaacatgcatatattatatactaggtatatgcccgtgcattgcaacggaaaacacttgtgtatacacaggtcattttttagtaatgctatcaagaatcaactcat

SEQ ID NO: 6260 - DNA, 133 bp, Zea mays
  Clone ID: LIB148-046-Q1-E1-B6
tacaacactctatagtgacgtcgtattaacgcgtccggttttctgccggtctgtcggcagccgctttctcctattcatcaagactgtaatgtctattgttgctacctaatgcttctcacttgtcattttggac

SEQ ID NO: 6261 - DNA, 388 bp, Zea mays
  Clone ID: LIB148-046-Q1-E1-B7
tcgcgggccgatacacgcctctatacgtcgtcgtagcacctcgtggacggtatgcgcccgctccgcctccgcgggcagctggagtactacccgccgccaccgccgccaccgccgctgggccacgccgatgtgtaccatgacgtgatcctcccgccgccgtcgcaggcacggttcggcttcgagatcaaggaggtgggcatgaccagccgctacgcgtccgctgaggatctgcaccagatggacagcgaccaggaagagggtgctgagggtggcgatgacggtgacagcagttgcccacacgccatcgacatgcaggcggaggagttcatcaccaagttctatgagcagttcaagtcagaatcgttcaacggccgtgcctccgagtgat

SEQ ID NO: 6262 - DNA, 415 bp, Zea mays
  unsure at all n locations
  Clone ID: LIB148-046-Q1-E1-B8
acaacactctatagtgatgtcgtattataagtgcatgaatccaaattataccgagtttaaattcccgcaaatcaaagctcacccatggcataagatattccataaaaggatgcctgctgaagcggtagatctcgtgtccaggcttctgcagtactcaccaaaacttcggtcgactgctttggaagcattggtccatccgttctttgatgaacttcgggatccaaacacccgcttaccgaatggtcgttttcttccgcctctcttcaattttaagccccatgagctgaagaacgtgccggcggatttcatggtgaaattggtcnctgagcatgcacggaagcaatgtgccttcgtagggtggtgatctctggataagaggatgacgactcgatgattagctgaggaccaagttaat

SEQ ID NO: 6263 - DNA, 439 bp, Zea mays
  Clone ID: LIB148-046-Q1-E1-B9
atacaacccactagaatgagtcgaacaacggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcaccc

SEQ ID NO: 6264 - DNA, 389 bp, Zea mays
  Clone ID: LIB148-046-Q1-E1-C1
gggtcggaccacgcgtctactaactatcagtgcatgtgctcatccgtgcacgccggcaatggtgtcctccgcccgtgcgctcatcggcctcctcgtcgccgcggcctccctcgccgtcgcgctctcggatggcggcgggatggcggcgccggtgtacgggtacgcggcggggagccccaacgggccggagaactgggggaagctgagccccgcgtacaagctgtgcggggaggggaagcagcagtcgccgatcgacatcgtcaccaagcaggccgtccccgccgccaccctcgacaccctcaaccgcacctacggcgccaccaacgccacgctcatcaacgacggccacgacatcacgctggcgctccaaggcaatgttgggaccgtga

SEQ ID NO: 6265 - DNA, 113 bp, Zea mays
  unsure at all n locations
  Clone ID: LIB148-046-Q1-E1-C10
tgagtcgtattaaaccggnacggatgcttctacgtgccggttcacctctctcgtttgatcggcgcttcggctcgggactggcgcttgtgaccgagtgatctgggatggcattt

SEQ ID NO: 6266 - DNA, 430 bp, Zea mays
  Clone ID: LIB148-046-Q1-E1-C11
tacaactcactagagtgagtcgtagtagatccatcttgctaataagcctgcgtgcccttcgttcttcctcgtctcgatcccgacgacgctccgttcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggaggatcggagggagaggctgctggctgccattgcctgtattcggttggattccgtttatatatatatttaagtactttaatttgggtctgaacatgtcgattgatccattcattttatttg

SEQ ID NO: 6267 - DNA, 414 bp, Zea mays
  Clone ID: LIB148-046-Q1-E1-C2
gtgggtcgacccaagcctctacacagactcgtgctaacgcgtccgggcaaggatgtcggacgcgaagctaggaccaggctgccggagtcgccctgatctagcttctcaggaactccgaatgccctggatcctagccaatcatcctccttcccctttgaatggttgctagcttctcaagaactccgaatgctctggatcctagccaatcgtcctccttcccctttgaatggttgctagcttctaaggaacttcccattaataaattgatgattattttgtcattggtgataagtcacaggaaactaaccaaaacagaaacaactgattttcccctaattttgtgtttcatgcacagttttttaaatctacggtggatgtttcctggtaaaagtattgtgttccttgacaataatg

SEQ ID NO: 6268 - DNA, 397 bp, Zea mays
  Clone ID: LIB148-046-Q1-E1-C4
ctctagccagcctcgcattaacgaagatggcgttcatcagcaatgtcgcagtgaaggcggcggccgtggccgcgctgctgctggtcgcagcggtgtcgcctgccgcgcgcgcggcggcggtggcggtggcgggaggggcgccgtcggtgccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggcaccggcgacctcagcgcgtaccaaaggaactg

SEQ ID NO: 6269 - DNA, 391 bp, Zea mays
  Clone ID: LIB148-046-Q1-E1-C5
acaagcctctagtgtgagtcgtactcatcgcgtcggtcccgcgatgggcctgttctcatcggccgctaagagatgtagaaagtgcaagaagttcctccgcagcgcgggcgcgtgctgctgctcgccgtcggcctcctccgcccctgctggtggtgtgcgcggcaacgaagaggcgtcgacgtcggcgctggcttccgcgccagatggcaagaaaaagaagaggtggaggaagagaaagttctggagaaagaagaagaaggccaagaaggagagcgacgatggcagcggcgagctcgtggatctcgtcaacagcttctcggccaagtccgacgtgtgcaagaacgtgaatgcggccgaggagattctacggggctgcaaccagaacatgccc

SEQ ID NO: 6270 - DNA, 381 bp, Zea mays
  Clone ID: LIB148-046-Q1-E1-C6
tacaagcctctagactgagtcttcgtagacaataatggcgcctctcctggcgtcgatgctgctcgtcgggctcgccgtgggctccgaggaggaggaggacggcggcggcaaaaagaagccccacgtcaaccacggcaagtttaaggcggagccgtggacggacgggcacgcgacgtactacggcgggcgcgacgggttaactgacaccacggacggcggcgcgtgcggctacaagggcgagctggggaaagactacggcaccctgacggcggccgtgggcccgtcgctgtacaccaacggcaccgggtgcggcgcgtgctatgagctcaagggccccaagggcaccgtggtggtgacggccaccaacgaggccccgccgcc

SEQ ID NO: 6271 - DNA, 394 bp, Zea mays
  Clone ID: LIB148-046-Q1-E1-C7
tacacgcctcaacacagattcggaaaaactgtttcaaatctgtgacataatgatttagggagatagctcacaccttttacaccatgccaacctttaacagtactttgcatatacattttttaatttgccaacccgacgctaattaaatctgtccacaacaatgtgacctgggacgacattagatcgagcaacaaggtcaattgatctagtttcactcggacacgactaattcatcgccatcgcaaccacttgtacgggtattatgtatggaagaagagcgtgaataaaacactgacgaggatcagctcgagtgcttcactgaacaagccactacttgagcccagtgcctgagccttgtcttcacaagcagagggttatctcctgggttgcaaat

SEQ ID NO: 6272 - DNA, 374 bp, Zea mays
  Clone ID: LIB148-046-Q1-E1-C8
atacacgcctcaacaccgagccatgacaatgacaatagccgccgtgctctgcctgctcctcttctctggccgtctcgccgcggcggagaagactttccgcggaggcggaggcggaggctacggcgggttggaggccggtggcggaggcggcggcggcggctactccaccccgagcgaggcagcgccatccacgcctgccgctggggagacgacgaccccttcgtcaggcggcggttactccacccctagcgaggcagcgccatccacgcctgccgctgaggagacgacgacgactccttcgtcaggcggcgggggttacggcggtgcaaccggcaaggcttcctcaagcggcggcgggctggaccccgacggcg

SEQ ID NO: 6273 - DNA, 398 bp, Zea mays
  Clone ID: LIB148-046-Q1-E1-C9
ggccgacacacgccaccaaagaaaggcgcctgagaacaagacggatgctgctaattgacgtttcagctcgtttgtttgttcgtcccttcggtttggcactgatgcttatgacccattggtctgccattgcaattgaaatgtggttggaacgtgcttgatcgggaactaacatgaaatgagtgaagggtagatgctgatctgaaaaatatgtgtgttcccccctctttccttccatgtcgtgttgttgcaggtaaccgtcacaatatatataggtggccccctttggaatccggggattattccgtttgctgtatttttttctgtgaaaatgaactgattcctgtcaattttctatatgatttatgattcatctgaaattcctgagaccgatgttgaat

SEQ ID NO: 6274 - DNA, 282 bp, Zea mays
  Clone ID: LIB148-046-Q1-E1-B3
ctctccgcgccggcggagactgcgaaggccaaccactcccagccgccgaataactcggtggaagagcgacggattcagattgctcgttttaatgccctgaagcagcggcagctcctcaagcaccggcgggatcgggagctcgccgtcgccacggcggcggcgtggggcaccagtgttgctgggtctcatcgtgccgctgccgccgccgccggcgggtacggtgcgccggcgccggcgcccgcgccacgtgtcctgagctcgtacgcgtggcccccgctacag

SEQ ID NO: 6275 - DNA, 422 bp, Zea mays
  Clone ID: LIB148-046-Q1-E1-D1
caagcctctatatagagtcttattattttttttggagcaagcaagcagataaaataatgaaatactcgtcacatatgccatggctggcatatcaagcggtgcaggtgaaacaaagtctttgtggtagcatacagcatgctacgcacgaaggtactactacataccgcataacttgagcgaatacaacaagcaaaccataggcaagccccggaatgaaaggaaacaagggtacaaatgtggcggcccaaaccacccttactcgtcttggatggcctcctcgtcctcatattccgcctcctcatcagcagtggcatcctggtactgctggtactcggacaccagatcgttcatgttgctctcagcttcggtgaactccatctcatccatgccctcagcagtgtatcaatgcaagaaaacctttc

SEQ ID NO: 6276 - DNA, 432 bp, Zea mays
  Clone ID: LIB148-045-Q1-E1-H7
cgcgggctgacacacgcgtcaagccgcactccctctacgcctcaaggctctcctctcggaggtctgataggcaacccaataatggcagaagtcctatcaggatctcatgaacaccgtctaagctctgccttagatggacactacgacgagaagaggaaatccaatgtggaatacacagaggacgagaagaaagccgtgatcgcggctctgaaaaagaaggctttgagcgcctcacagaagtttaggcattccatgaagagggggaggaagagcagcaaggtgatgtccatctcgattctggatgagcgtgaacctgaggaggtgcaggctgtggatgccttccgccagcttcttgtacttgaagagctgctaccatcgcagcatgatgacgtacacatgatgcaaagatttctcaaggcaagaaagtttgat

SEQ ID NO: 6277 - DNA, 294 bp, Zea mays
  Clone ID: LIB148-045-Q1-E1-H9
cgtattaaatctgcacctctagcactcgactggggatctactaaacctgcaagcagacgtgaatccttcggatctggtactcgaataatgcagtgcattgggactcgatgttgtagcagcagttgaccacaagccgcgagcatctcacagtatgtttgatgtcaattcgtcagggtgggagctggcactgggcactgctccaagcactcaaattatccaggcagttgagacaagattggctggaggctttgacgagctgctaattaacaggatctacaaagactaggccagtag

SEQ ID NO: 6278 - DNA, 431 bp, Zea mays
  Clone ID: LIB148-046-Q1-E1-A10
tacaacactctagagtgagtcatgctaatcacatggttgggaagctggcattagtctcccggagttagcttagctgtggggtagtgccgagaattgtcttggaagcacttcctgctgtttttactattcgaaaagaagcaaaaggcaaaagctatcgatataatagtgagtgaatgcagttaatagggataagggctatgacggtattgtgctcgagtcctggtcaagatgggctatttatggtgtgctggatgaccaagagctacgttacatggcacttgaatttgttaagcagctgggagaggttttgcattcagtcaattccaaaatcaagtagccaccatttggaattaatttatgttattccagctccaagaatgcaaaagctcaataataaggactttggacccaaagatctcatgcatctggct

SEQ ID NO: 6279 - DNA, 439 bp, Zea mays
  Clone ID: LIB148-046-Q1-E1-A11
gttacaactcactagactgagtcgtattacaggaggcgagggtgcaaggtggcgccggagcccaaggagctggaggaggggaccgccgcgctcccgtcgatgcccggctcgccgagcttcaggtactactgccagaagaagacggcggccgtcgataggatcgtggctgatgccatcgacgccgatgacaccgtcaggatcagagcgacggcgcgacagctgagcaataggagcgaaatcacggcaaacaaggcacaggactccaacgaggtctctcaacctaaaggggggaccaaatggcttaggttcagtggcttgtcgatcgtcgctgccgcttggcacaagcacaacttgttcagccgccaaagaagcaagccttcgccgcctcctgctgccgcttcagatgcaagctcccaaacctgattaggcagcgctatat

SEQ ID NO: 6280 - DNA, 241 bp, Zea mays
  Clone ID: LIB148-046-Q1-E1-A2
tccagctttaagaagctgccgcctgttcttgtcacatgatgaatcaacgggatggttcttgtggatatttctgcttaacgtggcattagtggtggatatgaatcttactccatggttgatggggatgaaactctcatatggagtctgcagactgcaagtaatgagggtgagcatttgatggttgatgttcccaggaagcagggccagcgttgccagtttttttggcacgaaagagtaaatg

SEQ ID NO: 6281 - DNA, 357 bp, Zea mays
  Clone ID: LIB148-046-Q1-E1-A3
cggtcgcccggaaaaccaaccgtctccgttccgttcaccttgcaagcatatccacggcgatggaggcgaaagcggccatgacctggtactgcggctcccttctggccgtggccatcgcgctgttcctgtccgtgtccctcggcgtgcgcgccgccggcgccggcgccggcgttgacatcaaggtgtcgtgtgcagcgacgccggacccggacgtgtgcctgcgcgcgctccaggcggacagcgactccaagaccccgcgggacctggcggaggcggcgctccgcgcggcgacgaccgcgggcggcgcggccggcgactacgcccggcacgagatggacgtggttaaggacaacgaca

SEQ ID NO: 6282 - DNA, 405 bp, Zea mays
  Clone ID: LIB148-046-Q1-E1-A4
gacccacgcctctagcgagagtcctgttatcatcggccgctaagagatgtagaaagtgcaagaagttcctccgcagcgcgggcgcgtgctgctgctcgccgtcggcctcctccgcccctgctggtggtgtgcgcggcaacgaagaggcgtcgacgtcggcgctggcttccgcgccagatggcaagaaaaagaagaggtggaggaagagaaagttctggagaaagaagaagaaggccaagaaggagagcgacgatggcagcggcgagctcgtggatctcgtcaacagcttctcggccaagtccgacgtgtgcaagaacgtgaatgcggccgaggagatcctacggggctgcaaccagaacatgcccagcagggcgctgacgttcagccagctgggcgccgcgaacg

SEQ ID NO: 6283 - DNA, 398 bp, Zea mays
  Clone ID: LIB148-046-Q1-E1-A5
gccggccgatgcacgaatctacagtgacgtcgtactatcgcgtccgcggacgcgtgggttccagaccaacctggtgccctaccctaggatccacttcatgctttcgtcctacgctccagtcatttctgctgagaaggcctaccacgagcagctgtccgtggccgaaatcaccaacagcgccttcgagccatcctccatgatggccaagtgcgacccccgccatggcaagtacatggcatgctgcctcatgtaccgtggtgatgtggttcccaaggacgtgaacgctgctgtggccacaatcaagaccaagcgcaccatccagttcgtggactggtgcccgactggcttcaagtgccgaatcaactaccagcctcccaacgtcgtccccgggcggtgac

SEQ ID NO: 6284 - DNA, 362 bp, Zea mays
  Clone ID: LIB148-046-Q1-E1-A6
acaagcaactagaataaggccatgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctgaacatcagcaagccgttcatcacgttccggtcggaccccaagaagcccgccgtcgtggtctggaacgacactgcggccacgaacggcaaggacggcaagccggtgggcacggtggggagcgccacgctggcggtggagtcggactacttcacggcgtacggcgtggtgttccggaacgacgcgccgctggccaagcccggcgc

SEQ ID NO: 6285 - DNA, 364 bp, Zea mays
  Clone ID: LIB148-046-Q1-E1-A7
tcaagactgagtcgtatcaccctcgtggcgttgttgtctgccggcctcttcccgcaggcgttagggaacggcaagggcaaggtgcatggcggcggtgccgtcaacccgctggttgccggcatctgctctcgcgccccattcccagaggtttgcacggccacagccgggcgccatgcatccaagtacccggtcatcgacaatttggccgtgctgaacatgcacgtggccgcgttcgccaagcgcacagcgcaggcgcggaagcacgtcgcggtggcggcccgcactattccaccgccgcaggcacaggccctcaggacctgcgacacgatgtacatgaacacgcaggacgccatcggcgcggcgc

SEQ ID NO: 6286 - DNA, 394 bp, Zea mays
  Clone ID: LIB148-046-Q1-E1-A8
acaagcctctagactgagtcctcctactcgcggcggtgctccctccctcttcgtcccccagcgacgcaggcaggcgcgcgcgcggccatgaaggggggcggtgccatgaggccgtcgcctatgttctacgtccacgaggcggacgtcgtccagatccaccacttcctcgaggagtgctccctctgcgccaaatcgctctccggcgacatcttcatgtacaggggtgacacgccgttctgcagcgaggagtgcagggagcagcagatcgaggtggacagggcgaagcaccggcggaagaagcgcgcggcggcgcacgcgctgtccgcacgcagcagggagcaccggcaccagcagcagctgcagcagcaccaccaccagcagcagcaaccgcagc

SEQ ID NO: 6287 - DNA, 248 bp, Zea mays
  unsure at all n locations
  Clone ID: LIB148-046-Q1-E1-B10
agtcgtattaaacncgcgcacttggcgctggccctcgatatcggggagtgcatgtcgttcctcgtcaccgccgaccagaagcccggcgacgacgtgctgggggtgtccaccctgttcatcaaggtcgtgaacagcatcagggccgtgatctgctacgggggctccgacaccgcgccgctggccaacgtggcggccagtcgcatcgggtgggcgtcgtccatgcaagcactgcaggtccttccgctgga

SEQ ID NO: 6288 - DNA, 416 bp, Zea mays
  Clone ID: LIB148-046-Q1-E1-B11
agaccagtcggatcaccgtgagagtccccacccacaccccgagggcggcgtcgggtcgtcggggacagctgatttcacacgacgagccggcgagccggccggcatttcgtcgtcggatggcgccggcctcctcctcgtccgccggcgtcgcgtgcctcgtcctgctcctgctcctgctcctcgccggcgcctccgcggcgcacggctcgttccaggctaggcgtgctctgtcagatgaccatgggagcggtatagtggcgcgatggcggaggttgctcgccgacgctgcgactccagcgaacaactctcttgtgctggctgcggcgaggactcaccggagcgaccccttcgccaaccttaccgcgtacagcggcggctggaacattagcgacgagcactactgggcttccgtgacg

SEQ ID NO: 6289 - DNA, 210 bp, Zea mays
  Clone ID: LIB148-046-Q1-E1-B12
ttgcaactccctgacgtgagtcgtattaaaaaaaaaaaaaaaaaaaaaaaaaaaaaagaaagaaaaaagaaagagcaaaaaaaaaaaagtaaacaagacagaaacggggaaggcacatctaaagggctgctagagggtcaactcacttgaggtccgtcggccgtcttcttttaagggagagtcctggaattccctgacgtaagcgaattg

SEQ ID NO: 6290 - DNA, 450 bp, Zea mays
  Clone ID: LIB148-045-Q1-E1-H6
attcgccggccgacccacgcgtccacccacgcgtccgaaagaaacaagcgcccacgaacaactacctcgccaccaacaatggcctccaggtcctccattgtactcgccacggtgatgttggctgcgctgttcgcggttggtttctgcaccaccccgctcaccttccaggtcggcaagggatccaagcctggccacctgatcctcacccccaacgttgccaccatatccgatgtggagatcaaagagcacggtggtgatgacttctcctttacgctcaaggagggcccgactggcacgtggacgctcgacaccaaggccccactcaagtaccccctttgcatccgctttgctgtcaagtctggcggctaccgcatcgccgacgacgtcatccccgccgatttcaaggctggcaccacctataagaccacactcagcatctaatcaacctct

SEQ ID NO: 6291 - DNA, 391 bp, Zea mays
  Clone ID: LIB148-045-Q1-E1-G10
tcgtattaaaagtctccgacgcggcgtctgcggtgccgccgctgcctcctggtgtcgagaccgccagcagcaacggtgcccgcggcggcagcgtggacgtggaggataagcagcggcggcacgacgacgactgccaccccgaagtcgttcccgataagatcatacgggaggacgcaccgccagttgttgcagataccgctgccgcccccaacatcacggacgtggaggtggagtcccccaagaaaggagcggcgccggtgccaaagcccatcatcgttgtcgccgcagtggaagacgtggtggcggacaagttcgtggctgtggtgaaggaggcgatcaagaagccggatatggacgagaacgaagtggcgatgcggagattcctgggcag

SEQ ID NO: 6292 - DNA, 431 bp, Zea mays
  Clone ID: LIB148-045-Q1-E1-G11
caagcctctgacatgagtcgtcctaagcctccgtttgcggtgcgacagctcctccaggaccggcccccgcgcgcgtgccgtacgtgccagggacgacgccgggcggccgatggagttcacgtcgtcctacttccacgccttcggcaaccccgacctcgcggcggtggtctccggcgacggcggcagcgcgcaggcccaccggccgcgccgctccaccgacggcgcgaaggcggaggacggcaggagccccaccaccacaacggcgaggcgcgcgccgtccatgttctgcgtccccgacacggaggcggaggagcccaacggcttcctggacgagtgcaccctctgccgcaaggcgctctgcggcgacatcttcatgtacagaggggacacgccattctgcagcgacgattgcaggagggagcagatcgaca

SEQ ID NO: 6293 - DNA, 391 bp, Zea mays
  unsure at all n locations
  Clone ID: LIB148-045-Q1-E1-G12
aagtgactcatactaaggngattcngtatatattttcggatccttgagcagactggacgaaaatcttggcatttccagaatcagacttgcttctggtgacgccagagattgtcaagaagacatactgtttgaagatcaggcaagagctgatgcatcgccttccagctgtgacgagtcgagtggtgtagcaagccttaaaattcagatttctctgttgaatataagactgagggcacttgaagaggatcaggagttcctcaatcaggtattgagttcgctccaatgtggtactgatgggctgcagtgtatacaggagataagcatgcacttagcagagttgcgaacagttgtggctcactaaaatgaaaatggttttgccccgagttcaaaa

SEQ ID NO: 6294 - DNA, 268 bp, Zea mays
  Clone ID: LIB148-045-Q1-E1-G2
actcctctatcaagcttcatgctaatcggcgcgcgtctgcagttgcggccagccatatcatggcgatgatcagcacgttgcatgacgatagagccgcgatgcaattagaagcactgcaggacctgaggttaatcgaccagcaggttgaccacgaccacttagccatagacgatctgtatcgttcgctcacacacacggacaactggttgcccgatctggacgccgtacctgcacactgcctgtcgctcctgcgcaacgacgatccgtt

SEQ ID NO: 6295 - DNA, 420 bp, Zea mays
  Clone ID: LIB148-045-Q1-E1-G4
gcttcatgaaaaacggagcgcgtcggcagttgcggctagccagacgatggccatgatcaataggttgcaggaggagaaggccgcgatgcagatggaagcactgcagcacctgaggatgatggaacagcaggctgaccacgaccacctagcgatacaggatctgcatgatttgctcacagagagggagaaagaattgctcgacttggacgctgaacttgcacactgcaggaggctcctgcagaacgacgatccgttcaatggcgacagatttgatggcactgattatacaacgaacaacaacacggattttgtggggagcgccatgtcccattttgaagacgacaaggcatacattttggaatccttgagcagactggaggaaaatcttggcatttccacaatcagacttgcttctggtga

SEQ ID NO: 6296 - DNA, 375 bp, Zea mays
  unsure at all n locations
  Clone ID: LIB148-045-Q1-E1-G5
tacccgtcgccgccgcagccccatcatcgtcgtctaggaagtctggtccagctaccgcgccagccaccgcctctacacccccttcttccacggacgaggagttgagcccttccccgccagcatccaccgccgcggcgtcccctgcggctgagggaccggctgctgatgactccgccggtgctgctgcccttggaagtggagctgccatcgccggcgttgccgctgctgttgctaccatgatcttcttctactaaactcaccgacgatggtcgtgtcgcggtgagacattagggtggacacgtaattggctgtgctgtaatcgctctcgtctggtggggagggagggnacaagtgtttctttgctttgctcacttc

SEQ ID NO: 6297 - DNA, 437 bp, Zea mays
  Clone ID: LIB148-045-Q1-E1-G7
cgcgggctgacacacgcgtcaagacttcatcgagaaaagccgcgtgccggacccgcagaggatgatccgcgcctacgcacagtcggtggcgacactcaacctgctccgcgcgttcgccaccggagggtacgctgccatgcagcgcgtcactcagtggaacctcgatttcatggatcacaacgagcaaggtgataggtaccgtgaattggcccataaggtggatgatgctcttgggttcatgactgcatcggggcttacagtcgaccacccgataatgacgactactgacttctggacctcgcacgagtgccttctcttaccctacgagcaggctcttacccgtgaggattccaccagtggccttttctatgattgttcggcccacatgttgtgggttggtgaagcgaatcgacaactcgatggacctcatgttgaat

SEQ ID NO: 6298 - DNA, 361 bp, Zea mays
  Clone ID: LIB148-045-Q1-E1-G8
aagacgtaagaagtcgtctaattcttggatcgaattagacgacttcttcgtccctctcttcattagcacgctaacttgtaatctgcaggatctaagcaaagacttgatttagttatggacggattggtaggcctcttgaaagttcgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggaggtgttcgacaaggacaccttcagcagagacgacccca

SEQ ID NO: 6299 - DNA, 421 bp, Zea mays
  Clone ID: LIB148-045-Q1-E1-G9
ccaatcctctgagctaacgtcgtgctaacgcgtccggtgctgctgcttcccctgcgtcatggtggaggtcgcggtgctcgccacggtgcgcgcgcccgcggcgctgtgccgcaaggccgcccgcgtgcgcaagggccgcaggcgctctgcctccgcgggccaggccacggagatatatgagctcctcgtggacgacaccggcatcgtcgaagtggttgccggtgccgccaatgccgtggcgctgcccgtgaaacccgccttgcatctggaggaaaagggggagctggagaaggaggtgtgggccacgttctacggcaccggcttttggaggagcccgtcgcagctggacgacaactacgacaggtgatcgggacaggctcgcgagcgagctatccacaagctcctccggcgatgcgtgggc

SEQ ID NO: 6300 - DNA, 404 bp, Zea mays
  Clone ID: LIB148-045-Q1-E1-H1
acaaacgtcctacgaaaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaggtgtgtgtgcccatcgacgacctcctggccggcg

SEQ ID NO: 6301 - DNA, 408 bp, Zea mays
  Clone ID: LIB148-045-Q1-E1-H10
gtcgtattaagggacttccgttccgtgctagcgcgcgatcgcgtcggcctccactccaccttcccgaaaaagcttaccctttgtgtttgtgtgtctgtctggcaatcgatcgatctccatgacgacgtccccgccgcgcgcacgcctgctcgccatggcgctggcgctggcattcgcctgcgtgctgctcgtcaggtccgcggacgccgccacgcccggcggctccgcgtacgggtgcaacccggccacggacaggacgtgcaggcccgagggcgtcggggtggtgctgcccgacggcggcattgacctcgacggcgacggcgacgaggacgagctgccgcagttcgacccacacttcacgatcctcggccatgcccagtgagtgtgagtgcaggtgcagctggctgg

SEQ ID NO: 6302 - DNA, 416 bp, Zea mays
  Clone ID: LIB148-045-Q1-E1-H12
tgagtcgtatacctaagcagctaccagccagtccgatccggctagagaccgtagacggcgcacacacctttcatccaatacatacatctatctgagccctttcccgcagtgaggcccgaccggagtccacacacacatcgtgtcaatcgcgggcgtaataaggagccgccgccgcgtgtccgttttcttctacgtcgtcctcgccgcagctgcagctgcagccgcggcgcaggcatccaataacgtcacctccgacgaggagtactgggcggagcgcgccgaggtggctcggtcgcgcaacctcgccgcctacgtcagcgaccccgtggccgccacgaaccgcttcaacgcggacgtgctgagggccacgacgcggcgggcgctggcgaagtacgatggcccgtgcatggcgacca

SEQ ID NO: 6303 - DNA, 340 bp, Zea mays
  Clone ID: LIB148-045-Q1-E1-H2
acgcgtccagtagagttcagggcatgggcttcgatcctgtagttgatcctgtcgatagaccgtgatacgacttccccagccaaagctgagatcgcacatgtgatcaaccatatggtgcgtctcggagtgttggctgggtaggctcgtttcgaggggaacgtttttatggtagcaccactgtcgggcttcaccaaagaggattccgtcgacctcactgcggtgaggttcattgcgctcacgagcctatacggcacgcacgccgatgattgtgtgcacaccctgggcgattgccatgtgtactatgccgatgtacaacggtagaattagtgagacagcagct

SEQ ID NO: 6304 - DNA, 403 bp, Zea mays
  Clone ID: LIB148-045-Q1-E1-H4
tcagggtgtgggcgaagagaccccagccagtcgatcgttcaagaaaaataccagcttaccaacaacagcagcagcaagcccacccgttcgacgacatggcccgcctcggcgccggcgccgtgttggcgctcctagtggcggtcgcggcggtggccgcgttcctcgcggtgccggcctcggcgaagtccggggagctgagcgcgatggggttgctggcggcgaagggcggcagcggcgcgggcccgcagaagtgctcgggcgcggtgggcgagtgcgacgtggacgaggcggaggagctcgggctgagcggcggcggcctcggctccgacgacgcggtgcggcggacgctggcgcagcggaagccgaccaaccggtacatcagctacgcggcgctgcgcgcgga

SEQ ID NO: 6305 - DNA, 443 bp, Zea mays
  Clone ID: LIB148-045-Q1-E1-H5
tcgcgggctgatacacgcctctaaaatgaatctgctaatactggggccgagtcaagggacgatgccgctactatggaacgcgagccgctggtagcagcagcagcagcaccacaagaagagaaggccaaagctgaggagaagacgacgcagccaactaaggccgtggaatctgccaagtggaggacgaaggatgaagggaggagcaacgaagccacagaggagggcaggggcaagtctaccactactgctgccacccaggagaggaagaacaaggtgatggccttggttgggaggtttgagactgccatgtctggctgagaagagatcagaacgaggtgatgtcaaaagactgctctggctcatgaaaatgtgtacgagtactactcaactgtgcaggcgtggagggttcgtatgtgtcgtttcattaattaatgtggctgttg

SEQ ID NO: 6306 - DNA, 407 bp, Zea mays
  unsure at all n locations
  Clone ID: LIB148-045-Q1-E1-G1
acacacgcgtccgcatagagtgtcgacttttctattggtgtgattgggggcactaaatacctaccacattgcactcagactacatatactgtgtttgtgtgttgtatgccgtatgcgtgtgtgagcttgcgcaaattggacatctaggccgtgcgtaccctgcgatgaaaggcgccgtcatcggcgcatcgaccgtcctggtcgtggcggtggtggccaccatctgcgtcgtttccttcaaaggcagcggcgatggcgggagggccgaggagggcgagatgtccacgtcggtgaagtccatcaagtccttctgccagcccgtggactacagggagacgtgcgagaaggcgctggaggcngcnggccgggaacgccaacagccccacggagctggccaagggcatctt

SEQ ID NO: 6307 - DNA, 423 bp, Zea mays
  Clone ID: LIB148-045-Q1-E1-E6
aagcgcgctgcgcagcggtgggcggtggccggtggcaatggcgcccacgacttgcctccggatccccttcctccccgcccgaggccgctccgctaacgtcaacgcccctccgtcctggctcccccgccgcctttctctcaaatccagcgcgaccaacggtgacaattccctccccaatcccatctccacctctcccacctcgccgccttggttaacggtggtggacgttaacgggttgcgtcgcccgcccgcgcctgtttccgcccctaccatccccggcgaccgcggtccccggtggctgcctcggccgttcactagcgcggacgtcatgggggcggattggaaggggctcaaggttgcttaccagggttgcgctggggcgtacagcgaagccggagcaaagaaagcatacccaaattgtga

SEQ ID NO: 6308 - DNA, 416 bp, Zea mays
  Clone ID: LIB148-045-Q1-E1-E7
acccacgcgtccatcgaccgtcggaaaatcgacgaacatcctgtggcatgagtgcgccatcgggcagaaggagcgacagggtctgctgaaccacaagggctgcgtcgtgtggatcactggcctaagcggttcagggaaaagcacgctcgcgtgcgcgctgagccgcgagctgcacggcagatgccacctcacgtacgtcctcgacggcgacaacctcaggcacgggctgaacagggacctcagcttcggagcagaggaccgcaccgagaacatccgcagagtaggggaagtagcgaagctgttcgccgacgctggcctcgtctgcatcgccagcctcatatcgccctacagaagcgaccgaagcgcgtgtcgcgatctgctgcgcaagcactcgtttatcgacgtgttcctggacg

SEQ ID NO: 6309 - DNA, 416 bp, Zea mays
  Clone ID: LIB148-045-Q1-E1-E8
cacgcgtctacatcacgcctctctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaagtggtcttggtggagagcccgcgcaaggactgc

SEQ ID NO: 6310 - DNA, 408 bp, Zea mays
  Clone ID: LIB148-045-Q1-E1-E9
ttactttgcgcgtcctcccaatccgtggctagcggtcccctgtttcctgccgagctcgccggcgttccccttcctccgctgctgccagtggtggttggagatgacacatatgtttccaagggaaggtgcctcatctagctcaacctcaatgagcagccagaggagtgaaactcatgatgataggatgattgcaatggttctctccgaagaatatgccaagttagatggtgctatggccaagcgtcttactaatttaacatcaattcctcatgttccccgtattaacacatactttccaacatatagtgatgccactatggaccattatcgcctccttgataggctaaatgcatacggcttgtttgaggtgagagtatctggtgatggaaattgtcagtttcgtgcact

SEQ ID NO: 6311 - DNA, 420 bp, Zea mays
  Clone ID: LIB148-045-Q1-E1-F1
acgcgtccagacaaacttgccaagcagctagcaaccaacccaagaaagctagacaccatacccatggctcgcgctagcgtcgtcttcgtcattgctactctcctcttcgtcgccatggttgtggcaccgatggccgaggcaaagtccgctgatgccccctccgccgacgcccccgcccccgctgctgacgcacctgccgatggacctagcggaccggcgggtgcacctggtccccagggcgtcgagggtctatcgggcaatgaggacgacgatgatgactccaccaactaaggccaagcacgtcggtccggttgcatttggaacaagacatggaagaaaagtgagagcaatgtcctttaaaaccaaaagtccataataatgtgtggtcatccgtgatatgttcttgctccccctcttttt

SEQ ID NO: 6312 - DNA, 440 bp, Zea mays
  Clone ID: LIB148-045-Q1-E1-F10
gtgggtcggtccaagcctctaaactgacgttctgctaacgcgtgggaggggagcacccatcagccaagagctatccatacgcacagcgatgcaccagcacgagatactagccatcatgcgcctgtcgtccctcctcctcgtcgtggccgccctctcggcgcgcgccgcggcgcagcaggtgccgccggtgggcggcagcgctctgaagccggactactacagccagtcgtgcccgcgcgcggagaggatcatcgcggaggtgatgcagacgaagcagatggcgaacccgacgacggccgcgggcatgctgcgcgtcttcttccacgactgcttcgtcaccgggtgcgacgcgtcggtgctgatcgcgtccacccagttccagaagtcggagcacgacgcggagatcaaccactcgctccccggggacgccttcgacgccg

SEQ ID NO: 6313 - DNA, 392 bp, Zea mays
  Clone ID: LIB148-045-Q1-E1-F11
caagaagcaaaccagcaatggcccgcgcctgcgtcttcctcgtcgtgctcctcctagccgccgtcgccatggcgccgttcgcgggcgcggcgcgcatcgacgtcgtcgagggcaggtccatggcgtccgcggacgcaccggaggccgccgccgacgctcccgctcctgctcctggccccgactcctcctcgaccccgtcgccggcaccctccagcagcagctcttccgactagccgcccggcagagatatctacggcgtccgatcagtctttggcgccacctatgacctatcggatcctgcaaagctatgtatgattctatggtataatgtgtggttggcggaaacgcccggaaataatgtgcttgcgtgattggttttctctctctttttt

SEQ ID NO: 6314 - DNA, 424 bp, Zea mays
  Clone ID: LIB148-045-Q1-E1-F12
ctctggagaaagtcgtcataatccgcggcatcacgctgctcaacagcaagttcttccacctcaacatcttcgagtgcaagaacgtgctgatcgacaaagtgacggtcaaggcccccggcgacagccccaacacggacggcatccacatcggcgactccagcaacgtgaccatcagcagcaccaccatcggcgtcggcgacgactgcatctccatcggccccgggagcaagatgatccgcatccatggcgtcaagtgcggcccaggccacggcatcagcgtcggcagcctggggcgctacaaggacgagaaggacgtggaagacgtgcaggtgacggggtgcacgatcgccggcaccacgaacggcctgcgcatcaagtcgtacgaagactccaagtcgtcgctcaaggccaacaagttcctgta

SEQ ID NO: 6315 - DNA, 408 bp, Zea mays
  unsure at all n locations
  Clone ID: LIB148-045-Q1-E1-F3
taccggtctgatgctcccgggtcgctncacgcgtccacagaatcagctacaaaccatgatccaatcctagcggctagcgatctctagtttatattacaattaggagcaagcgatccaattatcgatagagcgcgagatcgatcgatcatgccgggccgctcggtggtctccatcctcctcctcctcctccatggcctcctctgcctgcagctggctgccttggccgagatggacgacgacgacgtcatggaggacggcagctgcatgcatttcagtgtgtccccgccgcctgctccgccggaggacgcggatgagcggcgcgactatttccgcgccatgcaggccaaggatctgttccggcacgagcagatgatcacgatgatgggcaacgaccggaaacgcaacagc

SEQ ID NO: 6316 - DNA, 429 bp, Zea mays
  Clone ID: LIB148-045-Q1-E1-F4
cacgcgtcaagagcctcatcggcacgttcgatgagatccaagacgggcgcagcggggtgccgcccagcgacttccccaagtggctgccggccacccagcggaggctcctgcagcagacccagaagcctaacacggtggtcgcccaggacgggagcggcgacttcaagaccatcaccgaggccatcaccgccgtgcccaacaccttcgaggggcgcttcgtcatctacgtgaaggccggcacgtataaggagtacgtcaccgttcccaagaacatggccaacatcttcatgtacggcgacgggccgacacagacggtggtcaccggcgacaagagcaacgcatgccgcttcgccaccttcgcctcagccaccttctctgctgaaggcatcgggttcatctgcaagtcgattgggttcctcaacacggcgg

SEQ ID NO: 6317 - DNA, 209 bp, Zea mays
  Clone ID: LIB148-045-Q1-E1-F5
acgctgctcaaacagttggactcggacgacgacgacgatcagtaatagcacatcgacgacgacgatcgatatgtaatagcacgtcgtcgacgaccgaccgcagtcgtcgcagactggctggcactaaaccacaaatcctcttcacctggattacaaatatgtaactgagaaaggaaaggaaaacaaaaatgtaactgcgtggctgtacc

SEQ ID NO: 6318 - DNA, 352 bp, Zea mays
  Clone ID: LIB148-045-Q1-E1-F6
atccatcgatctccccccagcggcgaggagagccggcggccacaggaaggagaaatggcttccgcacacaacgctctccgggtgtttttcatcctagccgtggtatgtgccgtatgcacagcgaaaaggacaggagccaacaaggaagaatcggcggcagcccccggtggcgctgctggaggcagcggcgggacgttcgacatctccaagctcggcgcgaccagcgacggcaagacggactgcacaaaggcagtccaggacgcgtggacgtcagcgtgcgaagcgaccggaagcgccacggtggtgatccccaagggcgaactactggtcgggcctctcaacttcactgggc

SEQ ID NO: 6319 - DNA, 376 bp, Zea mays
  Clone ID: LIB148-045-Q1-E1-F7
acaagcctctacaatgagtctcatcatctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacga

SEQ ID NO: 6320 - DNA, 439 bp, Zea mays
  Clone ID: LIB148-045-Q1-E1-F8
ctcgcgggctgacacacgcgtctacccacacttccggtagcaaatgttggagattctagagctgttatttctaaaggaggacaggcgattgcggtttcaagggatcacaaacctgatcagacagatgagaggcaaagaattgaggatgcagggggctttgttatgtgggctgggacatggagagtgggtggcgttctcgctgtctctcgagcatttggtgataaactcttgaagccgtatgttgttgctgaccctgaaatcaaggaggaggtggtcgacagctccctcgaattcctcatccttgctagcgatggactctgggatgttgtcactaatgaggaagctgttgccatggtcaagcctatccaggacccccaggaagcagcagacaagcttctcgaagaggctttcccgaagggaaactccgattacatcacag

SEQ ID NO: 6321 - DNA, 425 bp, Zea mays
  Clone ID: LIB148-045-Q1-E1-F9
gggtccgaccacgcgtccgagcaagcgtccgatcacaaggagaaggggaagggcggcgagggaagggctccgcgtcgtgtcccttctcttcctcctcctcctcctcctctctccaacaccccatccatcagcgctgccctccgcattgctcttgatcccatccagtacatcgattctccccccaagatcaaaggccggaggaggaagaaaggttagggagtcggccatgggatgcttttcatgctgctgtgtggcagatgacgacaacgttggcaggaggaagaagcatgacgatccctatgttcctatccctgctcatgtttataattttggacctagccggttcccagccccaacccctgtcatctccactggcagagctcagccaattgcagtaccggccattcatctggaagagctgaagg

SEQ ID NO: 6322 - DNA, 336 bp, Zea mays
  Clone ID: LIB148-045-Q1-E1-E4
cgtcgcgcaacggtgggcggtggccggtggcaatggcgcccacgacttgcctccggatccccttcctccccgcccgaggccgctccgctaacgtcaacgcccctccgtcctggctcccccgccgccgttctctcaaatccagcgcgaccaacggtgacaattccctccccaatcccatctccacctctcccacctcgccgccttggttaacggtggtggacgttaacgggttgcgtcgcccgcccgcgcctgtttccgcccctaccatccccggggacggcggtccccggtggctgcctcggccgttcactagcgcggacgtcatgggggcggatt

SEQ ID NO: 6323 - DNA, 419 bp, Zea mays
  unsure at all n locations
  Clone ID: LIB148-045-Q1-E1-C6
acccacgcgtccgcccacgcgtccgggccggccatggggttcccgtcggtgtgctactgcgtgatcctgccgcagccgctcatcctggtgctgcagctgctggacttcctgcggcacgccgtgctgctctgcctctcctcgctgggcctcgcggcgccgccggccgccgacgaccatccggcctacgcctacgcggcgccgccgccgccgccgtcggacctctgggcactgcagccgtcgtccctgcagcagcagcagcagcaggcggcggcggcggccctggcgcggcggcccacgccggcagccatcaaggcgcgcctgcccgccgtccggtacgccgacctgctcggggcncgccgcgccccgccgggccccgccgtctgcgccgtgtgcctcggcgcgctccaggcgcggcaccg

SEQ ID NO: 6324 - DNA, 290 bp, Zea mays
  Clone ID: LIB148-045-Q1-E1-C7
acacccacgcgtccgctttagtaagagatgcttgcctctattcttggcgatgacgattgtcaatgtgtacatcttcaaacctttgtaaggtgagcatcatactgttcttttggacatgcatgtggtgaaagcatatatatattttttgttcatttcgaagctggctggccttggtttacagtctgaaggagttctacttcggggaatctggatcttgcagaggttaccttctctcaggcttagggttttgatttgggcattgatgctgtgtgcacattggtgagagagga

SEQ ID NO: 6325 - DNA, 415 bp, Zea mays
  Clone ID: LIB148-045-Q1-E1-C8
tcgcgggccgacacacgcgtccaaacggcgccatcatcaggtccgagcggccgagcgccaggaactgcctcgccgacgagagccacgtgtgctggaggaacggcaagttcgcgcaggacatgatcctccggctcaggaacgtcgagagcggggagatacagctgcagctgcagtgggtgaacttccctcctggtcctgctcctgctgctgcaacaaccaggtgacctgatcgatggtagctgctgttcctgtcgccattgcctcctgctggcaggaacaggaactctctgaagcacggggtcagggtagttcatgttgcttcgattcgatcgtaggggagataatgccggatggctttgtaaagtttgggaggacatgcatcataattgaagtcaagtgataggatcctgttttt

SEQ ID NO: 6326 - DNA, 115 bp, Zea mays
  Clone ID: LIB148-045-Q1-E1-C9
cgtattaggtaggatggcgttcatcatcaatgtcgcagtgaacgctgcggccgtggctgcgctgctgctggtctcagcggtgtcgcctgtcgcgctcgctgggggggtcgctgtg

SEQ ID NO: 6327 - DNA, 433 bp, Zea mays
  unsure at all n locations
  Clone ID: LIB148-045-Q1-E1-D10
ccaagcgtctaaagagactctgcgtacgtgtgtgcagcgagcagctagggcatatgcattatttcagaagagaactagctactccgatcaagatgagcgacgaaggattgtacgtatattgctgagaggagatcgaagagacggtgatgagttggcggaagatcgatgcatgcgtggatgatcatcacagccaatcgtacgtgtgtaaaaggtcngccggaggggggaataatcgtgcatgagacacctctctcgctcgctcttcctctcctacgtcttaattcattgggttcgtcgatccgagatcctacgtacgtcgtcgtttttgtattgtatatattataggtcatcatctcgtgggggtcatcagatctggcgggttggtggtgtgttgtaatttgtaaagagatcgatcaagggtgatgcggtgtgg

SEQ ID NO: 6328 - DNA, 395 bp, Zea mays
  Clone ID: LIB148-045-Q1-E1-D11
tggatagctgcgccacgacctctcctgctgtcgctgctggtcgccgtgctagcggtggccgccgatgtcgccaacgccggccacgccaagcccctgacgcctggcgggcgtgtggtacacgacaaccacggcaagttcacggccgggccgtggaaacccgcccacgcgaccttctacggcgggcgggacgggtccggcaccacggcgggcgcgtgcgggtacaaggacacgcgcacgcaggggtacggcgtgcagacggtggccgtgagcacggtgctgttcggtgacggcacggcctgcggcgggtgctacgaggtgcggtgcgtggacagccctagcgggtgcaagcccgacgcggcggcactggtggtgacggtgaacgacctgtgccccgc

SEQ ID NO: 6329 - DNA, 401 bp, Zea mays
  Clone ID: LIB148-045-Q1-E1-D12
cgtatgaaggacgcgccgccagttgttgcggagaccgctgccgcccccaccaccacggaggtggaggtggagtcccccaagaaaggagcggcgccggtgccagagcccatcgtcgttgtcgccgcagtggaggacgtggtggcggacaagttcgtggcggtggtgaaggaggcgatcaagaagccggagatggacgagaaggaggtggcgatgcggagattcctgggcagccgggtgaagacagcgatggagccgcggtcagagtcggagcagccgcggcgccgggaggtggctcggatcaacgacgtgatcgaggcggcacgcaccaagctgatgcacaagcgccagtgcagcagggtcaaggcgctcgtcggcgccttcgagactgtcatagacaccca

SEQ ID NO: 6330 - DNA, 391 bp, Zea mays
  Clone ID: LIB148-045-Q1-E1-D4
acgcgtccagatggttcgtggatggctgcgccacgacctctcctgctgtcgctgctggtcgccgtgctagcggtggccgccgatgtcgccaacgccggccacgccaagcccctgacgcctggcgggcgtgtggtacacgacaaccacggcaagttcacggccgggccgtggaaacccgcccacgcgaccttctacggcgggcgggacgggtccggcaccacggcgggcgcgtgcgggtacaaggacacgcgcacgcaggggtacggcgtgcagacggtggccgtgagcacggtgctgttcggtgacggcacggcctgcggccggtgctacgaggtgcggtgcgtggacagccctagccggtgcaggcccgacgcggcggcactggtggtga

SEQ ID NO: 6331 - DNA, 410 bp, Zea mays
  Clone ID: LIB148-045-Q1-E1-D5
acattctctctctcctctctcggccttcttcgcgtgtttccctctttttcttaggccgccctctacacttctcgacataaccatcgagagggcggtcgagagaaacgagagcggcagacaccatggggagctcgaggaccatcgttgcgtcccccctgctcctcctcgccctcctcctcctggctttcgcggccaccgccgaggcccgcgttgtccccgagctgtttggcgaggaccaattccagcggacatgcaaccaggtgcacttcaggaagatgtgccagagcttgacgaagctcccgaaggttacaacgccgcgccaactggtgccaaccttcaatccccttcccgcggggaagggccagggaggccagaagccggttggacaattcccccgcaaggaaccacaa

SEQ ID NO: 6332 - DNA, 416 bp, Zea mays
  Clone ID: LIB148-045-Q1-E1-D6
agccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgccgccgagaccacgacgacggtggaggccaagaagaacgccgaggaggccgggaaggagaagctggcgcagc

SEQ ID NO: 6333 - DNA, 427 bp, Zea mays
  Clone ID: LIB148-045-Q1-E1-D8
acacacgcgaccagtggaattcgacgacgaaactccgtcacgtcattcctctgcgcctcccgtctggccgtcttccagacgtctccaatcggagctcccagcgtctcggagaagaggagcagcacggcacggcggctgtggcgaggaaggctcctgtcctgtcccatcccaacccagcagccgtccaaggaggaggagatccaatcggcgtgcaggcgtccaccgtccatccatcgatccaattccaatctgcaggcctctgcgtcgcggcttgttcgtggaggagaggttgctgtggaacccgccgccagttagccatgtcgtcctccgtgctgagggctgcggccgacagggctattcgcaggcacgccctcacgctgacggacgccgcggcgttcaggatccgggagctcctcagcctcagggc

SEQ ID NO: 6334 - DNA, 285 bp, Zea mays
  Clone ID: LIB148-045-Q1-E1-D9
atcagtgctatcaaatatcacttctccgtgaggcctgagcccctcgccgcggtgagccaagccggcgcacgtcgccccggggctcacgctcaccatcgagcgccagccaattaataagatatatatatagctacgatcgatcgtcagtaagatggcaagctccgccgtcctgaggagccccctgtcagtcctcctctacatgctcgccgcagtgcccgcgatcgccgcggcgacgtcgaccgacgccgcgatcgacaaggcgtacgcgcatcgcgtgaagttcac

SEQ ID NO: 6335 - DNA, 374 bp, Zea mays
  Clone ID: LIB148-045-Q1-E1-E1
accacgcgtccggctggttcgtggatggcggtgccacaacctctcctgctgtcgctgctggtcgccgtgctagcggtggccgccgatgtcgccaacgccggccacgccaagcccctaacgcctggcgggcgcgtggtacacgacaaccacggcaagttcacggccgggccgtggaaacccgcccacgcaaccttctacggcgggcgtgacgggtccggcaccacggcgggcgcgtgcgggtacaaggacacgcgcacgcaggggtacggcgtgcagacggtggccgtgagcactgtgctgttcggtgacggcgcggcctgcggagggtgctacgaggtgcggtgcgtggacagccctagcgggtgcaagcccga

SEQ ID NO: 6336 - DNA, 422 bp, Zea mays
  Clone ID: LIB148-045-Q1-E1-E10
aacacagtccatgttacctctctcaccatagcgcccgctctgtcgcccttcgttcacctctccttcctctcctccctgcctgccagggagaggggaagtcagaggcacggagtggcgcagagcagacgcacgtgaaccattgtagctgtccctgtcgtcgtcgtcgtcgtcaacgaatccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctcgtccgccaccccaacgtcgtgcagctgcacg

SEQ ID NO: 6337 - DNA, 419 bp, Zea mays
  Clone ID: LIB148-045-Q1-E1-E11
taaagaaactcgggcggacgcgtgggcggacgcgtgggcggacgcgtgggttcgccgagagggaaagcacattcttcatggaaacatccgcactggagtccatgaatgtcgagagcgctttcaccgaggtcctaactcagatctatcgtgtggtcagcaagaaggcccttgacattggcgatgaccccgctgctccaccaagagggcaaaccatcaacgttggtggcaaggatgatgtctctgctgtgaagaagtcagggtgctgttcatcctaaatcacttatgaccatgaaaaggaaccatatactctccgatcatatgattggtaactgaaaataggactctcttgtgcttcctaacctgttggttatgagattatgttggtgctccagagaaatgattagatgttaagaatttga

SEQ ID NO: 6338 - DNA, 232 bp, Zea mays
  Clone ID: LIB148-045-Q1-E1-E2
tggagccggtcatggcgccgtcgtcctctctgccgcggagcgccagcgagctaccggacgcgccgtcagcgttcatctcgaacacggcgcagtaccgcgtctccgtgcccaccacgtgctaggttgtcggtatgttgctcgtcgttcggccacatggtgagcccgcccacccacacatcgccgatgacgcccagcagaaagcatgaccacaagcctaagccgaggccggacg

SEQ ID NO: 6339 - DNA, 418 bp, Zea mays
  Clone ID: LIB148-045-Q1-E1-C5
acacgagcacgcgttcttcgcctctcaccccacgggagggacgggaggcgagggcgcggcgagccggcgggcgcaatcggatttggggaggcaaaaggaaaattccggagagcagttcctttccgcctccccatttcctccggatagatttgggtttggcctgcgtcgattagtccggcgctcgaacccgcaccaatccattcgccgagggatcgagcaagcgaggcgtggatcgcaggcggtattccctgcctgcctcttcttctcctccgcctgttcttgccgcggtctccccctccggccgatctggactcgacagatcattaattttttgttggcatacattcccaaccttgatgtaaagacctccttcattcataaccctgtgttttggaagggtatttcacaatgaagccca

SEQ ID NO: 6340 - DNA, 426 bp, Zea mays
  unsure at all n locations
  Clone ID: LIB148-045-Q1-E1-A9
cctctaaactgacgtcctagtacttcttcatggtggggttcgccccgctgacgtcccgcggctcgcagcagtaccgcgcgctgacngtgccggagctgacgcagcagatgtgggatgccaagaacatgatgtgcgcggcggacccgcgccacgggcggtacctgacagcgtccgccatgttccggggcaagatgagcaccaaggaggtggacgagcagatgatcaacgtgcagaacaagaactcctcctacttcgtggagtggatccccaacaacgtcaagtccagcgtgtgcgacatcccgcccgtcgggttgcccatggcctccaccttcgtgggcaactccacctccatccaggagatgttccgccgcgtgagcgagcagttcacggccatgttccggcgcaaggctttcttgcactggtaca

SEQ ID NO: 6341 - DNA, 394 bp, Zea mays
  Clone ID: LIB148-045-Q1-E1-B1
atgcgtggacagcctcaccgcaaagccagagagccagaaggcgaccccgcgccggctggcggagctgttcgtgaacatcgcggccgagaagggatccgggatggccacgttcgtgcacgggaagtacaacaacgccaaggacagcaccgtgttcaagtgctacgacagctgctcggacgacgtcgaggaggccgtcgcccacctcaacggcctcgtccgggagcccaccgacgccaagttcctggagctcaagtcgtggctctcctccacgctcggcggcacctccacctgcgaggacgcctgcaaggacctgcccaagaacggcgacaaggacgacgtcgtcaacttcagcctcgacttcgagaagctgcagcgcgtcacgctggacctcatc

SEQ ID NO: 6342 - DNA, 373 bp, Zea mays
  Clone ID: LIB148-045-Q1-E1-B11
gtattactcgaaaccgagcgccgcgcggcactggaggccgccccctcagccgccgccgcccgagacggaggaggcggggcgtcgcgggctaataataagcgcggagtccgcgcgccgccgccgccgctgctggacgagccgtcgtggaccatgttctgcaacggcaagaagaccgggtacgcggtgcgaaggcaggccacggacgacgacctcgctgtgatggagacgctgcgggcggtctccatgggcgccggcgtgctccccgggagggccgccccttcgtcggcgcccgacgctgttgctgcggcggcagcggacgacgaggtgccctacatgcgcggctgcttcgaccacttcgtcgggttccgggact

SEQ ID NO: 6343 - DNA, 312 bp, Zea mays
  Clone ID: LIB148-045-Q1-E1-B4
attagcgttgcggctgttcttcgacccgtgccgttcgtgtcgattggttcgttccgccatggaggctctgatgaagcccgcggtgtgctgtgcccatcgtgtgctgcgcatcgtcggctccagcgcagtcggtgtctattgctcatgacgagagctgctggaatgacgacgaccaccatcctatctgctttcccgaagactgcctggcgacctgccatgatcaccggcactcagaccgccgctgcaactgggcatggtcgtggaggccgtattaccagtgcctgttggcggactgccaataagctcgaacag

SEQ ID NO: 6344 - DNA, 425 bp, Zea mays
  Clone ID: LIB148-045-Q1-E1-B5
acacgcctatacacagacgtcctgcctatgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccttcatggagccggttgttgctggcagcaacacagtagtagctgttgcccaagttgagttgcaaacaatgaacgtgcagcagcccgctgatgttgccggacccagcgagggggtgg

SEQ ID NO: 6345 - DNA, 426 bp, Zea mays
  Clone ID: LIB148-045-Q1-E1-B6
acactcctctagcttgactcgtagtacgacgagctgtgcatgctcacggtgccgcacggccacctcaagtcgtccaacatcctgctcgacggccactacgagccgctgctgacggactacgcgctggtgcctgtgatgaaccagtcgcacgccgcgcagctcatggtggccttcaagtccccggagcggaagcagttcggccgctcgtccaagaagagcgatgtctggtgcctcggcctgctcatcctcgagatgctcaccgggaagccgccgacctacgacctgcccaaggcggcgggggcggtgccgtcggccgaatcgttgtcgtcaccgcagaaaccgggtccggcggcgggcaacagcactgacctggttaccgtcgtggggtcgacccgggagggcagtggctgggcaccgtggtggacc

SEQ ID NO: 6346 - DNA, 414 bp, Zea mays
  Clone ID: LIB148-045-Q1-E1-B7
acaaccctctagaataagtcctattaacgggcacgcagtcgtggtcgccctggcctcgccacggtgttctagtgcggtggcgctgtgccttggcgctccgactgccttcgtggtgtagttcgtggacgggaaccgaatggcgctggggcaattgctcgccagacatggtgtaccgccgtggtgtagttcggcgacgggaaccgaacccacctcacccaaatcaccggtatgcgttgttcacctgtgttcgcctaagactcaaaatacgtaggatcgtgcgggtcgtgtgtcggttgccaggggacggttgtgcgtgcaccaaccatggcgccgccgggggctggaaagctggagctccgtcgagctcgagaattttgcaaacatgacaccatctacggagggcttcaaactttt

SEQ ID NO: 6347 - DNA, 382 bp, Zea mays
  unsure at all n locations
  Clone ID: LIB148-045-Q1-E1-B8
acaatccactacacacactcctaataatctcaagagaccagaaaactgggcactagtttgagaaagggaanaatacaatccacaattccgggatttttcccttacggtgtcacctgattccatcaatttagttcctgagcatgctgcaacaaataaaaaagtgttcctcatgaacctctctgctcccttcatctgtgagtttttctgtgatgcncaagagaaggtcctcccgtatgctgacttcatcttcggcaatgaaaccgatgcaaaaatcttcgccaaagttcgatgatgggagacagagaatgtcgaggagattgctttgaagatctctcagcttcctttggcttcaggcaaacaaaagaagactgcctgtattact

SEQ ID NO: 6348 - DNA, 415 bp, Zea mays
  Clone ID: LIB148-045-Q1-E1-B9
gagtcgtattacgtcttccatggcctcctcgtagtagaatagctctatctcaccgcaacaactcctcattacatcctttatgagaggctgatcgattggtagatacgtactcgggtggagcagaacaacgagagacatggcgacgacgacgcgtgttgccgccaccgccgccggcgtgctgctggtcctgtcggcgttggcgaccctggcgcgggccgaggacccgtacctgttcttcgagtggaaggtgacgtacgggaccaagtccctgctgggcgtgccccagaaggtcatcctcatcaacggcgagttccccggccccaggatcaactgctcctccaacaacaacatcgtcgtcaatgtcttcaaccagctcgaccatccgctccttttcacctggaacgggatgcagcac

SEQ ID NO: 6349 - DNA, 456 bp, Zea mays
  Clone ID: LIB148-045-Q1-E1-C1
accggtctgatgatccgggcggccccacgcgtccacatggtccaagtgatcttgccaagttacgagcagcaagcagagatcagatcatccatcggcaatgtcgaacatcgggcagtccttccaggccggcaaggcggaggcccagggcgagtaccaggcggagcacgcggcgcagtgcgtcaaggacaccgccggagccgcggccgacagcgcgcagctgcagcagcaccgcgccaccggcaccgttgagcaggtggcgcagacgggccagggcgtggcggcaggcgtcaaggacacggtggcgggcgcggcggttggcgtcaccaacacggtggcgggcgtggcggcgggcgtcacgaacacggtgaccggcgcggtggcgggcgtcacgaacacggtgaccggcgcggcggcgggtgtcaaggacaccgtgaccggcggccactgatcgacgac

SEQ ID NO: 6350 - DNA, 404 bp, Zea mays
  Clone ID: LIB148-045-Q1-E1-C10
tccggcaatatcgggcgccagagatcattctaggtgcaggatactcgttttctgttgacatgtggtccttcgcatgtattgcttttgagctcgcaacaggagaaatactatttacacccaaggaaggccatggatacagtgaagatgaggatcacttggctttaatgatggaactacttggcaagatgccgaagaagattgcaaccatgggaacacgatcaaaggaatattttgaccgccatggagatctgaagcggatacgaaggctgaaattgtcatccattgaacgtgttctcgttgacaaatacaaaatttctgaatctgatgcccgggaattcgccaattttctttgccctttactcgactttgcaccagagaagaggccaacagctttagattgccta

SEQ ID NO: 6351 - DNA, 410 bp, Zea mays
  Clone ID: LIB148-045-Q1-E1-C12
tcataatatgccagatgtactgagaaaggctgatattcataagattcaggcagagcttgtgtcatgtcttccgtcgttacctcacctttcagatctacaaaagctgaaggatgagctgaagacctcttggaattctatggaggttcttccatctctgtcccgttggcatctcttggagttactcgcaaattgtctgccacacagatttacccatcccaatgaaacaagtttgtctgttcttcaaagcatgaaggaggatctagcaagcctgattgcaccgcaactgatcagaccaattgcgcggtggccattctatgccttcttgggaggagccatgttctgcctcctggccagcagcacttgccaccttctctcctgccattctcgccgcctagcatacattatgcttc

SEQ ID NO: 6352 - DNA, 426 bp, Zea mays
  Clone ID: LIB148-045-Q1-E1-C2
cacgcgtccacaaaagcattgaagccgtagccgccgccgccggacgagacaggttgaggcggggcggcaatggccgccggggaccttgaggtgctcaccgcgctcgacaccgcgaagacgcaatggtaccacttcaccgccatcgtggtcgccggcatgggattcttcaccgacgcctacgacctcttctgcatctccctcgtgactaagctcctcggccgcatctactacaccgtggaggggtccgcgacgcccggcaccctcccgccgcacgtgtccgcgtccgtcaacggcgtggccttcgtgggcacgctgtcagggcagctcttcttcggctggctgggcgacaagctcgggcgcaagaaagtctatggcatgacgctcatgcccatggtcctcggctccgtcgcgtcggggctctcgttc

SEQ ID NO: 6353 - DNA, 416 bp, Zea mays
  Clone ID: LIB148-045-Q1-E1-C4
acgcgtccacagacgcgtgggggcctggtgaacgacccggagatccgttccgtggcggcgatggtggccggcgacaaggtggccttctaccactgcgcgttctacagcccccaccacaccctgttcgacagcgccggccgccactactacgagagctgctacatccagggcaacatcgacttcatcttcggcagcggccagtccatcttccagtgccccgagatcttcgtgaggcctgaccggcggacggagatccgcggctccatcaccgctcaggtgcggcaggaggaggacagcagcggcttcgtcttcctcaatggcaaggtgtacggcgtccgtgaggtgtacctgggccgcgtcaccgcgccggactcgcgcgtcatcttcgccgacacctaactctccaagaacatcca

SEQ ID NO: 6354 - DNA, 373 bp, Zea mays
  Clone ID: LIB148-045-Q1-E1-A8
acaagcctctaatgtgagtcgtagtacgcatcaacaatcgccgagagcgatcgagagataaataaagatgaagaaagtggcatcatcgtcagccgttctcttcgtgctagcgctgacgctagtttgtgccccgctgatagcagaggcaaagaagaagagagtcgccgccgccgccgccgaggagaagaaggtgcaggacaacttctgctcgacgctgtgcgagggcaggaaggggatggacctggtggtgtgcaaggagtcctgcgacctctcacagcgctccaacctggtgctgtacggccggatccagtgcaagggcaagtgcaccgagcagaagggcatcaccgcgccgcagatgaacgtgtgccaagag

SEQ ID NO: 6355 - DNA, 284 bp, Zea mays
  Clone ID: LIB148-044-Q1-E1-H10
ggtcgacgcacgagtgtaatcgccgtcgtcgtggggcttcacttctcctagaacgccgaaggtcaagaagagaagaaggcgagacgtgcagtccgtcaggcagcgctcgataagagggaagcaggaggaggctagacatcgaactcatcaacgaaccaagtcgtacgtcgtgctcatcatcacgtgacggcgcgtgccgcgtcaagctaagtgtccaggaaggggcactccgcagcgatgacggtggtggaggagtccgtggggaaggtggaggacactgcggt

SEQ ID NO: 6356 - DNA, 415 bp, Zea mays
  Clone ID: LIB148-044-Q1-E1-H11
tcgcgggtcgatacacgcgtctaaagtcagtcatgctcaggaggaggctctctcctgtcctacctgttcgctcccggctcccctccatctctttcgccacacgcgcgagagggaggagaggaaacagctagcagcgagcgaggaacgaagagggtgcttcgcacgtgcatgcgagatcgatcccgatcgtcggccggcgggaattgaactagcgacgacgtacgtgcgaccggggcgggcgttggattaattattccggcctgagcaatgggcaagatcgagtacggcgtggtggcgcgcggcgcggtggtgctggcggagcactacggcgcggcggcggcgggcggcaacgcgggcgccgtggcgcggcaggtcctggagcgcctccctggcggcggcgacgacgactgcaacg

SEQ ID NO: 6357 - DNA, 244 bp, Zea mays
  Clone ID: LIB148-044-Q1-E1-H12
ccggcaaccaccggcttccctctccgtccccaaccgaccgaccaacgcgccgagcgaagatgtcgtggcagacgtacgtggacgagcacctgatgtgcgatatcgagggccaccacctcacgtcggcggccatcgtcggccacgacggcgccacctgggctcagagcaccgcattccccgatttcaagcccgaggagatggctgccatcatgaaggatttcgacaacccggggaacttcgcccc

SEQ ID NO: 6358 - DNA, 399 bp, Zea mays
  Clone ID: LIB148-044-Q1-E1-H2
aacctatcatgaacttgtcgcccttctcccggactcgcatcaacgccgtggcttcaatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaggtgtttgtgcccatcgacgacctcctggccggcgccgacaagggtggcgatccgaggcccgtgagctaccaagtgcgcaggccgcactctggccgcgcccacggcgtcctctacttctgctataagttcaccgatgttcccgccgtctcttgtgtct

SEQ ID NO: 6359 - DNA, 62 bp, Zea mays
  Clone ID: LIB148-044-Q1-E1-H3
tctcatacaagccagggcctcaccaggatggtcattgcaattatcactgcaagtactgggca

SEQ ID NO: 6360 - DNA, 414 bp, Zea mays
  unsure at all n locations
  Clone ID: LIB148-044-Q1-E1-H4
gcacaaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccangaggagtgcgacaaggcgtacgtggtgaaggcggccgaggttcacaaggcctgcagcg

SEQ ID NO: 6361 - DNA, 417 bp, Zea mays
  Clone ID: LIB148-044-Q1-E1-H5
gttccgccgtcctcttttactgcatctgcatcgccgtcgtcgtcgcattgtcgtcgtccatggtcgccgtcggggccgccgccccgggggaaacccccaagttcatctcggcgagcgcccttgagtgctccgctaacgtaacggaaatagcaaaggcgcgcaagctgatcgatgtccatggccacgggctgtgcccggtgcggttcgaccacacgcgcgggatcagcgcggtggccagcagctgcaaggaccgcccgctgccgtcgccggagcgctgctgcggggcgctcaaggcctacgcgtgcccctacagcgagctcatcaacgacaacgccaacaacggctgcgccagcgagatgttctacgtcatcatgacacgcggcaggctgcggccgggcctcttctcgcagctgtgcg

SEQ ID NO: 6362 - DNA, 428 bp, Zea mays
  Clone ID: LIB148-044-Q1-E1-H6
cgtccaccctagcttgctcctcgatccatcaattgcaagaggagcaagataccaccaccgtagcaccacacgcaggtacgaagaaggcgacgaacatggcgaggctggccttggtagcggcggtggttctgtgccttctattagcgacagggccgcacggggccgtcagcgccgatgggatggtgtcatttgacaatttgatcagctgcaaggtactgggcaactgcgataagaacctgggccccgaggcctcccgcccagggaaacccgccaacgactacacccgcggctgcaacccgatcaccggctgtcgcggctgatcatatctctctggtcgatgtgcgcgcaatgtcaatgtcgcacgcgcgtgcatgtaccaggccttagcgtgtggtgcgcgtgtgtgtatatttacacacatgcatata

SEQ ID NO: 6363 - DNA, 416 bp, Zea mays
  Clone ID: LIB148-044-Q1-E1-H7
aagacggacagtggcgcttacatggagcaccgtctggccggcgtggacagggtgcagatcacgggcctgaacgcgggcacgctggacctgacgaataacggctggggccacatcgtcggcctcgtcggcgagaggaagcagatctacaccgacaagggcatgggcagcgtcacctggaagccggccatgaacgacatgccgctcacctggtacaagaggcacttccacatgccgtcgggagaggacccggtcgtgctggacatgagcacgatgggcaagggcatgatgttcgtcaacggccaatgcatcggccgctactggatctcctacaagcacgccctcggccggccatcgcagcagctttaccacgtgccccggtccttcctgcggcagaaggacaacatgctggtgctgtt

SEQ ID NO: 6364 - DNA, 424 bp, Zea mays
  Clone ID: LIB148-044-Q1-E1-H8
ggcgcaaaacgtcatcatccacaacctgcacgtgcacgacgtcaagcacaccatgggcggcctcatgcgcgactcccccacgcacatcggctcccgcaccagggccgacggcgacggcatctccctcttctccgccaccaacgtctggatcgaccacatctccatgtccaactgcgacgacggcctcatcgacgtcgtgcacagctccacggggatcaccatctccaactgccacttcaccaaccacaacgacgtcatgctcttcagcgccagcgactcctggccgcaggaccagatcatgcagatcaccgtcgccttcatccacttcggcaggggcctggtgcagcggatgccaaggtgccgctggggcttcttccacgttgtcaacaacgactacacgcactggctcatgtacgccattggc

SEQ ID NO: 6365 - DNA, 392 bp, Zea mays
  Clone ID: LIB148-044-Q1-E1-H9
accaaggttttgagaaacgatttagtgtcctgcacatatccaatatgatacttgctattgggagtatgattttccatgccaccttgcaacttctcctacaacagagtgatgagactcctatggtttgggagatccttctctacatgtatgtcctctattcaccggactggcactacaggagcacaatgccaactttcctgttcctgtatggtgctgcctttgccgtagtacatttctttgcccggttccaagtcgtattcaagctgcattacgttggcctctgcttgctctgcatcccccggatgtacaagtactacatacagacgaaagacgtgggtgcgaagcggctcgcaaaactgtgggtccttacactgacccttgggaacctctgc

SEQ ID NO: 6366 - DNA, 193 bp, Zea mays
  Clone ID: LIB148-045-Q1-E1-A10
ctccctgacgtgagtcgtattaatacagccagcctccaataggagcgagccagtcaaactgatcgcactctctccgccgccatcagagcgaacatgctgactgaccccgtctccaaggcaatccgcagccgacgtaccaccaccaccgggggagcgagatggatatcaagatgatcctcgtcgccgtcctcgt

SEQ ID NO: 6367 - DNA, 421 bp, Zea mays
  Clone ID: LIB148-045-Q1-E1-A11
tcgtcggtccaagactctaaagaaagtcctggcaatccagtcacggtgtacatcactgacatgaactacgagcctatcgctccctaccacttcgacttgagcggcaaggccttcggctccctggcaaagcccgggctcaacgacaagattcgccactgcggcatcatggacgtcgagttcagaagggtgcgatgcaagtaccccgccgggcagaagatcgtgttccacatcgagaagggctgcaaccccaactacctggccgtgctggtgaagtatgtggcggacgacggcgacatcgtgctgatggaaatccaggacaagttgtcggctgagtggaagcccatgaagctctcttggggcgccatctggaggatggacactgccaaggcgctcaagggccccttctccatccgcctcacca

SEQ ID NO: 6368 - DNA, 433 bp, Zea mays
  Clone ID: LIB148-045-Q1-E1-A12
tacaacaccctgacgtgagtcgtattaagccgacttctctctgcgctccccaacttgcctcacaggatggtatcacttgctcggacagggtggcttgctgctgcattggtgcccatgccaatggccttcttcctgatgtggaaacaacaggacgtacgcgctctggtagcaggaacagcgatggttggcctgagctcaggattcatcttcgccgcagcagtgtcagtgacctccgagctctttggaccaaacagcatcggtgtgaaccacaacatcctgatcaccaacatcccgctggggtcactcctctatgggcatatcgccgccatggtgtacgacgcgaatggacaaaggatgacactgatggataatcgcactggcatcattgacaccatgattgtgtgcatgggggttaagtgctactccaccacct

SEQ ID NO: 6369 - DNA, 337 bp, Zea mays
  Clone ID: LIB148-045-Q1-E1-A4
cagggtggcctgctcttcaagtacctgtaaaagggacaacaccaagcacacagcagaagtatacgatctcccgaccgaccgtggacaatatcgaataactcctgccaaatcgccagttccttttgtgtactgtgcgctagccgccgcctagctgcactgctgtatttttgtttcaggattgctgctgctgttcgcattcaatcgttgggcctcccggagccgccggaggcgcgttttactgttagccttactactcttactccctgtagctccacgtataagaaaccgatgtcctgcgtctggcaatttgtcgtagtcccttgatgatggcgatgat

SEQ ID NO: 6370 - DNA, 359 bp, Zea mays
  Clone ID: LIB148-045-Q1-E1-A6
ctcgtgggccgatacacgcctctacatcgcttcctcctacgccgcccgtccgatccggtcactggccggggagggctcagaaacctttcatccaatacatacatctatctgagccctttcccgcggtgaggcccgaccggagtccacacacacacggtgtcgatggcggccgtaataaggagccgccgccgcgtgtccgttttcttctacgtcgtcctcgccgcagctgcagctgcagccgcggcgcaggcatccaataacgtcacctccgacgaggagtactgggcggagcgcgccgaggtggctcggtcgcgcaacctcgccgcctacgtcagcgaccccgtggccgccacgaaccg

SEQ ID NO: 6371 - DNA, 447 bp, Zea mays
  unsure at all n locations
  Clone ID: LIB148-045-Q1-E1-A7
ctcgggcgccgacccacgcgaccacgctcccgactagcatccaccggtggccaagacctctgccacgcccgaaccgtacgcatctctgaacgtcgccggcggcgggcagcccaacgagccggcggcggggaggccgccgaagctgtcgatggagacgttctcggggatgatcaagaggccgttcgccaagttcctgagcccggtgatcaagggcgtgtgcgccaagacggagtacccggaggactgcgagtcgtcgatcgggggcctcccgggggccgcgtcggcggcggccacggacagcgtgggcgtgctgaagctggccatggaggcggtgcggcagaaggccatcgaggcgatgaacgcggccacggacaggatgaacgcgccgggcacggacccgacgaccaacgangcgctcgactcgtgcacgtcgtcgtacagcgacat

SEQ ID NO: 6372 - DNA, 427 bp, Zea mays
  unsure at all n locations
  Clone ID: LIB148-044-Q1-E1-H1
acaatcgcacaaggcacacacgtacagccatggcgaactcgtcgtccggcctggcggtgagcgacgagtgcaaggtgaagttccgggatctgaaggcgcggcggagcttccggttcatcgtgttcaggatcgacgacaaggacatggagatcaaggtggaccgcctcggcgagccgaaccagggctacggcgacttcaccgacagcctccccgccgacgagtgccgctacgccatctacgacctcgacttcaccaccgtcgagaactgccagaagagcaagatcttcttcttctcctggtcccctgatactgcacgcacccggagcaagatgctgtacgccagctccaaggacaagttcaaganggagctggacggcatccagtgcgagattcaggccancggacccagcgagatgagcctcgacat

SEQ ID NO: 6373 - DNA, 399 bp, Zea mays
  Clone ID: LIB148-044-Q1-E1-F7
accagaatatgccatgactggacagcttagcacgaagagtgatgtctacagctttggagttgtgctgctggagcttttaaccggtcgcaagccagttgaccacacactgcgccgtggccagcagagccttgtgacatgggctacaccgaggcttagtgaagacaaggtgaggcaatgcgtcgatccaaggctcggagacgaataccctccaaaggctgtagccaagatggctgctgtggccgccctctgcgtgcaatacgagggtgaattccgtcccaacatgagcatcgtcgtcaaggctctgaaccccttgctgcacagccggtctggcaaccgccctactgcctcgtcggcctcccacgctgccgagcgatccggactgtgaattctcatcgctgc

SEQ ID NO: 6374 - DNA, 426 bp, Zea mays
  Clone ID: LIB148-044-Q1-E1-F8
accgtggatctcgacagcagcaagacgacgtcctcctcctccagtcaggaggagtgcaaggatcaagaagagaacacgggggacattctggaggagaagcgtgacgggaaggacagcgaagacctgagcagcacaggcgacaaggcttgtgtcgggctcgggagcagtgatataaacatcccgatggaagaagcggttgatgaacctgttaaaccggcggaagctgtggacgaagctgggctgaagagagatgtctgctgttcaccagctgagccaaacgaagccgttggtcagaacgagctcaatgaggctgctgtcgtcggtgaaacgacgactgaaccgaaggaggctgaggatgaagccaagataataaagcaagtcgactgcgaaactgcatcaaaagaagttgctagtactggggccgag

SEQ ID NO: 6375 - DNA, 415 bp, Zea mays
  Clone ID: LIB148-044-Q1-E1-G10
cacgagtctaaactggacgtcctggaacgtcgtacgagaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaggtgtttgtgcccatcgacgacct

SEQ ID NO: 6376 - DNA, 437 bp, Zea mays
  Clone ID: LIB148-044-Q1-E1-G12
cccgggtcgacacacgactctacatcgactcctatcaatatacatatatagacctaataagaacaaagacgtacgataacctgcttattttgcgacccatcccgttcccacgcaaaggcgccgagcgtgatctccgtccgtgccgccatggcctcgcaccgggcgctgctgctgctgctcctcgccgccgcgctcgtcgctgcgctggcctctgtcgcatccgccgacgacgccaacgccatgcccaccatcctgacccccgtggcgcataccccgctggggtccttcgacggcgacaagccggcctctgacgacgacgccgtcgacgacgacgaggacgccgcccctgtcggcgcgcccaacggggccaccatgactgagcccagggacgacgtccccgccccgcccggcgccgaagcaaccgcgggcggcgccgc

SEQ ID NO: 6377 - DNA, 409 bp, Zea mays
  Clone ID: LIB148-044-Q1-E1-G3
cccaatggccgcaagggtccgttcgttccccttcgtcttggggccccttttcctcgtcaccctcttcgtctcggccgcggcaattgcccggaccgtgggcgacaccgtgcaggacgcgtgcagcaataccaagttccccaagatctgcgtggacagcctcgtcgccaatccggagagccagaaggcgactccgcgcaagctggcagagctgttcgtgaacatcgcgggcgagaagggatcctggataggcagcttcgtgcaccgcaagtacagcgacaaggatgacagcgacatattcaagtgctacgacagctgctccgacaacgtggaggaggccgtcgcccacctcaacggactcgtccgggagccaccgacgccaagttcctcgagctcaagtcgtagctctcct

SEQ ID NO: 6378 - DNA, 417 bp, Zea mays
  unsure at all n locations
  Clone ID: LIB148-044-Q1-E1-G4
atcgagattctacgcgtggataacctggtcatcaccggcaagggaaaccttgacgggcagggcccagccgtgtggagcacgaactcctgcaccaagacgtacgactgcaacatccttcccacccgcctggtcaccatggtcataatccccagcaaggctgccgctgacacccgccgactctcactccacgtgaggctccgcgcccagcctctatgactcacccattgcgacaaccaccaggtgttcatccgcaactgctacatcaaggaccacgacgtgctagcccgccatatcgacgccggcaacggcgtgggccgccccgcgggcgtgctcatcaacggcaanggcggcaaggacctggaggccgcgcctgccttcaccttcgangccggcaagacgtaccgcctccgcgtctgc

SEQ ID NO: 6379 - DNA, 423 bp, Zea mays
  Clone ID: LIB148-044-Q1-E1-G5
gctaggataagcacaaacgcgtgcacgcgctgacgccgacgtcaaggtgtacggtaactcggagcgtcatcggagagagagacccgccaccgccacgcttgaccgtaatccgtggagagtgagtgcccggccgggctaccagctaagacacgacggtccatccagccatcggtggcccagcagattccacaatggcggcaacggcggacatggagcggatcttcaagcggttcgacaccaacggggacggcaagatctcgctgtcggagctgacggaggctctgcggactctggggtccacctccgccgacgaggtgcagcgcatgatggccgagatcgacaccgacggcgacggctgcatcgacttcaacgagttcatcaccttcagtaacgccaacccggggctcatgaaggacgtcgcaa

SEQ ID NO: 6380 - DNA, 424 bp, Zea mays
  Clone ID: LIB148-044-Q1-E1-G6
agtgatttgaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgacaagtacagtgagcgatttgttggggcatgcatgatcgcagacaactgcgccaatgtgtgccgcggtgagggcttcttggccggcatgtgcagcaccttccgccgccgctgcatctgcactaggcagtgctaaacaagatcgctcgatcgttcgccatgcatcgacaacctattcttaataacgttcattatctcgttcttatttatgacgaatgtcatgtatgttctggtgactgtcatgtatattctgatgac

SEQ ID NO: 6381 - DNA, 416 bp, Zea mays
  unsure at all n locations
  Clone ID: LIB148-044-Q1-E1-G7
aagatcactacaagatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcangaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaccggc

SEQ ID NO: 6382 - DNA, 365 bp, Zea mays
  Clone ID: LIB148-044-Q1-E1-G8
accctatcatgaacttgtcgcccttctcccggattcgcatcaacgccgtggcttcaatctccggattcgacctccgcatcccttcccacagcacccaagcagaccacagcaacggctgcaacccctgctggaacgccgtggttgaacaacggggaggtgtccggggtcacgctgctcaactccaagttcttccacatgaacatgtaccggtgcaaggacatgctgatcaaagacgtgaccgtgacggcgcccggggacagccccaacacggatggcatccacatgggcgactcatccgggatcaccatcaccaataccgtcattggcgtctgcgacgactgcatctccatcggacctgggacctc

SEQ ID NO: 6383 - DNA, 395 bp, Zea mays
  Clone ID: LIB148-044-Q1-E1-G9
gtcgatacacgaatctaaattgcctcgtatcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcctggtggagagcccgcgcaaagactgcgacca

SEQ ID NO: 6384 - DNA, 449 bp, Zea mays
  Clone ID: LIB148-044-Q1-E1-F6
tcataggacgatacacgcctctacactcacgtcctaacagccccaacaagttgtgtactgccaacggcgcctccaaggtcaccgtcaaggatgtcaccttcaagaacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccgtcgactgacccatctctctagttataatttttctctcgtccttgcattgcccattagatgctatccattggtaacgcacaacagtaaaacgacagacatccgacagctatattatgttcgacggtgtaacaccctgaatttgagggta

SEQ ID NO: 6385 - DNA, 427 bp, Zea mays
  Clone ID: LIB148-044-Q1-E1-E10
ggaagtcgcagggcgacgtcatgatgaacggcgccttcttcaacgagtccggcggccagaacgagcgcaagtacgacaggttcgacttcatcccggccaagcacggccgctacgtcggtcagctcacgcgcttcgccggaccactcaagtgcatcgtcggccagccgtgctagtagacagcggcccggtcgggcacatactcctcttcctatatacatcggatttggatgggcggcatatatgtacgtgtgtgtaatatattattactacatcttgtactatatgcgacgattgcttgactgatgaatcacgctttttaggttagaccaatttagaagggaattagagtggattaaattcgctcccggtaaaaaatgactcgaagaaaatttagggactgtttggtttgtggttaaatgtgctacac

SEQ ID NO: 6386 - DNA, 405 bp, Zea mays
  Clone ID: LIB148-044-Q1-E1-E11
cgcagcctccgcagtccgcacctgcctccacgacttgtcgtgctcgtgcgctactctcctcgagcgcggcgcggagcacggggacatcaaatggcggcagcggcggagatcggtggtttcgcggcggcgagagtggcggtggcgacgctcaggccggctgcgcacccagccccggcggcggcggtggcaccgcagcctaggagggcggtggcggcgcagtcgctgcagacgaccgccaccgaggcgctgacggcggatctcgccggcacgaccaacggcgctgtgcatgctcggatgaatagtaaggctacaagtgaaatcacttcacaggcagttactgcaaattctaggagaaagacaaagatagtctgcaccataggtccctcaaccaacactcgtgagatg

SEQ ID NO: 6387 - DNA, 369 bp, Zea mays
  Clone ID: LIB148-044-Q1-E1-E12
aaacagtctcctgccacgtcggcgactcaggcacaccgccttcaatccaccgtcagtacatgcggtccagttcatttcagtggttcaatgaggcggacatgttcatcagcgtgcaacggtctctaatccagggacaatcctcgtggattaccttaactttggcatccgtcccgcgagtgacactcgagtggacaaacaatgtaacaaactagtcatcgatggctccctttaatttcatccatggcattcctggtttgtaaccaaatgttccaatttcatctccgacgccaatgttaagctggaatgcaaggaatttggtcacggcaagctcaaacgcttcaacgaacgggttaccgaacggaaagggac

SEQ ID NO: 6388 - DNA, 435 bp, Zea mays
  unsure at all n locations
  Clone ID: LIB148-044-Q1-E1-E2
gggtcgacgaacccttcgggcccgcggaaacctaacccggcccggcttcgccaacggcaatggccccggcataatcggtgcttccccttggaacggctggccttcgggaaccgcaaaccccgctgcggcggtggccttctccttaccggggctcgcttctcccttctccgccttcccgcgtcctcccgcggccccgcccccagcgggatcggggcccctcatgtcgaaggcaaaggtctacaccgacgtcaacgttctgcgtcncaaggagtactgggactacgaggcgctcaccgtccaatggggtgagcaggatgactatgaagttgtcagaaaagttggaagaggtaaatatagtgaggtctttgaaggcatcaatgttaacaattatgagaaatgcatcattaagatccttaagcctgtcaagaaaaagaa

SEQ ID NO: 6389 - DNA, 364 bp, Zea mays
  Clone ID: LIB148-044-Q1-E1-E4
tccccaacggcatccccccttaactccccttctccttctccttcctgcggtcccaactcccatacttcggttcaggaggcacgcaggcacgaaggcaggttcgaggggggattggctccgctcctgctccattgcgcgcgatccggctcgttcttgtgatctgtctacccgtttcttgggtcagtgctggaaggtcaaactgttggtggaaacctcaccggggtgcttcaacgaacgcgaaagtgtcactgtcatttagcgcgtcttgattggatttgacctgttggcctggtggcgtgttgtccttgattgagctcgaggatgactaaatgggggctcagcagcggcacgcccgcggattcct

SEQ ID NO: 6390 - DNA, 410 bp, Zea mays
  Clone ID: LIB148-044-Q1-E1-E5
agaacgtcgtacgagaacctttctccctcctccaccgttctccttttcttgccacggcaaatcagcttcgccggcgagagcatggcgatggcttaccgtgtcctggaggtcaccctgctgtccgcaaatgacatcaacaaagtgtcgctcttctcccggactcgcatctacgccgtggcttccatcgccggattcgacctccgcatctcttcgcacagcacccaagcagaccacagcagcggctgcaacccctgctggaacgccgtggtacacatccccatctcggctgccgctgacatccgcggcctcgcactccacgtgaggctccgcgcccagcgtctatacatgggcgatcgcgacatcggcgaggtgtttgtgcccatcgacgacctcctggccggcgccgacaa

SEQ ID NO: 6391 - DNA, 427 bp, Zea mays
  Clone ID: LIB148-044-Q1-E1-E6
agcgacatttctaataacacagttgagcgcgacgatgggatccctcgctaataacatcatggtcgtgggtgtcgtccttgcagcgctcgtcgccggcgggtcatgcgggcccccgaaggtgccgcccggtcccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacattaactacgagcctatcgctccctaccacttcgac

SEQ ID NO: 6392 - DNA, 400 bp, Zea mays
  Clone ID: LIB148-044-Q1-E1-E7
aggattcatcgtcccatagctcaggctctcatcagatgatcgatcacgagttggagatggctccattctatcaatatggcatcactctaccattcatggggttgcgagcgccaccacgtgcatcatggatcctttttccagcgcatcagctttgatcagggattcacatgtagggttttatgatacggtcagatctaccgtcaccgcgagactatatacgctagtgcatatgggattgggattgtactacatggaacaagttctgtggaatcgcttgtcgttacgtctagatcatacgaggcagtgccggctgcggctcatgctcagatgtgagattcttggcatgactacaatgctcgggatttcaatctctgtgtatatcactgacattagctacgag

SEQ ID NO: 6393 - DNA, 416 bp, Zea mays
  Clone ID: LIB148-044-Q1-E1-E8
agcggtcgcctctgcatccgtgctaatactggtccgccggccgcgcctgtcctctacacgggagttcgctgcggccgtcacgcactctggggcgctgttcgtcgccggtggctacgtcccctggtcccctttctacgccagggctctcgatctctccactctgaatgccaagcggagagccgtcgctagtcctgcacacctccgcgcgatgtggatgcacggctgcgcggcgctcgatgggagggtctctatggctgcgcgatggaggatactccaccggggctcaagtaattgctcgccggacttcacatccgccgctgtgcctctctacgtcgaggagcgactccaacgctcgctctatgccgagcgaggacacgtgtcatctgaaaatcatgttggtacctggattctcaagt

SEQ ID NO: 6394 - DNA, 264 bp, Zea mays
  Clone ID: LIB148-044-Q1-E1-E9
actgcatccttgctaatactggtacgcaggccgctcttgtcctctacacaggagttcgctgcagccgtcacacactcagtggctctgttcatcggcggtggctacctctggtgactaattttctaaggaacggctctctattcctatactctgaattctatgccgagactagtagctaattctgcacacttcggcgcgatgtggatatacagctgcgcgtcgcttgataggagggtctctatgggtgcgcgatgaatgatactt

SEQ ID NO: 6395 - DNA, 421 bp, Zea mays
  Clone ID: LIB148-044-Q1-E1-F1
gtggatggcggcgccacgacctctcctgttgtcgctgctggtcgccatgctagcggtggccgccgatgtcgccaacgccggccacgccaagcccctgacgcctggcgggcgcgtggtacacgacaaccacggcaagttcacggccgggccgtggaaaccagcccacgcgaccttctacggcgggcgggacgggtccggcaccacggcgggcgcgtgcgggtacaaggacacgcgcgcgcaggggtacggcgtgcagacggtggccgtgagcacggtgttgtttggcgacggcgcggcctgcggcgggtgctacgaggtgcggtgcgtggacagccccagcgggtgcaagcccgacgcggcggcgctggtggtgacggcgaccgacctgtgcccacccaaggacaagtggtgcaagccgcgc

SEQ ID NO: 6396 - DNA, 418 bp, Zea mays
  Clone ID: LIB148-044-Q1-E1-F10
cgcgtgtccatgttacctctctcaccatagcgcccgctctgtcgcccttcgttcacctctccttcctctcctccctgcctgccagggagaggggaagtcagaggcacggagtggcgcagagcagacgcacgtgaaccattgtagctgtccctgtcgtcgtcgtcgtcgtcaacgaatccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagattaagcgcgagatctccgtcatgcgcctcgtccgccaccccaatgtcgtgcagctgc

SEQ ID NO: 6397 - DNA, 427 bp, Zea mays
  Clone ID: LIB148-044-Q1-E1-F11
accgcctccaacggtgaaatctccttcaccaccatcacctccaccgatgattaaatcaccgccaccaccggtgccggtgaggtcacctccatcgtcagtgaaatcaccgcctccttcaccactgttaagttcgccgccgccaccagcgcccgtgaggtcacctccaccgctaacgaaattatcacctcctccaccaccgataaggtcgccacccccaccacaagcatactcacctcctccatcagctccaataagctcacctcctcctccgatgcaatcccctccaccgcctgctccagtcagctcaccaccaccacctataaaatcaccaccaccggctccagtaagctcaccacctcctctggcgcaatcccctccaccacctgctccagtcagctcactaccaccacctggtaaatcacctcct

SEQ ID NO: 6398 - DNA, 392 bp, Zea mays
  Clone ID: LIB148-044-Q1-E1-F12
tacaacaccctgaggtgagtcgtattaaattccacgataacatcaaccacgtccagatctgagtccagcacatggtcctcttccgcaagtgcatggagcccgtggagaaatgcctcggcgatgccaagatggtcaagagcaccgtggacgacgtggtgctcgtgggcggctccacgcgcatccccaaggtgcagcagctgctccaggacgtcttcaacggcaatgagctctgcaagagcatcaaccctgacgaggacgtggactacggtgctgctgtccaggccgccatcctgagcggcgacggcaacgataaggtgcacgacctgctccttctggacgtcacccggtgtccctgggcctggagaacgccggcggggtgatgaacgtgctga

SEQ ID NO: 6399 - DNA, 186 bp, Zea mays
  Clone ID: LIB148-044-Q1-E1-F2
cacgattccggaaacgggttaccttttttttcccacatttataagcggcaatacatgcttgcacctgtagtattgtgaccatatgtactgtgctctcggtttgtatatcgatagtagcatataaagctactactcccgatttgtaactatagatctcggtattaaagccattttatttttattttt

SEQ ID NO: 6400 - DNA, 422 bp, Zea mays
  Clone ID: LIB148-044-Q1-E1-F4
gggcgaacccttgggcggacccttggggcaatggcggccaaggtgttcctcctcctccgactcaccatggtcgccgtcgtcctggctgccatcgccacattattgctcccggaggaagccgatccgcgggcactgccggcacagtggaccaccgcgaagaagtacaaggccacgatggacgccaagacgcggcaggctttcgacggcgtggtggccgccgctacggcagagaagcggtcccaggcggtggaggccgtgctgcagcagcagctgaacatggacgtgtccctgtccaaggcgacgtcttccggggacgagaacaactacgtgagcgtggccgccgcctacgagaaggccgcgggcgccgtcatcgcggcgacgccggacaacaagctccgcgctatggcgttcgcgttcgacgg

SEQ ID NO: 6401 - DNA, 115 bp, Zea mays
  Clone ID: LIB148-044-Q1-E1-F5
cacgcctctaaaatgagtcgtattataaaaaaaaaaaaaaaaaaaaaaaaaaaaaagaaagaaacacataaaaagaaaaaaaaaaaattacacatacatacaaaaatcgtcaatc

SEQ ID NO: 6402 - DNA, 422 bp, Zea mays
  Clone ID: LIB148-044-Q1-E1-E1
gtaatcgaccccaccgggccaccgttccttgccaactgccaagcatcaccgcgaaatctaataactcgttgctcttcgtcttcgctccgcgatcgatccaggagggggaagcagaaggagggatggcggagaacccgcagctgtttgggaatgggatgccggtgccgttctacagtgagatgttcgtcctcgcccgggatggcgtcgagttccacgtcgacaagatcccatcagctcctggtggtcatgtgaaaacaaaaggcacaatttacctgtctaatataaggatggtgtttgttgccaacaagcatgttggcaacttctttgcttttgatatgccactgttgtttgtgcacggtcagaagttcaatcagccaatatttcactgcaacaacatctctggattcgttgagccagttgtt

SEQ ID NO: 6403 - DNA, 420 bp, Zea mays
  Clone ID: LIB148-044-Q1-E1-C6
acccacacgtccgcccacgcgtccggcagagatgcttcccactgaatcactgatcgttgatcagtgttccaatattttggcaagtgcagctttgaataaattgaacagattggcctcgtggccattttcctgtatttatctgtagtcaggtccaattcttttctgttggtgagcgcaagttattcatagatgactcggtcatgggaatatttgtaatattatgtcatgtatcgttaaatttcagttgttttgtttcagctgccagaactgttagcaagagtattctggagctggaagctcgaacgcaactggttgtatctatatccttgaatgccgaataaaggacgggcaataaactgcagcgaaatatgtgctgtcagacattgttgaaaaaccaatgtatgggaaattgagtggatc

SEQ ID NO: 6404 - DNA, 406 bp, Zea mays
  Clone ID: LIB148-044-Q1-E1-C8
ggcggttcctgagggctcctacgctggtagcacgcccatggggagcgactgctacggtggtgctccgtgggcagaagacgaggaggtgcgccgcctcagcgtgcggatgcaggcgttggaggcagaccgtgagtccatgaggcaagccatcatgtccatgggagccgagaaggcgcaggtgatgctgctcaaggagatcgcgcagaagctctgcaaggacacgacaccaccagttccagcggcagcagtggctcagcacagcttttacaaagggggcaacacacagccggccatgaccatcactgtgcgaccaccacggcacccggctttgcttatgcaaaggaaactggtgaagaagaagccatcactccttgctgcagtggtcaagtgggttacatcaatcatg

SEQ ID NO: 6405 - DNA, 359 bp, Zea mays
  Clone ID: LIB148-044-Q1-E1-C9
agcgcggttcgcatgagcgcgcggaatgttgggggcgcaccggtcaaacatgctcaggaggaggctctctcctgtcctacctgttcgctcccggctccactctatctctttcgccatacgcgcgagacggaggataggaaacagctaccatcgagcgaagaacaaacagggtgcttcacacgtgcatgctagatcaattccgatcgtcggccggcgggaattgaactaacgacgacctacttgcaaccggggcgggctttggattaataattccggcatgaccaatgggcaaattccattacggcttgttgccccacggcacgttgtttctggtggaccactacggctcggcagcagca

SEQ ID NO: 6406 - DNA, 426 bp, Zea mays
  Clone ID: LIB148-044-Q1-E1-D1
acgatgttgcgcccccatggaaccctgtgccccaccgtgaatcatagtagtgccgcaccgccgttcctagggttccagagaccagcaagacaaacctcgcgtggcacctgcgtgccgtcctgcagtaacgcgccagtagaagcttgctccatcggctcgcgtcggtgacttctccctcttcgccgcgttcgtcgagcgaggtcacgagtcacctgatgagcaagttggtacctggaatctcaagtcccaggtcaagaacaggtaccgcacgatgaggcgcatggaggatgctgcgatgagttcgtgagagatctaggccgtcgtctcccagtcaactttgggttgctggaccgttgtctccttataatgtaattatttatttattttgtatagaactcctattatgtagtaaagatgtgacattcg

SEQ ID NO: 6407 - DNA, 415 bp, Zea mays
  Clone ID: LIB148-044-Q1-E1-D11
agtggctagcggcgtcctccatcgctccgcctccctatgtctccgcccggccgccggctcctccgccgactccggccggggccacggcgcggttatgatcggtgattcgaggacgcgcgttgctgctctgcagctgggaggatctagccggagagagttattatctgtcacaatggcctccagagatcacactggcttgacccgacaacttcttgattttcaacatgatacaatagatgaggtaggcgcaggacatgacccattcattgatttgaaagcgagattcatggactttaaacagagaaactatgtggaaaaattttcaaattaccaaacccttgctgagcagcagacaccaaagttcatggtggttgcttgtgctgactccagggtctgccctaccgctgttttgggg

SEQ ID NO: 6408 - DNA, 448 bp, Zea mays
  Clone ID: LIB148-044-Q1-E1-D12
ctcgcgggtcgatacaagactctaaagtgacgtcatatgacatcaatagtccctaccattcggcgaacgtacaaatcaaagtgcggcgtgcccgctcgcaaactttgagtacgtactgctactccggctcgtcctcctctcttctccatcgccgttggttctctcacgccacacggtcatccgatccctgtccaccgcgttgggagcggcgcagcccatggacgacaacgagagagagaaagagaatgagaatgagaaggagaagcactacgggactgacgtcgaggatgaagaagaggacgaggaaggtaacaagcgagtcgtggtgcttggcccccaggtccccctcaaggagcagctcgagctcgacaaggatgatgagagcctgaggaggtggaaggagcaactccttgggcaggtcgacacagagcagctgggagaaactgcg

SEQ ID NO: 6409 - DNA, 407 bp, Zea mays
  unsure at all n locations
  Clone ID: LIB148-044-Q1-E1-D2
aggtgaaggctgtggatgccttcggcaacctcctggtacttgaaaacctgcaacaaccgcaccatgatgacaacaacatgatgctaaaatttcccaaggcaagaaagtttgatatccaaaaagcaaagcaaatgtggtctgatatgctgaagtggagaaaagagttcggtgcagataccattctcgaggaattcgaattcgaagaagctgataaggtggcagaatgctaccctcaaggttaccatggggttgataaggaaggcaagcctgtctactttgaacggcttggacagatcgatgtgaataagctaatgcangtcactacaatggatcgctttgtcaagaaccatgtcaangagttcgagaagaactttgctgttaagttcccagcttgctcaatcgccgcg

SEQ ID NO: 6410 - DNA, 418 bp, Zea mays
  Clone ID: LIB148-044-Q1-E1-D3
atgcctactacaaggcgctcaacgagcaccatgtcctcctggagggtaccctcctgaagcccaacatggtgactccaggctccgactccaagaaggtgacccctgacgtgattgctgagtacaccgtccgtaccctccagaggaccgtacctgctgctgtgcctgctgttgttttcctctctggtggacagagcgaggaggaggccacccgcaacctcaatgccatgaacaagctcagcaccaagaagccgtggtccctgtctttctccttcggccgtgccctccaggcgagcaccctcaaggcctgtgctggcaacgtggagaacttggagaaggctagagctgccttcctcgccaggtgcaaggccaactctgaggctaccctcggcacctacaatggtgatgctgccgccgacac

SEQ ID NO: 6411 - DNA, 411 bp, Zea mays
  Clone ID: LIB148-044-Q1-E1-D5
aggtaggtgcattgcttcggtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccatcagagctacgcgctgtacgcgcagaagtccgtcggggacgggggcaaggagcccctggacaagaagctgtcggaggcggagaagaataaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctgaacatcagca

SEQ ID NO: 6412 - DNA, 418 bp, Zea mays
  Clone ID: LIB148-044-Q1-E1-D6
aaacaacaagactgacagcgacgatgatgccacagctgcgtagcctcgtcgcgctggtcctcgtggccacggccatagccgccgctcccggcgttgggtttgtcgtcaccggccgcatctactgcgacaactgccgcgccgggttcgagacaaacgtgtcccacgccatccaaggcgcgacggtggagatggagtgccgccacttcaagtcgcagcaggtccacgacaaggcggaggcgacgacgggccccggcggctggtacaggatggagatcagcggcgaccactaggacgagatctgcgacgtgcgcctgctcaagagccccgaggcggactgcgccgagatcgaccactcccgcgaccgctgccgcgtcccgctcacgcgcaacgacggcatcaagcacagcggcgtccgcta

SEQ ID NO: 6413 - DNA, 416 bp, Zea mays
  Clone ID: LIB148-044-Q1-E1-D7
gacacaagcgtccgatctcgagtctccttacaagggccacgatgagggcgcctctcctctcctcgctcctcgtcctcgccgtcgtcgccaccgtgcctctactagtcccggcggtgtgcatctcgcggcacgacaagtccgagagcaaggctgacgaataagctgctgctactaccgttgccgccgacgagcatggctctgtcaagaccatgtccctcgacgcatacgggccactggagatggccgccaagaagcccaaggagcaggtcctgaacgcgcaagctacgctggcgacgaccgctggcgctgacacatatgaccagaaacccgttggtgaaaaacaggctgaaacggccacggtctccgctgccgatgaacaacccgacaaatacgtggaagctctagttcctgacgag

SEQ ID NO: 6414 - DNA, 328 bp, Zea mays
  Clone ID: LIB148-044-Q1-E1-D8
agcgagaggatggttatttcattcttctgtacagttagagaggattcatatgagcgggaaaataggccaagtatgtagagtgatctgtcttgtatagaaagcaggcaaaaaggtccaatgtatatgtggaacgtagcatcttcagttgtgctaggcctccattctttttttttcttgtttggatgggccttttgcttcttcgtagctgctgtatcatgtatgctcccattgagccatgagttgtaaaatattaaattgaaggtgcttcttccataataaaataagcaagataaaaaaaaagttatcagaaaaatttaaaaaagtaaaa

SEQ ID NO: 6415 - DNA, 317 bp, Zea mays
  Clone ID: LIB148-044-Q1-E1-D9
atttctggtcagctaattcattcatctgtacagttagagaggattcatatgagcgggaaaataggctaagtatgtagagtgatctgtcttgtatagaaagcaggcagacaggtccaatgtatatgtggaaggtagcatcttcagttgtgctaggcctccattctttttttttcgatgtttggatgggccttttgcttcttcgtagctgctgtatcatgtatgctcccattgagccaggagttgtaaaatattaaattgaaagtgcttcatccataaaacaaacacagtcacgaaaaccctttttttattgagcagtg

SEQ ID NO: 6416 - DNA, 441 bp, Zea mays
  Clone ID: LIB148-044-Q1-E1-C5
tcacgggtcgacacaagcgtccacacacgcttctggaatttggtgctgcttggtcaacaacattaaagttcaaggtcaatgaatcgtacagctgcagatatatgctaggtagtaacaaggctgatattcactcgaacaagctattcaattgtactgctgaggaaccttcgactggggagcttttcaaaaggatacttatactgttttcagagatgtatgtgtcagaagatttcagttcagggcgaatgcttgtatatgtggcagcaggtgttgtgctgggcatgctgagttcgatgttcattacggccttattcagaggtatgtatgggttgttgctcgctgccgccaggtgggctgtgaggaagcattgcatcagagtatttgccagccggttgaagcgtgcctgccttcttgtcgcctatgtatccgctgttggctgga

SEQ ID NO: 6417 - DNA, 350 bp, Zea mays
  Clone ID: LIB148-044-Q1-E1-B11
aggacgcgtggggtggtggcgccggcgcatggatgcatgcgtacgcgctgctccagctgcggacgtccgatgccgcggggcagcccgcctcgcattcgccggcaatggtggtgtcgtctggcggctccaatcccaagtgcgtggccggcgccagtaacgaccacgcgtgccgcgtcggtccagtgcacgatccagtgaaccatgaggaggagggctctagcgtcaatatctacgcgcccaccgccgcgcccgactacgtctgacacgacgacggcagcgactacaaagatgccgacgtgcccaacaacgatcatctcgtcatcgtcagtcattgaaagctgtcgcgcgcg

SEQ ID NO: 6418 - DNA, 394 bp, Zea mays
  Clone ID: LIB148-044-Q1-E1-B12
cggacgcgtggggctccccaaagatagcatagcagcagcactcacaatagcaaaaaccaccatccgtcgtcgccaaccgtagcaaggagccaaggacatcaccaccgcccagcaataatggcgcagagcatgaggattgtggcgctggccttggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggaccagggcgccggtgccgccggcgccgcgccggcttgatcgcccagcgcattcatcgcttcagctcgatataatcgctgctccgtcagcaacccacatatga

SEQ ID NO: 6419 - DNA, 434 bp, Zea mays
  Clone ID: LIB148-044-Q1-E1-B2
ggtcgatgcacgcctctaaaataaatcgcctaattctttcgatcgaattaggcgccttcttcgtcccacgctccgtctttatttgtaatctgaagcttacaggaacatttgagtggatcatggacggattggtaggcctcttgaaagtccgggtggtgaggggcatcaaccttgcctaccgcgacgcaagatgcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcaaggacgacccgatgggggacgcggagatcgacgtggcgccgctggtggaggcggcgaacgcgagcccggaggcgagcctg

SEQ ID NO: 6420 - DNA, 398 bp, Zea mays
  Clone ID: LIB148-044-Q1-E1-B3
agacggaatcgtaggagagcacaatcatcgagccggagccgccggtgtcatgcgccacgctgtcatggctctaacaggacgagctcaactacccgtccatcagggtcatcctcagataaccgcccttcaccgcgacggcgaagcgcgccgtcacaatcgtcggcacggccagctcgacgtacaccgtcgccgtgaacgtgccggcgtcagtcacagtggaggtgatcccgccgaaactgactttcaaggcgctggaagaagtcctgaaatactcagtcacaagcaagtcggccaatggccagacgcttatcggccctgtcgagggggagctcaaatggttgtccggcaagtaattcctgcggaacacgatcctcgtcagtaacgaatccaggacctcg

SEQ ID NO: 6421 - DNA, 255 bp, Zea mays
  Clone ID: LIB148-044-Q1-E1-B4
ttatgtggctcccgttaacgacagggccgcagggggccatcaccatcgtcgggatggtgtcatttgcgaagatgatcaagttcaaagtacaggagaactgcgagatgaatctgggcccccaggcaacgagtctaaggacacccgccaaagattagaccagctgttgcaacccgatcaccggcgtctcgcagctgattatatctccctggccaaggtgcgctcaaagtgaatatcgcaaactcgttcatgtgccag

SEQ ID NO: 6422 - DNA, 386 bp, Zea mays
  Clone ID: LIB148-044-Q1-E1-B5
agggcatcgagtacctgcacgaggtggccaacccgccggtgatctaccgcgacctcaaggcgtccaacatcctccttgacagggacttcaacgccaagctctccgacttcgggctcgccaagctgggccccatgggcgaccagagccacgtcagcaccagggtcatgggcacgtacggctactgcgcccccgagtacgccatgaccggcaagctcaccaagatgtcggacatctacagcttcagcgtcgtgctgctcgagctcatcaccggccgccgcgccatcgacgtcacgatgccgtccgaggagcaggtcctcgttcagtgggcaacgcctctgctgagagacacgcggatgttcatgaagctggccgaaccgttgctgggc

SEQ ID NO: 6423 - DNA, 422 bp, Zea mays
  Clone ID: LIB148-044-Q1-E1-B6
aggctccccaaagatagcatagcagcagcactcacaatagcaaaaaccaccatccgtcgtcgccaaccgtagcaaggagccaaggacatcaccaccgcccagcaataatggcgcagagcatgacgattgtggcgctggccttggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggaccagggcgccggtgccgccggcgccgcgccggcttgatcgcccagcgcattcatcgcttcagctcgatataatcgctgctccgtcagcaacccacatatgattcgatcaatcttcctcctctaatttctcgactccgtc

SEQ ID NO: 6424 - DNA, 410 bp, Zea mays
  Clone ID: LIB148-044-Q1-E1-B8
gcggattgcattggagatcagacttagtcgccatctcctatggatgtgttctctggcttcaatatttcatatgttgactgtggttggacgatcgtctccatcactctagccacatttgggtggcatggactctcatcgtgaagaatcatcaagtccatttgacataggatttgcatccgacgttgacgccaatgacatgttcatggttctgacatcactgcagcatacattactacatcatcacattctcaacatttattctgggagcttaacacagacatggatttctcacaattccagaactgtcatatattccttctgagcatcaaagctgtttatcctacgtcgcacgacaggactctcagatgttgcgttcaatacatcaacgagcttttacagctacgaatcca

(The sequence listing continues in the following parts.)

We claim:

1. A substantially purified nucleic acid molecule comprising a nucleic acid sequence wherein said nucleic acid sequence:
    (a) hybridizes under high stringency conditions to the nucleic acid sequence of SEQ ID NO: 68811, or the complement thereof, or
    (b) exhibits a 90% or greater identity to the nucleic acid sequence of SEQ ID NO: 68811, or the complement thereof.

2. The substantially purified nucleic acid molecule of claim 1, wherein said nucleic acid molecule encodes a maize protein or fragment thereof.

3. A substantially purified nucleic acid molecule comprising a nucleic acid sequence that shares between 100% and 90% sequence identity with the nucleic acid sequence of SEQ ID NO: 68811 or the complement thereof.

4. The substantially purified nucleic acid molecule of claim 3, wherein said nucleic acid sequence shares between 100% and 95% sequence identity with the nucleic acid sequence of SEQ ID NO: 68811 or the complement thereof.

5. The substantially purified nucleic acid molecule of claim 4, wherein said nucleic acid sequence shares between 100% and 98% sequence identity with-the nucleic acid sequence of SEQ ID NO: 68811 or the complement thereof.

6. The substantially purified nucleic acid molecule of claim 5, wherein said nucleic acid sequence shares between 100% and 99% sequence identity with the nucleic acid sequence of SEQ ID NO: 68811 or the complement thereof.

7. The substantially purified nucleic acid molecule of claim 6, wherein said nucleic acid sequence shares 100% sequence identity with the nucleic acid sequence of SEQ ID NO: 68811 or the complement thereof.

8. A transformed plant having a nucleic acid molecule which comprises:
    (a) an exogenous promoter region which functions in a plant cell to cause the production of an mRNA molecule; which is linked to;
    (b) a structural nucleic acid molecule, wherein said structural nucleic acid molecule comprises a nucleic acid sequence, wherein said nucleic acid sequence
        (i) hybridizes under high stringency conditions to the nucleic acid sequence of SEQ ID NO: 68811, or the complement thereof; or
        (ii) exhibits a 90% or greater identity to the nucleic acid sequence of SEQ ID NO: 68811, or the complement thereof, which is linked to
    (c) a 3' non-translated sequence that functions in said plant cell to cause the termination of transcription and the addition of polyadenylated ribonucleotides to said 3' end of said mRNA molecule.

9. The transformed plant according to claim 8, wherein said nucleic acid sequence is the complement of the nucleic acid sequence of SEQ ID NO: 68811.

10. The transformed plant according to claim 8, wherein said plant is selected from the group consisting of soybean, maize, cotton and wheat.

11. A transformed seed comprising a transformed plant cell comprising a nucleic acid molecule which comprises:
    (a) an exogenous promoter region which functions in said plant cell to cause the production of an mRNA molecule; which is linked to;
    (b) a structural nucleic acid molecule, wherein said structural nucleic acid molecule comprises a nucleic acid sequence, wherein said nucleic acid sequence
        (i) hybridizes under high stringency conditions to the nucleic acid sequence of SEQ ID NO: 68811, or the complement thereof; or
        (ii) exhibits a 90% or greater identity to the nucleic acid sequence of SEQ ID NO: 68811, or the complement thereof, which is linked to
    (c) a 3' non-translated sequence that functions in said plant cell to cause the termination of transcription and the addition of polyadenylated ribonucleotides to said 3' end of said mRNA molecule.

12. The transformed seed according to claim 11, wherein said nucleic acid sequence is the complement of the nucleic acid sequence of SEQ ID NO: 68811.

13. The transformed seed according to claim 11, wherein said seed is selected from the group consisting of soybean, maize, cotton and wheat seed.

14. The transformed seed according to claim 11, wherein said exogenous promoter region functions in a seed cell.

15. The transformed seed according to claim 11, wherein said exogenous promoter region functions in a leaf cell.

16. A method of producing a genetically transformed plant, comprising the steps of:
    (a) inserting into the genome of a plant cell a recombinant, double-stranded DNA molecule comprising
        (i) a promoter which functions in plant cells to cause the production of an RNA sequence,
        (ii) a structural nucleic acid molecule, wherein said structural nucleic acid molecule comprises a nucleic acid sequence, wherein said nucleic acid sequence
            (A) hybridizes under high stringency conditions to the nucleic acid sequence of SEQ ID NO: 68811, or the complement thereof; or
            (B) exhibits a 90% or greater identity to the nucleic acid sequence of SEQ ID NO: 68811, or the complement thereof,
        which is linked to
        (iii) a 3' non-translated sequence which functions in plant cells to cause the addition of polyadenylated nucleotides to the 3' end of RNA sequence, (b) obtaining a transformed plant cell with said structural nucleic acid molecule that encodes one or more proteins, wherein said structural nucleic acid molecule is transcribed and results in expression of said protein(s); and (c) regenerating from said transformed plant cell a genetically transformed plant.

17. A method for reducing expression of a protein in a plant cell comprising growing a transformed plant cell containing a nucleic acid molecule wherein the non-transcribed strand of said nucleic acid molecule encodes a protein or fragment thereof, and wherein the transcribed strand of said nucleic acid molecule is complementary to a nucleic acid molecule comprising the nucleic acid sequence of SEQ ID NO: 68811, or the complement thereof, and whereby said transcribed strand reduces or depresses expression of said protein.

18. A method for increasing expression of a protein in a plant cell comprising growing a transformed plant cell containing a nucleic acid molecule that encodes a protein or fragment thereof, wherein said nucleic acid molecule comprises the nucleic acid sequence of SEQ ID NO: 68811, or the complement thereof, and whereby said nucleic acid molecule increases expression of said protein.

19. A method of growing a transgenic plant comprising (a) planting a transformed seed comprising the nucleic acid sequence of SEQ ID NO: 68811, or the complement thereof, and (b) growing a plant from said seed.

* * * * *